United States Patent 6,812,339 (POLYMORPHISMS IN KNOWN GENES ASSOCIATED WITH HUMAN DISEASE, METHODS OF DETECTION AND USES THEREOF) - sequence listing, part 79

SEQ ID NO: 17320 - DNA, 9512 bp, Human
tggtgcctggcgtattccaatagtcttcttcccagtcttcctggttacatttctccctgaacccatcctccccatccctaaaatttcccccaaatgtgaactcagtcataccagtttgctccttatgtttcattggcccttgctgctaagagcatccgcttgcaccttctgctcatccccagacaagctttgtcctgtgaccataatgaactcttcatgccgtttccaactttagcccatgttattcttcttgtctgaatatccacccttttctctgttctcaataataagttcaggcttttcgtcttctgagaagccctttctgacttccacaggctgaaccactggcttctgctcctctacataatacttcaattccagcattgatctcactctatcatgatcatgggtttagctgtctgtccctgccactgctgtgtgttcctcttgagggcaggaacatttgtttttcactttttaaaaaacctctgttgcccagtctggcattaggaagtgcccattaggttgttattgcttgttggcgcttgagctggggcttgaaggtttctataatgtgtagcagtgtatagaaaacaggcaggtcagaaaaggcttctgtgcatcacaccaacatggcacatgtatacatatgtaacaaatctgcatgttgtgcacatgtaccctaaaacttaaagtataataataataaaatttaaaaaaaaaaaagaagaggcttcctggaggagatgacagctgagctaagtcctggaggatgagaaggagtataaaataagataataggagaaaaaaggcagtaggaacagcatgggtaaaggtgatgaggcctgaaagaggcacgtggaaggaaagacaaatgcaggaagggggaatgggagggaatgctggggtacaggccaaagagggaggcatttggtgagtattctgcagagtctcctctgctgtgctgaggtgtggacaatgggaaaccatggacggactggagtaggcaaatgtcatattccctgttgcaactgtctgtttgcatgtcagccttctagaagccccttaaggtatcaactatgtttttgttttgtcatcattcaatcctaagtgcacagaattccgggcatattacaggttccccataaatgtttctttctttattaaaatgtatgaaaactctccagatttaaggaaggtcctcaatgtttcaaattctttttgttagatcattggtcctgtctacagctgtcacaaatttaaggactctggttatatttaatcttcacttttgaattttctgcttgaaaaatttgtattagaaaaaaaagtctatccttttatggacggctctaatctcttgaatcatttgggttggcttttctttggaccttcttcaactctgttttgtctctgttgagttaaggcttttaagaacacctgaattctttccttctgcaaaaccagaggcagcttcttttccgcctattttcagtttatttcttgtgattttagtttttttctcttaaccaaatgctaaatggatttaggagaaataaacttatttgtaaagctgtcaagggaccattagaaggatggtgcttcacagatagaatacagtttttattaatgatgcctagacaaatcctgccattagcccaagggctcagaaagttagcagcctagtagttttggagatgtcaatgaaatgaattggactggatggttaaggatgcccagaagattgaataaaattgggatttaggaggacccttgtactccaggaaattctccaagtctccacttagttatccagatcctcaaagtgaacatgaagcttcagtttcaaattgaatacattttccatccatggattggcttgttttgttcagttgagtgcttgaggttgtcttttcgacgtaacagctaaacccacggcttcctttctcgtaaaaccaaaacaaaaaggctttctattcaagtgccttctgtgtgtgcacatgtgtaatacatatctgggatcaaagctatctatataaagtccttgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctgccaggacctggccctgcactctcctgttttttcttctcttcatccctgtcttctgcaaaggtgagtgagacttttggagcatgaagatggaggaggtgtttctcctacctgggtttcatttgtttcagcagtcaagggcagtgatttatagcaaagccagaagttaaaggtaaaactccaatctggcttggctggctctgtattccagggccagcagggagcagttgggcggcagcaaataaggcaaagagatagctcagaacagagcgccaggtatttagtaggggcttcatgaatgcatgtgagttggtttagtagagagacacaggcaatttcagacccttctatgagactggaagtgatttaagagggaaaggatagccatagtcctgaatacatttgagctgggtttcaggatgagctcacaagttcctttaaaaaaaattgacttaagcaaatcctgggaagagtttttttgctatacaattcaaggttttaaggtcctcggattcatatactttataaatgaattagccagcttgtttaaaatgtagggaaattgtgggaagaatgccttctttacttaattcaaggttttaaggttctcttaatcaattctactagctaattagccaattatttaaaaataaaagtttgaaattgccaaaaaaaaaagacaaggaaaaggaaagaaagaaagccaccagtctgtttggcatacaatacttaattgttgcctgacctacgtgtgggtttcagatgcagatcctcagttttcagctcttcagagactgacaccaggtttgttacacggcttaaaatgatgagtatatccattgaatctcaaccttatctctctctagaccttcttggctaagaaaccatgtagtttgtatgaagtaggtactcaaaagatatttgatgatttaatttttactggagaagaaatattcatatatgttttcttatttttacatgttttaaatatgtaaagattaaataaacactcttagaagtatttaaatttcctaaagtaaatttatctcaaccagtaacaggaccctcccaatactggaaagttgagtgtgaccgcatttagtggtgataagtgtgagcttgcttggggagagggcaggacatttaggatttcttaagcttagagtcaatacaataaagattattgagtgctcacttgggtgggctataatcactgctcacaggagttcatgaaccacaagtaaaagagtgaggagatatgattagctcacaaataactttaatacagagcagaaagtaatgaactactgcaatggagttatcacagtgctaaggatgctcagagggcatctctgataggcagaggtgagggttagggaaggaagctgtagtctagctagctagagctgctggaatagacatgacaatggctgctgccaaactgttttctcttctgaggacagatgtcccgtgcaagtggcttggtggaagggactagtgtctctaatatagggtgatttataagcaggaaagtgtgtcctagaaattcagaccagagtgatagattggaattggatcatgggggactcattgaatgttatttattgtatttgtttttgcgatcagtgttagtaaagtgtcaaagggattgagcagatgagtgacatcatgcaacacaagttttgagtttcacttgtcagactgactggagaggggcctggttagttacaggaaggtaatttggcatgcagccactatttttgagttgatgcaagcctctctgtatggagagctggtctcctttatcctgtgggaaaagagaacaaaggagcatgggagtgttcaagggaaggagaaataaagggcagagaggcagcggtggtgtcaggggaagcccacaggagttaacagcagggttgcctcaacctagagaggaagcgacctggtgccctcggctctgtggcttccttcatctaacaacatcttccactctacaacaatgccagggaaggcggaggctggtacagtgcatcaagacacagctactcctgggtgacagaggttcagggccagctcactaagtaggcagaagtttttgacatatactttgagagataaagcaagattctgtacctcaaccttcagaatttcccctaccactcattatagttccggagctatatagctcctatcattctatcataaccttagaataccagagaacatatcatctcatctaattatctcttactatatgtgaaaaaaatgaaggacatgggggaagtgtgacttgccccaaatcacatatttcatggtagagccaggtcttctgtttgtcatatcagtgttcttcctgccacaaccatcttgaagaatctatttctcagtaagaaaatatctttatggagagtagctggaaaacagttgagagatggaggggaggctgggggtgtggagaggggaaggggtaagtgatagattcgttgaaggggggagaaaaggccgtggggatgaagctagaaggcagaagggcttgcctgggcttggccatgaaggagcatgagttcactgagttccctttggcttttccatgctagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattggtgagcaaagccatttcactgagttgacacctgttgcattgcagtcttctatgcacaaaaacagttttgttccttaatttcaggaggtttacttttaggactgtggacattctctttaagagttctgtaccacatggtagccttgcttattgtgggtggcaaccttaatagcattctgactgtaaaataaaatgatttggggaagttggggctctcgctctggagtgctaaccatcatgacgtttgatctgtacttttgatatgatatgatgctcctggggaagtagtcccaaatagccaaacctattggtgggctacccatgcaatttaggggtggacctcaaggcctggaagctctaatgtccttttttcaccaatgttggggagtagagccctagagtttaaaactgtctcagggaggctctgctttgttttctgttgcagatccagaaccgtgcccagattctgacttcctcctctggatccttgcagcagttagttcggggttgtttttttatagctttctcctcacagctgtttctttgagcaaaatggtgagtgtggtgctgatggtgcaccatgtctgatggggatacctttagtggtatcaactggccaaaagatgatgttgagtttagtgttcttgagatgagatgaggcaataaatgaagaggaaggacagtggtaaagaacgcactagaaccgtaggcattggcatttgaggtttcagaatgactaatattttagatgaatttgtttgacattgaatgttcatgtgcttctgagcagggtttcaatttgagtaaccgttgcaataacatggggcagctgttttgctctttgtcttcatgacaactgtacttaagctaacagccctgaaacatgagattaggctgggcagaatgctgctagagaggaccacttggatggtctttattctccttctccatgtccctctccatcacctggaagtcacctctgggtgccactctggtgccttccttgtcgaagctgtagctgctcacatgacacctatccctattatccagtttgcttgactgggacgttttgccttccccttcagccaggaagtgaaagtcccagtttttatttatcacaggtgttggtattggtggtagaagaggtagaattatggaatcaggcctcctgtcaggatttctttttgacagtccctctcagacacctctgcctaaggccagctttgccattgcaaactctcccttctccctctctcccttcttctcttcctcttccttcttctcgctctttctctctctctctttctccctctctgtctcttatacacatacacaaagatatactctattccaacatcctctacccaacctgacagagatgtcctttgctgtaggttcagcagtggggatgagaaatacagctctcaaacaggataactaaagcttattatcttatcaagcttgttcccttgcagacaagattgatcaattatcataggctttctgggtgttctttctgaagctttctcaaagtctctttctcctatcttccattcaaggcaaatgattgccatttaacatcaaaatcacagttatttatctaaaataaattttaatagctgaatcaagaaaatctcctgaggtttataattctgtatgctgtgaacattcatttttaaccagctagggacccaatatgtgttgagttctattatggttagaagtggcttccgtattcctcagtagtaattactgtttctttttgtgtttgacagctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgttttccggagttgtctttatcatccttgcatttgaatattgtgtttaaatttttgattgattcattcagtatctggtggagtctccaatattagaaatactggaaacaaactgaaaaaccacaaaaggacaaataatgcttcatgagtcagctttgcaccagccattacctgcaagtcattcttggaaggtatccatcctctttccttttgatttcttcaccactatttgggatataacgtgggttaacacagacatagcagtcctttataaatcaattggcatgctgtttaacacaggttcttcacctcccctttcttaccgcctgctttctcagctcaactatcacaggcattacagttgtcatggcaaccccaatgttggcaaccacgtcccttgcagccattttgatctgccttcctgaaatatagagcttttccctgtggcttccaaatgaactattttgcaaatgtggggaaaacacacacctgtggtcctatgttgctatcagctggcacacctaggcctggcacactaagccctctgtgattcttgcttaaccaatgtatagtctcagcacatttggtttccacttaaggtttcctatttttgacctccacatcctgttattgtcttttgcagtgattctcagtgtggtcagggaccacctgtaactgaatccactgggtcacttactaaaaacaccaattcacacttattcccagatgcgttgaatcagaatctttgagtggtggggccaggagtttgtatttccaaaaatcttcccagtgcttcttatacccatcaagttttgagaatcactgcttaggcaactctgtctgtgtctcttcctctgtctctcccccttgctcattctcttgcttgctcttgctctctttctctctttcttgccccagcaagtgctaacaaacacacaagacagcacatagtaagcatttcaaaaggggttgttaaataaaaacgaataggtctttcaaagtaaggtaatgattattacctagaatgagctccttttctgtggaagactgtgcttcttgctctctaggcctttggatggtagccatgaagaaaaacaccaatcaggagcctcagtggatagtatatcatttccactcctctaaacatctttagagagattactctttttcatagttgatgggcagatctgagtgacagagagtgccttacacaagtgatgccctccaggtacctttcagacacccttagataatggactactttatataagcttaatatttcctctgctattgcctaaaattctaccatttgttgttcactgagataagacttgccctcttcattcagtctcaatcttataaaaataaaataccctttagctcaaaaaagcttcccctatgg

SEQ ID NO: 17321 - DNA, 109251 bp, Human
  misc_feature (1)...(109251): n = A,T,C or G
atggcatatgaaaaaatattcatttctttgttttgcctcttgaacagatgccagtgatattcaaaatcacattcatctttgtattactttacattttagctacacttgtacaggtagatcccccatttaccttttcaaaagctgcctggtacttcatgttggccaggttttgcatcatctggctccggctgccttgtatacttcaggctccagccagatttaaccctgagtgagttttgcatccaaatgccttattctttcctttggacatttctagtctgtttttacctagctgaagggcacccctcacttctctgtctgccagtatctttcccgtatttcaaggtcagagcagaaatttcctccccttctttgatgctcacctgccatcctaacatgggatccagcattcagcattcattgctctttctccagtgctcccactgaacacttcctatacctattcagccatcaccatccctgccttgtgaaatgttggtctccatgtcttatctcctcccctggattttaagcccattgatgatagtgacatttgctttttcatcattttatccttgagagtatcagatgcagagctttgcatagtcattacttgatattagttggattatatgcatatatgacttaatatttcccacagtgtcctggacagcgaaataaatgccacttgaacaaatgcacaaagacacacacacacagtttcatcagtctaaatatccatatttgtggcctgattacctttagcatagaaaatgccttgttgaaggggaacattggactcaagtgtacaccaatgaggacaaatgagaaagcttctactctcagtctgaaatgtcacctttctcatctgcatgtaaaattgggaggcttttgtccagtcatatgttagaaaagtaccaatctgttataaatcaggatgttccagtggccactgaagatacaactgaactcttaaggatagatactgctacaatgttagtgagttctactgggacttgtataactaatgataaaataaaaaacaattggaaatttttcctttggtcactcctgtgaaaggaggctattcctgtttgattgatttatttattaaacaagtatcatcttcttgtgccaggcaatctgtgaaagactgaagatataaaggtaaatcatctgtggccttgcccctcagggatttataatcaggaaaaaagcctgagaaagcaaaaggatgtgttcaaagtctcaggtgaagtcaagccccgaggatctgacaagctctgagacacatcagtgagtttgcccgttagaccctgccatctgtccccgtgtgaaatatttgctgtaactcctttccatgaactgcttttggtttgaatgaccttggagacagcctgaaatcctgagcttggaagggtgctcttagcgttactggtctgcacttatagccttcaaatagaatttccacaaacctctaattatctcctcttaccatgctccctaaatgacagacgaccagctctttagtcactccaagaacggatttctattcagcccatgcccgggatgcattaggatgcccagaacatgtgtggctgctctgagtggcacagagcaattaacagaagccaagcaatttgcaaaatgcctcaacttcctgctcatctcgaaggcagaaaattgtcaaaccttaacctcaggaggctcatctgcagaattacacctcccccacctcaaagaagaaactctggtgtcagattcaccccctcctgctttttgcaaacataagcactcggctgcaacaacagctatgactcagttcctagctaacgctgcttgaattgatttagtctgagttcagatttagcacataatcatgttcaatttgctccactgcactgcctagagataaaaggcttggagaaaaaaaaatagcttcagcttgtgtcagtctttgtggtgatgtcattgccatgagcgagccgggccgttcgttactctgctgtgctgcctcagacgcggagggctgcgtgcagtgggagcgggctccaggagcccgagcctccagccgtccccagagcaaggcagcaccgaggcctggccacagcaatatccatctggaagctcttcccttcactcccaactctgaggttgcctaactctttattaaaaattcagaagggggaatgccagcccctagcatggactgtgatgtttccactctggttgcctgtgtggtggatgtcgaggtctttaccaatcaggaggttaaggtatgcacctgcaatcttatttttcattgttgctgttactgacgctgcttggcagagcctttttagcatgaagaaataagactttggttaatagttttcagctcatagtctgcgctagaaatgcatgtagtgagtgcatggctgcattaagtagaataagttggaagagggaccagcatattatttttaaatatgacaaggtctgccattgtttcttcttgtcttttttattaggtaatccctggtcagtcctttctgagtagacacattttcatattctcatattgtatctttgtcaataaggagaattttccagccctcaatgtcaagagggattttgaatcaatgattacatgaagaaagcacacataataaacccagcatccaggccagcctgacagtggggcaataaccctttctggcatgtcacttaaatatcctgtgatgtggtcttcaaattaaacaatagctgttctacagatggcagtttcagtccccagctttctggaaatcaaagttggagaacagctgcctaaattttctttgtcaggcaaagaaagcaagtcattttccttgagcagttgttcataaagtttaggcataaatatttcgcatcttaaggcttagtattatacatgctggtcctcactgattgccggcagcagttgttgacttgtcataggtaatcgtcctctgatgatattcattcccttttattttccatttggctttatattatggagaagatgccaggcttgcaaaatggaaatgtttattttttctctcatatttaatagaagaactagctgaagcttcttatttaaacagttcactcacacatatacacgcacagaaggtcagttgttcattgtgtggtgggaggaataaaaggtgaattacattgcataatcatttaccatccttgctttagtcttaacttaaggaaaaaccctgaattctttattgttgggtgtgcaggtgacaccctggtgctttacaggtggggatttatgtgttcttggcatagcacatggctatgtcattcaagattgcagctttaacaatcttttgaaatagatttgataatctggcattttgttcctgaatattttaaacatgtagccctgtatttactaatttttgtgtcagtgccatggaaatgtctaccacctgtcatatgaaggttcagaaaataaggacataaaggtttggcactgtctgtgattgcattgagaatggaaacatgcatgcagagacccacagtcctgccagtcgtacttccatagcacttgagaagggagagcagtcatttaaagccagcgtcaagtccagtgtgggtaaccaggtagagagacatcttccagtaaccactggaacataattccatctatggagaataaaacttcacagctcccttctgtcctcaacagttatctgttgtttacacacttgccctgagaatgtcataaaatattctaaactttattcgtttcagaaaagataatgagaaaatatttattggagatctgcaacatgccaggcattgtgcttatataggaaaaagtttaaaatatgcttatatggcatatgtatctatgatatagctataaaaataaccaactgccgaaggtttctttaaagacaaagaatattttgtggaattaagaggatacaaagttgttacagctggttgtatgtgagtggttggggtggttttatggaaaaatgatacttaaagatgggtagattttatacagaaagagagaaggcacagcattttgcagtctagtgagtcaattcttttgactgcagtaggttctctatgagagattagaggcaaacgggaaaggaggtgagtcagggctagatggtgaacagctgatgctgttcttcataaatttatgaggtttttcgaggaagactgttaccagaaatatgtgctacatgtatttactgccaatagctctgaatcatcatgggcttttttcttttcttttttttttttttagaaaggttacctaatctttctgggccttagtcttctcatataatgtgagaatagtagtaatttctaccttattagcttagagacaagagaattttacatgtagaataattaacacagtgcctgactcctatttaatgctcaataaatgttagctatcaccatcgtcatcattgtcatctttgtaggcactctctgaaagtgataggtaacttttaccagtttatcagaatgtcctaaatccagctgagtttacaatgacagtctagcacacagaaaatgttttccctcccaccccactcccaatacacacaaacactctagccacttagaaaacatggctttccatttttgatatttaatcatctaatgtaaagcagtaacattattaaaaagcaaagatctacgttgtgcttattaaaaagggggaaaatgaacaaattaaggtgggccaaatgttatgtgttaagaaaacctgcgctccttgttcaaaactgaccattactcttatcacgaagaaaggttcaaacgtaaaattctaggcaccaaacaaagcttccccaaaggtatctgtcttcttcattcattactaataactggtggagccaagagttccttcttcaaaatctttaaggtttattgtcagagaaaagggaggcacatggaaagggtctgtctcacctgcttacatccatcttgcttaatctcagtcttgtttgtttaataggcatccccactttctacatgtagcccccatgggcaagcagccatactagggggatgcaaccagcaggcctccttcataagtatgggagtttatttgaaatgggtagaagcatccacaaatctagtttcccatagtgacacagaaagcctcatcctccagtgtggctctcagctgattgtattaggggcccttctgactccagtttcctaaatttcatcaaagctgctcaagcaataatactaaaaagaggaggaaatcagacaaatggaattctgccatatttggctttctctggaaattccattggtggtgttgtgaacttagccgtctgttctgcaatgtgagagttctcagaaagatctagaagttgagagccctcaatagaaaatgctataggggaactgcagaatttctgtgtgtgtgaatgtgcagggttgatgttctccagtattctcatatttctgaaaatagtctacccactccacaaagagccaaacccttgggaaaatgaaagagatccaagagattggtaacgaaatttacatttcactttagtccagtggttcttaaacctgattgcacatcggtgtcccctggagatcttttaaaaatattaatgtgcccaggccccacccccagaacttttacctggctggtctgaatggagcccaggcataggtaatcatataaagccagtgtcttgtctctttcaggcacaagtaggtacaggtgaggtcagccaagaattgtctagagtaagctctgcttaagcacttggatccttatctccccagctaagacttgatgtatgcagttttaaaaacggtatctctgagctgtcagaaatgttgacgctcacccaacacttcagttctccacacctgcagttccttcacctgattctgagccaacagcaaatgctcttctttactgctggccactgtggggggccttctcagagctgcagagtgccaccactctgccagggggcatccaaacctggggctgccccttctctgcaatggtggcttcctgcacagaagaaagggtgggttccttctctctagattggagggcttctgattcatgtaccaggtttccagccttgtctccatgggcatccatgtaggacacaaggaattcacaaagctcccttccgctcattagagcaggcaggaaacatgacaaatcttataagaaatacagaagcttcaaagacccttggcacttgagagatttgttcattcattcaaaaacatgtgtggagcatttattacctaccaggcaatgctctaggcctaggagttcgataaacgtccctgccctcacggagcatatattctaacatgagatgcagacaatgaaatagtaaacaagtaaatatacatggtaatttcagctagtgatgagggctatgaacaaaaatgaagcagagtgagagatagagcattgatgggggaggaatggccacttttgaaaagattgccattggaaacatctctggggaagtgacagtttattaaatgtcattgtttcaatgtcattcagagatctaaagaaatttagagagccatgtacagagctgagagaaaatcattccacatagagtgaatagtaggtagaaagagaggccatcttagccatcttatctgatgtgctcctacctagtccccccaccagcactatttaacctgtttcaatcattcattcatttaggtacccattgagacggtcactgtctcaagctataatttatttttttaaggagactctttttcagaaaactgtacttaacctaattccctcatgctacgttttaagcccaatagctctcttagggtaagggtaaatacaagtagaagtgtgttttcagcacagtaattcttcatatgcttggaatcttaggattgctacaggacagctcttttctcttctgaaaggccaaggcctttttaaggtcactcataaatcctactttctctcctctgcttttgagaatttctcaacatcctcccaatccatgtgacctgggacaatctcttagcctttctggatgcaaaataatcatgctgagaaaaatcccctactgctctgtgcattttatttttctttttacacgatagtatacctgactgagtcagagtctatttgttttatgctgttgtgtgagttatgaaaaagaccagcacatcatggccactgagtacaatgaaatctctctgtcatacaaaccactggacatttcaaatcacttgttttgtatggtgagagtgataggaggagaaggatgaggctgagttggtatgatgcactttgtactctgctttgaggagaaacaagtgacacaatttagtatgtgtcacttgttcaggaattgttttggaagagaaacttaggtgggtgttggtcaagaaagctggttgaacttcatgcccatttcttaagttttttgcgagcactagggtaaggatctgggcacaaccaatcatgacctatggctctgcagagctctaaagctctttaagaattttcaaaaaccattgtgttcactcagtaacttagaagtgtttgagttgtatatgatttaatcctcagaaatggtaaaccctctagaggtattcatggtaattaacgttcagtaaccaaaacgtgaagtcaactgaaatgctcattccctattcaatgaccataatagtaatattaaaaataatattttgtcatacatctctagaccatctttggtttatgaagaacaaaaggcagtgtgtgtgtgaggtggcaagagagatggcatgtgtataacagattctaaccctccagcaaaacaaatgttgctatttctccggtaataacatggactagaattgaggccattttggaaataaatgaattaatgcaaaactgaaagttaaaattaatgatctctaaaacaattctttaagaacttaacattcttaaatgtacaatactaaacattttcttgcctctgaagaaagtagcaaacatctttcagagagagggaagaaatgattttatgaaagtgatactccctgagaaggttcagaggcagatttctcagccacctatcacatttggtaaagacaaggtagaccgttcaactaataacattgttaagtggggaaatcaactaaaaacttgtttatctgtttaaagaatcttttaactgttgagaagtaacagacattggcagttgctacctctaacctaaatgtcagatatattaaaacaaaacagcaattttaatgaaaaattgttttcctaaagaaacagattttaatgtaaaattcagagagtgccatttgcagtcttagtgattctgtttgagtccaactatcagtaatttatatgggtttgttttagtactttctgataaagcttagaattgacacataagaaagaaaatgatacctgaaacacttattatcactttatgtgtttaggtggtaagcttaatgggcttaataggcattgcaactttgcagtgactagcccagctttgcaaggagatcataaactatccaactcatacctggcctagaatttctttatgtaaagggacaaatgtatttatgtaaaggttctgtatcctttcccaatgctaaagctaaactatttcaaaaatagaattttaaaaacacatggagaggtaatttcaactggaaattttgagcaggtacaaagttatatatacccattccactctagctagaatggagagttaattgtcaaagtttttgagaataaaatgtctaccaagttagaccttccctagaaaaggttcgatatatgtaatttcatgttcaccttttgggtaagtatacctgggtaaaacatatgtgtgtacatatatgtatatacggatattatacacatgtgcaaatgtatgtataacatgcatatttactatatatttctctttttttttaaccttctgttaccatagaaggttttttctggatcctctacctattctacaatggcacatctaactagttaatggtaattgcgtgcttttaactacatcaagggattaagggcccaaagaagattcttggcaagtgagttgaatagaaacttgaacaattgctaaaggaaactcccctgggagtgaaggggactaagaaattcattatcttctctttttattgttatataccatagcagtgtccacatccttacagtctagtactacaacagttattctttccagaatctaatatatcagctctgaactatacttttttttaatgtttcaaaaaggtcttgatcctttagcttccagaaagatgactttaacctatctatgcttctgttagattggactatgtactaactttcatttcctaaaacaacatcttcaataatgttttatttgctccaacaataggatactttgctatttaattgtaagattttcttcccctacctctggtagttctatagaaatatgtgagcagtgttcatgctgtaccccaaacatttaacctcaggggactgtttactaagttgagcattaaaccatcccacatgtcaccacatggtgacaaatgtaagctccagagatattcatctccatggatcaatattatatgttatcaaggtgggcaattttaaaacttccaactactgtttccaatcacaaaattcttctaactacaaggcatataacaggtacttcatataatccccattatagcccaaggcatctatgtagttgccccattataaacagattcctgatattcagagaagttacctttttacacaagattacacagctattaattggcagaagtgggacttgaactgttctttccactatcgaaatctctctaaggattaattaataaagcattaatcaattattggggtataggccgggcgcggtgccttacgcctgtaatcccaacactttgggaggccgaggcgggcagatcagaaggtcaggagatcgagaccatcctggctaacacggtgaaaccccgtctctactaaaaaatacaaaaaaaaattagccgggcatggtgacaggcgcctgtactcccacctacttgggaggatgaggcaggagaatggccttaaccggggaggtggagcttgcagtgagccgagatcatgccactgcactccagcctgggcgacagagagagactccatctcaaaaaataaaaataaataaatgaataaataaaagaaaagttattggggtataaagctgggaagataagacattgaactcatatgtaatatttcatctgatgcttaaaacactgtttttgtctatttcttatcagaagtggtgttatactacttgtacataaatcagtagttgagatcatgttagcttttcttaataaatctaatgtggcaattgaaggcatagcatctattttggattttgttttagaatctgtttcaaaatctaattatgccatctagtttgggaaaaagaaaagttttctggaaaatgcaagggtttccctggtttgacatgcgcctggtttgacagctcctccacctccttgcttatgtcaccaagcattttccattgactcagtgagggataatctgtgaagaattgtagggcagaggcagtgaaagcaatattaataatattttacatctgaacagtgctttccaaattatacaaaactcagctttttcacaggaaacctccaaggtaaacaaagccacacaactcataatgggaaaacttggactgggattctttcacaacacaacacaagatctcttggtgtattattatagcctgcattatcagtgcatctaatagaattgatttcatcttctatgactttactgtgcctttgggtattgactaagaaaatctcagcctacctttcctagaacaggacacataacccatgagcaaacttaataatagcaacaatgtattgagcactgactatttgtcaggcactatagaaagcacttttattcattcattcagcaaatatacattgaatgccttctatggtcacggcctcagattaggctctgcagatatagggatgtataatcccattggatacaaaagcctatgtagtgctggcctttattctcctcagttcctttttccccaaaaaggatgatgctgttatgacctctaaagaggcttcctttgctgacgtagggcatgtgagaaggaagtctagtctccagagtgagacatcctggagagaactctctacttgacctctaggccacttgatagtgtgaccttgagcaaggatccttactgctctgtgcctcggtttcctcaactacaaactgatgaaaataatactgcttacctcataggttggtggtgatggctaaatgcattagagtatgtaaaacacttaacataatgactggcagacagaacacatgcaagtaatgtcattcattaccatcatcatcatcctcagtagtagtggactttgtacatggagttctaagttttcttgccagggaagtctaccttacttgcctctcattatatcaaactcttcccctgcagttttcaactcatctttgcacaggggcagcagtgccctcacctcagggacactcagaggtgacagaaccctacatcagaagggactggctcagtttgggagtgaggaattacaggccctcccagggagcagagatgctgcagttcttctcaggctgtgtctcttccaaacctcttttcttgtctcttccaaacctcttttcttgtctcttccaaactcttccaaacctctctagataagtgttccctgtagaacaggagacagcaggaaatgaggggcctggataaacaggaagtatcttcactgtagccacaaggggatgttgtggaatgaagcctccaggaagttgctgttgttgactcagttaatggaaagggaagcagcctgaatgaaaaagcaagtgtagaaccccctccctgaccccaccagaatttagagactccgtggctcctatcacactcagaagaaagcccaatccttgctgtggccctcaaggcccatcagaccttgccccaacagccctgctgacctcatctcctctgcacctctccccctttcactctgctctaacccccacttcctgcctgtaccaagcatcccttggaacttgcctttgctgtgccctctacctggaatcttcttccttctggagcctacatggcttgctcctcactcatcatagagctgttcctgactaccacacctacacagaccacaggccccgctccacccctcatcctgccttgtctttcaacacaatcacaagatgttgtattgtgtgttcatgtattggctcattgtctatctccactcaccagaatgcaagcttcatgagggcaggggcttttctgtgtgtctactgctgcatccctagagatgcatatggtaacatggagaaaatgtgtgtttacaaatgaatgatagactcccatttgcaaaccctaaaacatgctgctagaccaccttctttgaaaaagatggcctagatttctagattcaaggccagttttaataagcattcagacagagtaatgtgcatagcagaatacagatgttttgagacaagatctggctctatcgcccaggctggaatgcagtggtgtgatcttggctcactgcagcctccacttcctgggctcaagtgatgcttccatctcagcctcccgggtagctgagactagaagtacacaccaccatgcccagctaacttttgtattttttgtagcgacagggtttttccatgttgcccaggctggtcttgaactcctgagctcaagcgatctgcctgcctaggcctcccaaagtgctaggattacagacagcgaccacacccacacagaatacagaagttttaaggcaagatgcccatgaaggaaaagagaggttgaactcagaacccatttctttaaaatatatctaaacacctttctttgggcaggaattttacatggagttatggacttgtttcaccgcagtaatgcttaactataattgtaatatttacaacattgaccttcaatttccatttctagtttaaaacagtggagataggtagaaattagattaattgcccaactgagttcagtttttttttttgttttttgtttttttgcttaggaggcatcttatcctaaaaaatctctgtattcggccatatacacctacacacctactctggctgcttataaacttatatcataaaactagtaaacatcttttttgtggttttttttcttttcttttttttttttttttttttgacagagtctcactctgttgcccaggctttagtgcagtgttgcaatctcggctcactgcaacctctgcctcctgggttcaagcaattctcatgcctcagcctcccaaatagctgggattacaggcatgtgccaccaggcctggctaatttttgtgtttttagtagagatgggactttgccatgttggccaagctggcctcgaacccctggcctcaagtgatctgcctacctcagcctcccaaactgttgggattacaggcatcagtcaccacacccagccactgggtatggtgtacccataatagtaaacaattccgatactaaaaaacaaaaagaaaaactaagctaaaagccccccactatttgttgcttgaataaataagagtagatttgaattattaatgagcaagatagtgcatggtgtattttatattctcactgtataatgaagtactccatttgtagtgcttagcaaaatagtattctatatttaaataattcttacatattactaacaacagttagcatttatgtagcctcagaagactggaactcactttgaatgaatgttgcctcataacacctctttgatgtagtcaggaagtatatgattctctcaatgagaaattctggttagaagagttccccaaattatataacaaatcaatagaggagagatacaagtttgcacatttttacttcacgttatgattgtatagttcttgaagttggaaccaagaagccatttgttataaaggtataatggaaagcaacttgttctttggaggcagaaagacctgagttcaggatatttcttatttaagattttccttatatgtaaaaagaagatacaaatttaggttgaaggctatgggatataggtgatcaataaataggagccattattcctgatgccctggtatagcattagtgagacagtcccacttgagaaatgtgatggagcactcagtgtgtagtaggtactgcctccagacatgggaattcaggaatgtgaggcatgcctcctgccctcagtgagtctctaggctggtgaaggagtacaggtagtaaataagtacatagagagtagaacatagagcgtgccatggtttgagtaagcccagtacactatggaagcctgtaagagagtagtctgggatgaggagggaaggctaccccaaggaggtaacccatgagttacagctttataggttaagtaggaatttgccaggtgaaggaaagatgggaaaggaagaggcctacactaaagcagaaatgccagagagaatggtgaactctaagaattagagtcctggatgaacgtagtattacacagaaactggggtcacattatgaaggagtttgggtcttatgtgcaagtctaacaggattgggtcatgggaagcatgttcagcagaggagtggctcattgcctagtctgactggaagtccactctggctggagtgtgaactgtgactgcactaaggccaacatgccaagtagggagcagagccacttgcaaatacctctctattaacagatgaggaggcggctgcagtattgcagccagacccgatgagggcttgtgaaactgcagagtcccagtatccttgaattatgttgattgccttctagttagtcttctgtctttcctttttaaagaagaaagaagtcaaactagaaaagcagccatcttgaggatatgattaagttgccattcaacaagggtaaggtttctggggagacaggcatatttgttggcactacacctaaaatattcatgaggcacatttagttcagcaggaatattgtgattgtcttccagagaagaaggtctaaaatcagaaatccaaaccctggttcctgccctggggaatcacttactctgggcaagggagacagacttacaagcccagacagatatcccttatctaactgttctgccctgattcctcctcaaattcctaaaaactcgtaagtggaaattcagtgatgttaaatgctggacttagaatattctaggcacctcctgagagcaaatacacatgcacatacataataacatctcaatgttattgctaaaatattttcataggggctaaaactcccgaagttgaccatataccacgctaggagaaaggaaaagtctgataccatgtccttgtacttaactgttgccatcatagcaccagccttgccttagcatggcatgtaacccatgagttacagcttcataggttaagtatctacatttagtaggtgctgaataaaggttggatgagggcagcaggatggaagaagaggcggaaggagataagcccctctgcctataggggcagactccagaagttacacatatcacttcctctcagattcaactggacagaaaatgagaatatggactcatctggacacaagaggggctgagaatatcacctttttcctgtgtggtcctatgcccagctaaaagtcaggattctattataaacagaagaggaaggtggatattgggagacacataacaatctctagtgcaggtgacaaatgaatcctttaaataaatgaccagaactcaagttctaggattcacatatgctaaacagcaatccagagggagttaataagtcctgaaaacacagtcttaggagaagtttgtcaagatttcatgaaacaaggaagctttgatctggggtttcaaaggcatggcaggtacaaggcactcttcaatcggattacttctttctaggtcagttggagagattacggcccggtaggctgcttctccagtcccacttccatgccttggcacttgcagttcttccatgctgactgggcatcccatgcacttaccctgttgtatgtgttgctgccattcacttaggtaattctgttcatttgcaggtagatctctattaacagatgacaggaccatttctgatcaaacccagagtatcattcacatcttttacagccattggttggggcgtgagttgcatagaataaaccagtaagtttctgcttatgtagatgtgtccatcctcagcctttcccaacccttttagatgcaacagaacccatgatacagccatgggctgtagagagacagaaggagggctgaaccaggaggcagagcactgggtgtagtcttcagaccactcactttgggcatcatggagagggaatgggatttagagccagaccagcgtgggctggaaccctggccctaatagttactaattttgcagtcttgggaagttttcccctctgtaaagtatgtataataatgctactcttcagggtgttgtaactgaaataagaatgtacctaaagcatgtaggtactcaatagatggttgttattgttattattgcctcttctctaaattttgatattgaaaataccttaagttctactgagtctattaatgatatttagctctcttaaagacacagcagttctgctatattgagaatcatctccatccaaaaaatatatggcatttttctgaaattcacttaatttctaagtaaacttcctacatagagcatcatccatttttgtgaaggaataaaagaaaaatccatcaggtctttctaagcttcaaataaaaataactcttagacaaattctctataaggtcactaattttgatgatatcagttgcttcatttggtacaacactgtgccaaaaataaaaaattgtttaaaacagctatttatttgccagtactatggagaaataagccagcaacaatcagtattaattccactaagagatttctttggaagaagtatgaatcaatcttcattcttttttttaaacaaatattagaaaacaaagtttcttcacaagagtgttaagccgggacactgcatgcttctcattcattccaccttctaatttgtgttgtagaatagaaggtctgagcacaaaaattttataattacttcctgatggtattccagcttcagattctttcttgtgcatggaagtaaaataaactcaagagtaccttgaactctttaattctgaatgagcacaacataataccatctgaatgcttcaacttcccttgaaccttctgcttttctgcttgatcctcctacacaattattccaggcaattattgtcattactcaggcatggaatctgaacccatctttactaacttcatatttaagcaaaaccaaatctcttcaggtcttttctacttagtgaaaattcagaaacagtgtttaagaaccgggtatgaattggagcactttgtaacacccaaaggatgggaaacaccttacctcaaaatcttagtctaccagggatgggtagtatataagcaccatgacaaaggtgcaaatttagtaacttgggcttcctcattttcttttaagttgggcaaatgaggaggaccagttctatctaaaaattagcttttttaggctggaagttgcaaaattggccacctgcaagccaaatccataggtgcattttatttggcctgtacagtgttgtttaaaattgaattccttactagtctttaaacataagtaagatttgacattaaaaactatcttccaaattctcttaaaaaattggtagagctggtatcactgggtgtcccttcccacagaccaccattggctcaacatgagctaggtctgtccttttcatagagcaagcactctccaattgagccactccaggtatacacagggagtagtgagaaataatgctgtggaatgaggataggtcattgataggtcattctatggatgaccttgagcaccaacctaagcattgtcaattaattgtatgaaccacaggagaatcatcagagtttcaagagccatgatttaggaagatcatggtgcctctggagtccagcctagctagaagaaaggagaaaatgggggtaagggaaatcagtaaggaggctattacaacttattaaacaaccatgtctcctttttttaacccctctctcttaatactatgtgaaaattccttagagtgaactggaaataattctggactaaaaattagacaactaggctcaaattacaggatggcccttattagcaaaatgcatgggcaagacttaagcattccaggcctctctttgcttatctatgaaatggcaatgagggtattactgacctctcaggattatggtgatgataaagtgagaaaacattttagataatctttgtggactatatcatcattacctcctggcttcatttctgcaaacttctcctgaacagcaggcttaccccatctcttttctattgattagttttgactttactcaagttatttccaagcctggagctctccaggtcttcctgttatattgacctccttaattaaggctttaagtcaagattgaaaggttgaaaaggactgtagagacaagtaagtgtcccctattttatgtaaccatctcctctccagtatttaagcctctccttgaactcccccagtgatggagccctcaatccttattgaaaccattttcatgattaatcaattttttttttctgaaacctcgtaacttcaaactactttcctattactactgtgctccataagccaacagagcaagtctgctctttgccagaaaagtacttttgttctttgaagaaagctgtttggcctgaccacatttccaggtcttcttctcctgactaaatatgggtcttctccagataattctttatatgacatagttgcaagtgccctcctcacatcccagaggtctccccaacgtacactatattttgtatgatcatccaactgttcttcccctttctcatctcattcattagtcttgtgcttagacattttggtctcattccaccctagactgtgctcaaaagcacctctggccctgcccaaccacatttgcctctcctctcccttaatccaaatgtttcctcacatgttgtgttgcaaaaccaatttgtctaagagaagagttcatgctccttagggtcattggtgaaagatctcaataattaaatgtcaaaagttcatatttgactataataataatgtctaacatacattgagtgtttactacttgccagcctctgcacttaagtgactttctatatcatcccttggaatcttcacattcccatatataataagaactgttaggatcatccttgtttcacagttgggaaaagtgaggctttgtgacatgaaggagctcccaagtcacagagccaagaagtggcagagctgagatccaaactgggttgtcaggctgggagcctgcactcctcatcacagcacaaggccttctcacagcatctttgccctgatgcctgttgctgagggtcttttcatttgtttatttgctggataattactttaggtctttcacaggatttaatagaaagtataattactgttataattactgtaacacataaaggcttctttccttcttccaacttgcttgaacaaagcctctgaaaccacaggcgggccaccaccatcttcaggaagattttcaatagaggattttaggagatgacctaaaaagaggtggtaattcaaacccaaggtgttgcagttcattcattccttcagtgttcttcattctccttccttactctattttcatcaatagcgcttgttttctaatatataattcatgtatcaattttgtttattatgtctcctctcactagaatgcaagctccatgaagccagaagtaaatgttgtctgttttgtttattgctgaatccccagattagcatggaacaggagcacaacatatatttgctgaataaataaatgaataaatgacaacaataaagcaatttcatcaccttttggatgtaggcatttaaactttgaggttcatttttttcagccaccaccatgaccccctgcctctcttaacttcccctcacatacactcttcagctacatacactcactcagccttgaagcctgaactcaccagggctttgatttctgccagaggcttagctgatctttgaggcacatacacccctcatctgtgtttccttaatgacgtgtttgtcttgaacattgcgcttactgtgttgtattatagtagtttgcgtttgcaaacatctccctgactaacctaaagctctttgcaggcagagaccctgtcttcttcatgtttgtttccccagcacccagcacagtgcctggcatagtgctcaatatttaattgatgaatttaaaattctgtttccatagatagggatttggaaccacaggggtagacacaagctagttctgcatgggttttagaaacagaaattgccatttgaggatggaagtgctttattcaataagcgtttactgaatgcccatcatttgccaggctctgttctagatataggctgaaattagcaaacaaagtagtcaaaaatgcttttcttggaatattacagtgggaagagagacatgataaaatgataagttatatagtatgctaggagtaatatatactaaagagaaaaaaagtagggcaggtcaaggggacttatgattagggacaggagttagaattttcagtagggtgccaggataggctcatcaaggaggtggcatttgagcaaagacttaagaaggcttccagaaacgtttagtgagctcctatagtgaatgaagcagtgtgctgatgctgcaattccaaaatagagctcatacatactctagtgagaagactgccatgtcaaccagagtgtgatacatgtgagagcagccaaaatgttaatataacagtttaccagtaggctgtcctagagagagctgactttcaatatgtgatgtaaatgtcaccatcactgccctcctcatctctccttaccattctaagttgccttatatcctttgaaactgtgtagaatgctaggagggtggtaactttggaaagcgtgcatttatgcaaaggagttagatggtatcaccctctgggatcggaggaactttgaggtgttacaggacagccattggtctagaagtgctggtgggtcatctttcttcatcataacacagttatggttgggctggaattcttggaggagaaatgtactgaacaggccaaggaataggggatttcagtggagccgtctgttgacaactctcatcgtttggctctttggacatggagacaagccagtcttggagccatacagcccccttagatgccacactgccattggcaccctgcctactcctcaccatatcccctgtaatcagaggcattttgtaaaaaaccaccctgctgtgtagcacactgggtgtggccacagcatactttcattactgcctcaggcagtgcctataaaggttctctcttgaccacctcagcaacatgtactgagcaccttggctcaccaggactgacgccaggcatacaaagtggtaatcatgaaaaaaaaaaaaaaaggtcttcagcagagaacaggactaggcagtgattgttcgggccaatgacttgttcacatttccaggacagtcaactgtttagtatatttctcgtatgttaaattggtttaactaagttcagtgctttgactagctcatgaaccaacatgatggtcttggtccccctccagcagctgtctatggagaaatattttcagctccatggctaacagagaatctcaggtcgattgttgaataaatttcccatgtagctgattggttggacttaattcatataattatgccttttctagtaaaggtgtgagtctttctttgaagttataaaagtgtaaaattggctcacacttgaatctgatgagacaaaaatcaatcaagcagaagtcttatttagtggcatcttagcctactgtctagcagagtctgagatgaaatcttgagcacaagtgctttaatggtgactgggagccaagaagcatgaatgggggccaagtgaagggaagcaaagaaggaagtggagccaacgtgatgacagggaatggagcaggcccctgttatgatgactatctgctggattctgtggaaagcctgagaagctacgtgaagtgtagtatagaacctcctgtccagggtaagaaaatgggaagcatttatccattagctcccagccaccatgcatcaaagtttctctccacagattgttaactccatgcattgactaccaagtggtttcttggggtgcctgcctttgtgtccgcggagaagtctagcatggaaggagccaggcactgatgtgaagtgaggtcctcaggttgcaaactgcatgaagataatcagaattgcatgaagtaacagaattggctatggcagcaggggctagactgagttaggtgggactaggagactatgaagtgatgcactagaagcatctaatacaagcactggataattctatttatttgagtctaccttgttccaatacaggcataagatcgttcacacacctgtcatttgcacagtgttctactgggcaccccccgttctagtaaattgtgcaattgcttagtgaggtgttaaatactgtctttaacgaaagagcatgggcttgatatatatcagacttgtttgatggttgttaactgttattttgtctcaagaaaaaattcccctgcctaccccaattgtaagtccttgattactgcctcccttcccctcctctccacctcctaaaaaccaccagggcattctgtaagtttctccctgcctcagtaccactgtgcttcttttattccgacccctccacatctttcctctcttatatctgaagaaagcttaattgtcagcattttacacactgtcaaataaacagacaacttctaaatggcttctgagcttcctgagtttaaagatacaagatttggagtaagcaaagatttcttaaataagacacaaaaattactaaccagaatagaaagatggataaattagactttattaaaaattaagaactcctaatcattaaatggcagcactcagagaataaaaaggaaagctacagtctggaagaagatatttgtaatacatgtatctgacaaaggacctatttccagaatatataaagaaatcatgaaaatcagtaagagaaaaacaaacaacccaattaaaaatgagcaaaatacttgaacagacatttcaaaaagagaagatatccaaatggcaagaactattagtcatcagggaaatgcaaattaaagccataattaaacaccattacacacccaacagggtggctagaagcaaaaagacagtcaatgccaagggttagtaaaaatgtggaacagctagaactctcctgtgttgccagtgggagggcaaattattacaaccactttgggaaattgtttgcaatatcttccaggcctaaatctatatctactgtatgatctggtatttctaattctcaagataaatgagtacatatttccaccagaagacatggacaaggatgtttacagcaggcttgttcataatagccccaaagtggaaaagatccaaatgtccataccaaaaaatagatgaataaatttagtcaccagtcatcaatgggatggatgactctcacaatttcactctcaaaatgtagagtaaaagaaaacagattttaaaagtacatgcttatcattccatttacacaaaatttaggaacaggcaaaactaatctatagtgacagaagtcagaataatggtcaacctgaggattggaggaggtggttattgactggaagagggcagaaacgagccttctaaggtactggaaccgttttaaatccggagctgggcaggggttacaatgatagtggttatactatttaagaagggacaagattgagaacataaaattggtgacccatcccactagcaaagtctccaaggcctcatggtcaagtaggagaagaagtagcaccataatgagattggaaattattacattaggcatagatttaaaagatacctggccttcaaattttaactgttaactaattagccacgtaatcctgggaagtaacagttttggacttggttttccaatctgtaaaatggctgactgctgaggatatctcatgcccctccaaatcataagatcccagtaagtacacaaggctaatatgaagatatacatctcgtgttggttctgcttggctgaataacactaaggaacgcaggacccagagctaaagagggaatagagtgaaaactctcacattctatttagggctctgtgatggcaaatcttgcaatggccagaactacagtgaacccagaaagtgagttactgcagttcctgtaccaccaccaccatatgggtcatgaatttctttctgcccctcactgaatcatttcctgccatgtcagagaaaacctgcctccaacagtatatgcagtggttgactgaggctcttgggagtcagccccacttgggtttgaaaccctgctctaatacttactgtctatgtgaccttagatgggtcacataagcccctgagcctcaattttatcatccataaaataaggaggtcaccaactcctcagaatttttgttgtaagcactaaatgagataaaatctataaaagcccagagcacagtgcctctctcctagccaatattcaatgaagtatactggttattattagtgtagccagtgtctgctgtggccaccatcaatgccccaagtttcagttgataccatgtttggagataaaaattacttcttaatttcataaggtagcaaagcaggaaataaccttagaaatgatctggttaaacaccaagcatttgtttaggtcctaatgagtggcaaacaatagaaactgaaaagctagcttgcaaaaagcgtaatttattgaaagaaagcaggagtatctcatgcaatcacagcaaatctaaacaacaaaattgcagaatggcagaaatcagggtcactctggtgatctgggcagcagagtctgcagatcctctcttggacatcactataaatatgactcaactctaatgtctcctgttactgagatccaacacatcgcttgatgtctaatatagcattcatacttaacatggccaaaacagaactctgaggttccctcctgcccccaaagtcagctcaccctgccattttctccatttcaggaaactgtacaatcacccgcccagttgctcaggccacagatggagcattcttccttgactgttttctttcccatactctccacatcagcaagtcctattgatttcaccttcacactccacttctctccactcagctctgaccttgatcccatcaccttccttcttgacactgcagtcacttcctaacagtccccttgtttctacacttgctgtactataatccagtctccacttagcagccaaagtggtcattggaaagcacaaattgggttatgttactttatgcacaaaaccttccagtggctccctgttgcgcttagaatgaattccaaacacattaccattgccaacaaagtactacaggattccatctatttgtccaaactcccctctatgtgctcactcccttattcgttattcttcgggacacactggtcttctttccctcctggaattatctgcctttaattttctatgtggttggttcctttttattgcctcccaagagaggtctttctcaccacctgacctgaaatagctactcccttactcagtcacttctcatcacttcaccattgttatatgttcaccattgcataaaatctaatatattcctatttgttaattgtctgtatccaccagtagagtgtaagcctacaaggaacaagctttgtcagtcttgttcaacagagactagaacagtgcctttagtacacatttaatagatgtttgttgaatgaatgaatgtgttaaattgcttatgaaatgtcaaatgccagagaggatttgattgtcccagcttggggagtagaatgtctatcccaggatcattcacctctggccaagttcccagggtccttgagcagaggtactgctatctggagggccatacctgtgtatctttgcagtccttacagctgtcttaagagggctcagtccccattttacagatgcagacactgggaaggaccagagtgaataagaggcattctcaattattgaatcctgttgggttttatgttagtagggtatgtttcatctgttcttgtctcttaaattcaatggtgttaactacatgttgataaatattttccttcatctccacctactctattttagcactagtgttggaattttcatttcctcctacaagaaagaaatatggcccagattttcatggtgggacaagatgtttcagttttcccacgctgatttttttgttgtttgttttggggatttttggcacttcggatttaaaaaaaaaatgacaaaagagtcttggtgtccctttagttgccacaatcttagtttagataacctatctcttttgttttgttttgggttttcattttttttaattaaggcttagtctttgctgacgaaatctgaaaataagacctcattttagtttcttcttctagctaaatgaaatctttagaatgtgatcatttaatagcaaagaatgtgcctaatcattgacaagaatttaaatgtgtttttagctagtcaaaaataatatgcagctgtcagtccaacatttctactcacttattattctattttctctgaacttcagctaaggaaataaatgtcataacatatgatttcaaagaataaaataaaaaggtgttagtaagtattggtttggtaacaatagagcatatgaggcaaggtataaaataaaattaattccattttatttcctaatttgatttatcagggatctgtgggttctttaatagagagttaaagagatttagatatagatatggccattgtgtatttttaaattttatataccatttctatcataaaactttaagatagtcactccatccttttatgattactgtttgtatgttacatcttttcccattctttgactttaaacctatatatggctttgtatttaaaatgaattttcttgtagagggcatgtagttgagtgttgcttttttaatcaatttggtaatttttgtctttcaatttacttgtttagatcacttatatttaatgtaattattggtatgattggattaaagtctatattttccatctttttttgttccatctatttttattccctttttccctcttttttcccacttttgtattcattgagcattttgattatttcattttgcttttacttttactttacatttggcttcttttaaattgctttaaaatttttttatcagttgccctggagtttacaatatacatactatatatacttttaataattactttatcttcgtgtatatcataaaaatgtaatataattagattccatatcattggtatgatcaccttataaccaattaagtagtgaagcttctttcagtccctatgtatatatattttaaaaatggtatttgcaattataataacaattactgagcacttactgtgttcaatattgtattccattattataagaacttttatatttattgactcattcaatcctcacaataacccagtgagggtaggttgtattcacttatcttcatcttccagatgagaaaaataagtcacagagaagtcaaataagttgatccaggtttcaaggcaataagtggtaatactacttttattttaggagaaaataacaggataggttttcatctataaaaggggggccagagaggggaagaaagccttcttagtagctcaagttttcatgtgagaaaatgaagaaaagctgtattctcaggacaggatggtagtggtgagccacactcaaacaatcccatgtagatacagagtagataaccattatgactgttatagttgttactgctgctgctgccataaatcagtcatctctgctgaaagtaactctgcactaaattctctgtcatgaactataagtcctaaaaatgtttgcattagagggaccaccagtactggtgctcttgaaatccatatgcattgatgatgtgactctgggaaatcatgtctaggtttctacttctttaagttaggtgcatctttctccacttttatttgagtttcatggggtatacatgcaggtttgttacgtaagtaaattgtgtgtgtcccatcatccaagtagtgagcatagtactggataggtagctttctaaccccctcctattcttcccccacaagcagtccccagtgtctgttgttcccatcattatgtccctgtgtattcagtgtttagctcccacttaaaagagcatggggtattttgttttctattcttatatgagttcccttaagataatggcctctggctgcatccatgttgcagcaaagacatgatttcattcttttttatggctgcatagtattccatggggtatataaagcacattttcttcatccagtccactgttgataggcatcttggttgattacgtgtctttgctattgcaaatagtgctgcaatgaacatatgagtgcatgagtctttttggtagaatgacttattttcctttggtttatacccagtagtgagattgctgggttgaatagtagttctgttttaagttccttgacaaatctccacactgctttccacaggggctgaactaattacattcccactaacagtataagtgttttaagttgggtaattttttaaatagagattctccaactctgattagtttgtacggtatctaccaaagtgagggagaatcttcaggtccataaaaatattaaggtttaccaaaatctgaaaaattattggtttagcataagtactggtaacatcgcattgtaagaatggagccattagcaaagaatacagcataaattgggataagcctaaggcagttctctcaaaatgtgatacctggtttgctcaatattgccctcaccactacccccagcccaacattagttttattttgagcattgacataatattgccctacactgagtgacatctatgacctcacataaaatcagtcatatttacaactacgggtgacttttggctgagttggaaaggcatgtaaaatatttcacagtattgaaggacatgtacttttataagttaattatttttagtattatttttcccttctaagctgctgagaagataattgcattttagaaaccacagtattaatgttaggcactttgtcactaagcaatagaatagactttgtaatgcaatttacataaattaacgactcccttctggtgcatgttggatctccaggacttaaataaagctttcaaactagtttgatatttggtggaatattaagcatgtgaaatttgtttcaaagtgtttcagttccattttcactcactttctctcctctttagaaagaagttctcacctcagactatttgttcttttccttctcgttctctctataaaacgtttgggccttaaagaattatattcaagtgatttgtacagaaaactagactttaatttgaactaactttagcaggaagcattctgaaaatgtgacacaattctctgtcttaggaaatagttcacatgaaaagaatggagctttcttagcaactcaaagaattgcagagtgttactcctatttccatcagaatgtttagacctgtagtaataaatgttttagaatatataggcaaattcaaatttaatttggtccttcatggaatctgaagaaaatatgtgttctgtgcctctacttgtgggaaatcctggctcttcttaacatttctcctcccctttcctttctttaggcaaagcggggggtgtctattctacccacccggactgtgcagtggttgtcattttagtaagaacccaggattcaggtgggttagcacttctgcaccctctggaggttcaggaaaagcttggtggtataggaccctttcaccataccaggactaagaagctttactgtgattattcgctttttgagagtatcctcacttcttcattccctctgaagtgacaagaggctgtatcttctcatctcgctggcctggcagagcccatgctgagccaatcagtgtctgtagagcctccttttgcactaaaattctttcttgcaaaattggatgccccatggggtacctgctgcagtgaaaatatgccagttctgcagagctgtgcaagttcaggatcaggtccttgaaacatgataaagggacactataagtagtacggagcctttatcataaagttctctgaagcggagttcagaagtgaggaaaaacattttagaagagtttgtactgttaggaaagaaaatgaagaagtaatttcgagtatttttggtggatgtgtctgggtataatggaaagagacaggacctgacctcttgaaggcctggttttaaatctctgtgtgacttgctacctattgtggctactccattaaaagcagaaactggtagcagaagagatttacagatttttttaacgtattgcataagaaggtgattcagtgttttcatgaatcttgtcataggggattggtagctttttatgttgttgatcttctggagatttccataacatcatagacacttgttcaagaaatatgtatgtacaaataagaagctaaatggtgggccagatggcctctgggtatcatataattttatttcatgctgctattcctccctacctaatgatttaatttttaataacatatagggaagataaatcatattgaatttttaaaatgtataaatatgaaattcaattagttacaaagaattatatattatgtaaatgtaaccttaaggaagaaaagagaaacataagtgtctatttattaggtatctttaaagtcagatagggcataataaggatcagttacactctgctaacataattaagtcagaagggaatatgtgatgtcaaaatatgtcaccagggaaggtcacaagaagtatctcaaaggacattgcattggtgaagtctttataatctagtgaatgaccctccactcttttgactcagaaacatggtattgtcaatattccaaaagtggctcaatctctctggactacatgtgtaaaccagaaggtcatctaacatgcagtgagaagtataaccatcaagcaactgggtattcacatgctctgaccagctttcccagtcgggaaatcaacatggcaggccaaagacagcacacacacacagacacacacacacacacacacacacacacacacacacacgaagctattggactgtaatcccaggcagtgtgactccccagcattcttaaccactgcataaaaggtgcccttataatcgatgaacattgctgttaaaaaaaaaaaaaagtttgctcatttctgttccatagcctacttccttgcttccatccttccactttcattgagaacaaatttgtttttggcctaagagaacacttgtgtctagatcctccctcctgctgcttccccaaatccatcaactctcctgaatcttcaaactctgaatctttgaccctcttctcctctggctccaacctctcaatttgcaaacttgcttgggtttcttccatcctaacaactgatgctcttttgatgccatgtttccttcagtcttttttcttctcttaagtgttcagggtctttaaatagtagatttgtcatctctccttgcttccctgcagtcctgcctttatctcctgcctcaaaaactgcttttgcttcctgccaactctggtagacactttgcattcttactctggcccctcttcaacttttgatacaggtgacccctctctacttcttgacacaagtatcctcctaagcttctgtcaggcttttcttttctggtgttcttctgttctccagctactactcatctccattctcatcttctctttcttcatccttccctccaatgccagtctcccaggttctgtcctgagccatcagctcatctctatgtctctcctaccaaagtggcttcaggtttcacatgtatgctgatggcttctgtctctgtctcaggcccagatctgtcttatgaggccaagatctgtaaatggagctgttaactggatgtctccacttgcatattcccaagaaacagccaacaaagcatgcggagggagatatttcctgtcttcattacctcagatcaacttctcccccaagatccaccaagaatttgcaagtcaccccactcctccttcctcctgtgcccctttagcaagcagtatggattttctctcctttgaagccttcttttcttttctatgttcctgccactaagttggcccagacccacacattttctcttttgattactgcagctgcccttacatatggtttttctgtctttattttttgtcactctccaggtcagccttcatattacagataaattaatatttccttttaaaaatgttaaaatgtgaaagtggtatgtgctcatactatttttcttaagccttggacaatgcgttggacacataacaaaaagttttcattatcttaaagcaaatatataaccgtggtaagcatactggtacatttccttccagctttaaaagaaatgcatgaatagtttttctaatcatcattgggatcatgctccatatatcactttattgcttgatttcttcacacaacacataaggcattatcccatatcattaaaagttatcttaaaatatgattttaatgaccacactatagtctagaaaatgaaatggatgaaccataatttaaccactcctctattgttgaacatttagtttgttcatttaaaaaaaattgtgcttaaatctttaactctttcctctcattatttccttgagatcaattactagaaatgaaattatttggttaaataatatgagtatttttgaattttttgatatactttaccaattgctttccagaaaagagataacaaattattccctttgtaatgcatgagattggatgtctcacactaactagaattgaatgttcacatttaaattatatgttttctgattcaataaatgaataattaaatttctaagtgaagttgagcatgttttcatgtttacttgctatttttaaattccgtgaatcatctatgcatgttgtcggtttgtctttatgttaaggtttcggttattctgttattattagtttgtatgacagagtagtcattctgaaattcaagccttgtcaaaatcctgtatcattccctataactctcaggatgaggttgaaatgccttagcttggcacacggtgccccaatcatcacgcccttgactacctgactttgctgctccaagatgcacataaatacagtacaggctattctgaagtctttccaattctcaaaaaaaaagtatttgttctttatgcctcatgcttttgcaacatgctctattttctactcaaattactattctccacctgacctctgttttgcctagccaactcctgctcactttcaaaatcactcaagagttacctcccttgtgaggaagctacttttgacctattagcctaaattatctagccctttctgtgctcttacctgagcaagcctttctcatacccctcaccacactgtattgtctttcctcataaaaagggcaggttttttgtttctgcttccccagggcctaatggccagcagatggtagatactcaataaagagggaagaaggaatgaagctgtcattcttcagctaaaaataactgcatttgcccttggaagtttatcccaatttgaatttcttatttgaatattataatatgttctggtccttcatatgtacaagtagaaagagctctctagtatttttgctaatctattaaagcttctatatataaagtgtgtggctaccatatagctaatgtctatacccacccatgaagttgtagaaaaataattctttggcatgaatttgataatctccaaaaatatttattattatgcacaaagaagtagaaattataaattcataaggtcagttatcatagcatgtagttttttcagcttaattccaaggaaaacacagtaagatgctaagaatattactaggtatatatccaaaggattataaatcattctactataaagacacatgcacacgtatgtttattgcagcactattcacaatagcaaagacttggaaccaacccaaatgcctatcagtgatagactggataaagaaaatgtggtacacatacaccatggaatactatacaaccattaaaaaaggatgagttcataacttttgcagggacatggatgaagctggaaaccatcattccaagcaaactaacatgggaacagaaaaccaaacactgcatgttctcactcataagtgggagttgaacaatgagaacacatggacacagggaggggaacatcacacaccaaggcctgtcgtgggggtggagggctaggggagggatagcgttaggagaaatacctaatgtagatgacgggttgatgtgtgcagcaaaccaccatggcacatgtatacctatgtaacaaacctgcacgttctgcacatgtatcccagaacttaaagtataataaaaaaataaataaataaaaataaaagaatggcaggatcaatggataagtggatggatggtcaataaatctaaaagtttacttgacaagaaggaaacatgttaatttggaaaaataaatttttctattacctaagaatgcttctgtgtaatttcacatttaagaatgcttctgtataatctcagcagatcatttgaggttcaattatatgctaacattaaaataattaagctctaaaagggaaattggaaaaattttgctgtgcaatttagggcaacccccccaccaaaaaaaaaaacaaaaaaaaaaacaacaaatcaactcccaagaatatggcaaaaggatagcataataagaatatccccaaatctactaattatattgggaagccaaccttcactttttaaacacatttgtcttttaaaaagttgaaataataattgcttgcctataatctactggatccacttgcttaatttgggggccaactaatctctcaagtagagttagctaagttttatcaattgtcacacccttccctctaggtagctttccaagcactgtcattgtatcctctctctgttgaacaagaaagaactgaggttggtgttacaccagttgccccactgactaattacaatttagtgtaagaagtttgctgagcaggcaatttcaaggggtatctgcattttaaggcttttaattccaattgcagaatgtaagaaattttaggcatcagtaaactactggaaaaagctgagctacttgtgctggttgccgaatactgtctgcacattcatgtctctgtatcttcaccagatgctgttctgtctgcttaaaacatcatttaccacctcaaattccacgtactttccctatggatcaagaaagtacatgtgccactttatactatgggttccttcttaggtatgcatagggcaccacaaaaactgcatttcaggggcaggtgtatccttagaaaacattgatgagagaagtcctagccaagttaggctgcagaatcacagaatgtttgtgattaggaaatgttttgtcctaagtaagggtgatcttgtctgtggggaaaaaaaaaaaaagaatgtaaggggcatatttctatgaattttgttgttgttgttgttaggaagaaaaagacactaaatgatcatttgctttccttcctaaagcactctccactctgagcttccaatcaaagccctgcagtgcctggagggggaaatccctgagggtgaagtcacctgattccactagcattgtaggcaaacttggttcccaccgctgggactcggtggcactccacagctgcctcccttcacacacttgtcactcagcatcataccttctcctcacttccccctacctgtctttcccttcctctcactcttcttgctttcatttaaaaagcaaaaataacaccagtggaaaaaaaaaaaaaacactggcgaattaacatttaaattctttcagttcagctggattcagctttttttccccctgactctgtggttgagtttttaagatataaataaaagacctcttagaaacacagtgattaaatttcttatttcatcacggaagcttccccttgtcctcttctaccctttcctagaccttggcaaagtactctttgcttctaaacttttaactcctgctgctcatgaaactgtggcttacctattaggtgaaggtcatgactggcctgctggtaatgggctgcactttgtgggccagtcctggctgtattgacccatgagctttcatgtcagggattgtgaggagtgagtgtagtatcaattttactatttcccatgagtttcaattagacttccaaattctaccaataaatgttgtaatttcctcaaagtcattttacttaaatcctattatcctgatcttgctactatatttctgtgtacataagttgactgtaggaaatataattctttcaggcttccgtcttcacggttttagtcatatatctttggctagtaccaattaacttgacagcaccatattaatactgttctaatgattcatttccttctatgctttttctgaattttcaagatagactttgttccatttggtttatttttctttatgattttaggcacaatgatttactgatatttaagattatcctggaacaataattcattgaaaatataagggtgactatgactattttgagagagggagaaagagttcaaataaagttcaaatgctgcaggcttccatttatcactgaacagaacaataaactaagaatagacaaagtggcctcctgcaaatttcatcccaattatgttttctgtattctctttttctcatcatttaatatctcatccctgttttatgatgttgtttattgtttaatacacaagatatagcagttgttgattccacctacaaaattaggatttattttctaatttacattagttcatgattttctatgtttttcctgcatattcttagagtaccaaatggataaaatcctgtattggggcacaggctgagtcactgcagaaagacacctacagatgcagcaccttacctaagatgcatttttttttttctgcatcactgttcagaggtagctggcagtccatggagggtcggtagctttgccccacagtgtcattcagggatcctggaagcaagccctgccatgctccatacttggtcccacttgcgggtccaagttggctgcttcacttgtctctatttcccaaccttggggaatgaaaaacatgaagtagaggacaatctttaacaaggagattgagaagtttcatgtgtcacttccacttgcatttcagtggcacaaacttagtactatggtaatacctaactgcaaaggaggctggaaaatgtagtctctagatgagcagctgtgttccctggtaaaacttgaggtgagggtcctattactcaaaggaagaattgatgcagggtgtcatccataattagcaatgcctttcacagatacttttaaagttagttaccttaatatagatttataagaattttatttttatttgcaaattgcccttaaatgattccccatttcactatttttctactcttcctaaacttagatgcttggtgggaatgaggagctgtcatcttacatactgtctgtgaagaagtatctgcgtgatacccattgtcctcatattcagcccactctctacattagcacataaataacatgaagataaaatatcttttttctccttataacagatgaatctggaaacaaactgatgatttatttacttaggcattccatagggtctacagtataaaaaggacatcttatgtttcctcttgggcttcccaaccagtattaggcttaacaacttaagattctcacaacccaactctttgcctcaataaaagaatactctttctagttcgttgcagttcaccataggctgtgttctcatccagagacccaggcctggggggaaaaaatagtgaagttggttattatctccactagacaagtgatgaaggtccatgtaggagaggaaggaagttggcatcagacccagtttttgaatctgaggtgttgccctgtgctccctgttaaactagctctgtcagtcatagctgatgcatctgcagccacccgtcagccccacagaatggccagcttcccgcatatgtagccccatgacagaaatagttctgctttaaataggcaagtctcacatgtgtgttttaagaaactgtagaattgcagaaagggaaggaaggaaattaactagcccgagcttgatgttgcatttacatcatacttatttattgagtttgctccctgttgggtgttgtactaggcactgtggatatagtgacacagcttctgacctcatggaactttcagtctagcaagttgacaggcatcaatcagaggataacttggctatgtcattagaactgggatacagaaagagacaaagctaagggcatcctgcccaaggcaataggttgccttcctaggccaaaagttatacttcggggatgaaagaggaaatggaggaataaataacgggatcaggattttgagaaactttccttcactcctcatttctgcttctctatttcttcagaaatgcagataactttttgaatatgtttagataggaggggaacaatagttactagtctgtttagcctcaaatcatccataggttgaggattctcccctctattagaatcctcagagggtatccatagagggaatattgaaggtgggtgaactcaagatctgctttaaaatgggcagctggggcagccagccagagttaaagccagtattcccattcacatcacaccttacttgctggtgcctgggattccttaacgggaaggatcccgcatgagagaataagcctcagagccaagaaagctggtctactctccaaaagttactgctatggttacttgtttcttttaatggtttaattttagttgactggtttttattaggtcttcccaacagccttctatcgtttgtgcaggtcctctctggcccagctgcctgttgctgcaacgtgagaacttctgacagcaaaaagagggagtctgctactgaaagcttgactgtgttcttatttaagtccttaattaggaagaacgctcaggaatatattcattggatgaataagagcaaaaccctctcccctccctgcaagaagaaaagagagtgggggtttgggtgcagggaaggatagacattaatatcctcgggtcgtattattctttgtcgtttacagcactttcatatgagtaacttttcaaattagtgtactaacccagtgaggtaggaaagctgatatcatcaccatcttacagataaggaaagtgagatttaagaacagctatttgctcacagcacccacggcctcttccaggaatcccatactctttccagaacacctataaaaagaagctccaagccagaccctgaggaaaacctcacaatttggctttgaatcttctctaaagaggttaaatctatgacaatgaaagcctattaaatgtgtgtatacttaaagatcatgaatattctacttctgtgaaaagtttagagtctaaaattcaatcagatgaagttcaatgaaaagggacccataatggaagtcatgcttctgctaatgatatcacaggacagagaaattcgtttagtgaaatgtacaagtaatctaagagtggaagacgtgtgtgtattttgggaagtggggggtagcacagagggaaaaagagaaggtttgtgtaaacattaaacccttccaggcaggggcctgtgtgatccatcttccttcacaaagtgcccagcacagtgtccagaactgggctacgtaagtgtttgtataactgaacagaaagtggagaccaagttctcctttgaaagtctaaacaaaaatccatttctgccacaatgccatcagaggtgtggtcactcagccctgccacctgtagagtcactctgtgaacaagtcaaaggccttggtgtgctaggtgtgttctcatctgttagcctccgtttcaggcaaagttttgtgcctacctgaaggacctcttcccattctccaccatggcatgatagcaggctctgccagtcacttcctagataaccacagtgagtgaggtttctttgcctggttgggtattgaagtgctctttctttcttttttttttttgagatagagtttcactcttgttgcccaggctagagtacaacggcgcgatctcggctcaccgcaacctccacctcccaggttcaagcaattctcctgcctcagcctcccgagtagctgggattacgggcgtgtgccaccacacccagctaacttttttgtatttttagtagagatggggtttttccatgttggtcaggttcgtctcaaactcctgacctcaggtgatccacctgcctcggcctcccaaagtgctgggattacaggcgtgagccaccactcccggccttgaagtgctctttctaactgcctgggcatgtctgttcttcagtccacagagagaaactgttggaatattctctagcttcccagaagttctgtacatgtctttaccttctcaagaatcatgccaatcctcccaccccagcctggatagtccatctttattctggccaaaacagaatttgatgcctttcacttctcctttctcatatatttctgctatctgtccttagaaatcagcataattgtgtaaagatagtacatttgtgggaaattttatatccttacttttagggaatgagaagagatgcatgatatataatagtgtgaaaagaaaaaccttagacaaattaaatttaagagtttaatgaagcaaagaacaatttgcaaattgccaccgccatgtagtcaaaaaggatttatggagagaaaaaagaaaatgacaaacagaaaatgctagtgaggtgcagaaacagccagattgggtataggtcagcatttgccttattcgaacagtttgaacagttggaggcctttggcacaaactcgctgactggagtttatagtctgtttatacattcagttaggttacagttcactatgcatggagaaacctttaggccacacttcaaatatgtaaggaggcaactttaggctaaacttaattttacaatacctgtttacaacagctgctacatattaataatattctattggccaggagcttcatgcagctcatctttaattctcacaataaccatgcaaggtaatcataaatataccattttacagcttcaaaaacagtgacccaaagaatgggctccttacctaacatctgtgtaaatggcataaccagaagtccagtctgtctaactcttgagctgcctctagaaaaagtaggcctatgtaacaaatctgcacatcctacacatgcaccctagaacttaaaattaaaattgaaaaaagattccagtaacattagacaagaataaaaactcttttaaaagataatacccaataatagcaaagatctggtagaaaaataaaatgattcaataccaaaaaaagaaataaaggaaaagtaggtagggaagacattttcatagtcaaattcaggatgtacttaccttcaagcaactagaagaacttaccaagaaatgcttgttggtcacctactagagaggtctttctcaaactgacccatgtatcacctgcatctgggcctcatcccagaacccctcgattagaacctctttatttgcgactttgcaattgccattgctaacagctctccaggtaattcttacattaccagagaactgtgccaggcccagagcctagagcagtgtttctcaaaatgtaatgttggaccacttgcataagatcacctagagcaattgtgtaaaatccagagtcccaggctccatctctggaaatagggtggagcccaaaattgatttatatttttaaacatccatttgattaagcatcacatgttatcattaatggtgcaatggtggtgaacattacatgttgcataattttacgcatacacacacataactagagattcaataaggttttagggtatgtgtgtgtgtgcatttctaggtgtaaagaaattatgacctgaaattattagtgaactaatatttgagaaagcaaagcaaacatgtatagatcaacaaatagatggtatatatagatagtgtataatcaaatgctacctgtgtggtacagaatctgatttcagtggaagtagataagagaacaattaatgaaggttgaaagaatcagtgctgtttttatggagaacggatgtctcaacaggcatcttaacagttgagtatttaatactttcccatatcccataattcatgaagattgcagtaatatactgcttttcccaaaataaactacaggaaaaaggaactgtgtcagcttttcagagacagagctgcaggaatacagtaggcaggagtagctggccctgaaatgatataggctgtggatgccatgcggccagcactccatcacagtgactcactcgggcaccagcctgttctcacttgtgtctcaggctcccccctcagcagaaaagcttgaggaccacttaggaatagtcatgatgcaaatgtcagtttctcctttgctgcagcagtaccaaaatcttaacaaatgagctgagtcacctggggagctcctgcaaactacacattctggtctattgggttttattaaaattagtgatttttcttccttttaccattttggagttcatgtttgcaagtcattcccttctagatagtcatgacattatctcccccttctgggacagcagaaacattggagtggcctcactgggctggatcattcaccagctttgcaattacacccccacatccctggagtcacagagtggaatagtgatgcccactctgccgagactaaatatccttactccaacctaagagccacctttaggctctaaggcctttcaactaaattgttatttgagttcttaacctttcaccatattttgcaatgagaaggtacaaattttctgcccacattaactctatcgctttatcctttagggcaactgttcaagctatttctcatttattaaaaaaaaattatcaagtattctctgatgttataagccaaatttacgagaatataatttttaaaattcatacaagtcacatttcccaatttttctaaaccatctggcacctgcaatctaaccaactgccacctagattcagcaactaggtctttggaaaggtttgtggagtgttaaaaatccaagcacacagtaggactttgctcagtacttaaaaattctactacttctaccacgaggaaagctcattttgcttctcttcattttaaatcagtgtgatgagtttgtaatattcatacttatatttaattgcagtagtaaagagttattttaaaacctcataataaaatgggaaagtattctaatatctcagttaaccaggcctttgggaaactgatgtgttcaaattatatccaaaggattatgttgatgacaacccaccatcaaggcagtcctgaatattgaggacaaagagaaagtatcttgagcaaggctgcacagatacctagggagggaagtcagaaaatcagagttcttgtccttgccactgacttcctgggtataagtcacttttcctctgggccctggctaatattagtttacattggtatgtgtgtaccagattcttgaaatatggttggattttttttcttaattagagagagacagggtctttgctgcccaggctagagtatagtggtacaatcacagcccactgcaacctcgatctcctgggctcaagtgattctcccacctcagcctcctgagtagctgggactacagctgtgtaccaccatgcccaactaatgttgttttaataggtagggtcttgctatgttgctcaagctggttttgaactcctgggctcaaatgatcctcctacctcagcttcccaaagtactgggattacaggtgtgagccaccacgcctggattgaatatgtttatattggtaaatatcctttacccaggggccctgcagtgctgccttggtcactcagcccctttcctgagattccctggatttctccatcattcagtcagtaaaggcttattgcctccctgccagcccccggtcaggcagtttccatgcagaaagatttccaaatattttgagcatcacctgtgctctgggcttaagatttcttacttctggaatgaaagtttagaatagataaccctaactctggaatgctgaggttttatgttgtacgtttattatttagaggaaaaggcagatttgacttggggccagaaccctgcctttgcctctggaattggctttttggaaaggtgtaaaactatttgcattgaaagccaggaaggacctgaaagcagttctctgccaaattgatctgtacactttggccatcaataacttcaagtataagattacttatggggccatcattgaatcataaagatgaacgtctcctcctaagctctagatcagtggtccaaaaacaggctttggtttcacagtgcgatttagaaatgaacacaaacatattcagtagatgaagatagagggtcatcttttcagagaaatttaaggattaagacagcatcattttctcttgaccagtgtgaccttttgtttgtttgtttgtttgtttgtttgttttgagacagagtcttgctctgtcacccaggctggagtgcagtggcacgatcttggcaccagccaccacagccggctaattttttgttttttttttttagtagagatgaggtttcaccgtgttagccaggatggtctcgatctcccgatctcgtgatctgcctgccttggcctcccaaagtgctgggattacaggtgtgagccaccgtgcccagcccagtgtgacctatttttgaggtatcagtaaccacaataatagagcagtaacacaagttgtatgttggatatttgagtggtctgttttggataatatatgcttattaggggaaatgcgaagtagttgttctaaaatatgtgtcattcaactttctcttctatgcaattaaaacattttaattgggcagtttaggactttgctaggccctgggcaaataggaatgaacaagacagaaagtgtccctgactttatagtgcttccagtataggtggtactcagtgaaagaaagttaccattaatgatgataatgggaggcagatttgcacagtggttaatggatgctagagaaaaactgctacttattaactgtgtgaccttggataaagtaattacctagccacttataagccttagtttcattatctgtaaaatgggggcactaatatttccttaggtctgttaataaaatcaaaaagatcaggccttataatatctttggaacaatgcccaacatatagtaactgttcaacatatggcatctctgattattaataaattggaatcactaataaaaagaaaaataacaaaataagagaaaaatgtttagctcagttctctttttcaagctctctctggagcacagaggaacccattttctataggctaattgatactgtttgaaagctgctacatcactggtgagccttccttttctctgattaaataattcaaatctcccttttcacttgttttaaagtcatgcctgctttcttaaccacaagtagcttcttattgtttgaatacactttttgaagagtggattgaaacccatagctgcttaattgtcacttgggaaacttgtttaaaacattcattcccagatggcaactccaggaatctgtggttctgatgagcaaaccaaggtattttcatgcacagaccaattgtagacacagtttgagaaattctgctcgtgacagctggtcttgcaaacccctataataaaggcagatgccataaactggacatatgtccagggctgttattagtcagcgcatgcctgttgaaatgtcaagctaattccctactgccattcctaggtagctgtggcctggtgtctctgacttttcttctccccctccctcactctaccccaaacctcagctgcctgaccctttctccaggaacctcctgaccaaccaacaactaaagaagtaacacctagcacagcattggcctctgccataggggtatggctaatgcgtactctagaactgtactgattgataatatttttaacattgcctttggaaatgattgatttagggaaaagatgacatctctgttcctcagtaaaatagccacacatacacacacacacccctacacacatgccccacatgtatgcacatgcatgtgtgtccacatacctccctgagacatctcactaaccactctactaagactccttcagtttaattaatacccaacttctttattgaagaggagaaggaatggatggcacaggcttctggcccactggttatgatgaatgaacttctctaccctgatatttcataaaaagctacagcatcttggcagtattctccaaggcttcattggaaccagcagaatcccctttaaaatacagctttatagggagagaaagccctcttagttatttacgttataacatggttattgggtatctggaggtgcctgctatgtactcctgggagtttaatttgccttgctgtgtgtgcttttgtgtgtgtgtgtgtgtgtggtcttctaatctgagtgttcatccttactatgttcacctaagttttcagcaaagatccttttaaccgttaagggttgacatcttgcaaaggttcaatgttctggtgtgccaattcctggctacaacagattaaagtattcctaatacttttctgttctcatttttaaaaaaaatattttcaggagatggtaagagattctatacctttaaatgctcccttgaatggccttagttctgacttctccaattcaaaatgattaatcacctcacttttactgccaagcctgggatattatggcactgctcagagctaacttggtcaagagtttcatctttcctggaattgtccttggtatttcaagctttgtgtggggtaggcagcattttactaggagtactaaggcatggattctgttcctagttctaccattaacttgctctgtgatcttgaccaagactctgaatcactctgtgccatagtttcatcattaataaggatgataacaacaaccactcacagctactgagttatcatgtgccaaacactaactcatcactttatatgcactagctcattcagcaacccttttttggggagttactattcatcagacacatcttgtgcattatctcattaaattctcataacaatcctatgaaggagctgttcttattattcctattttgcagatgacaagactgacagttacaagggcagaattacttgagcaaggctctcctacagtaagtggcagatcaaaaagttgaacccagtatggtctgataaccaagccaatgtttatagccacatatataccatacttcccccgattcaactgacaaatggagatgggtgtgaagaatactttgatcaaagatccggaggcaggaatgtacagagcagtgcttctcaacagggagcaattcctcccttcccaggagacatttgagagtatctgcaaacacgttgtcacaattagggggatgctactggcatttagtggatagaggccagggctctcaccaaacatcctacaatgcacaggacagttcactgtaacaaagaattatctggacccaaatgtcaatagtgccaaggttaaagcaaacctctcgagagcaagactattctgctagtgtatctcaaaagaaggagacaattgggcactcttggtattgcctggttgctaatgtacccacaaatgtccatcaggttatgaggaattgaaactgtcaggatatggggtacagtgagaatcaacagctcttcttgctggcaagcaagactttggcttttattaatcaagtttaatcaagatggatagaatgggaaggtcttcaaactatgtgaattctcacattacaccaaaaaaatttagtacctattcaagggtaagaacaaaccaactaacccctggctacatattagaatcatttgggaagctttttaacataccattgctcaggtttcaacccaagagattctggttaacttgtctggtatggcctaggtggttccaacgcatagccaagattgagagtctctgactatattagatcaaggtgtgcagttaaggagtagaatttggatgaaacagcagctttagggatgagttgataagaaaatgagcatccagtacatggaattttaaaatatttgcaacagggttccagagatgtattgcccgaatctaatcatgaggaaacagcaaacaaatccaaattaagggacattgtacaaaatacctggcctgtacaatacaaagatgtcaatgtcaaagagtgaggaatgttccagatgaaacgagactaaagagagatgataattgttcaatacattatgtgtgattttcttgtgttataaaggaacactaatgggacaattggccataatggaaagtggtttatagattataatattgtatcagtgttaacttcctggtttgataattgtacagcagttatagaagagaatgtccttgattttagtaaatatataaaacattttagaggtaaaagggcatagatctgaaacttttctcaaatgattcaggaataaagtgtgtgggttttttttgtgtgtatgtgtgtgtgtgtgtaaaggatgggtgggacaaaaggataaagaaaatgtcgtaagatatgcatattggggaatctggatgaagggtatataggaattctttgtattactctatttttgccacttttctctaaatcttgaaattatatcaaaatacaaagttaaagtaaattactttaaatggtaataaaagaattcctgtctccagagtccttttgggggctaagatacttgtctgcatttcatggatgtcttaggtgacatcttttgttcaaagaagagggaatggatagaaatgggcaagaggtatcctgaagattatcaggtaattattattattttataatgagggaaaattaattgtgactttcaagctaggagattcccctaaacaggttttctgatagagctaagttacctcttaaagcgcctccgtctttaaacatctaatgtcaagtcaggttcatctaagtcagaatagtgacctgaagagctacagctacttttagtactttgtctcggagaatgcagtttccctctttttagatccttttatcataaggtggggtgagggcatgggaggagtagctactgaagaagacagaaatagattaaatattcaattgagtaaaaccctttaaagcactcccttccccatgaccacccacaccctgccccatctatgcctccctctggcataaataaaaaatatttaggtggtgaaagggggtgcaggaactgttccttctttatagaccaaaaaaaattaagtaaaattaaaacctactttctataaaaaaaaaaagttttaaaaagtgaagtcaatgaatgtttatgggcacaaaatttattgtctacttcgaagaaagtgatttatttttacattgttcttcatgatccattgatagggcaaccacccaccccaactggcccaggacagttcttctgggtactagtcctcctaccataattatcaacaccttcttttacactgaaatgtgtcttagtttgaatatttagttctatagtcatctacctatagaaaaagccatttctcctcctatgagaaaataatttttaccaagaatggtattttacccagatcactgggcttcctaataggaaaattaacaagatcaggtaaatagccatgtggaaatctgagcccatttgtgatagaacagagatggatgtacaaatagaaaaccaacacgttccacaaatgaaacaatgaaagacttgagaacagacaatcaaaggggacagttttgctgtttcttttttcctcaaccaccattctaaattacttttttgatagaacaaaacaatgttttattcttgcccttgcaggcagaggctgcattgccagcatgcatttgtcttccatttccacataaaggccggatagtactgatggtatctgcttaagaacttaataaaactcacacctagtttcaggggaagtcaacccaggcatctgtttggaggctgccactcacctctagccctgtctagctcacaaaatgacatacatgtttgctgctctgttcaacctatctgggaagcaaaggctccatcaagaggaaataaactgtagctgatacatggccaagaggatgatttaatgcagtccagagagctttcagagcaatttcaactcccatgcttgagtgttgaaaaagtgtgactgcagtttaaagtccttatgtacgagcttatgggacagcttctttcaaatacagacaggtttttgtatttaaaatattccccaaagtagcattttgtgggaaagactgtgtataacccttcagatctgaaacagggacagtttgatggtgactagattagagtttaaacacgttctttatgttttggccagtgcagattgacaggtctcatggatgcctcttttgatggtgggatatttaaatcataggaccacagagctcctagttgtggccataccttacatactcctggacacagttgctgtttcttgtggtgggggcttgtctctcctcagagcttgtgtcgtggcaaagtatactctatgatgggcactgctgctgatgcccataattgaaggcagatattccgaggaaacctctcatgatgtaataatatccactagaattctacacaccaaccctgcatagttggtttttgttttgttttgtttttagacagagtctcactctgtcactcaggctggagtgcagtggcacaatcttggcttactcagctcaatgcaacctccacctcctaggttcaagtgattcttctgcttcagcctcccgagtagctggcactacaggtgcacaccaccatgcctggctaatttttgtagttttagtagagatggggtttcaccatattggccaagctggtctcgaactcctgacatcgtgatccaccccccttggcctcccaaagtgctgggattacaggtgtgagccaccacgcctagcccaaatattcttcatttgggaaaagaacccacctcactaaaatggtgatgacctcatagtggatgttcctttactgttgttgcatttgtggaacatcttccatactttaagaaactttctggtcgcatctgataatttttatgtggcatttgcactgatagagcatgagaaattaaccaagctctaagacggaatagtggagaagagcctgtgtctcaatagctgtgtagcaaaataaaggtcttagctctgtggccgtgctacaagcactttgtcatcactagcctctgacaatcaaatagcttttctttctcaagaataaaaaactaggtgatgcttataccaagccaacaaaaaagattttatgatttttagtgtccaaccattaaaagaacaatgactttgggtgccatctgagtggcttagaggaggtctctatttgagagaagatggtggagccaagtccagtgttggcaaactcaccaactgttttgcattgtgattgcattctcatcatgagctttagtggggcatagaggctacagacttcaaaggcaattggctcagggaaacaaaagcaataataccctttattttttgtagcaaaaataatatctactgtaaaaccctagtctgctgatcataagaatataatcttagccacctcagggttttctcagtcaattcagaccactcccaaacagatgctgaatttaaaacacttacacatgattcctgatcaactgtggaaaaaaaaaaaaggtgatgattgcaccactgtactccagcctgggcaacagagtgagacctgtctcgaaaaataaataataaataaaatgaaacccttatacattgtcaaaatgttgagatatggttgttaagagtgacagtgaccttgtttaaatttagccaatcagtatccgccactatattctcagcctgctggttccagtcatctgcatatattcctcatggcaggaagtgcccatgtttccatttgctcccctgttaagaggccacgtggttaccctccatcttccttgtcctggccaaagggtctccttgggtatcctgctctctcagcctacctctgtacccctcttggaaaaattcagaaagtacttggtggttcttccattacactctagaactatgggaaatccactggggctgtctcgggacctctctgcctagatgtccacacaaccatgtctgctctactgttaacataggacatgggagagggattctggaggctggctgctttcctggtcactcctccctctccaggtggtgaggcacaggtgctgtctgtttcagatttctcaactcacttggatcccagaattttaccaccctttgaaggttgtgaccaagatggggcggggggatgcagagcccatactcagagacctacatcagcatacaaccttattgctcccttctctaactctcctacttttccctagtccagagaatttttatcttctctttgatggaacaactgtttctgcaaatatacctccaaatattttgtgctagcagctgtaccttagcttttgaacccaaggccaagaatctgaccttttgttttctgcttccacagttgaggcagtagatgacctatatatagctacctgaatagagtaatgggattcagtgaaagaaaccatcaattaatatattcctctgcaaatgcaaacagcattccaaaaacagaagttctcgagcaaacactttccccttatcaaaggtttgcaggttgaataccttcttgtcttaagtaagctttgtgttaatatgtgaaccacaaacaggaaggcagccaaaatgctgctggaaagtaaaagataaaataatcagagtccaaattttgcttgctgtgtgatccatagtaaacctccatgctgtgctccattcagctgactcctcatcatctttctcagcatcttatgtacccagcctttcatagagacgactacaggccaactttgccctaagaacaaaatgcaaggattaggcttgttcacaaaagaaacacacaactcatgatttaaaaaaaaaagaatctgccacactcttacagctctctaaaaaggaaatgatcatgattagctcaacagctacattttcatttagagaaaatgcccatgccatagatggacacagccattcagccaaatcaatgttgattaatctcttctgcattatataaagagaaaatacctaatggtcctgagatatttataattctatttttatctgttcatgtttattatttatgcatttttacaatgctgcacaagatttttttctcatgtgataaaggagctatggtcataacttttagttattccaactagaatgacgagattaacttcagcaaaggaaaatcacttaagctccttaagtcatattttcttcatctgaaaagtggtaatagtaatgtttcctctgtgtacctcagagggttatgaacatcaatgatataatcaatatcaaaggtagacaacacatgtgaaagcaacttttaaaccctgaagtgctacgcaaacaccataatgttaatgttatcataattagtagtatacaaaacatgttttcatggatgaaacagagagagcagagaaattgtgaattctgtgccctcatctttagtggaagcaagactaaatgtcagaaagtctgttaacccaatttccctgctggccaaaaagaaccatgttggtccatcaggaagggcactagagaaaatagtgtgagcgtgagctgcccacttccaagatgttggaaccgcaactcctgaaattcaaaataccacagctttgggtaccattccttaaaacaaaaacaaacacagacatagctaaggtccatgaaggcttatataaggcaggacaggtaaaatattgaagaatatttgtaaagatcagacacctttaaactctaagcaaaacagctacaatgaaagacgcttagaggggcttagatacggtgaacatggaacttattcataacatcttggaacctccatttaaaacttgcaaaagacaaactgaggaccaaatgaaaaaggaaagagtctatacttttacaacaaagtatctgttgaatataaaatgaacttacgaaatcagtttcttctaggagtgatacagactgaaaattattatcttaattcaaaaaagtcctatttttaacatttgttttttccaattaaacattacatgtttacagaaaaattaaagagtatgaccaaaaagacaaagaatgttaacacagttttataacagaaaagcattttaacattttgatgtatctttttccaattgttttgttttatgtattgtgtgacatttaatatacataaaagtagttatgcatctatatatatgtgagttgtgaagcataatgaaataaacctctataaacctaccacctaacaggattaagtcattgtcccttatttcaagaggccagcaatagtttcacaaggggtagactctttaaagaagcacaataacttgttacaggttctatgatgacagaatgtacaaggttcagtagagagtctaaggaggatgtgatcggtttcactcggctgaaggtgaggggcaggtagaagtagaacgcccttgtaaagggtgtaacccatatttaactccattttgaagctttaggtgatcattaagataataatattttgccatgttcatctttttagcaatattggctattttgtataacaatggacagaactgtgcaagcatttgatagaaaagggcacaagcttcagagacaaacattggtgttaaaatcccagctatactgtcactagctgagtggcttttggcaaggttcttaacttcttcacaattaaaaagtgataatatctgttattgttttgtgatataaagcttatatctgaaatctgaacagtgttaaaggctggctttaccttggcccaattactacagcacagagtctcgtcacctacttggctgctcattatagtggtgcacatgacactggctagtttttcagagatggggaaacagttaaacctaaaagagactggtgtacaaaatacagtattatgtgttaattcagcatgagatgtacttctttctacttcccagaataatcgtgaacattatccaggttatccctactaccactaccacgagtaagggaaaggaagcaagaaaaaagagaaagaaaccaacatttactgagcaccatgtgccaagtgctttgcaagtatcctgttatctaatttttatgataatcttcaaatttttgttatacagctgcagggatggaaatgtggtgggattaggtactggccttagttcaccagtggatttgttgtctgtggttgggtagctgagatggttaattatgtgtcaacttggcagtgccacggtgctcagatgtttgatcaaacattgttttggatgtttccgtgaaggtgctttttggatgagattaacatttaaattggtgggctctgagtaaagcagtttaaccttcatagcgtgtgtgggcttcatccaatcagttgaaggccttaatagaacaaagactgacctctgtgactaagaagtctgtcattatactgtcgttagactggagctgcaactcatcttacctctccagcctgttggcctaccttgcagatttcagccctgtcaagcctccataaacccatgagcctcttccttagaataaatctctttctctcattaaatagatggatggacagacagatagagagataggcaggcaggcagacagatacacatcctgttggttctgattctctggaaaactctgtcaaataggtagcaaattgccccaaaactcagtggattaaaacaacacgtgtattctctcacagtatgtatgaatcaggaatccaggcatgacttaattgggtctttagctcagggactctcacaaggatgtatcacagaactggctgtggctacagtcttatctcaaggtttgactggggaaggaagcacttgtaagctcactcagtggctgttagcaggattcagctcctcacaggctgttggatgagggcctcggttcctctctggttgttggctggtggtcaccccctgttccttgccatgtggggttctccagagggcaactcacaccacagcagcttgcttcatcagaagaggccattgagaggagccagagagaataaaacgaggagtcacagtttttttgtgtgcattcctctcagaagtgacagcccaccacttttgacagattgtattatttaaagcaaatccctacatccagcccatattcaaagggaggggcttgcataagggcatgaatagcaggatgtgaggatcactgggaaccatctgagaagacagccaatcacacacaacgagtaaatacacatcactggttgacgagaagctcagtctgactctggggcccaccttctccacgatgccagctgcaacctcgaagagccgaggggaaccctccacaggaatcagcaatgagagggtggtctgtgagcatggcacaaagtgggagcatcgaatggcctaaaagaatcatccagatggtgcggaggcccattgcccctcagcaaggtcccggcactcctgcagccctcagagtcagcgcttctctcctctgcctgcagcaggctctacctgccccagagtaaagccactctggtgggcttagtcctggggccctatactcacttgactcctcctggcttctgtgtcctgaagcctgtcagcacttcccacccacaagcccaagcccccagtcttcccatccagggtgtagtgaagctgtgatgagcagcccagatcctcaagcaggcccgcagcaatcattcgctacctctaaattatggacagctgaatgttctcagctgagtccctgcatgagaatagcccttagccttggagagctggcatcacctcccagggccatgctccctccccagggatagctctcgacctgtgactgctccatgagaggagaggggaacataagatcctgaactgggggtgcctgtgaagggtacccctcccctcattgccaccttgaatctgcagagacctttgttgggactgcattgagttcaagtcctccctctgcccaatcctgggtccctcaggtctccacaggtgttgatcctgacagcactcctaaatgaagctcctgtacacaaaacctccactcacaggcctcagcctaccatccaagaaaggcctgtatctgcacagctgcagctggcactcctccagccgtctttacttactagcttcattctaatgttgtgaatgcatgaccaaggatctccacgcacttgagaagaaccaacagcaagatacataactagtgagataaaccaagagcacaggtgacctagagtattcagagctatgcagaaagtagacaagatcttttttaaaaaagagatctatttaatattcgcagaaagatttaacaggctatgacagctgtaacacaagaacacagctgctgtgaaaaagagagatataacaaaataagcgtccctgtgctggcaaaatttattggaaaatttagcagaagagttgaatggacctaactgaagaataagttaatgatctgaaaaataatgtgaaaggaattctgagaatacagagtcaaaagacaaagagatggaaaatatggaagaaaagaaaaacagataatagatgcaagaaattctatatccaactaggaatgctgaaggaaggtagtagaagcaatggagaggaagaaattatctaaatatgagtgtgaagaaactatgaacaaagacacaataagagcccactgaatgctctataggaatagtcagcaaatttttttctgtgaagaaccagatagtaagtagtttaagttttgcaggtaatatttcttgactgtattgcagcacaaaagcttcaatatgtaacaaaaacacaatacgtgactgttttcctacaaaaccttattaaacataaataagcatcaggccagactgggcttagtttgctgacccctgccttccagaaataatggggaaaaaaatcacacatctagtcacattttactaaaagttctgaactccaaaattagggaaattctgtaaagcttccaaagacaaaacaaggccaggatctcacttgtcttctataacacagttggctaaaaaccaatggagtcatattctggggaaaattgaagtgattcttaacctggattatgttctaagtcaaactatcagtctagtgtgatacacacgtatttggccagtcaatgacttgaaatgtttatcacctgtcactatcatgggaggagagggcctactcaaagatgttttctcacacaatgtaaaatgttactccaagaaagaggaagatatgagatacatgaaacagctgaaataaccccagatttagatgaagagaaatccagttatgaccattatacagcaggtgaaaaacccgatccattgaaagtgagacaccaactcagagggttctatgatgaatgactttattaaagaacacatttgctataataacacaaatgatagaattaggaacctggaagttcaattttgtggagttaccaatgagataatggcttatgtctgctctcttcaacaccagtagaaatgcatttaggaattttaggaggaaaaaaatgagacagacatgattgtttaatgaagcgagtaaaaatttgtgccgttaatgaagtgaataaaatggtgttttctgaaacagcaaatccaaactcccacaggtcaagaaacttagagttggaattaagagagtcactaactgttcttgtaaatttattttttgtttattgcatatatgaccattacagttacttctctatgtggctatttttttttctaccactgcttttgttacttttatataatattttataaatttgcctttttccatgattttattcttaagtaggctcaggttgtttttaaattagaaaatagaagtcttaaaattttatttagatatcggtattataacatcttctgattttcttaagacagatgacagattttacatctagaaacataaatttatttttcttgagatttgtatttaaagtatagaagactccttcaggaaatgaatatttcttgttttaaagaaatctttttctgaaagtcagcaatttctcatatttcttacatttcttattttattttattttacacaaggtctcactctgttccccaggctggcatgatcatggttcatttcagcctcaacttcccaggctcaaatgatcctcccacctcaggctcccaagtagttgggaccaccagtgcatgccactatgcccacctcgttttcgtttgtttgttttgcagagatggggtcttcctatgttgcttaggctggtctcaaactcctgggctcaagtgatcttctcaccttggcctcccagagtgctgggattataggcgtgaaccaccataccgaccctctttaattctttttttctgataaacttaggtaaagttacatgtaatgcttttcatttaataaaaatattaacagtgattatctttaatgtatgggtcactttgtccttatgtttatgtatatttttccaagtggtctaccatgaccatgttattttctaaaaagaacaacattattcctttcgagttacaatatcattcaaagctagagcttggcaaatatatgaattagaggcttgacgttaccatcacttgcccataacttttaactaatcactcaacctcttttaaccttggttttatgaaattaaaaaattgggttgaaatttatatttgatgattttgaaaaaacttatcctagacctgtttttttgtttgtttgtttgttttgaattgttcaaaccctttgcatcatttacaaggtcatactatatcagggaggattcttgattttaaatgtcggtggaatgtctctgggttttgtgtgtgcctacatttatgtcccaagttctatgcaggtctgcctccgactggtgatggggccttgagcatgtcatcccctgctctgtgctttgcatctttcaactttcaagtcgaggggttggaatcagtcgcctccagtgtcccttccaagaataaagggtaaaatgatgctggagacaaagcttgatcactgggaccctgtgggaaaagtagttacaattgagtgagatcagggaatctgctgcttatatccatgacgcaaagcctgaggatggtctcattctcatggatgtactgcttcatcttaaatgtaccaggattaggcaacacaaaacagcagaaataaattcttccggggatactcctaggcagattgggggtcacattaccaatcagctcaggtcaaagcttgtactatttgaatgtctctgcacattctcttcttcacttgttcatgagaacttccaacagtgtcccacctacccaatgtgttccctctttgtagtggggagaaaactcagtcaaaataaagaacgtgcagataacatgataataatcaaaggaaaaacaatgtcgtgattgtaagaacaaaccagtctacaagcgttaatgcattaattaatgcaaagagctgaaaactattaacacccaagaacagtactggtaattctcagtagcacaattgtataaatcagtttattcagagtcaggaagtgcttaggtcttaaatggtccaacccatgtcttctaaactggtacctcttaaacttcaatgggctactgattatctggggggtcttgctgagataaagattctaaattagtaggtctagagacttgtgacctgagataatgcatatttaggaagcttctaggagatgctgccaccgctgatctgttatccataagttggactataaggatgtaaagcacttagaacagtgtctgcatttaggaagaactggtgttagtgatgattattatttctactagctgcaagaattccaactctccatatgctcatgtgctacaggagtaccaagagttgtgcagcaatagccatatttttaagctgaataactagaatcattttgtaaactcgtttatgaaattttatggaataaaaatttattccgtaacttttattagatcacaaataagcagcccttggtagaaagcacatttatggaatgagcataatttgctgctgagaactgcagagaaggcctgcatattttgacaggttccactcatcaagaggactgtcacgtctctccagtgagctgaggaccatggtttcagaattactaactcagaggaccaaccagttggtgactacataaccagtgtgcccaagacagtcctgaagtcacagcataattaatagcacccctctcctagcttggacaacgcattgtgtagtcatcctaattatagtggacactatctataaattactggctttacccagcttccctagctgtccctaaactttcatttctaccacatggagaaaagggaattctcagtcaaattttcttgcttagctgacaatggttttggcactgaacgatgcctatattcaacaatcctgaagttttgtttgtaacacacacacatatacacacacccatacccacacacacggaggaaaccaagtttcatcaatacgatccaattttcaggtgcttctaatctgagctgcttatgtgaagctctcttccttttgacagaaccagctcctctttcatttccaatcatttctccaggattgcacaagaattcttcatactgctgctggtctatgagatatgcatgagaaaaactagatgaagacaaaagacgtgtccatcccactgggtgagatgcactgaaaggggtgaagccatatcgacccagcttccctctgccatagatagtcctctgggatgaaatctgcattctgtcactgacgagctgaccaccttaggcagatcgtttaatctcttttaactcgtttcttcatctgcctcataagtgtattgtgagaatgagataaattagcatatgtgcggggcctagtgtggacttggcatatagaaagcattttaacctaagtcatatctaataaattcccacatgaaaatgtaaccactgtgcaaagttgcattcccaaattttgggcagtgttagccatagccgaagagtcggttttgtttctagtaaatccacttcagccatgatagatgtagactgtcatgtttcaatttggaaatgctttccttcaggtctcttgtgtcctgaatctgtgatgggttgaaacaatcatttttgtttcaaatcttaaggaatttgaacatgagagatttaattttatataaggtttcatcattaatatacattcttttctatgtcattacataaagaacagaggaaaacaaatagaaaaggtgagatggagaggaggaaaagagattaggagtataacaagctgcacactttctaaatttaatgattgaatcataagaagttccttatatctgcatcttaaaagaatgcaaatgccattttaatttcatgggaaaaataagttaaaggataccctgctgcttttgaaaagcttactttgatcacttgccaaatggcaaaatgaatggattaaattttaaatcgcctgtcttcaaaggacatgatatggaacatatttaggatttagccctttaatttaacattaaacttactaaaaatgtcctcatcaattattgacagctcgattttaaaacagagcctccacctcaatgttgagaaggtagaacactgcttgtttttagaagtacattttctacttctttcagctacaacaccgggtagcattctgcaaaggggtaattttttaaagaggctccaagctggtgagcagtttgcctatctgcatcagcaggctcatgacccatcatttagaactcaaatggaatgtattcagtgaagcatcttgctattaaataaatgttgtaaaaaatgtgtgagtgctgactaataccaaaatctcaaatctcatttggtttatgtttcctgtgattctgtgggtatttaataacagatgttattgtgcaacaaacaaggccattcccagcaaaatatggcttagggccaactattatttttatcctcttcttaatcccttgaaatacctttttttttttttagaaacaacatcatattaatgtaaatatttaaatcctttgataatgctgctctcctgcctggagaattctgaagtcttccattgccacttatttccacatacacaaattctatccatctcttacaggccatttcttccttgaccacccccctatactaacacacacacacatacacacacacacacacacacatacacacacacacacacatacacacatacacacacatacacacatacacacacacacacacacatacacacacacacacacacacactctctgatgacacattactctgaaatatattcataatattttaaatagtaagaggaattggagattaaagctcaatagaagaagggtatttggtaggggagtagtcaagaaagacttccgagaagaaatttgtataatttttattttggcatccctgtttcattacattatggaggatcttaatacatatgtttagtgtgcatttgttgctttggttgaaggatagctttgaagaaaagaacaaattcatcaaacggtagtgtgtgggagggaggactgttctctcaacattgtctggttcatttcatcaccaagtgagccctttccaaagtgtaggcatctgcatgtcacacagttggcactcaatagtgaatatgtgagcaaaacacaaaaatgacaccattactgcccttgaagttcttgtaatccagttaatgatggcacatttgccctcactaacaacactgttatgggagcacagcagaaggatgtctaaaccttaatgggattcaggacagatttcttggatttgagatatgagctaggacttgagagacaattagaaagttatctggaggaaaaggctgttactggcggaagaaagggcaaatgagaaggcttgcaggcacagaataacctgcctttgggaacctgtaaagagaagtttggctggaatataggcaaaaaaagcaaaggagaggtatgagattagtggggtgggtgatagccattttatgaagggcctttaatgccaagcagagccttattctaaaagctgtggggagccactaaagaattttatagaggaatggtataatcagaattttctcttttgctttatttatttatttatttatttatttaagacagaggctcactatattgccaaggctggtctcaaactcctgaactcaagcaatcctcccaccttggcctcccaaagtgctaggattacaagcatgagctactgcatccagcccagaattttctcttttagaaagacctctctagcagcaggcttccaaggttgatttttgggtggccagacagagaccagggagaccaagtgcagtcatagggtaagccacaaaattgatggcagggtgaacagggggctgatgggagacgtactgaaaggtccagagaacatagtgcttgttgagtagtgggatgtggaagtgagggagaaagaagagatcaggataacatttaggttgcctgcttaagcaactgggtagagggggccatttgttgtgataggatgagtggcagatttagaggccccagcttaaaaaaaaaatggcttcagggccattacatcaaagacacctattggaaatctcagcaaaacaattgaatatggggcgtggaggtctggaaatgggtttgtctaaaagacagtagaggtgtgttgggagaagaggagaaaggaaccagataggaggggcttacctactctgtgtgtgagcttctgatgttttcaatagtcactggcatctttatcctttgctcactgtctctctgagctccagctaatggtgcaggatccccaaagggaaggattgaaggcaattacccagttgatttcctccttagaattatttaatttatcatgttgttttgtaaaggacatgattaaacctttacagacaaaaaagaaattttgtggctaatttgggctctacattttcagtagataataacatcaataaaatcaagttagtttaattagagttgatttcataggagacattttgctgacattcctataattggtctttacaatctttgaagattatatacaggtacgagtatagatataaatatatagatagatgtagacatagatataatatacttggttccggatatagggatatttggatgtacagctaataagccaaatacaggcatataaacaaaatgtttatcttccaatctgggattagtaatagctcacacacacttactgtgctcagcaaccttttaaagtgatataaatatactaatttacttaacagccaggatacccctatgaggtagatactgtcattatttctattttatagtaaggaaactgaggcatcaatgggtaagtacattgttcaaggttgcacagctgggaccagcatttaaactaggtagtctagctctagagtttgctagtaacataactttatactgcctcttcttacctgtatcttatagataaatgaatatttaaacaaatttaaagtaaaattcctgtcctcttgtgagactggataagctgtaagacaggctatgcatttcatcaattacacatgcacaattagagcctatatctaatcagggctgatgacagccacagacgtttgtacagattaatgatcagagaagaggaattgatgggccagagaaggttgaagctgtcagcttttaggaaatgccctgagccaaggcagccattgatgttgtaaactgaaatgtggcagctataaaaggactgtcagatccttcctttgcataaaaagtatttattaccatgcacagaagcccaattttctggcatgtaacagagatctgtattcataactacttactcaaaagtctttagtatgcctggtccaccctcctccccatcctggggacatgtgggagagctcctttctgctacctcttacattttcatagacccattgggagacttagaagtgtcctggtgcaggcaagagacttgcagccatccacaaatggtaccttgcttggcatagccgggctccatagcctctggtgagtgccccaccagaacaagccctgggttcacgtaatgagagggtcccactcacccaaaggatggacagtcactgcatggagtcagaacaacaagagccctaggcatgcaaactatgctgcctttcggttcctctcttgtcacctgcccctacttattggacagcttccaggacaggttccaagcaatcccctcacttgctcctcttcctcagtctccactttgggtacttacaaagtggatttaggcaaggaaaggatgtactcagccatctataatagggtgcgttgacttaaactttgcggattcaagtctcttggctcgttctggtgtttaaaccttttagggaattgacccttatcagctaagagtataatattttgaatataataagaaatatattttttgtcttcctccctgtttcctggtacacagttccaagaacccctggaaaatctcctcagtgataagtgtctttttgtatgctaatgagaacactaggggccctgggtggcctcaggatggggttagaactttcagcttttcagcctactgtctgacctctgggaaggggagagatgctgaagttagagttgatcaccaattggcaatgatgtgatcaattctgcctgtgtaaggacgccttcataaaaacccaaaggacagcattcagggagtttccaggttgctgaacatgtagaggtactgagagcgtggtctagtccagagaggagcatggaagcccagtgccccttctcgcataccttgctctatgcatctcttccatctgactgttactgagttgtattctttataataaaaggatgagcataagtaaagtgcttccctaagttctgtaagccattatagcaaatgatcgaacctgaggaggaggttgtgggaacttccaatttataactagtgggtcagaagcaaagcctggacgtgcaattggtgtccaaagtggggcagtcttggagtactgagcccttaacctttgggatctggcactatcttcaggcagatagagtcagaattgagttaaagcgtaagacatccagtgggtgtctacagagaactggagaattgcttgctgtgagaaaaactccatgtgttaatgaccagaaatgaagtaatgtgagagtatagaaaaaccaatgttttggttttctttctgtacagtacagtgatagaaacactgtacttgttttagctgttctgaaaacctggactccagattattttgtgactgcacagtacatacttcacactctcttgggcatatttcccaggggttaaatgaagctttagagcccctcatttgcattggtctttaccaagacttaatagagccctagcattgtattcatgtggttatatatttttgcaaaatttgcaaaagttatttcttatttttgttctcattcttaaaaaacaaacctccaatgtttatgtttagttgctttttttgtgttttgtttttgtttttgttttgagacagggtctcactcggtcacccaggctggagtgcagtggcatgatcttggctcactgcaacctccacctcccaggttcaagtgatcctcccacctcagcctccagagtggctgagtccacaggtgcgcaccactgtgccaggctaattttttatatctgtgcttagttttctattattttgcttaaagaaggctccccaaggtgtgaaatcttcaggttacataatacttggattcacccccgctctgcctccctcattcaaaggttattccagttaatagtcctcatacacgtttttatttgtattggaggtgtttgggttattttgtttgtttgtttgttggcttggagttttttcaagttctaagtgtttagatgatgactaagaagaatcagagaaatggaaatttccttaactaaagaaaactaaaaatatacttttgaatagcaatgttattcagccacagtgaactttaggaccgctactgggaaagaaataatagactggaacatggatcatggaacttgctccactgagagaggtgtgtgatgagtccatgaggttttagaacaaagtggcttcttctagagtttgaggctgagtattagatctttgcctctcacaagaactccagggagaaaggataaaggcttctatacctttaccagcaagctatcttttcttgaagcagttatatgacacaatgtctgtctgcttctcttgttagtgaagaaagattgcagttcctcttttcacaatgatttttatttaggtagcatcaggaccacaaatggaacaaagcataatttcatacaagtttggctggcctaagaaatcctgataggttaaagtccagctgtgggaactctcacatgcacgccagttatgcccgtcacataaggagtctgcatcctgtccaggaggtcctcctgagacgcccatcacatccagagtggttcttcaacatgggatttgcccatggcctgtcaatagtatccactgagaagtgataaacctaaaggagtggttttactctttggcagtttctagtaggtattatctgaaagatgagagccttgtgattttgagagatgccaaatttcttattaaagcaatttatgcccaaagggatcataattgtgaaaattgaaaaatatataaagcgtatagcatcatttggaaagctgacaaaagtaccagtggacttccctagtagctgtttcttcaaagtcagcactgttcttttggattgacaaggaaagctggttttcttattcctgtttggagacttctcactcctctgcatgtatcagtgatatttatgcagtataaataacttgaactcactagttttggttttgctaactggctagttgtgtgacttagtgtatgtgattagcttctctggctttcagttgctttctaggtaatatggtttggctcctcgtccccacccaaatctcatctagaattgtaatccctacatgtcgagggagggacctataatccccacccgtctagtgagggaagtgattggatcatggggacagttttccccatgctgttctcatgatagtgagtgagttctcacgagatctgatggtttcataagcggctcttcccccttcactctctttccctctcctgctgccatgtaagacgtgcctgcttccccttccaccacgattgttaagttttctgcaacctccccagccatgtggaactgtgagtcaattaaacttcttttctttataaattacccagtctcaggtatttctttatagcagtgtgagaatggactaatacactgggtttctcaaggacaacaaaaattccaattcttgctcaaaggacttattgaggattcagtgagataatattttagaagttatgatttgtctgccacctgtctgatttagagttaaattgagggtaatattttaatatcctaatattttataaaatacttttttatattgaccaaatagaacatattgagcactccctgagtactgaggtcactgctgaaagctattgattgaaaaaaataataatacttgcttacattctgattggaaactctaacagaccaatcgctgcttgtttcatgttctgtaattactgaagacagtgctctccgcataacaatatctttttaatgaggatgctggacagatccttctgcctggtttttagatcaggcccatctttattccatagaccctgtgaactgtataactgatgagggttactctatcctgttaatgttaagaaagattacaggcaaaatgttggcccactcattgtgatattcaaggatctatgagaagcttttcagtttttggaacagacctccttcttggcttcaatgtatgtttctacacttgtttccccctttttctcttctcgttttccattttactttattttattttgccataatatatctttataagccatgtttgagtctttttaaaaatctggggcacaaataagaaacaaataattatagtagaggtgaataagatttaaggaaaaccacagtaagcctctctaagacagcaataaatacctgtgtccgtacatctcagactacttaagaaaagcaaatacatctaaaggtagaagtagaagccttaacatccacaaatgttcatatttgacactatataatcattttatttcaaatatggcctgagttcggcctggatctgtgtttgttatttggtaagcagcacatgcacatcttcagacattctacctggaacatattttattttattttattttattttatttatttttcttttttgagacagaatctcgctctgtcacccaggctggagtgcagtggcacagtcttggctcactgcaacctctacctcctgagttcaagtgattctcctgcctgagcctcccaagtagtagggattgcaggcatgtgccaccacgcccagctaatttttatatttttagtagagacagggtttcaccatgtcagctagtctggtcttgaactcctgaccccaggcgatcctcctgcctcggcctcccaaagtgctgggattacaggcgtgagctaccgtgcccagcctccaacccctattctaacctctcccactttcttctctagagtccattattgattttctcagagtaccatttgtgctctacaataatcactccatatcctctccttaccaagtctttaattgctctgagcaatgcttattccctcgcaattacacattgctaggcagattattctccagttccctacctctgaagcccagaatattaggcttagaattctctggcttcctcctatgcttctagactgttgttccatccctttttatagatgatctctgtgaagcccctgccctccagttgaactcttttcttcctgtctatgctgccataccctgcggctctccaggtcactcctcctgtttctcacgcagcttatctggctcatggttgtccctcaactctgtttcctgttgtcctcctgagtcggtggtcaccgtgcaatcctcttacctcgctattctttagcctctattcccatcatcctcaccctgtcatccatcacaattccattcatgtgcctcatgttgaccctaagggcatctgacactgaaaaccttctgaaaccttaaacttacaaaattatcttttgggtttacaatttttttgtcttctacttttcccactatgtcattcctacaaaacttatttttctaactcatccagaaccttgaagtctcacatcttcccattctttcagttgaatgtgatactcctggtttctcttctttcctcacaacctctcatagtcgggcatctcattgcctacttgccaagcctttcaagttattccttcatgtttcttctcctatccctcaacacacacacacatacacacacacacacctgtcttgtactcatcaccttggaatgacccaaatatccacttcctcctctcctggggggaaatggtgtaattatattaggtgctctgtattcttcccagagtcatctggttctgtaggtctgcaaggctgcctatatttgtttcctggggctgttgtaaccaagtgccacaaactgagtggcttaaaacaataaaaatttattaccatacaattctgaaggctaaagtccaaagccaaggtgtcagcagtgcggtgatacctctggatcccataggagaatccttttttgcttcttcctagcttctggtggtttgctagcaatatttagcattccttggcttgcagaggtgccacttcactgtcttcacaggacactctccctatgtttctctgtcttcacatggctttcttataaggacactagtcaacttagattagggtcccataccacttcagtatgacatctttttaactaattacatctttgatgaccctatttccaaacaaggtcatgttctgaggtcctggggttcagacttcaacatatccttactatctcttctctctccctctttgttagtttcatttcttcagccaataagtgtttccccacactaccaaaaatctgcttgtgaccgtgactgcccacatagttagcccagctccctggttttcattgccaaactctttttccagctttttctctgcccttcactcctccatctgtaattaatctattacacatctgttcaaacagctctctcagtaaggtcatcagcatcagcccatttgtcaaatccagtggtgtcatctccatcttcaccctatttgaccttcctgcagcattcaataccagtattatcacacttccttgaagggcagctcttttctgaccattatgttgtacccttaagggtctcactagacctcctgtctttccccaagccaactggatccttacttctgagatcctgttgtacagcagtgttcagtgtgtggtttatagactcatgagggatcccaataccagttcctatgttgtcaaaactattttcatagtaatacaaaggtatcatttaccttttaaattgtgttgacatttatacccatggtgcaaaagcaatggtagttaaaactgctggtactttagcatgaatcagtgcagtgccaccaaattgtgctagcagtacagtcatgtgtcgcttaacctcaggaagatgttctgagaaatgtgtccttaggtgatttcgttgtgtgaacatgatagagtgtatttacacaaatctagatggtatagcgtactacacatccaagctctatggtacagcctattgttcctaggctacaaacctgtacagcatattactatactgaattcggtaggcaatttttacacataagtatttgtatatctcaatatatctaatcatagaaaaggtatggtaaaaatatggtattataatcttgtgggaccacagtcagatatgcagtccattgttgaccaaaacttcattatgcagtgcatgactgtatttctattcatcacagccacacactcacagttaaaaaaagaaaaaagaaaaaaagcagaaaaagaaaatgccaattttacttagaaatgtccttgataaggcagtaagttttattcatttttttaaccctttaaccttaagcacatacctttgtaatattctgagtaaaaaaatggaaagtacacatgagaagcacttctgtgacatccagaaatacaatgtttgactggaggaaacattctaagctgtcctaagctgcccttggtacttttctcatggaacaccatttttacttgaagaaacaactgacaggcaaagtatagttatggacactttggtatttggcagacagtttctcaaaaatgaatgaaatgaatctgctactataagaaaaataactgaaagtgtgtgttgcccaataataaagaatgagctttcaagcaaaaattaaaattttggaaaacttgtatccaccaatgtgaattccacagcttttgaataagatagatggtagatagattaaaagtaatggcaaaaatcacaattacttttgcaccaaactatagtattaatgaatgtgatttttaacactgtattgaaattggtcaagttggaaaagttatataactcagggaaccaatattgtctaaatgattaatgtacactattatgaaatcattgcatgggttaaaatttattcaaagtgaaaaatagataaatggatcttaataaaatcatataaaatgttatgtgattatgcagtacactttaagaaactactacttattgagttttgatgagatatcaatgaagaatactcacaattatttgaagggctgttaaaatactccacccttttccaaccgcatatttggatgaggccagtttttcttcatacccttcagtcaaaacaacttggtgcaacagattgaatgcagaagcagatatgagatccaggtgtcttctattaatgtggaaattaaataggtttgcaaaaatgtaaaacaatgtcaatcttctcattaaactttttcttcttttggaaaacagttatttttcattaaaaagtttatgttaacaaacaaagggcttattattattacttttaaatagatttatatataaatattttcaagtttctcagttgtaatttctagttcaataaacattgttaaataaaacccacatttacaaaaattctttaggatcctcaataattattaagagtgtaaagaggtcctgaaaccaaagagcttgagatcgctgctgtggaactttattcaaacaggatgctacaaagagaactaacgatcgaggagaaattaataatttattggatttgttgggcaacacaactggagaaaaatgggagccagaggacaacaaaatattattgtgtccctggtgagaacctgcacatcaagaccacagaagattttctgtaatggcaggtggagaattcctacagctagtgcttttggtgacactgttttgcctcagtgtacatctggtggcttcattgtgctggatctgcctctaactaatttggtctggtatcttgttgcctcagcaaatgatatgtgtgtaatgtcaccaatggaaacaaaaatagagaaggctagcaagtccctattcttggacaactgtcacccctacaaataaaggtcccaaaaggcctgaaaagagaggacatgctgagtaaatgtcagctgtttattattatcatcattgtggactttaagccccatatgatccagtgaaaaacctggtgcctgagctctggactacaccccaggtttggtgcaagagctccttttgtttttcagcctaagcccaaaacaaggaatatcaaagagtttcacgtcaacggccaattctaacttggtgggagttggtgcctggagccttctattgaggatcagtgggaacaagatgttctcgatgtctgccaatgcctcaccaaggaggtagcacattgtcagcaccctctaagcctaaaacctggagtccttgattctttgctcctaatgcagtctcttgaggccaaactgctctgataaactgagatgtgaagcataaaaatgaaatatgaaatgaaaaggaaggaattagactcaaaggaaaaagcacctcgctttcaaaagctagacttaatggcccaagctcaggcattggagaggtgatgagaaggtgaaactcccaccctggaaatgggaaaacataccagccacaaagaagacccaaggattctgtccttaaaaaaatattatactctatatagaaacaagagtttttaatctcttaattctcctattcctgaaaacttcccaaactaatcaaactaccagctgtgacttgaccagttcagagtactctcattgtgaggaaacagaatgcattttagtcatcagtattcctgctcaggaaaacacagtattgttgggacacaattccgtaatgagactacttggagtggtagctgaagccctgagtctgggagttggctgatcccaaggcttaagagatgaagggagacaaaaagcctgctctgcataagacaaggaaaaattcttgttttgttcgtgatgggaaaaggagtataagaaaaaaactgaaaatgcgagaaagaacccctcaaatctccacaaatgtcacaaaaaaagcaaaagcttttattgtattctttggggtccttggactggtataaaagagaagagtgtgggcagacaaaggagtcaaagataggagggggaactgcagcctggggattctcagaaatgggcagcagggtatggaatcatcaccaacatgggcttgaaggtctgatacaagttgatctggatgcccaagaggcaggaagaccttccctgacattcgagttactcctcctgtggagcctcagaagtcagtgtttttacaaccccacctcactatgttgattctcttagatgtgatctaattaaatataaatgctcttattaaaataagcatctcctcctatcaacctgacagtataattctttatcaagttgacagtatctctctagtcagggtcacaaggactttggcctggtcctggctctgctactgactgtccatgtgcccatgggtaagtccttatcttttcagatctcagggttctgactcgtaaaatgatggaggtgaggaggaaaaggttgagttcatcatctcttaagtccattcctagttaaaattctatgaatcttgcagtattaatatttcatgcatctccatccttacttgtactcactgttatgagaaattaccttttactgttgaaataaaagaatcaggttggttgtatatataatttccttagtggaagtttctctattaagaacacactagcttataacatatactagttttcttataataaggatatttttatggctaagaggaaccagacagatcagacagatggtattaacataatgcctatatattttttcttttttaattctctagttttctgttatgcctttctgcagtgttctgggtgtcctcttacttgtgtgtatctgcttcacatgttagattgttagatggttgagggtcagaacaatgtgatactcatctctgtatcctcttaaagtcttgagagagaccatgcctcatacaaagtaagcatttaatagatacttactcagttgaattgaaattgtgtattgagtctaaagtttttaattactgctttgtattgtgatagcttggttatgctgtaggaataaaataattctcaaatctcagtgatttaatgcaatagagattttttttttccttgctatggcagagttggctatagaatggggttggagtcgggagaaaactatttctgcttcatacagccactcagggacccagagtgaagagaatcctgtttctgacagctgtaccttttgaaacacatggcctcttcagagaaataaactgaaaaattactcgagggctttcttctgcactctacacgtatttcattgaccaggactaatcaaatggtactgcctgactaggaaactggatggagtggatcccatatttttaggcaagaaaagtgcccacccctccctaggcctggcatggtggctcatgcctgtaatctcagcactttgggaggctgagacaggtggatcacttgaggtccggagttcgagaccagcctggccagcatggtgaaaccccatctctactaaaaaatacaaaaattagctgggtgtggtggcacatgcctgtaatcccagctactcaggaggctgaggcaggagaatcacttgaatccaggaggcgggggttgcagtgagccaagatcatgccactgcactccagcctgggcaacagagcaagactctgtctaaaaaaaaaaaaaaaaaaaagaaagaaagaaagaaaaagaaaagtgcccccaagattggtaatcacaatatttaccatatgctttactcagtagctccagtattttggagataatgaacttctttgagaatctaatgatcattatgatccctctcctctacagaaatactcaacattttgcgtaatttcccatttgtttcatatactttgaatgctattcactggtcctctagagaaccttggaccaagattataaatcattcaggcatgttttgcacctggcaacagatctacagatgaaaaaaatacattactggtgttctatttaaaccatatgttattaacagcctatttatttagttgtttgtttttatcagatatgacatcatacgagatccatgccatggccaatggattttcctctgtgtttgtttttatcaggaaaaatttgagggactgtttcggacttatgatgactgtgtgacgttccagctatttaagagtttcagacgtgtccgtataaacttcagcaatcctaaatctgcagcccgagctaggatagagcttcatgaaacccaattcagagggaaaaaattaaagctctactttgcacaggtaaggtaattgtttaccaaagttattctttttgccctacattattttttaccattttaaaatgtaaatgaagccctttctattttcagattggttggtagtctataaattaattcactgagaaatagacccacatcatgatttccagacagaaacagcttagtggcttagaaaacaggctctgagagctgcctaccagagcaagttacataacctcactggggctccttattctcatctgtaaagtggggatgatcaagatctacaccccatactgttatgaggattgcatgaattattgtgtgtttaagtgcctaatatttggcaaatacacaataaatgcccgctagtagttataataagaatgacgtaatcacagctattcctaaccttcctatcagggttataattaaaacttaaatcatatgacagctttagtggaatgtataacttttcaatgattcatatttatgagaaaaggtgacaaatatatggaaattaatttgtttcatccaaaaatcaattctagctcttccaaaatgaaatgagtaattcttggcaatgcttatgaagttcacagcaatagaaatcaatatccatcatgttccattagtgccctcacctcatcactagataccttgatccatctcttaagtgatctgtaagtatggtttccaccttcagattctacagagatggcacagtgaaaagaacacagacattggccctgcatccatgttcaaattccatcattgctattctaatgtgtgtgatgtggacaaacctcagtttcctcgtctttaaaatctcactcagttccttaaaaagttaagcattgaattaccatctggcccagcaattcgactcctaggtatttaaaacaggtactcaaaaaaatacatgtacacacacgttcacaacagcactattcacaatagacaaaaggtggaaaccattcaaatgtccatcaatggatgaatggattagcaaattatagtatgtccatatgatggaatattattcatccataaaaaggactaaaatactgataaatgctacaatgtagatgaaccttgaaaacattatactaagggaaagaagccagacacaaaaggtcacatattctgtgattctacttataggacatatcaagaacaggtaaatctgtagagacagaaaacagcatggtggttgccagtgaccagtgggagacaggaatggtggtaactggtaatggtagtactggtagcaataggcagaggagttcctttaaggtgatgaaaagagcttggatctggatagaagtggttgttgcaggttaggaatgtactaactgccactgaactgttcactttcaagtggttaattttatgttatgtgaatttcaccaaggaaggaaggaaggaggaaaagagagaaggagagaaggaaacatttggcaggtgcgtggtgggacagtggactggcagccaacagcatagcctggggatctattagaaatgcaaaccctcaggccccatcccaggcctcctgaatcagaaatgtaggggatagggctcagcaatctgtgttttagtaaggactgcaggtgattctgatgtacagtaaaggttgagatccactattttcaggattaaataaggcaattgagcacatggtatgtggtaagtggtaattattattacggtcgggttcatcggttcatttgtcgcaggctgaaactaaacccatgttttaatgtgccaacatgacacatctgaagccatgatgaataagtttcttcatctctactctatttgaaaggttcagactccagagacagatggagacaaactgcacttggctccaccccagcctgccaaacagtttctcatctcgcccccttcctccccacctgttggctggcagcccatcaacgatgccacgccagtcctcaactatgacctcctctatgctgtggccaaactaggaccaggtaagctttgcggtccattttaaaaataaacgtttgtcagcaacctagaaaagccaaatgagattaacaaccttgagatcctgggttcacagtaacatctgcatttctaatagatttattcctctgtgtggacaatgagagggaatgatggatgagaatgcagcatcagactttgcacccgttcaaaaagcaactcaggaacctgtactaaaatggtgtcaagtccatgaagcttctggattgcaatgcagatattttaagatccaacagcactacctaattcttgtgggatttaactctatcccaggaggaaattgtttcctcagaacagacaaaatgaaccctaccagctggaaggaggcatctatgctgtgcaacccagttttattgctgtcacagtgctagtacacactcaggaaccccctgttacaagaaaacctgcctgccaaagtgaacctccaagttcctaagaagtcagtcacagcagcctctaactttaaaaaaatcttagtcactttgttctgatgttggcatatgtagctctgattcactcattctcacgcagtatagcattctaaaatatgaatctaccaccacactttatttagccactctcctgttgatggacatttagattatttccaggttttttgctattacaatcaaagtaacagttaacattcttgtacatctctatgcacttgtccaaaagtttctttaggctttgtagttagaagggatactgccctcaatttcagcagatgatgacaccttgcgccccaaagtatttttttctgtgttatattaggagaggaaataatagaaattgaaggggctgaaaccaggtggcagctgagatttttagcactgtgaattgagtggtaactaatggccattatgtctgctctgtctactgctggttatcttgggataggaaggagctttaaaaatagaatctgaatgcctgaccccaccccaagagattctaatttgatgtgggtaaagttcaggtatcagtacattttaaaagctcccccactgattctaatatgcagataagttcaagaaccactggtagctaaatgccaagtaccaagaatagtcaacttataagttcttaccagcatttcttaatgtagcaggaaaacatttggcccagagtcgcccaccccagaaatctgcagttttgataatcacatctgttgatccttgtatacgccaaaacctgagaaccctaggaattatggtgaccaactgtcctggtttctccaggactaaggagtcccttggccataggaccttcactgctaaaatcagaaaattcccaggcaaaccaagaaaagctggtcgtcttaccaggtacctagattaagatgatgctgatctgattaataagcacttcttgcaagaagattgccagctgttgcatgtatgtcctgaaagttaaattatagaactttcaagagcaagctcactggaggtttccttgtaatcaccatcacatcactcagcttctcaggccctttaaaatggccataagttttaccttcaagaagcagtaggtatgtctaactaacatgtgctgatgaaagaagcaatataataataagagagatgttagtgaaatatgatttcattaaacgtctggttcacatccaggatcctgatcttagaccctcccccttcagagagccacatgtgtgatatgcttaaacactgcacagtgtataaagtaaattaagtctactcacatgaagccttgtgaagccctttcccacagtcattcaggacattgcagaaacaagcacacatatccaaatggaccaatttcagccaaggtccttgaagctgccagtttgactcctatgcacagatattgacaaggacacacttgaacactttgtagaggtgttttgaatgtcagcaaacagagctctttatagaatcactaaggtcttggctagaggacctaggagtctgacctggattttacagaaaaggaaactaaggcccagagcgaagcagggagctgatttgacaatgaaagtgccagagcttccaatgctgtgctcttcctacttcactatttagaaaggaggctcaggctatgtcagactttctaaccatcacaccccagctggactccagctcactcatgtggagctgatcatccagtaaaattcaaatcatttttatcaagaatgtgaaagaacattagttgttgtcagcattcacaaagattgatgcagaaaaagctaggggcaagttccagacacccttactggctgacccagctgagtccaggctctggaaggcacagacagggacaaatgtgacttgggactgatggaggcagaaggcacagatgggatggaaattaggccccggaagggacgctcacagagcctgacacagaagaggaaggaaagaaagagggaggaaggaaatggtcttaaagaggcagagaaaaaaaagcagttggcgatgggggatggggagctcggagtggtaaataacttatcaataatgttaaaaatacacgccttttaccttaatgttacagctaatctatagcacccaccttcttttatcacaataaatgtaccatctaccatttttgaagggccctgctttgtaataaacacagagataggacctattattatccccattttatggatttggaaacgaggctgtagaaagaagcatgaactttcccaaggtgacacagctggttggtgacatcgtcagatttcaaaccctggcgcttctgactccagagagtaaacttcacactccgccagctggccttctattaaggatactggttggcttggctgacttcaggcctgctctgcttcaactctggcaaacatttatttgtttttaaccctgaatcaagaattatttcttggtttttttttttttttttttttttgagacagaatcttaccctgtcacccaggctggagtgcagtggcacaatatcggctgactgcaacctcctcctcccgggttcaagcaattctcctgcctcagcttcctgagcagctgggactacaggcgcatgccaccacacctggctaatttttatattttttagtacagacggggtttcaccatgttgaccaggctggtctcaaactcctgacctcgtgatccacccgcctcagtctcccaaagtgctgggattccagacatgagccaccgcgctaggcctcaagaattatttctaacaaacaccaatctaaacttccagaaagcctaacctagtgtctggtaaatgtgcaaatggagacttgtgcatttggtacaagagcaaatattgagagtttcctgatttttaagtatgactgatattgtgtccatggaacagctgcaatctggatgtattttctaggatatgtttctctccattccttgccagcaatttgggactgtttgtctttatttggttatccatttatcccttttctatgtccttgaagcttcctcagccacacacatgcatgatttgcgtccaacaattgagttgaaaatatcagacgttaaattaaaggttgtttcagctgcaacaatcagggagcagggccacacccttcctcctccccatggcatcctcccccacatcgcgtctctgcccccttcccaaccaggtgccaaggcaagaggttgctccttcagtctcctcctgtcactttgcacaaatattcacttttccttatggtaattttctatcattcaacttactatcttcacttcttactgagggaaagaatgcatgtttcattcattttggtattcccagtacctgaaactacctggcacatagtggatgctcaataaacattggaggaatgaatgtgtgaatgaacgaaggaatagaccagagctattagcctgcctagagatagtttctttactgacaaattgttgctttcttatagctttagccagactcagtcgggaagcattaaattaatgttttctataattagaggacttctagcattttcatttttaaaaaagtgatttagtaaaatttagttttaatcctttggcagaatcatttcagtaacaaattataactaattgcatgttaaagaatgactacctcagttccagaagtacagaaacaaattagaatgggagcagaggaaagcaactcaaatgatcaaaggaatggagttttgcattagaggaatgatgaacagtgtttaattggtagagcagagtgattgagaaggtatgtagacatttaaagctgctgggaaaaagtcagtctaaagaaagaacgttatggagcagggatccagagtgagatgggactcgggctaagtcaactgactggctgcccccagaggcaatgacacagtttattaggaccctttcatggagaacaaatgaaacagtggggatccaggcctcatctcagacaagcaaggggcaaaacagtctgtagttctttaaggaggaatattggtgacctctcagagagggacaagtccaattcctgaaaacttctagagtggtcctagaaacaaacataaagaaagcagtgcagttataatggaaccatgatcagacccaaacctgtgggtgcctattgaaatcctttgaaatatttaagatgttgcgacaggagacgagggccacgttatattcaagaagtgtctctcagttccctttattataccaagagcaagtttatattccgaaaattatgagaggcataattttaaacatccttaatcattgtccccatgaccattctatctttgatccagagagtaagtaaaataggtattatacattagaaaataaataaataaaaatgacttaaaattatgtggggatgaagataaattacttactatgtgccaggcactgttctaaataccttacaatattatttaatgttcacagacaataacaggtattattattgtcctcaattatacagctggggaatgtgaggcacagagtggttaagtaacttgcccaaggcgacacagctactaaattaaaatatgtcctctgccactggcaagaagagtaaaagattggttgagccagcacccttgccctgggaagtgaaacatttttctctagaagaaatttaagattgctgtaaaggagaaatttaagaatacaaaacaacttatgcctttcgttccctcacattttatttctctactttttggcacccactaaaacacactactgcatcaattctttacggtacatttcatgcttttttcttgtgtccagcaggacgtgcagatcaaaatttgccttcctctgtttaaggggcagttattgtctctataaaacacaatccttgtgtgtttctattagtcccttggggaatgtgtagaagcccatcagtttaacagtgacctagacagaataagatgggctctgaccttgaggagaattatgagttgaatatttattttgaaatatctgttgttcctgactccagaagcagtacagtgccaggttcttttctgatgtaaaacaaaataggagaaaataaaaacccagcctggcaaaatagcttatctccaccaatcagcagaaaatggtaaaatagagacgcacgtggcactaactagacaggaaatcagaggtgggaagcaaaatgccagcctttattctgctctctaagatggctctggaaggtcatgttcattgtcactgaaaatgcctgcagggagcgatatgaaaagtcattgtctcttcttttttttcctcctgctatttttagctcttgttaggaagatcaattttagttaactgcagagaagggtttttaaaatggtgcttgagtttcaagttgcatgtgtctgctatatttagatttttttccaaattcttctgtatcaaaacatgacatagtaaggcaattttgctggtgttactgcttggtatggtgttttccccaatgggaaaagatattccattaactaatgtaacctatactaaagaaacattttctattccaggctctgattcagaggtagaaaaaaattcagtttttaaaatatagatgaacacctatgtttttggtgcatgtggtatgaatattatataaggcctcgattctcattcagcaattgctgtattctctgatcacaaaaacaataggcaagtaaaacagtgagtgtccagtgttcccattagcacagtctctctgtgtcataccccacataagggactcagattgggatcctggagcacatgttcaaattttcccattgcctttgaaagaattgtccctggaaaaaaaaggttttttcagaggcttttcttcccagcatatattccattaatctatcttccatcactatggagtagcaatattaaaatacttccttttctaaatttacaggtaaactgtgtacattgtagaaaaacagaagacatatgaccaaaaaatgggaaaatatgaataacaaatcctactgcctataaaaaaaagtactttaaggaagaatcattgtagtgtttacccttgcattttttcttataggtatgtgtgtgtgtgcatttgtgtgtcctcacagttgttgtggaggctgggcccctaatatggggcaagggagaacaggatgtttcattcccagggaggacccagctcacagagggctctcccaggcagctccccctttcttcatctccgccactttcctctcaccccatgtggaggagcccctttactctggtcgctctccctctttatcttcccacctctttcccctctgtggttcccttagttttctttgcctataccttccctccgggattctgcttctttttctcaaccattaattcaggtcctcagtcaatcagttgatcccataaagtactttgggtcctaaatgtctcaggaagggttgaagataaatctccccattcccaatctagtattagagagaaacctccagaagataagcaaatgttcttatactgaaatatatatagctccccttataccaaaactacagagtatgctctttgtcttctttctttcccttgctctcttgctcactctcatcctcccccttccccatcttaccaaggaccccttcttatttcctactttgatatggatcagaactgaggagggggaggaaaggaaagagaaccccaattatttcatcaatattttcttaaaatgcacacatacaaggcctactgaggcagaatgtcagtttacagccctgatgccacctgcagcatcccaacctcgtgcatgcctaaatctaggaagtagtaaggcggttacgctggtcgctcagcagacctggattggagttcaccacttttctctgggatccaccaaagttcaataggagctcatggaaacacaaaagaatcagagagaaaaaaggttacaaaggactgaattccctggactctgtcttttaatcccaaatcctctttccacttccacttagaagataagttctttctctgctcccagattgagcttgtgaataggcagctaccaaatagctatgatttttatgtttccaataagtctctctgcacccagaatatctccttttattttatagctgtaaatggagatccaacatgaagagaggcttttctcttgcctcaggatgatgattgaaacataggatgtgagtttgaatctaggcttctagcctccacattttattagctctgtgaccttgaggaagtttcttaacttctctgtgcctctgcttcttcaatagtaaaatcagtttgtggcaagcatcaaatgagataatccatataaaactgtatatccagtatcatacataggaaaggctcagtgtatgttaactatttattatcacttgattttcaaaccatatattagccttctattaaaatgtgtcactgagtgtggtggctcacccctataaatcccagtctttgggaggctaaggcaggaggatcagttgagcctaggagtttgagaccagcctaggcaatgtaatgaggcccctgtctctacaaaaaataaaaaataagattatctgggtgtggtggtgcacatctgtggtgccagccactcaggagacagaggtggatcacttgagccaagaggtcaaagctgcagtgagctgtgatcctgcccctggactccagcctaggtgacagagcaaagtgagttcctgtctcaataaaaaaataatttaaatgcctgtgttaagctcttagctcagtgctgctcaatgtgaaagctatgatattttggagttgacagtcctacacattgcagtacatttagcatccttgggtctcacctactaaatgccaacatccacccacaccatatgacaaaaaaaaatccatttccagacaccattaggggtttaacattcttatgtgagaaccacactaattatactttcttgaatgtgacaaagagttgtcacaggcatagaggcagagaacgcctagtaaggggtcggcgatgtgtgcagaaagaagagtggaagaggtgagatgtatagaggagcagcccctgcctcccagctttcctcactcctctatgccttcccagacacacacacactttttttccttccctttagaaaactaggggaagacaagaacaatgagaatttgcatggcccatgtccatttatcaattgccacataacaaactatcccaaaaatctagggcttaagacaacagtcatttattttgttcacaaatctgccatttgggccaggctcagggggaagggtcatctgttccatgcaatgtttctggggcagcacaactgggggctggcaagtcaactatgaagatggttcactcacatggttggcaaaatggtgctattagctgagagttcacttagactgtgggtcctggttcttcttaacgtgggcctctttatgggctgcttgggcttccttacaacttggacatagggttccaagcatgagcattctgcaagagcaaagtagaagcgcatagcatatttgttacctaattcagaagtcacactgcttacttccaccacataggttgaggatcccttatccaaaatgcttggggccagaagtgttttggattttggatattttgggattagcgatacacaacaacctgtactatatttgtcaagacaatcattaaagcctgcccaggattgaagggagagaacacagagggaacactccttaatggaacattgtcaaggttacaggagagtatgtggggtgggaaacattatgaccatctttggaaaacacaacctgctaccacaaataactttcctgttgagaattcacccgtaatatgagagatagtacagttttaaaatgagaatgtagaggatcttcttccagagtccaaaacttccttccctaagagatgcagattaactcagtttataatttatagtctcttcttttcataatttattgtgttgtcttttgaggagattcattgtcaaagagaccatgcctagaataactatcaatggccaaaacaaaacaaggcaaggttcagaaggaatacatgatccatctttagctagagaacaaatattcactaaaaatatgagttgccatgaaaatgtattaaaagtgaaagacaaaactaggctccctttcagtagagtcgcttgtagaatatgtaaacagtgggaagtatgagagttagggacagagaggggctatgaacacattctttgaagtcaggcaagcctgagtttaaatcctggctctgccatttactacctgtgtgatctcaacttactgttgtataactagatattatgaaacccacatgacagagctgttgttataattaaagatctatttcatgccaagtagttacagactttcctgtgcctggcatttagtaagtgctccataagcaattgttattatgtttagggaatgtagtgagtttctatgacacctactgtgtgctagcactgatagaatgctgataagaggatagatgcttgcctttaaatggttttccacttagttgaaaagctaaaacttacacaagttaaactataggaagaatattcacgtgtgagtacataccagacatcactcaagtatgttagtaatgaccaagcgtgatgctcttcataaatcaatcacatattcattgaacactaatgtgtaccttaagctgcagcagtcacaaaaggttaagtcttgacttcagtggtttggaatataacacattgctagaggaaataactaatgaataatatcaaaggtgatataattaagcattataaatgggtgtttctatctcaaaaaaaaaaaaagaaaatcagagatctcattaaaacggcaacataagattttctgtctcatggaaatagaggtatagaaaaggttaggaaagaggaaaaaaaggagagaaaattgccagtgatgacagagaaaggggaagtggtggttggaggaaaaaggataggttcattttgaagaccagattatatgatacccactaccgtgggatgcagcctgttatcgttcaccccttactgctctttgcaatggtgtctccactgaggaaaagctctttgcaattgttcagctgcttaattctttgactattgtgtgatgtaatcagattagttaatcatactggaaaccagaaattacttgggggcaacagtggccaaaataatatcgccctaaataatcatagcatgcatcttgggagagggctttatcaagtatttgacacatatgtctgtttcctagtatcccagtgatatgagtgttgttctcattgatgaggaaaactgagattcagaaatgttatataactttctcagagtcacattactcatatgtgataaggtgatctctccaactgttgtcttaggtggcttattctggcacggaagttagttcctgtcgtggggaaaccagcaaagagtattttgggtgggagggttagtcatggatagggttataacaaggggtgtgtagggaaggagcatgcagagaaggtttgacaagcaatgttcaatagtgcttggtgactgattacaaatgatgaaagagagagaaaattcaaggatgactgactctaaggatttgcacctagaaggctggaagaatgatggcaattctaagaagcgtgatagctggtaacggaacctagattggcagagaaaataattctactttagacatgtgagtttggaaaagagtagtcaacttgtagagagacgtcagtaagtcaggatgcatgtgtgagatcaggcctggatatgtagctcctcatagggcaggaactggggctcatgatgagcaagagaaagaatgtcctggaaagaagggcagcaggtgctgagcagagcaaagcttggccttgcctgttagatgtggctgtattttcaaagcctctagttctgggattctatctattgcttggcagtacacatacaaagactttgtccagcaggcactaaacttataggaagatttccccttccttccatcatagagtttttcttattaggaatctaaataatgaatctcaaaagcttctctaatacatagacatgtagctctgtttcatctctctacctttaccttgtctgaattttgctgatttttataaactttgcataatcatactgattattttagaaagaatttaagaggtggccaagtcatggcccgtaagccaaggtggcatgagagagaaactcagtggcacttggactgccagccaccaacacatttctctgcaattgtggcaagtgaggttgtaccatgtcaccaagtttcccagcccctagtcagcacagggactcaccctcctccctcctgagaatgggaaacagcccatgggcaccctcactccctcctccagtcatagaggaattgggacattgtcacaaacctgtctccagccacttgggaaaagacgagacagaactttggcatctaatttaagcaatggccaaacctcagtcagtttcaaaggcctgaatgagaatttaacgttaaccatgtgctaaaaggtttttcatttaattggctgaaagtttgtttcatggaataggtagaaaaccctgaccaatgcacttgttggtgacttttggtcctggcctcctttctgcacacaaaggagaggacagtttcaatactggcagaggagtgagcatgtgatgggtcaaccctctgcttgtcttttcagagaaatgctggttccattggtctgttctcactgcaccatggtgggacctcccaccctgtgtgggtaagatttgacagactctctgtccccagacaagcccagttggtccatgtgcctggtgacagcattgacgtcagcccttgtggtagaggaaatagttgaagcccaaagggaaaaagaggccaaaaaaagaaaaattcaatccaacaagaccaaagctatttctttttattttgtggttctcagcagctgttaagctttgctggctttcgatagtaagaaagtgtccaagaatagaacagtgcaatgtcagagttaatgggatcacagcaataaaatgtctctactactgagcaatctgatggtattaagttgatgtggaagttgctttgcaccctgcacacagagtggactccctgcttgccctcccattctgagtgttcccccaacacacctattctgagaggaaagcaaccacttctaaagtggtaaatgcattgcaaaagaagtgtcttcaggccgggcacggtggctcacgcctgtaatctcagcactttgggaggctgaggcaggtggattacctgaggtcaggagttcaagaccagtctggccaatatggtgaaaccccgtctctactaaaaatacaaaaaattagccgggtgtgatcgtaggtgcctgtaatcccagctactcgagaggctgaggcaggagaatcgtttgaacccaggaggcagaggttgcggtgagccaagatcgtgccattgcactctccagcctgggcaacaagagcaaaacaccatctcaagaaaaaaaaaaaaaaaaaagaaatgttcttcatctcagccagggaaaaaaggtttaatcaaaggcctagctttgttaggtgtattttattacaatttctttaaaatggccagcttcttgctaacagatggaaaaaggggaagggtgtctgagatctccgaattctctggcctgagccttgccctcatctcaaccccaggttctgggtctctgctgcagattcctttctattcctcatttgaggatgacagaggccatccccctttcctcaatgcactccccatccacagagcaatgaatgaaactacagtggccaccagtgtttcttcaaaaggggcttcccctgcaaatgtaagaacttaaaaaaaaattctatacataaaaacaagaatcaccaccatatttgatgactcagcaaacatttctttctctgtctctctttggatggtgtctttcattcagcattgcaagaagttcctgaaggaaagacaaaatttgagaaaccctggatgcggttaactcaatcattgttcaccgtggaactttgagtgacttgatgttctctcctgaacaacaatgagaacaccaaagatgaacgggagctggtggctgggagcgccagagaagccatccaggattccttacctcctttcctttatgcattctcagcttccatccctccattatcctctacctgcactgttaccatttaccattttccagcaaaaaaatatgtagaatggaggaagggagggggcacattgtgtgtgtgccagtatcctcatggggccacagcctcttgctgggagttccatgtaaccgtcaccacccaaacacagaagcactgagaagcacttagggctgatgggtacacatgtagattctactaaatcggaatttgcaggtttgcttccctatactggtaaactcttttttttttttttttttttttgagacagtcttgctgtgtggcccaggctggagtgcagtggcatgacctcagctcactgcaactaccacttcctgggtttaagtgattctcatgcctcagcctccgcagtagctgggacttcaggcatgcaccaccatgcccagctaatttttgtatttttagtagaggtgggggtttccccatgttgaccaggctggtcttgaacttccaacctcaagtgacctgcccacctcagcctcccaaagtgctggcattacaggcatgagacaccacgcccgacctaaactctttttttaatgagcactcccagttaattgtcagtgtttaagaaccactgcttagagacacccccaaccagagctgcccactctgacccagagcctttgatacaaccctcagataaagctggtttgttgtagatttctctccttagcaatgtctgcagattatctgtttacccggggacatggattaaaatgccaaaatattttagagagaacagaacccacacaattaagtgaaccttacttagcatcgatacatacagcactataccgcatatgcgtagtttgcaacttccccatggattacagcgtgctgggttagtgccaactatcaattcttgctccgcagggcaggatagcaaagtgatcaggcagtcatctccttcctgggtctcccctgtatccctgctcctgtcactgtcttcttctgtatcagactgggccacatcagcttgcttgtatcagagattcaatgcttgttgatgcagttctccctgcctatgatttcaccacttctagactttaaatacagagtcatatcagccatacttcaatggctgtggctggttctatttctctgtactatcaatatccagggaaatgctggagttgtaacactctatttctgtgaaatatttgctgccctcacccaggaaagcctttactctacacagcaggatgtcaagggcaagaggtgcctaatacagacttctctgactcttaactgaatgagcacactctcagcagggtatggctgtgttcgtttgctagggttgccataacaaaatgcaacaaacctccgggcgtggtggctcacacctgtaatcccagcactttgggaggccaaggcgggtggatcacctgagatcaggagttcgagaccagcctgaccaacatggtgaaactccgtctctactaaaaatacaaaaattagccaggcacggtggcgtgcacctgtaatcccagctactagggaggctgaggcaagagaattgcttgaacccaggaggcagaggttgcagtgagctgagatcacaccactgcactccagcctgggcagcagagcaggactctgactcaaaaaaaaaaaaaaatgccacaaaccgagtggcatttatgacaaaaatttatagactcaccgttctggaagttagaagttcaagtcaaggtgtacacaggaccatgctgtctctgaaggtgtcaggaaaggatctgttcctggcctgtcgtagctttgggtagttccttggcttatggctgcataacctcagtcttcacatggcattctccctatgtatatgtcaatgtccaaacttcctttttctataagggtgctagtcgtattgatgtagagcccaccctaatgacctcatcttaatttgatcatctgcaaagaccttaggtccaaataaagttactttcacagctactagaggttagttaggacctcaacatcttttgaggggactcaattcaaccaataacaatggctgactctgaatgtctacatccttcccagcatcacttagaagggcttcgatatttattgcattatcagtgttcctcattccctaacgtcagcacccagaatttaaaactgtaccttggagagaggttccaagatggccggataggaagagctccagtctacagctcccagcgtgagtgatgcagaagatgggtgatttctgcatttccaactgaggtaccaggttcatctcactggggcttgttggacagtgggtgcagcccacagagcagggtggggcatcacctcacccaggaagcactaggggttggggaattccctttcctagccaagggaagccgtgacagatggtacctggaaagtcgggtcactcccaccctaatactgtgcttttccaatggtcttagcaaacggcacaccaggagattatatcctgtgcctggcttggagggtgccatgcccatggagcctcactcactgctagcacagcagtctgagatcaaactgcaaggtggcagggaggctgtgaggaggggcatccaccattgctgaggcttgagtagataaacaaagcagccaggaagctcaaactgggtggagcccactgcagctcaaggaggcctgcctgcctctgtagactccacctctgggggtagggcatagctgaacaaaaggcagcagaaacttcttcagacttgcacatccctgtctgacagcattgaagacagtagtggttctccaagcacggagttggagatctgagtatggagactgcctcctcaagtggttccctgacccctgagtagcctaactgggagacacctccaagtaggggccaactgacacctcatacagccaggtgcccctctgagacgaagcttccagaggaaggatcaggcagcaacatttgccgctctgcaatatttgttgttctgcagcctccgctggtgatacccaggcaaacagggtctggagtggacctccagcaaactccaacagacctgcagctgagggtcctgactgttagaaggaaaactaacaaacagaaaggacctccacaccaaaaccccatctgtacgttaccatcatcaaagaccaaaggtagataaaaccacaaagatggggagaaaccagagcagaaaagctgaaaattctaaaaatcagagcacctcttctcctccaaaggaacgcagctcctcaccagcaatggaacaaagctggatggagaatgactttgacgagttgagagaagaaggcttcagatgattggtaagaacaaacttctccaagctaaaggaggaagttcgaacccatcacaaagaagctaaaaaccttgaaaaaagattagacaaatggctaactagaataaacagcatagagaagacgttaaatgacctgatggagctgaaaaccatggcaagagaactatgtgatgcatacaaaagcttcagtagccaatttgatcaggtggaagaaagggtatcagtgattgaagatcaaatgaatgaaatgaagcgagaagagaagtttagagaaaaaagaataaaaagaaatgaacaagcctccaagaaataagcgactatgtgaaaagaccaaatctacatctgattggtgtgcctgaaagtgacggggagaatggaaccaagttggaaaacactcttcaggatatcagccaggagaacttccccaacctagcaagtcaggccaacattcaaattcaggaaatacagagaacgccacaaagatactccatgagaagagcaactccaagaaacataattgtcagattctccaaagttgaaatgaaggaaaaaatgttaagggcagcaagaaagaaaggtcaggttacccacaaaggaaagcccaccagactaacagctgatctctcagcagaaactctacaagccagaagagagtgggcgccaatattcaacattcttaaagagaagaattttcaacccagaatttcatatccagccaaactaagcttcataagtgaaggagaaataaaatactttacagacaagcaaatgctgagagattttgtcatcaccaggcctgccctaaaagagctcctgaaggaagcactaaacatggaaaggaacaactggtaccagccactgcaaaaacatgccaaactgtaaagaccatcgatgctaggaagaaactgcatcaactaatgaacaaaataaccagctaacatcataatgacaggatcaaattcacacataacaatgttaaatgtaaatgggctaaatgctccaattaaaagacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccacatattctcactcataggtgggaattgaacaatgagaacacttggacacagggtggggaacatcacacactggggcctgtcatggggtgggggaagggggggagggatagcattaggagatatgtaaatgacgagttaacaggtgtagcacaccaacatggcacatgtatacatatgtaacaaacctgcacattgtgcacatgtaccctagaagttaaagtataataaaaaaaaaaaaactgtaccttgtgaaagtttgctatttgcaccattaaggcttaccaagatgtgcacagtagcacataattagtgccctgtcactggaactgacaatacttgctccagccatccagtggaggcacttagactgagaatagcagattcctgggctgcatcgggtctagctttgatcctggaagaaggtcaggatttagggaactctggaggggaagtgaggctatgcgaagtaaaagtagctattttggtggccctaagaatgtagctgtcatgattaggggccaacagataaaccagtttgaccaaaacaaagaaggaactgatgcaggtagtgatggaaaagattggtgagagattacgcagggtcttctgtgctagactacaaaatttatacttgatcttgtgagatctagagagccactaaccaggaggatatctgggagttattgtttttggaagatttatcttttgatccatgaaagatgggaagtgaaggatgggatgtccggagaggattaagattagtatgtcaacaatgaagttgaaaagttacaagcatgcaggttgagaataccccctcctcttaccccaccacctggagtccttccgcttgtcttttagacccagatcagctgccagtccactaggaagcctttcagagttacttaccatttgatgccatagtccttaacatacattgccaccatagtgctcaccattttatattgtgatatgttctgtctccacatgtctccactggactgtgcacttgtgaaaggcacaaatactttttattctaccttgtagcctttatgaacagcaatagaccacgagagatgctcaagaaacatctaatgaagcaacagaaagacagaaagccagtcagctaacagccatttgactgtaatatgagccagtcaagaatgtagacacttggaactagaaagggccttgatggtcatctaacccagttacccagtaaccactgaatcctgggcatgtgataaccccaccttattccatcctggagcagctctggctgtaagaagtgtagagctggaggggaactcagaaactaccatattcaaaagataaagaagtgaagtgattggcccaaggttgctcaaaaactagcagcaaagttggaaaatagaagagaaactaatacgactaactgccaagtccatccagtcctcgccaccatcctacagagtggaagtattaccatgttgaaatttacggtaaaggatgtggaggctaagaggtattgagtggcttgtttggggttgcacagttgataagtggcagagccaggataggaggaaattgatctctttccacttgccaacaccctgtgccatccctgcataagatcacaggcttcctgagaccctggaaaatgctcctgtcatttcctaagcagaccctgctccaggatctcttttgaaatccccccctctttctcacttccatttttcttgcttttcaggagagaagtatgagctccatgcagggactgagtccaccccaagtgtcgtcgtgcacgtgtgcgacagtgacatagaggaagaagaggacccaaagacttccccaaagccaaaaatcatccaaactcggcgtcctggcctgccaccctccgtgtccaactgagctgcctgctccttctcgataatagccgtctcctctttatcatgctttttccccctgttgtttgtcaaaaaaaattgcctttaaattcctgggtgtttggttgtttgagattccttccttgttatcaagcctctcggacaaaagggctaggaaaaggtgatatgtctcctgatcatatcatacccattaagtataacccattatttagaaggttctagggaaaaaagtagtattttcttattaaacaatcagcacagcctatatctttgttctctcatgttgatccaagccagagacatcagtaacaaatagcacctgtgttgtttgtgagctgtttcagtcccagtcctgatgtgtgtgcgttgttctctcctggccacttaaataggaccatatgtaaacttgactttgactgcatgagatatccctatctggtctcactcagtcctctgcatcccaacattcccaggacatgcatgatcaccagcatttattttcatgatttgaggatatcttataactcacagattgtcagcatccagccatgtcctatctagattaggaaaatgatcagaatattccagctcaacaagtctgggtatattcactattgtgagtcaatacaccatagctctgttgaaattcctggaggcaaaattgaccttggccccaaagatattcctcaatagatttcaaacaccactcccctgtagaactctcccagcctcgttggggaggcttgtccagggtgatagagactgatttcagacaaacctatttattacaaaagtttcatggtgtctgaatgattgttttctctctttgtatatttgtacaaatgtttcagctgtgcttttaaaaaatctggatgttttttatttagtgattgttcgacaattagctgcttcaaaacataatgtgcattgcttatgaatgccttcatatactaatacagatactctgataatattacactctaataaggataatgctgaattttgaaaggacacaaaacatctaatgccaatatatacatgattagccaacatctttgctatcaagaccacttgtttttaaataaagatgcaagtgtcagttgtagattattgggatgaagctaaatccccagaatgcagcagcagctgagcatgttaaaatggggaaggatgatagctacatgtatgccggtcctactcacgcgacacccgtgtgctcaaaaaagttatttgtttttgttacgtgtgatttttctatttctctagcccaaagtgcattacagaagatacacctatagaaccattaccttctgctatgtgtgccaggcctcatctactcctgtacattaatgaattactttagatgcaaacgcagattacaatggagtggggaagtactttcattacccaagcctcagaaaaacacacaagaacaataacacagcaaacagattgagggattgttgtggtttttgactaaggtgtatgttagtttcatcagaaacttaaaacatagactgatcactcagaaattaaagtccgttttactgtgaatatagcaatatagtactggacacagtactggtgaaactgaggagagcattgcttgtaaaatcctgagtttccataaggaaaatgaaaactccttttaaaaataaaatctgaggagtgtacaataagcatatgctttgactttcctttgctgtggaggtttttggtttttcattgatgataaacgactacagacttagtagtggagaaatggtgtcctctagtggaagaaatagtaggctccgctattcagatgcagagcactgcagcatccagcctttcaaagctgactcttctcaatcatctgtgggtcatttgacttgattttttaagctaccctgaatttccagaatgcaggttctaaagaaatctagatgagagaaagtatttgaaaatgatttttaaatgttttttaaaagacacatctgacatttttaacaacttagtaaaagttgaaatgaccattctgtgtagtcataaaagaaacacaatgaagtgtatggcctctggagttagtcttagtaaaacttattgctctgtgtcaatgttaacctgtctcagatcaagtaattctttcactaggttgggtttggggaggggggaaaagaggggcttttcctaggagaacgataagaaatggaaagactccttgaagtgttgcaagggaacctcctagcactgtgaaagtcagaatcgcctcagcatttccatgacgcacattatgcaaatctctttagcactattttaagtttgaaaactttaacaatgaaggggaaggggaagatttccaccaactgaatcatttgtgcacgtgtatagctcaaagagcttagacttcaaatatatctggtgaatgactctttgtccatgtggtttaatttctgtgttgtcgacctgagttgaatattcttgaggggtaattgtgggggactgcatttcaacctagagtttttctaagaagtccccaacgtatggggttaacccatatacctaggctcttcctgaaagtgggggaagctggttggcagccctctcttgggggaaggggaatttgagcagggcctggagggcagggttggcctctgataagaggaactgggagagctccctgttttattgccatgtttcaacatcttggtcctaaaagccatttcaagtgtactaaaaacctcttttaatgtcttcccactctattctcttgttaaaagcactataagagacctgagttagcaaaaaaattattattcaggagaaaagcactatcataatctaaatgattaatacattaaatgccattaaaatgaagagcttctgttcatcagatgggtattaggagaatgaaaagggacagcatcagactggaaaaggatatttgagacacatgtagttgtaaaataaattatatccaaaatgtaaaaagaaaaccctacaaataaggaaaacagacaatccatttctttgatcatcaaaaaatttcaaaggcacttcatacaggcaattcacatacacacagacatacacaaaatacccagatgacccattagcattcaaaagatgctcaattttattgcttatcagacaaaagcaaatgataatctcagagctactacacagatctatcagaatgactaaaattaagtctggagaaataaaaagttctggtaaggatatgaaggaaggggaactgtcatgcaccactggtggagtgtcaactggtgctcacttcacagcactgtttggtaatatctgctaaagctaacatgcctctgggagcaattcactccagggcatgcacctagcagatacaagtgcacacatctatcaaaatacttgtacaataatgtccctagcaaagttgttcatcatagccattaactggatacagcccaaatgtccttcaactatagaataaactgtgctatcctcacacaaaggaatgtcacaaagcaataagacacataaactagtggtacatatatgaacatgaatagatcgcaaaatcatattttgagcaaaaaagaaaaactagacatgaaaaaaatacatagtatatgactccttttagcaagctaagaaagtcaaaactggcctatataaatagaaataatagtggctattatgaaaacacttaggactgtaaggtcccccaacaccacccccaaactaaaaaaagtgctaagagtccaaagaaggactcagacctaagtccagcatgaggagtagatgagtttattaggacttacatacggggcactctgggatggcggcaggatagctattgatatgtgcgccacctcccatcccataaactgctgttaagctagtttcctggctctttgcctacgtgtttgaacaatgagactgtttttcttggtagttcctcagaaactctctgggaggtttggcttctcagggacacctgctcctcagctcggcaccagggtcttggctcactgtccggccctcagagttcaggcaacagacttatacccttcggtaacctgttgggggacctgtcacagtacagtggctaccttttgaatggtactgcctgagaggaaccctctcatgtggaagccttccaatgtgccatcaatattctacatctcgatcctgatctccatatggatgtatacccatgtaaaattcagttaaaatgtgtgccatatactacagtaagttatacctcaactaaaacaaaagctgttctccctgaggacagagaagaaggagccattagttgtgatgggggtttagaatgtcctcatactaaaaacgtacgtctcccatctcatgtctgtgagatatttccatattttcaaagccttcatttaaaaatctataaataagtgttcct

SEQ ID NO: 17322 - DNA, 7456 bp, Human
cgtctgggaagtgaggagcgtctctgcccggcagccgccccatccgggaggtggagggcagctcccgcccagccagccgccccgtccgggagggaggtgggggccagcccccccgtccgggaggtggggggcacctccgcccagccgctgccccatccgggaggttgggggggcgcctcttccaggccgccccttctgggaagtgaggagcccctctgcctggcggccatcccatctgggaggtgtgcccaacagctcattgagaatgggccatgatgacgatggcggttttgtcaaatagaaaagggggaaatgtggggaaaagatacagaaatcagattgttgctgtgtctgtgtagaaagaagtagccataggagactccattttgttctgtactaagaaaaattcttctgccttgggatgctgttgatctatgaccttacccccaacctggtgctctctgaaacatgtgctgtgtccactcagggttaaatggattaagggcggtgcaagatgtgctttgttaaacagatgctttaaggcagcatgctccttgagtcatcaccactgcctaatctcaagtacccagggacacaaacactgcggaaggccgcagggtcctctgcctaggaaaaccagagacctgtgttcacttgtttatctgctgaccctccctccactattgtcctatgactctgccaaatccccctctgcgagaaacacctaagaatgatcaataaaaaaataaaataaaataaaataaaagagattaaccagtttctagcaaaaaaaaaaaagtattaagatgaacttcaattataaaatcttaaaaaaaaaaaagaaaaagaaattgggtatatgtaccatacttaagagagtaactccattattctttggctgtgactttgtgctagcaatatgcctattgctattctctccatcagctgtcactgtcaacatgcttctctgtccttcctttccctctgttttatgaattatttctctaatgccttctgatatgacataatatgacaaaatacaatgtgacatggtattatataagataatctttatttaattaaaatgttcaattaggtctgattcttatttgaaatattccaatgacttctcattgcctgaattataaattccaaaccatctattccattatagaagacccaaatataccgttagtcagaattgtttattcttttttgatactctcagcaaaaaagatcaactgtagtttgatctttgtagatcaactgtaatttgaggctacatgttattgaagctgaaagttagggctttgaaagctcatgttttgcctccaaaccccattgttattcctttttaggtgtgtaaacatttcctagtaatgtcacttttatgagtctaattttgttcatctacaaaatggaataaatcatactactttgacaagattattaaaaaggtttaatgagataatgcatttatttagcaaagaatgagtgacataagatgctaatatctggtaggagcacatttataattggtaagtactaatattagtaactcttaatattgtcattcttatcatacaatgttgatgatgaaatttcaagtagcattcaatactttgtgatatatgcacgtctccctttctatactgtgagttgagagaaaacatgtaccattcccaggaaatgtaccattcccaggaaatgcttatttatatcaattagaatagtagtgcctggggcagatgatgtgctcagcaaataaaagttgaataaatggataagattagtatctacttatttcagtgtatacacacgtattttacgaaaatatttgagaggtatttaaaacaatataaacaactcatcaataactgaacctcttgaatatatttatttgagcttataaattatccagatttcattttgataagttatcctttctaaaatattaagactagacagttgcgtgctagactccggacccggccggtggtatggctgagccgactagtgatttcgcgactcctatcgggtggcctgcatctcccgggctgactcccacgttagggcccctgaccgacactgccccgccgcgggacagctggatgttctgggcaattctgccgccaccgccaccaccgcttacgtcctcgcttcccgcagccgggtcaaaggcttcctctcgcagccccccatagaggcccagtctctccccagggctccgcccctctttgacgcccagcttcttcccggggcgcaaccccccttccacgcacagtccccccttgattctcagcctcaacccagcggccagccttggaatttccatgcttccacatcgtggtattggagacagtcttctgataggtttcctcggcatcagaagtccttcaacccttcagttaaaaattcttattatccacgaaagtatgatgcaaaattcacagacttcagcttacctcccagtagaaaacagaaaaaaaagaaaagaaaggaaccagtttttcactttttttgtgatacctgtgatcgtggttttaaaaatcgagaaaagtatgacaaacacatgtctgaacatacaaaatgccctgaagtagattgctcttttactgcacacaagaagattgtccagttccattggagaaatatgcatgctcctggcatgaagaagatcaagttagacactccagaggaaattgcacggtggaggggagaaagaaggaaaaactagccaactctggccaatattgaaaggaagaagaagttaaaacttgaaaaggagaagagatgagcagtactgacaacaacacaatatggcaagatgaaggggatgtccagacattcacaaatggcaaatatcagaagtcctggcgagaatcagaaatgaaaaaacaattatagacagagagcagtcactggatcaggcaatcacttgtgtgatttgaagccagaaggtccacctgaggcaaatgcagatcctcttggtgttttgataaacagtgattctgagtctgataaggaggagaaaccacaacattctgtgatacccaaggaagtgacaccagccctatgctcactaatgagtagctatggcagtctttcggggtcagagagtgagccagaagaaactcccatcaagactgaagcagacgttttggcagaaaaccaggttcttgatagcagtgcttctaagagtccaagtcaagatgttaaagcaactgttagaaatttttcagaagccaagagtgagaaccgaaagaaaatttttgaaaagacaaaccctaagaggaaaaaagattatcacaactatcaaacgttattcgaaccaagaacacaccatctatatctcttggaaatgcttctagctccggacattcgacatgaaagaaatgtgattttgcagtgtgttcggtacatcatcaaagaagacttttttggactggatactaattctgcgaaaagtaaagatgtataggcgtctggtgtttcagcatacataactgaagcatgtgaaacagtatcatcctcattagtagaggaaaaccaaaacccttttttccctcaaaactggatttgtaattaaattgtaagcctcgtaggatgtatgttggaattttaagtctttcctttggttctatgcaaataaatacataactgattttttaagactgtgtctgtattgttgggattgaatctagtatttgctgggagaattttttctttgtatttattttaatgtattgttctcatgtaaaaatgactgatgttgtgtcagttaagaattgaagataggtttagcagtaaagaaagcttttaaaaggattgattcagctaagcaaagttgggcagagaaatacagccattttgtttttaatgcagaaaaggaagatgttctgtagcaagggggaatattttaaaaataaaccagatcaaattaatacaatcagaaggtttcgaaatgtaaatattccttatttaagacatgtttatattcacctactagcacgagttacatagctcaaatattgaatgtttaaaatattaatacagatggggcctctgttttatgtttagatacaattgaagtacttaattgaagctttttaaaaattgtaaagaaaatgaaagctactgagatcttcttgtctcctataataccagggaatttgagcttgtgttctagtcattgtactagctgtagctattggtctgcccttttgacatacagctaaaagggactaaatttttaaaaaattagtctgttatagttgaagattaacttttcttaacattgtgattattgaagttcatgaatcttgctgtcaaggaagaaaggtaagaaagctgagagctcctccatgttggtaaaatcctctccagaatcttggaacacctggcatgtgaccctagtgacgtcacagacctgagatgaagattcatgtttagccagtgttttccagccttgtacccaccatacagatctgtttattctgtttcaccctactcctccagtgagccccatattttgggaaattatctgcctcatacattaactaattcaattcatataacactgttgagtgcttactctgtgtacctctattgtgcctatattaaaggtatacaaataaataaggccatgtctgacttcaaggaactcagtttaattttgatatattcaaagatgtgattcccaaccaactcaggatgaagtaactagtgttacaactgagttgatattctaaaatataacacagtttgtacttttattactagttagcatacacattttataggcttatggttaataaatgaattcacggactcctggactactttcattgatgaccatatctccagggatgttgttgatccccacactgccttaaggtatattatataaacagttttattttccgtttttcttgtttcctgataatcaatgtatttaggactgaaaatacttctgagtactcccttggcagtatgtctgacagtctttagctatggtgactattgtttatttttaacgggtatttcagattccaagtgtatttaaaatttctaaggagatataatatagcctgtatggtttctattttatggaattatatggtcaatatttgtaaatattctatgagttttgggtgggtagaggggtgctttgcctgttttgggtacaggtttttttggatttagcttgttaattgttcaaactttctgccttctacattcctatcttattgttcatttaatcagttcctgaaatgtaagcattacatgactattgttgagttctgccttttataactgaaatactttactttttctcatatcctctataattgacttctattttccttaatcaaaccagctctgggaaatttaatacatttattttaattgagattattaaaacatttggactattcaaaaaaataaaatattaagactaaatctataaaatgcaaatataattatttaaattattcactcaggtttaaaatcaattctgtgtattgttttaataaagtgggaattgtattagtctgttttcacactgctataaagtactacctgagactgggtaatttataaagaaaagaggtttagttgactcagagttctgcatggttggggaggcctcaggaaacacaatcatggcagaaggtgaagaagcagcaaacaccttcttcacaaggcatcaggagagagagcaaaggcggaagtactacacgtcttaaaccatcatgtcttgtgataattcactcactatcatgagaacagcatagggagaacccactcccatgatccaattacctcccacctggtccctctcctgacgtggggattacaatttgacatgagatttggactcaaagccaaaccatatgaggaatttagtcaaagcaataaacccgtttcaataagttgtctaacaaatgttaaacaaataagctgattaaagtagatatattataactttcttgacatttgatcaaagtcaaatgaagtaatattatgttttggatcaaaaactaatgcttttattcttccataagaaatatactctgacagtctaaaatttctttttggagacataatcagttctatttaataaattatagttaagtgttatcactgagaatatacataataaacttacatcataatttcgtttcattacagcctcttaaaaataaagaatctgctcaagaatgaggagggtaggcatctgttacagagagactacaacaaatgtctctgttgaccctaataacacaacaggattaaaattacatgcacgttacaggatttgccaattatgaaaatattttagattcagacccagtgatttataaaatcaaaatggaatattatattagttccctattgctctgaataaattcagaggcttgaagcaatgtgagtttaggtcagaagtctaaagtctaggtgccagaagtgctgcactccttctggagctttcaagagagaatcagtttcctttcctgtttcattatttaagattttaaaaattccttaaaattatagaatgatacttcctctaatcatggcaaccaaaggccataatacagaacttccacaaaataccaataggcctttctctgttttttttttttttttttttcatttaatttgcccctaaggaaatagaatgattcatttgatttgtaagcacagggaaacaactaggcacaaacatcttttgtcttactcttcaccctcttgggagcaagtctgcctattaaaagcccaagctctcttcagctattccatgacatctaagcaaatgtgtagaattccatttgcaatgctcattattaaaaatttacaccctaaagagaatgtcagatttacaaatgacgaacataaaatgaaccagggaaatggaaatatctttggatgagatacaaataattgattaccacatagttgcacactatggctttagagatgatggctaaagtaaatccattacacatatgttgtgatgaataatattaggtgtcaacttgattgaattgagggatacctagatggctggtaaagtattgcttctgtgtgagtctatgagggcattgcctgagattgatagttgagttggcagactgggagaggaagacccaccctcaatgtaggtgggcaccatctaatcggccgccagtgcagctagaacaaggcaagtggaagaaggtgagatacatttacttggtgagtattctggctctctttcttctttccatgccagatgcttgcttccactcctcttgcccttagacatcagattccaggctcttcgatctttggactctgggacttgcaccagtgacttcttgcgggttcttgggcctttggcagcagacaaagggctgcactgttagcttacttgattttgaggcttttggacttggacttaggcactatg

SEQ ID NO: 17323 - DNA, 46698 bp, Human
gtggtttgtctttttgttgttgagctgtaagaattctttatatatctggttactagaccctcatcagatatatgatttgtaaatattctattctgtagattgtcattttattttcttcatagtgtcctttgatacacaaacgttttaaattttgatgaagcccaatttatctctgttttcttttgttgcttgtgctcttgctgtcatagctaaaattttatcaccaaatccaaagtcatgaagatctcccccatattttcttctaagagttttatagttttcgcttgtacatttatattttatatcctctaaattttgtttataatttaaatcattgctatagacttggtccagtgagacctataaacagaggtcttaatttactcagtggttaaattgtcctaaaattgatttctgcaaaattcagaggggagatttttgggatttcatagagaaatctatatccatacagttaaatccttcatgatttcatacacttcacttttttaaagtattaaaacttttttatttgaagaatacgtggggagaagagaaatatatttcagcacttagatatgtagattatttccaaaatagtttaccactcaactagtcacttctgtgtaaatcagttttccctgaagcaagcattgtgttgttcccggctacaagcggtcctcattttgcatggtactgtgggaccataaaaatggccatgcaaagcaatcttaataatcaatggggaaaatgatgattgttccatgacctttaaaattctgctaaaatattaaaactcttaaggtcagttataaatgtagaaaaaaatgcaaaaaaaatttaaaaatatttagtacactgtaatttaaaacattaaaaatagaattaaagtgttttatttcattgtgaaaactaagtagtttgaatagggattgccttttttttctgccaagtgacttatgatactgagtaagcatcttttctattcatggcaaactgtcatactccttttaagtttgggtgagcttccagccttttattgcttgtgctttcaatgttgtgaagtatttctgtattcacattaaatgctctttagtgtgaagtttgtttttttttttttttaccgtcacttcctctgggacatatttatctttattgcaatcacttttcttatttgtgttgataagtttgccttcactaagctcctatgaatgcacagcaggaagaacattcccatgatcagtgacttcttctacaaatccatttatgtttgattcaaatttcacttccagtgttatcatttttcgttgctttgttggactttcatctttgttggccagttctttcgattgttcacttctataaaatgtcaggtggaggacaaagagacagtgtaactacgtgctctgctgtgagtgaactgattaacagatgcacagggaccaaccactggaagaatttgaaacaagtaacacgactggtcactgatcatgaagcatatctgttatttacatcgtgatttgtagactgaagaactagcagagaagtttgtacttcctgtaattactcagagttatactgtgctacctaaaattttaacctaggtttaaacaacaccagtttccttaccagtttcctttccttcctggtaaggaaactggtatttaaactaaatctaggtcactgaaatttgtgccatgggaaccgtgcacattgaggacctgcctacaccctacatgtttatattggtccaggcaggcttaatgctgactactgagaaataggctatctgaatttatatcaaatagtgaatcttaaagcacccaagatgaaaaattcgtgcacattgaggtgcttttaaaatctttgtcatttgacaatcaagcttaaaatgtatcttagagtaaccgaattttagaaataaagacctttaaaggccccatagtttgataccacagattatccagcatgtttataatgaattatttctcctccttcaatttcagtttgctcatactttgtgacttgcggtcacagtggcattcagctccacacttggtagaaccacaggcacgacaagcatagaaacatcctaaacaatcttcatcgaggcatcgaggtccatcccaataaaaatcaggagaccctggctatcatagaccttagtcttcgctggtatcactcgtctgtctgaaccagcggttgcatttttttaagccttcttttttctcttttaccagtttctggagcaaattcagtttgccttcctggatttgtaaattgtaatgacctcaaaactttagcagttcttccatctgactcaggtttgcttctctggcggtcttcagaatcaacatccacacttccgtgattatctgcgtgcattttggacaaagcttccaaccaggtacaagcggtcttccgaattttgcactcagaaaagtggcatcatctaagtcaattacatgcaaattttggggggctagttttttgtgtatgttaaatgggtcacaacacgacttctgtaaatcctcaaatctgtcaatataaatttttatgtgatgaaagcaaattgtattgttcctagaaagtgtccttccagttctaagttgaagtaaaagcatgtcatttgatgacaattcttgcaacatcttaaaacctgtgtgacaagtatagtaggttttatggcactcatttgtagtacgaagctggactgcaactatcgatccatcattgttgattctagcatattttccttgttttattttgtctagagatctaggtcacgggctgatcacccttagcttgagctctcctccgcctggcttccggcaggatccacgtccacacaggcacacttgcctgcccgttcatttcccagcctgtccccatgctaccactccacttcacttattatatatactctaaatctttttcttctcaacataaaacattctacaatcctgcagcctttttacttttttaagcaggtaggcaaacatgtagttgatactcagtggaagcacagagcagagttaaagagaaggaccccctttcactgaccagttgagttttttttctttcctttattttttaaaacaatttcaaaattgagatggggtttcgccatgttgcccaggctggtctcgaactcctgagctcaggtgatccgcccaccttggctgggattataggcgtgagccaccacacctggccaagttgagtttttaaagtagaaaattttggagaaattaactttattgtgcagtgaatgagaaagaaagaacggttttgaaagaaagtctctgcatttatgtgagactgagatgagtcctataaaggggagtctccccaacccctctgtctcctaaactgcattgggaaactcagattaaatatgttctgtgagcatcactcattcaaatgtctcttccattgtaggatacgggaagaagaaatggctggtgatctttcagcaggtttcttcatggaggaacttaatacataccgtcagaagcagggagtagtacttaaatatcaagaactgcctaattcaggacctccacatgataggaggtaggttgctataaaaaatgatatggcagccataaaaaatgatgagttcatgtcctttgtagggacatggatgaagctggaaaccattattctcagcaaactatcgcaaggacaaaaaaaccaaacaccgcatgttctcactcataggtgagaactgagcaatgagaacacatggacacaggaaggggaacatcacacaccagggactgttgtggggtggggggaggggggagggatagcattaggagatatacctaatgctaaatgacgagttaatgggtgcagcacaccaacatggcacatgtatacatatgtaacctgcacgttgtgcacatgtaccctaaaacttaaagtataataataataaaattaaaaaaaaaagaaaaaagatatgaccttataaatgtaagctgggggaatggcaactctggcacaactttgaggtcaacactttagttttgtgagagtgctcttggcataaagtgggaaccatggtggagccacagttgactccagagagaaaagagggtagaaacctttccatgcttcaacaagacatgctgctttactgtttgaggtgactgcttaaatgctatattgaatgtaggttcaaaccctcaaaggtagtcataggaggtagtgatgactagagtacttgtttttagatagtgcatgagttgtataatattttatgaatattctctttgtaatcaggtttacatttcaagttataatagatggaagagaatttccagaaggtgaaggtagatcaaagaaggaagcaaaaaatgccgcagccaaattagctgttgagatacttaataaggaaaagaaggtgagtgattgccattttttcctaataaatgggaacttgcaaatacattttctgtttctctctgtgagaaaatactttcatacagagtaaagccattcacacgttcccttacattcaagagtttggttaagtcattcaccctatcttcatttctatgaaaccctgagtgagagccacacctaggacaccatgggcaaagctggataatagttatttagagtgtcagcagcagttaaatactctaaagttgaacaaatatggaaaggtgagaagtgttcagtgggaaatgagctgacaggttctgggaggagtcccctccacctaaatgaggaagtacagtaaaaaaggaaaaagagatgaaagtgattgtagggagaataatgtacagtggtcactcactctctgtggggaattggtaccaggactccctgtggatgccaaaattcactgatgctcaagtcctttatataaaatggcatagtatttacatataacctatttacatcttcccatatacagttatgcattgcttaacaaggagaatacattgtgagaaatgcacctttgggcaatttcctcattgggcaaacatcatagaggtacttacacaatcctgaatggtacaaccagtacacacctaggctgtgtagtatagcttattgctcctagactacgaacctatacagcatattattgtactgaatactgtagccaattgtaacacaatgtttagtattcatgtatctgaacatatctaaacacagaaaaagtacggtaaaaatacagtataaaagacaaaaggctgggcttggtggctcacacctgtaatcctagcactttgggaagctgaggcgggtggatcacctgaggtcaggagttgaaaaccagcctggccaacatggtgaagccctgtctctactaaaaatacaaaaaattagctgggcgtggtggtggacgcctgtaatcccagctacttgggaggctgaggtaggagaattgcttgaacccgggagaaggaggttgcagtgagctgaggttgtgccactgcactccagcctggggatcctatctcaaaaaaaaaaaaaaaaaaaaaaaaaaagacaagcaaaagtacacccatataaggcacataccatgcataaatagagcttgcaggactggaagttgccctgagtttgtcagcaagtgggtggtgaatgaatgtgaaggcctagggcattattgtttaccactgtagactttataaacactgtatacataagcaacattcattttatttaaattttttttcttcaataataaattaaccttagcttactataactcttttactttataaacttcttatttttaacattttcactctttccaaataacacttagcctaaaacacaaacgcggccaggcgcggtggctcatgcctgtaatcctggcactttgggaggccaaggcaggcagatcacctgaggtcaggagtttaagatcagcctggccaacacggtgaaaccctgtctctactgaaaatacaaaaattagccgggcatggtggtgggcacctataattccggctacttgggaggctgaggcaggagaattgcttgaactcaggaagcggaggttgcagtgagccgagatcgtgccactacattccagcctgggcgacaaggcaagactctgtctcaaaaaaaaaaaaaaaaaaacccacaaaaccacaaacaaacacatagtatggctgtacaaaaatattttgtttctttacatgtttattctataagcttttttctatttttaaaattttaaacttttttttttaacttttaaactttgttgtaaaaaattaaatcatggttgggcatagcggttcatgcctgggatgtcgaggagccatgattgtgccactgtactccagcctgggtgacagagtgagaccctgtctcaaaacaaaacaaaacaaaacaaaggctgggtgtggtggttcatgcctgtagtcccagcactttggtaggtcaaggtaggtggatcacttgaatttgggagtttgagattagcctaggcaacatggtgaaaccctgtctgtactaaaaacacaaaacattagccgggcttggtggcatgtgcctgtagttccagctactcaggaggctaggcgggaggatcacgtgcctgagaggtcagggctgcagtgagctgtgatcttctgactgcactccagcctgggcaacagagcaagaccctgtctcaaaaaaaaaaaagaaagaaaaaaaattacaacacaaacacacacatcagcctaggcctacacagcgtcaggatcatctacatcaccatcttccacctccagattttgtccctctggaaagtgttcaggagcaataacatacatggaggtgtcatctcctattgtagcaattccttcttttggattacctaccgaaggacctgcctgaggctgttttacagtttacttttttttttttttaagtagaaggagtaacttctaaaataatgataaaaaaagtatagtaaatatataaaccagtaacagttacttatcattatccagtattatgtactatacataattgtgtgtgctagacttttttataagactgtagaacagtagatttgtttacagtagtgtcaccacaaatgtgtgagtaatgcattgtgctgtaacccaggagtttaaaattatcctgggcaatatggcgaaatgctgtctgtactaaaaatatgaaatttagccattacagtggctatgacctcattagatgacagtaattttttagctccattataatcttatgggaccactgtcatatatgcagtccattgttgaccaaaatgtgattatgtagtacatgattatcctttagatcatctctagattacttataatatctctaatacaatgtaaatgctatgtaaatagtttttttgttgttgttgttgtcgttttttgagacagggtcgtactctgtcacccaggctggagtgcagtggcatgatcaagggtcactgcagcctcagtctccccaggctcaggtgatcctcccaccttagcatcccaactggctgggactacaggcacgagccaccacacctggccaatttttgcattttttgtagcgatggagtctcactatgttgcccaggctggtcttgaactcctggactcaagcaatctgcccacctcagcctcccaaagtgctaggattgcaggcatgagccaccacacccagctataagtagttgttatgctgtattgtttagggaataatacaagaaaaaaaatctgcatatatttagtacagatgcaaccatcattttttttccaaatatttttgatccatgattggttgaatccagggatttgaaacccgtggatatagcgagccaagtgtttacagagagcaggtaatggagaaccaatatacatgtgactggtatcccggaaaataagaacagagtaaatagtgcagaagaaaatgatctgaagagatttcagcagacaatgtttatgaaataaagaaagacttgactgcagattaaaacaacttaatagatacaggaaaatttagaaccacccagaccaacattgattctttttttttttttttttgagacagagtctcgctctgttgtccaggctggagtgcagtggcacaatctcactgcaacctccgcctcccatgttcaagcaattctctgcctcagcctcctgagtagctgagattacaggcacccaccaccacggccagctaattttttgatatttttagtagagacagggtttcactatgttggccaggctggtgtttaactcctgacctcgtgatccactcgctttggtctcccaaagtgctgggattacaggtgtgagccaccgcgcccggccccaacattgattcttatgaaagtactgtgctccagagatgaggaaagaattttataagcatctagagagaagaggaaaactatgtaaaatgtaaaaatttttaaaatttcatgctgtgcacagcaacattataaaccaggagatagtgtagcaatgcttataaaatgaaacatgaagtcatttacattttagacaccagagggccattctcagatttggaaaatgttgggaaaatttaggtttcaaggttctttcttgaaaaatctacttaaagatacccttctaaccaatttttttttaactcaagcaaaagtgcaaagtataattattaatgaggtagaaaattgagtcaagaagttagaaaaaacaaaaaacagaatgttttacccccaaaaagcagaagaaagaaaataacaatggttgaaattactataaaagaaataaaaaataaaaaaaaaagatcaataaaaccaaaagctagttttttgacaagattaataaaatagcaaaactcagccgggtgtggtggctcacacctctaatcctagcattttggaaggctgaggcgggcagataacttgagcttaggagttcgagaacagcctgggcaatatggccaaacgctgtctctacaaaaaatacaaaaaaattacccaggcatggtggtgtgtgcctgtagttccaggtgcttgtgaggctgagacaggaagatggtttgaacccaggaggtcaaggctgcagtgagctgaggttgcaccactgcactctagcctgggtgacaaagtgacaccctgtctgaaaaaaattaaaaaaatatcaaaactttggacaagatttttgtcggactaagaaaaaaaggtagagataataatagtagaaatgatgctattatattcatctttttcattaagttatgatccagtatacagctttactgtaatatctcttgccttgttttttgagattagaaagggtataacaagctagaaagtgttatagtactttccaaggacaaacaagaaaaagtgacttctttcctgttgttaaaatctatcttcgtcgatttttttctggtagagggagatacgtagtcacacttttgctcaaggtaatataataggaaaatatataacatccaagttgtctttcaaattgctcatttagtaattttattagaagaatgatttttaaaaggttaaatctttgttgtcatttatattaaacaggaattttttttctttgtaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaagggtaagacataatttggcttttctttctgtttcattgtatttaagcaataaagttggtttattttcgtgtctaattttccagaaatatgtgtccttttaagcattctgtatgcaaggttttacatgattgataagtaattggatttataatttgtaattaaaatgcttaattgctgaagccatggaacccatttaccataattgatcaaattagggtaatcctttatttcagagaagtagctgggtggtttagtctgtggaacacccaagagagtacagggtgccactgctcgaagaatacagaaatcttttcatcattgaggacatgatggtggtaactgtctgaaaacctctctgccacatgtatagaatcactcttcacccttgtcagatcagggagctctttgtccaggtatttgtccttcaaatttgattaaatgaacaaataccatgtatcagaaggaatgagctttagccctagactatgaggagaccgggatttgagggatctgatgagacagatgaactagagtttcaaagttactgagaacatcaccagtgagctaagatgtgtggaaataggataaagaatggattggaactgaaaaaagcagaaatcaaatgagtatgaggcaattgtttttcaactacaaccaaccagttaaagagaaagaagaaaaaaaatatctacatggcaaatagttcaaatcatcactttaggatacacttctatgaattgactcagctatttacagtcatggcttttgagccaaaaccaggaagagaaaaatgttatagtattcattggaatgaaatagtcaaaagtgaatctgtgagtcaatctcaataattaagagatgattttattttctgtagctcacttttttggtttctttaaattatgctaacattagatacctaaaagaaagaagaaatctgtttgcgggggggggcagtatctgaaaaaaataggagctatagaaatgatccagtcactcaacccagctatttaattcagggtctagcggggaagactcaccctgtttggatgtgtttctctcgatggcttccaacagaaacataaagcaaaaggagttcaaatactggaatcatttttcagtaatagatagtaaccctgtgatataaattgccatgtccattgttttatcccttaaaaatagttattatataattgtccaagtatccttgcctaaccacaaatgtccttacatctaataggaggagagtgtggactttagtatagggaatctgcactgtggggattttctcaaatttttgtgcacatgagcagatggcagacaatggtgaagttagagcagaatccatgctttgctcttcccctacactataacctcatagcttctcctgtggaagcctactttctctgctggctttttccttcccatttgagcacctctgaaaaaattcactggatctctttctttcttttctacctccgtatcttttgacctttggggaattaaaaaaaaaaatcaccacttagtgcctttgtgccagatctttcagcaaagcaacaaaaaattagaaattgcctggaaaatgcaagctcagatgtcagctgatcctgggtattcagagaaattggtcaggcatgttactgagggtttaaattatgcaagatatgaactataaatctatctaataaattggtgttatcttaagatctctgttaatatgttattttttttgaatcctaagttggatttgctatatttttcatgtttggataagtaccttctatgatttctcctagatttcattataaatgcaaaatgggacagaaagaatatagtattggtacaggttctactaaacaggaagcaaaacaattggccgctaaacttgcatatcttcagatattatcagaagaaacctcagtggtacgtattgcctttggattaaatttttatgttttaaaattccctctgaagttgacttgaggttagactgtgttaacattatgccaagacagccagtgatttagcaaaatgattcctccattctgtgtcgtaccgatgagccatgcaccatggggccatgaggcctcagagggataaaatttctggtggcaactcagggtagtttttaaactccaggctgggctgggtgtggtggctcacacctgtaatcccagcactttgggaggccaaggcaggtggatctcctgagttcaggagtttttttttttttttttttgagatggaatctcgctctgttgcccaggctagagtgcagtggcacgatctcggctcactgcaacctccgcctcccatgttcaagcaattctcctgcctcagcctactgagtagctgggactacaagcgcctgctaccgtgcccggctaattttttatttttagtagagatggggtttcactatgttggccaggctggtcttgaactcctgacctcgtgatccacccacctcagcctcctaaagtgctggggtttacaggcttgagccactgcacctggccgaactcaggagtttcagaccacctggccggggcaacacagcaaaaccatgtcgctacaaaaaaaaaaaaaaattagacgggtgtggtggcatgtacctgtagtcctagctactcaggaggctgaggcgggaggattgcctgagcctgggagatggaggttgcagtgagccaagattgtgccactgcacttcaacctagacaacagagccagatcctgtctgaaaagaaagaaacaaacaaaatatctgccctgtgatccagaaaagtaaaataaaaaataaaataaaatccagaccaaacatccaaaaaatgttattaatcttgtaattgtttatggttgtggatttggtaaatgtgttgaaataaatgtgatagtacatagaaactgagcctctgtagagaaataattagttgtatttaagcctactaagggatactttttctttcagaaatctgactacctgtcctctggttcttttgctactacgtgtgagtcccaaagcaactctttagtgaccagcacactgtaagtgtagacaaacaattgagatacttaacatattcatatttctgtctgaaagacagatttttatgtttaaggagaatttagggaaagaaataagtgataaaaacagaattaataaactaatagttacacccttttcttctagcgcttctgaatcatcatctgaaggtgacttctcagcagatacatcagagataaattctaacagtgacagtttaaacagttcttcgttgcttatggtatcgtattagtctcgaagcttcctacttaatcttatttttctgtgcgtttcctcatttaaaaataacttccagtattccaccataatttttatattttttatcttatgcactcttactaaatgataatacctcagtagactttttttttttttttttttgagatggagtctccctctgttgcccaggctggagtgcagtggtgagatcttggctaattaccacctccacctcctggttcaagcgattctcctgcctcagcctcctgagtagctgggattacatgcgcgtgtaccacacctggctaatttttgtacttttagtagagacggggtttcaccatgttgttcaggctggtctcgaactcctgacctcgtgttctgcccacctcggcctccccaagtgctgggattacaggcatgagccaccgcgcccggctcggcagctttttgactttttttaaaattaagttccattccttacccttccacacgtcacttctgtctttcctcactcatccttatattttagtatattcctatgattttgcttttctctcctaccaatgggataatatttaaagattcactaatatagttcgtttctgtttttaaaaattagaattaaacttaaaagtaaacttgaaatcagataattttttaggctggtgcagtggcacatgcctgtagcctgcagcacttgagaggccaaggtaggaggatcgctttagcccaggagtttgagaccagcctaggcaacatagtgagaccctcatcgcaaaaacaaacaaacaaacaaaaaccagacaatttttttgtgcacataagcaggcaatgttgaacttagagcaaaatccatgcttttggtgattagtgttacaagagtattctgttataaagaactacaaatcaataagaaaatggcaagcagctcagtagaaaagtgtacaaaatgtataaacagatattcagagaagagatacccaaatgggcaacaaatattaaaagctgctttactaggaatcaggaaaatttaaatcaaaacaattagatactattttaaactcattagattggcaaaaagttaagtcttacaatactaagtgttgatacagggcttgatgagagtacagacattgatggactaagaaattggtcagagagccatctagatatacaggaggaaggaaaacgggaaaggaagatgactgatttagtcatctgaaactatttctcattttcttttgttatagaatggtctcagaaataatcaaaggaaggcaaaaaggtgagtatcattatgcattgaacatattttgatctgaagttttatttcagacttatttattgttcttaatacttgtagagtattgtacacccttatttgagcagagtttcagaagcagaaagcttgaaatctataaacaaataattttagatgtgtcgagaaatctttgactatgtgcacatgctacactgtaaacataaagcactttgggggtatcgctagagtaattaggttaagggcattattttgtacaagactggcaaggaattgggctgttttcactgtagaagtgttttcaagagaagtgtattattttgcagacaagtaaggttaaaatagcataaaaacttggattaaaaaaaggtcaaatgctatgtcaattaactgaagagaaaggcaaagatgtaaatatagtcagaaatgacagtaagatggcagtaggagccattatgagccaccagtatattctgagcagtagatagatgtattgaagaaacatggttcttgatgtggatgcttggatggagagaagagagttctgcacatgaggtgccctcagccacgattactgtggcagtcaggagggatgaggagaatgtgtgagaaagactgtaaaggaagagtggacatgacttgagggaataggttccccgtagctgagtgaaagcatgaaggagaggtaaaggagaaaggatttgaagattgcttcactttgaacaggatgcagtcaagaaccatggcactaatggtgttaaggaagttaaggagttaagggcttagagagaagacagcagtttggatatgtttagttttaggtggtatttaaacttccatttgcaggtggcttatcatcagtaaggaataacagctaggatgagggtgtaaggagatgtacttcctgaggttttgagtctggaggaggaaaaggagaggttagtgacgcatcaacaatgagcactctaaggtggaaaaaggaaccagaggagggatgaaaaagtattagaggccagaggagaacggtaagtatatagttttataaagaaaaaagttggctgggtgctgtggcttgcgcctgtgatccccagcactttgggaggccaaggtgggaggatggcttgggtccaggagttcgagaccagactgggtaacatgaagagaccctgtctctactaaaaataaaaagaattagccaggtatggtggcacatgcctgtaatcccagctacctgggaggctgaggtgggaggatctcctctgagcccagaatttcaaagttgtagtgagctatgatcacaccactgcactccaggctgggagatggggtgagaccttgcctctgaagaaaaaaaaagaaagaaaaaggttaacattaacactaaataagttatatttgatttcaattttatttgagttttacattcaactcttaatttttagatctttggcacccagatttgaccttcctgacatgaaagaaacaaagtatactgtggacaagaggtaagattttaagtgctgaagaaagaagaaggggtaatgctgtcggtggatgtttttggtagttgtctgtgaaatggccatgatcctgtcagttaaaaatatttgaataagattaactacgcagggtaagaacaatagtcttaggcttatcattaagagggggcccaggaatgggatgacccatattatgattttgttcccaaaccaagaatctagttggttgttttgatactcccttagctttttagccctttctttaagtttttcatcagcgtttcttactaggcccaattggttgagataaaagcaacattcctcacccaatgagaggcagaggtcccttttttcagccattattagatctagtccccatctgttttggaggactactccagccgaggagtctagtttgtcttggactcttataatgcttcaggctatatcttctaaagaaccctgtaattctgtggaaagagctttaaagtatgttaagggagtggccaatctgcctgctcccaatccaagtctggaggttatatccaaggcagccattaaaggaatgacgtggatggccctcctcttcctaacgtattggatggatggaatgggcaaaggttggctaggaggaattagtccaatggagggagaaagataaactagggtacaggttccagtccagttagtggggagacaaagatatgtgttggtgccactcacacaaaaaataagcctttgtcataaatacagttggagatacagaaagaaaacaagtgaattaaagatgggtgttttttctttcctatggttcattactccaggtggtcaaggaggaggtcaaggagacacccactatagtagcgatataggaagagttattttttacacatttaatacgatttgatgttgcaccattgcattgatgttgagccatggataaaggtgggcgctaggggcagcacaaattaggccagaggcattggttgagggagaggctgcaaaacgaacaggttgcagaaatgctccattcgtttcaggtgatacttggtagtcaactcggttagtttgatggtcagcagggtgtttaacaatgataatgcggttgcattggttaggtttaaggatcttacacggaaatttccctcagaggctgaaaagcaaagtgaggcttgttgtaaaagtggggtgtgtttaattatgggcccttcaatgggagggccttgtggcttaaggcgttgtagggagttgtaataggtttgaaataatgtgttggcctgattgaccttggaagtgggataatcgccaaccagactgtcagctctttcaaaaaaggaagctcctttttggagtttatagattagggttacgttttctgttaaaaggtcatgaaggggtgtaggaagggatgtataagctgaagaagacagcgataaacacatccagcattctggagcaaaggaagagttagcttgcagcaagaggggttgtgtaaggtttatagaacgttctagtttgatagcagtgaggagtggttgtatcggtgaggttgatgtgattagggaatttagatagaaagaaacaacaaaaggaggaaaaagtttgggtaggaataaagtcctggaaggttccttgaagccataaatcccgtggaatagtaaggagctgatcaggatgtataatgagagtttcataaggataccactgaaggtctgtaacaaggctagttaggaagcaatgaaagtttgggagagaaagagacatagctgcttaggtgaatttctcttccttttcctccggcattcatgtgagatgaagggaagtggatcctgtggagacacaagagaggctgaaggtggtttagatttgattgtttggatgtgtagtgaagggaagtctgtgttcttgagagaagtataatgaaaccagctggggagtccctggagctttgctgctgtgggtgtagtgaggaagatctggtaaggccccttccatttcggtgtgaggggggaattgggggtagggctgggaccttttaccagaacccagtttcctgactgtaggaagggattaaaggagttgtattttgtcagcatattcccaaatgaaatggcagatgatatgcagaagaggagaaatgagaggggttgttagaggtggggcttgaccctgaggtggaacaaaaggagcatgagttcaaatacttatgctcaaaactcccatacatgagttcaaaggggatgagcattaaaggtttacgtgagagtgcccgaatttttaggagggccaaagctagaagtgtaacccagtctttatgtgtttggagtgagtacctggtgcgggtgatttttagaatgccattcattttttcaacctttcctgaagactggggttgataggggatgtgtagcttccaggtgattcgtagggcttgtgcaagtgtttgagtaatttgagaaatgaattcaggaccattatcagattgaaaagaaggaggcaccctgaacctggggatgatttctgttattaatttggaggtgacagtcgaagctcatttgttggttttcggaaaagcctcaacccatgccgaaaaggtatcaaccagaaccaaaagaaatcgaaccttttttactgggggcatatgggtaaaatcaatttcccagtcttgtcttggaaggtgtcccctggcttgatgggttggaaaagaagggagtccagtgttggaatggggtgaagctttctggcaaatagagcattgatggaaaatggctttcaactgttcctttatatctggggttatgtgtatgtgggaacttaagaaatgttgtagaggggaatggctagtgtgcaagaggttgtggatgtcccataacagagttgttttttgtttgtttgttttttgagacagattcttgctctgtcacccaggctggagtgcagtggcacgatctcagctcactgcaatctctgcctctggggttcaagcgattctcctgcctcagcctcctgagtagctgggattacaggcacgcaccaccatggctggctaattttgtatttttagtagagacagggtttcaccatgttgatcaggctggtctcaaactcctgacctcgtgatccgcccgcctcagcctcccaaagtgttgggattacaggcgtgagctaccgcacctggccaagagttgttttttcagggtcaggtaggactaatttgttttgtatgacagtatgggagtttgaattgtgcccccgctgtgagtagttgttgtatttggtgtttgggataaaaggggatatgttgtgtgaggggaaatagatattagagaattggatggttggttgaggtgtgttttgcccaatagtcagcctcacggttccctaaagaaatgtggcttttatctgattgaagtcctttgcaatgggtaactgcagccttttttggaagtagagctgcctttagtagacaatggattagttttccattaatgataggagttcccttagctgtgagatagccccacttgctccaaatttgggcattggaatggttgatgttataaacatatttagaattggtggtatatattaacttgtgtgttttttgctagggttaatgctttcattagggcaactaattctgcttgttgggaggatgtgcccaaaggcaagggggcagcctctacaactcttctaggtggaagacagtgggtatcatcacaatatctctcagtgactgcatatcctgcttggcggggagggttttttgatgcgctgccatctataaatcaatctggggctccctttatgtgagtggaagtaaggtggtaaaacacggcaagagaactttcaattagatcagagcatgagtgttggtcagggtccaaaatcagtgttgaagataaaagagtagcaggattaggagtgagcatctgtgaagagagatggagggttgaatgtagggcttgcatgtgagaggatgagatggaggtgagcgccttatggctgagcatatcttatagactgtgagaagaaaacacctgaagaggttcatagaatgtgagtttgtgcctcagggataattaaagaggctgtggacaaaatttttaagcaaaggggccaggttttgtaaatggggtctagttgttttgaagaatatgccactggttggagggaatctcccatggattgggctaatagtccaagggcctgattatgagaactgtgtaaatatagatgaaaaggtcttagggggtttggaaggcctaaagtgggggcctgtaataaggcacattttaggtgacagaaagcatgataaaggtctggggtaggagtgagtggttgatcaagatttcctcttgtgtgttcataaagaggtttagtgatagtggcaaaatttgctatctataatcagaaatatcccactaatttgaggaaagaaaataagtccctttttgtcttaggaaatgggacttgttaaatgccttgctttcatgctagtggaatttccctggtatttggagttatgattaatcctagctatgaaacgtttggagaggttaaattgggtcttccttttggatatctggtacccacattcagccaaaaaatttaaaagcctggctgtgtgttgaatacagtgttctagagaggggctgcaaagaagtaaattgtccacatattgaagcaaaacactgggttgtagaggtagttgggaaaggtccaatcaaagtgcctgaccgaaatagtgagggctgtccctaaacccctgggggaagacagtccaggtgagttgttgggagtagcctgtgtcagcgtcagtccaagtaaaagcaaaaaggttttgagaggaggaagatagagggataatataaaaggcatctttgaggtctaatgcagagaaatagctagtattgggaagaatttgcaatatgaggatataggggtttgggacaacaggacaaacagaacagtagtggagttatttgttgcaaatcctgaaccagtctataggagccatctggttttgtaattgggagaataggagtattgtggggagaatgggtggggattaaaatattggcagccaggccaggtcggtgcctcacgcctgtaatccgagcactttgggaggccaaggcgggtggatcacctgaggtcaggagttcaagaccagtctaggccaacatggggaaaccccatctctactaaaaatacaaaaattagttgggcatggtggcacacacctatagtcccagctactcaagaggctgaggcaggagaattacttgaatctgggaggcaggagttgcagtgagccaagattgcgccattgagctccagcctgggtgacaagagcaagactccatctcaaaaaaataaaataaaataaaatattggcagccaaaagttgggagatgatggacttgagtccccatagtccattaggggatattgtgggaccactatttgacatttaggatccttcattgaaatttgaattggagaatggtgggtagctaacatgggggagtcagtgttccatactatgggatttacagggctgaggaatttgggatttaagtctgtttgatatggaatgtctgaggaagggttctgttcttgagatgataataaataggggtagctttggtgtagggttgataaatgaatgattcgtccccgtttgtgtaggatgtcccttcctagtaaaggagtgggggaatgaggaatgaccaagaaagagtgagtgagggtgactccctgaaatgagcaatatagaggcagtgttttgtatggggtttcttgtatgcccttcattccatcaacagaaacaaatgaacattctaatgggccttggtattcagttaatgccagtagacttgccccagtatccaaaagaaaggaaataatcttaccagataccgtcccaattaacctgggttttgtggactcactagatgtgggggcgaaggatgccgggtaccctcagtcttccgttgtcagcaccaacagtgaagagatttcctcctgtaatgtttggggggcttcattatgagtggtacccgaatggggaaggtgtccctgttgagggcattccatcgtccagtgtccccaaagactgcaagttgggcatggtttggtgggaggccaggggataggacaagccttttcccagtgtccagggttgccttattgaaaacagactcctggagaggtgggggagtttccctttgggttattaggaggctttcgtataactgacttttggacagcagaggcaagcatctggtattttaaatggagatgtttgtcctcttgaattttttgttcctcatctctgttgttaaagacatggaaggtcgcatttaggagctcccaccaagatgtctgggggccctcctctaatttttgtaattttttccgaatatctggggtggattgggaaataaattggaggtagagaaaagtttgaccttctctagattctgggtccaaattggtatattttagcatagcttcagtgaggtgtgataagaaaagggcagggttttactggtgctcttgtgtaatttctctgagcttttcataattaactgccttatgggcatttttgtccatgcccgtgaggagacaggtaatcatgtggtctcttcacctgatgccattgtctccctgttggcaagtcccatctgggcctctatgggggactgcatcattggccactggattttgtataggggctttattatggagttattataatcaaggggaacttaaagtagtggtgcttgtccaagatggtaatgctcctgttctgtcaaagatggaactgtgaaatagaatttgtttaaagatgtgttgttcattcaacagaagtttcttgagggcccattataaggctaaattatacttccacccgaacagtttaattgacattgcactatccggcgcacgattgatcatgtctcttggagaagtaatatctagacagatccaaatggaatgtggtaattgtagatctttgtgatgcttatgtggatttctctgacatctatacaagttattaatattgaaaacaagtactcctgtaaatcagtgattaaaaaaaatacttctgtgggaattagaattgatccacttgtatctgttttctactttctagctccatatcagatttcacttgaaaaaaagtctactctgctgtagacaatatgtttggatttaaaatgaaatgtctgaaacgatggagacctgtttgcatcagtggggcgggtcattcaatataaaactttaaaaaacaatacggaatcaaaagtttattaagcacccaatatagaattggcactgtgctgggcatcaggtttatggtaggaacaaataaaatggtccctgttgtcatggagtttcatggggatgaccgactttaaataaataattacatgaacaggccaagcacagtggctcatgcctgttatcccagcactttgggaggctgaggcggatggatcacttgaggtcaggagttcgagaccagcctggccaacatggtgaaaccccatctgtactaaaaatacaaaaattagcaggtgtcgtggcatgcacctgtagtctcagctactttggaggctgaggcaggagaatcgcttgaacctggagggtggaggttgcagtgagcggagatcgcaccactgtattccagcctgggtgacagaacgagactctgtctcaaaaaaaaaaaaaaaaaaattgcaggaacaaactatggtcagagctgtgaaaggaaagcaatggcatggagagaaatggaagcaggggtgaggcgaggtttctctggggtcacagttgtggggaggcctgatggatgagtgggcacagagcagtgggtgctaggtggaaggaagggcgtatgagaaggtaaagatggaaaaggtgatgtgaaagttcgagaacagacagaagagtgtgtgctttgagtgcaatgaggaggggcacagtgccatgagatgaggatgctgagggaggcaggggcctcctcatttggcaccttataggccatttaagggctttttgtttttgtggaatgcaaaggttggctgttggagggtttcagcaacagagagacatggccagactcagttttcatccctctggttgctgcatggatcatagattggagtgggggaagagaggaagtggggatccagttaacgaggtactgctatggcctaatggaagcatggactggggtgaagatgttggaggcagaggaaagcgggtggataccagcaatgtgttttggaggtagaattgacaggtcttaatgatggaacacgaagcttgagggagaagagaaaaccaagtagaaacctaggcaggcttagagcgtatgcccatttctcttataaaagcttgatgatagtagctgtggagcacaatatagcagttcctttgaacattttgtatttgtgataggatttttatcatggctttttttttttttttttttttttttttttttttctgtttttttgagatggagtttcattcttggtcgcccaggctggagtgcagtggtgtgatcttggctcactgcaacctctgcctcccagattcaagcaattctcctgcctcagccttccaagtagctgggattacaggcactcgccaccacacctggctaatttttgtatttttagtagagacggggtttcaccatgttggccaggctggtcttgaactcctgacttcaggtgatccacctgccttggcctcctgaagtgctggtattacgggcatgagccatggcacctggacttatcatgacttttgaaaagccaggagttgactgtgactgcctggggtgatatgttacgttagacttgccctgggaggagtgagaggactactctttgtgagtcaagagtttctgccaagtggatctttcttattcagaaggagagaatcaaatttgttttattgtccatttcacaagtgacattaaagggaaaggagtggggaggcgggggggtgggggttgagcatgaaatgtcaaaataacagtggtttttatctttaaggtttggcatggattttaaagaaatagaattaattggctcaggtggatttggccaagttttcaaagcaaaacacagaattgacggaaagacttacgttattaaacgtgttaaatataataacgagtaagtagtaaatgtttacatttttttgaatggcaaggtacgctgaatctgcactattcttttttatgcttctctcttctttattagggtatcatttatttctttctgatcctcattaaacatttcattctaccaagaggagtttggcttactccgagatgatctcactttactgtggttatttcaataaaaatggatataccattgatcatccttttggtgctatcttcagaactgaagctatagagtcatttgctttaaagtgacatgcaaattcatgaaatgctccgtattttaaaaaccgtggcaccagatagaacctatcattacccacaaaataggtgatctttgagatgttctagtcttaccttcttattttatagatgaggaaactaagatccagagatgtgaagtgattttgtctaagataaaagctagatggtaattgttctctggttgtctgttattgtataaggcactgctccaaaatgcagtgcttaaaaacagcaatttattgttgtctctaatggttccatgggttgattgtgctcatctggacaattctcacttggggtctcagagggatttgcagtcagtagtcatctgaaaccttgactacagcctatcttaggctggatatccaagctggctagcagttgacaccggctgtgggctggaagttcagctgggactgtcaatcagaatacctccacatggcctccctatggggattgggcttcttacaacttggtggctgggtttcaagaaggattgtccccagaacaagtcatccaaaagatcaggagtgagtggcaaggcttcttttgacctaatctgaggagttccagaacgtcactaccatcaagttatattggttaaacaagtcactgaagccagcttagattcaaggggaggccaaataggccctaccccgtaatttgtcattctaggggatgagttctaagaatattatttagggactgggtgtggtggctcacgcctgtaatcccagcactttgggaggccgtgcaggcggatcacctgaggtcaggagttcgagaccagcctcaccaacatggagaaacccctctctactgaaaatacaaaattagctgggtgtgatggcgcatgcctgtaatctcagcttctcgagaggctgagtcagaagaattgcttgaacccgggaggcggagcttgtggtgagcccagatcatgccattgcactccagcctgggcaacaaaagcgaaactccctctcaaaaaaaaataaaaataaaaataataaaaagaatactatttagggaggctgaggtgagtggatcacttgagcccaggagtttgagactagcctggggcaacatggcaaaactccacctctacaaaaaatacagtaattaggccggtgtggtagccacgcctgtagtctcagctacttcagaagctgaggtgggaggaccatttgagcccagtaggtggaggctgcagtgagccatggtcacaccactgcactacagcctgggtgacagagtgagaccctatctccaaaaaaaaaaaaagaatgttattcaaattatggatttatatccaagaagatataaatcacagtgtcattcattaacagtaaaaagttagaacaaacaaaatatccagcagtaaagaaatgagtatatatattttgttctgtcccctgatcgatggctgttttgcagccattaaaaatgactggctgggccaggcatggtggctcacgcctgtaatcccagcactttgggaggccaagacaggcagatcacgaggtcaagagactgaggccatctggccaacatggtgaaactctgtctctactaaaaatacaaaaattagctgggcatggcagcgtacgcctgtagtcccagctacttgggaggctgaggcaggagaatcgcttgaacccaggaggcggaggttgcagtgagccaagatcgcgccattgcactccagcctgggcgacaaagcaagactcttctcaaaaaaaatgactggctgggtgcagtggctcaggcctgtaatcctaccactttgagaggccaaggctggtggatcacttgaggtcaggagtgcgagaccaacctgggcaacatggagaaaccctgtctctacaaaaaatataaaaactagccaagtgtggtggtgtgtgcctgtggtcctagctactagggaggctgaggtaggaggatcgcttgagccctaggggtggaggttgcagtgagccaacattgccactgcactccagcctgggtgacagagtgagaccctgtctcaaaaaaaaaaggaagaatctaaaataacattattttaggattgtcaaagtatcagtaattttttttatttttgcaaatttgtgtcatatactttaaaacttcttgcattaaaaaataaaattgtaaaatgattattcttcctcatctttgaaatctccaatttatttactgcacttagcatggaattttcttaggtcttggcaacacatccctgtaaagccttccaccatttcaccttctctgcataagttatcctctttgtgtatatttgccacacattgaaaatcctgaattaggtacttcacactgcctgggttacctagccttgctgcctaaatgtggtttgcttgtgaaatacaaagattttaacacaaatctaagcaaaacataatgtatgatttagctatgaaaaattgcactggctgggtccattggctcatgcttgcaatcccagcactttgggaggctgaggcaggtggattgctagatcccaggagtttgagaccagcatgggcagcgtggcaaaaccccatctctacagaaaatagaaaaaattagatgggtgtggtggtgtgctcctgtggtcccagctactcaggagactgaggtgggagaattgtttgaggctagaaggttgaggctgcaatgagccaagattgtgccactgcactccaacctgggtgacagagcaagactctgtctcaataaaataaataaattaattaaaatgacatcactggcatttcaagagtactacagatgatttttaaattgtctgatgcttggcattaagtcgctgccttttatttatttattttttgagacagagtcttgctcttttgcccaggctggagtgcagtggtgcaatcttggctcactgcaacctccgcctcctggattcaagcgattctcctgcctcagcctcccaagtagctgggattacagacatgcgccactgtgcccagctaaattttttgtatttttagtagagatggggtttcaccatgttggtcaggctggtcttgaactcctgacctcgtgatccgcccaccttcgcctcccaaagtgctgggattacaggcctgagccaccgcgcccggccactgccttttattttatcttgagagtgagaactgctatgttttttttcagtatgttcactttttccttttgaatgtcctggcttccattctaaaactatgtgagaaccacagcaatggtttaataagggaatgtagacagttgtctattacatgaggtgttttgtggttgttatgagggatgtacactgacactgccatgttccctgttccttttaactaggaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaaggtaactaaaaataaattctcatagccataataggatggaaggaaattgttatttactatgtatgggccactggataaggctattaatcatcacgattaattatcacaattccctctgagagacactgttatctctccattccgaaggtaaggagaaagtgaaaatctcttccttgctcctcctcttgctgcagacttgctctcacaaccctctgttacatcctcagctgtctgcaaaatctcaggttcagctttcctgactccattgtttcatggagagccttgttcacgtgccggcttcagcgcaggctgtttaagtgtagtcttgtgaagagagttttaacatatagatgctgcatctgggggctccctcctcagctaccaacacttttctgtccctctcttaggctgtgattggtgtggtgccgtcagagggtctctttggaatgtaactataccacttatgctggggtggtggggagtgaaaatatttttaagaccacaagctgagatgggggcaccctcatgttttatgtcagttaagccattgccaaacaactggagatcctaaagagctggcatctgtctttgaaagtcacccaacctattatggggacagtcctctcactaaaatcctgaggccaatggggtcccattcattcattttctcctgccccacctccatctccatgtcgtgtaagtgagaacattatcatcagttcaggagttattgaccgtcagcatacaggacttcagctttcagcaaattcttggctacctcttcctgttttcaagctgacatatatacaaagaatataaatgaatattgaggctaacttaattcagaaaaaaaataaaacgtggttagcaaaaaaaaaaaaaaaaaaaatcaagcctccaatttatgtatcttagtaatttgttggcacttctcttagagtaccttccctattgttttaggtttgctttccctttactctctcctattagactattatccccgtgacggcaaggatatagtgtctaactgattttctcatctctaggtgcctttcatgcttagtagatcaatggtgaattaaaaggtttcaaagttactttatataataatgaaatttagtttcctgcattgtattcatgttcctatttctatctgttagcaatggtgattgcagatcttcagcaatgaagaatgggtggctcattttttttttcttctcgtttttttttttttttttttttttgagacggtgtctcgcactgtcgcacaggctggagtgcagtggtgcaatcttggctcactgcaagctctgcctcccggattcacagtattctcctgcctcagtctcctgagtagctgggactacaggcgcccgccaccacgcccggctaattttttgtatttttagtagagacgggatttcaccgtgttagccaggatggtcttgatctcctgacctcgtgatccacccgcctcggcctcccaaagtgctgggattacatgcgtgagccaccgcgcccggcctcttctttttttttttttgagacagagtcttactctatcgctcatgcgggagcacaatggcgtgatctcagcttactgcaatctctgccttctgggttcaaatgattctcgtgcctcatcctcccgagtagctgagactacaggtgccgcgccaccacacccagctaatttttgtgtttttagtagagatggggtttcgccatgctgcccaggctggtctcaaactcctgagctcaagcaatccgccagtctcggcctcccaaggtgctaggattataggcgtgagccaccgtgcccagcccagctcatattttataaattagctaaacaaataaagctctggacatccgggaacttatgattgaaataaaaaatggcctattatattttgattcaaatttgtttattatatttagatttctattttgtgacatgttttggggttctttttttttctttttttttttttttttgtgagacggaatctcgctctgtcacccaggctggagtgcagtggcgtgatctcggctcactgcaagctccgcctaccgggttcacgccattctcttgcctcagcctccccggagtagctgggactacaggcgcccgccaccacgcctggctaattttttgtatttttagtagagacggggtttcaccgtggtctcgatctcctgacctcgtgatccgcccgcctcggcctcccaaagtgtttttggggttcttaagaagataaggtataagcttttaaaaagttatgaaaaactttaaaaagttataaaaaattttttataaatttatatttattgttacttttaacatactgtgaattttatacccaggtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaaggtaagtggaaaatgtactttattaattgatatatatataatatagtaattttaaaatatatcttctcagctgggcacagtggctcacgcctataatctcaacactttgggaggctgaggcaggcagatcatctgaggtcatgagttcgaaaccagtctggccaacatggtgaaaccgtgtctctactaaaaatacaaaaattagctgggcatggtggcgtgcgcctgtaatcccagctactcgggaggctgaggcaggagattcgcttgaacctgggaggtggaggttgcagtgagccaagattgtgccactgcactccagcctaggtgaagagtgagacttgtctcaaaaaaaaaaattatatatatatataaaataagatagatagatatatatttttttctctagttttagaatagtggttgattgatagttatgagaaaatggtatctgaacatttccatgcaaataattactgtgactggcacagccaactggctgctctgcccctgttcctcctgcctcctctaagtgactcagctttatttgagaggcagaggggactctgttgactgttgctttaggaatatggttccctaatctctcagtcattactcgcgagggctgtcacagctactgggtccagagtctaatactgtcttggttaagcatttcaaccccatgattggaaaattgcggtaatcccggactgggaaagtgtatcatcccttagtattttcattttcctctggcttttatggtccggacaaggagtttccctattttttacttctcattaaaatgacagaaggtgagagacagaatagcccttcacagcctttcctccattccctattccctgtgacttgcctaagcctgtcacaagctggccgtcctgaatcctgtccctggacctttgctcatgttcttctctctcatgggacactcttctgcctgccccctttggttgtaattcctttactgagcctttcctgatcactctggaactgcctttttctgttctaggcagaagtaccttatttatgtggctatctgcttatcccacccctctaaaacagcaaggaataaggaatgaaacaaaaaaattccttgagagaaataagttcccatatacacagttgtttattgggctcagagaggaatgagtagcccttaaaaggtattgcttccgtggtctgcccaggggctggatgtctgatgcattggtgttttgagtctgtctggttccaatatgtctcttctacaatatctgaagttgttctttgaaggtggaacattgtcagaactatttcaaaaggataaatgtagagttggttatgctttcactttgggataaatcatacatatagttaaataacaaataagcacaattatttctatataaaataatttgcaaataaatgcagaagtgtaggcattaagctcctagtcctcagaatgaattagcaaaattctgactggtgcctacccacttacctgccaactatgccccacaccgtgtgtgccctgtgtcatggactgatcttttcttgtgtctatttgcagagaatttttactctggctgcagttgctcaagggtcagactttattattcttcttaaatttttaatttttatttttttttgagacaaggtcttgctcttttgcccaggctggagtgcagtggcacaatcacggctcattacagccttgacctcctgggctcaagcagtcctcccacctcagcctcccgtatagctgggaccacaggtgtacaccaccacacctggccatttttgtgtgttttttttttgtagagacagggtctcaccatgtttccgaggctggtctcaaacttttagactcaaagtgatcctcctgcctcagcctcccaaagtgctggcattccaggtgtgctccactgcacccggcctcaagctttgatactgagacttctttcatcttctataacttttcaggctctcactactacagttgttgatttctctcctctaagaaaagatacaatgaaggtgtacaattttggggttgtgttttgcaaaatagcagctgtaggtggttttgccagagaatggtctttacctaacacagcccctcttacaaaagtctccaagtgtttaccactttctgttggaatcttaggaactagaccaaaggcgctgggaagggacataggggtttctggagtgagggcttcttgtgcaaggctgcttctctctaaaatgttcagtctcctaaagcccaggctctggtcatcctcagcctgagcatcagtcctgttcctgtgcctcctaggtgaagtttgcatcccttttatatgatctacagccctatattttgtctaatcatattataactgattagacaaaatgtggcattattgtttttatttcttttgtgttttacaaggtctcactctgttgcccaggctggagtgcagttgtatgatctcagctcactgcagcctggacctcctaggctcaagcaatcctcccacctcggccccccacatagctgggactacaggtgcaggctaccaaggcaggctaatttttgacattttgtggagacaggattttgccatgttgccctggttggtctcgaactcctgagctcaagtgatctgccgaccttggcttcccaaagtgttgggattacaggcatgagccaccatacccagcttctttttcttttctttttttcttttttcttttttttttttttttgagacagagtctcctctgttgcccaggctggagtgcagtggagtgatctcggctcactgcagcctctgactcctgggttcacgagattctcctgcgtcagcctctcgagtatctgggattacaggcgcctgccatgatgcccagataattttttgtatttttagtagagacagggtttcaccatgttggcaaggttggccttggactgatgggcccacgctgtctgcccgcttcagcctcccaaagtgctgggattacaggtgtgactcaccacgccctgcccactttttcttttgaatgaactacaaaaagtgatctgatattttcactagatagcctcatccagcttagatatttacacggcttcacaaattcaattttctgtttcttagagtcaggtgatagccttatgtgggactagcagtttcacttgcaatcctgacatattcctacacattgcaacttgaacatagcataggaatgttttctctccacatccactccacatctgtctacagctttccatctgtattactggtgttaggctccaatctgactgttaattgaattctaatccaactgctaattgctgtatgagccgtcatctcaagctggcttctcggaagctcctccttcagccttccctgggcttatggtctcttccctcttaggtccttactaggtaggccctctcataagtgtgttatcccgtagagtctgtgtgtttagcctaagattgtattaaaagtccagccttttcaaaaatagcaaaatattaattttctcatcaactaccttcctgtttttgtggtctttagaatattggtcagtagagctgggtgtggtggcctgtggtcccagctacttgggaggctgaggtgggaggatcgcttgagctgaggaagtcaaggctgcagtgagccatgatcatgccactgaaatccatcctggataacaaaatgagacactgtctcaaaaacaaacaaaaataatattggtcaatacctcctatgggctgggcgtggtggctcatgcctgtaacctcagcactttgggaggctgaggtgagcagattgcttgaggtcaggagtttgagaccaatctggccaacatggtgaaaatctgtctctactaaaaatacaaaaaaattagccaagcgttgtggcacatgcctgtaatcccagctcctcgggaggctgaggcaggagaattgcttgaacccaggaagcagaggttgtggtgagccgagatcatgccactacactccatcctgggtgacagagcgaggctccatcttacaaaacaaaacaaaacaaaacacctcccttaaaaaaaaaaaatctgcttaaagaattgcatggataaaaatatttcagagctagttattagcttccagttaacttggtatgctttcatggtggaagggatgtgtttgttaagaagttgtcagaggcttggagaaaagacccccaagagaaattctgcacaggctaatctgcactattgttgggaatggacccattccgagaatctcaaagttggaagggatcttaaggatgtctgcttcagtccctatcagatcatggactcatatttgcaacatttcctcaagtggttgttcagccctatcttgggatggggaactgtctaactcccattctttggacaacactattaggatattaggatattttaaagctaatctttaggtcatttccaccctatagtcctggatcttttcccttggaccatgcagagtgaatccaccttgcacgtgacagcttttcagatattcgagggcagctgtgcccagagccacctctggtgtcagctaagaaatccttacttctgtccaggcgtggtggctcatgcctgtaatcccagcactttgggaggccaaggtgggtggatcatgaggtcaggagatcgagaccatcctggctaacacggtgaaaccctgtctctactaaaaaaaaaaaaaaaaaaaaaaaaaaaaactagccgggcatggtggcgggtgcctgtagtcccagctactcgggaggctgaggcaggagaatggcatgaacccaggaggcggagcttgcagtgaaccgagatagcaccactgcactccagcttgggtgacagagcgagactccggcccaaaagaaaaaaaaaaaaaaagaaatcctgacttctttcagctggcattttaaagacgagtcatattaaattccctgattttggctacctgtgtaagggtaaaggtcttataaataatataaaaatagtcttttctgtatataattaagacatgtggtaatagtatgttaagttggtacatgtaagttaaatttttttttttcatagccaagtaatatattcttagtagatacaaaacaagtaaagattggagactttggacttgtaacatctctgaaaaatgatggaaagcgaacaaggagtaagggaactttgcgatacatgagcccagaacaggtaaggtctctttcctgtctgtctatattttacttcttttattttgaaaattataaaaagagtagacactacttatataattaaaactgtacagaagtatatactaaaaattttccttaccattcttttctacccctattcttcttatcagtttattctttatccttttagataattttctgagttataaaaacatacaaacacaaatatacacccagattttttttacagaaacatatatatgtgtacattttttcaaggacttattttgttattttgtgactatatagcataatttctccatattagttcaaatagatctgccacattctttttttaacaactgtattatatttcaaaatatggagataccataatttaactatttttttaaatttaatattttttgttgttgttcttattttgttttagagacagggtcttgctctgtcacccaggctggagtgcagtagtatgattattgctcactgcagcctcaaaatcttgggctcaagcaatcttcccacctcagcctcctgagtagctaggactctagaggcacataccactgtgcccagctaattatttttatttttattaattatttatttacttatttattgtagagacaaggtctcactatgtttcccaggttgtatttaactattttcttatcgaagggtatttctttaggttgtttacaacttcatacacttagacattcctccttattttgggtcccaagaacaaataattctgtgataatctgtgttagacttcttgaggtaaagtgattgaatagattgaccagtgcatttcaaacttaattgctgtttaattgtcattctaaaaaaagtgattctaataatactgtcccgtcaaaatgtatgagaatactgcatcatcatactctccagtgatcagttttgggtagtgtgttgaattaggagtatcttgctattttagtttgtattttccagatttttagtaaggtatgccctcttttcatatatttacttaaacattttctgcaaattctctactcatatcctttcccaatttctcataattaagttctcattttcttgtgtatctgtaaggaatcttgatctatattgggtgttgatcccgtatctgttaactatattatagaatttttctccttgattgttacttctttgtttataatgacatttgtggtactgcagctttttttttttttttttttttttgagatggagttttgctcttgtcaccaaggctggagtgcaatggcatgatctcagctcactgcaacaacctctgcctcccgggttcaagcaattctcctgcctcagtctcccaagtagctgggattataggtgcccaccaccatgcccagctaagttttgtatttttagtaaagacgggtttcaccatgctggccaggctggtctcaaactcctgacctcaggtaatccacccaccttggcctcccaaagtgctgggattacagacgtgagccaccaaacccagcactgcagcttttaaattgtcatatttatcaatacggctgctaggtttctcatttttattttggaggcttctattacaagattatgaaaatattttttggttttactaacataaaaattaactgcaatttgaattaacttttgtttatgtatgagaaaggaatataacttgattttccccgtgtgaatatgcagttgcttcatcactacgtgttaagcagttaattatttaaatgctattttaaggaaaattcatagagacagaaagtggaacagaggttatctggaagaagggaggaatgggaacttcttgtttaatgggtatagcttctgtttggggtgatgaaaagttctggaaatagatagtggtgatggttatacaacattgtgaaggtagttaatgccactgaattgtaggcataaaaatggttaaaagggtaaattttatgttatgtctattttaccacaataaaatattattttatcatatataaaattcccacacattcatagatgtgtttctggactttgttctgtttccttaatttattttatatttctctctttaatattatgctatttagattattgtagcattataaactaggctttagtatttgaacagcaggacctgccacattattcttcaatttaaaaatgctctcagctattcacatttacaattccaaatgaactctgtaatcacattgtcatcttccataactggttttgaggttttgatagcaattgcatcaaatttgaggattcaggtgaggaacattgatatcttcatatatttgagacttctccaaaattggtattttctctcacttattcgagtcctccatcagtcagcttttgccagactatgctgtggtaacaaatgaccccagtttcttagtggtgcagaaaataccaagggtctatttcttgctcacatgacaagtcggcagcagtctggctggctgcagttttgctctgagtgtctccttcattccaagacccaggctgtaggaaaaatgctatctgagtcactgccgtcctcaaggcagaaagcaatggcagaaccttgtgatggcttttacatgttctgctcagcagtggcatacatcactaaacatcattgcccagagcaaaatgcatggcccagctcaaggcaatgagggtggagaagagtaatcctctcactaggaggccagtgcagcattgggggcaatcatacaacctacctcagagccacttttatactgttcaaaatctatatatatatatatatagagagagagagagagagatttattatgatatatatatatatatatatatatatatatatattttttttttttttttttgagacagggtcttgcttttcacccaggctggagtacagtggcacaatcatagctcaccactgcgcagcctcgacctccttggctcaggtgatcctcctgcctcagccccctcagtagcaggactacaggctcaaaccaccaacacctggctaatttttttttgtattttttgtagagactgggtttcaccatgttgcctaggctggtctcgaattcctgggcttaagcgatccacctgtcttgacctcccaaagtactaggattacaggaatgagccacggcgcctggtcatattgtttatatttttgaagctttctccagaatctgtattgcattttgctattaaaatgagattccatgcttgaacccgggaggtggaggttgcagtgagctgagatcgcgccattgcactgcagcctggtcaacaggaatgagactccatctgaagaaaaaaaaaaaaaaagaaaagaaattccatatctctaatttgttattagtgtagccgttaattttaaaaatatatctctttatttttaattgtggtaaaatatacaaacataaaatttaccaccttcaccatttttaagtgtatagtttagtggcgttaaatgtgttcacattgttgtgctttcatcaccaccatacatccacagattacttttcattttgcaaaactgaaactttacacccgttaaagaactcctattctcctctccctacagcccaatcaactaccattctactttctgtctgtatatttgactattctagatgcctcatgtaagtggaatcgtacggtatttacccttttgttactggcttattttactcagcataatatcctcaagatatatccatgttgtaacatgtcagaatttctttttaaggctgactaatgaattccattgtatgtatacaccacattttgtttgtccttttatccatcaatggacacttaggttgcttccaccttttgactgtggtgaataatgctgctgatgaacatgggtgtacagctgttgagttttaaatatttgtctcatatatagtctcattatttgaatgtgatttttttttgggttgattgcttttattttttaccttttgggttgtttatcctattttaatttctgatttgtaaatgcccgttaaagattattttgctgacaatacagctttcaaaatatctctactattttgtcatccaagaatagatatactgagctatctgatggtttgagagtctagaatggagaaggcatgtactttttccttttggggagccagttggcataaaaaatatagaacacaataggccagtggctctctttaacttcctgctgctttcagtatctcctgcatcctgtattgctgccctcacactatttggttaaaaacattcatcattgtactttactttttattatgtgtgtgtggtttttttttccatttaaaaaccttttgttggctgggtgcagtggctcatgcctgtaatcccaacactttgggaggctgaggtgggcagatcacctcaggtcaaggggtttgagaccagcctggccaagatgttgaaactccatctccactaaaaaaaaaaaaatacagaaatacaaaactacaaaaatgagccaggcgtggtggcacgtgcctggagtcccagctactctggaggctgaggcaggagaactgcttgaacctgggaggtgggggctgctgtgagccgagaccacgccactgcattccagcctggtgacagcgggactccgtctcaaaaaaaaaaaaggcaacattttgttgaggaacaatttatacagtataaaatgcacagatcttaagtgtatattttttcgttttgacaaatgcatacacctctgtaacttataagactataaagatatagaacattttgctccttcaagctcctttccagtcagtgcctcctccccactgatcagaagaaaccagcactctgagttctatcaccatagcttagttcttcccgtttttgaccttcatatgaatggaatcatacagtaggtactctttgtatttaatttcttcattcaaaataatatcttctggaaaaactttgttgctcataccagcagagaattcctttttattgctgagtcgtagtccattgtatgaatatgccacaacatgtttatccattcttctgttgtggtcctttgagttgtttccagttatggaatattgtgaataaatacgctatgaacagttgcaatgcaagccgcctactgggtgctattttaactgctttacccgctgcatctcactctcacaatcaaactctgtggttgatactgttgttatccttgttttataactgagattattcccatgttgatcgttaatttacacagaggattcagctattcggcggtacagatttgaacctaggcagtcagactccacagattttgctaataaatagacattgttttgtggtgtaagatgttttggtcaaataacttttttgggctttagaaggctggatatttatgtaaggagcataacaaaggtaaatctattttggtctctttagatttcttcgcaagactatggaaaggaagtggacctctacgctttggggctaattcttgctgaacttcttcatgtatgtgacactgcttttgaaacatcaaaggtaaaattatctcaaagaaagaattaaacaagaaaaattactgactaccaccttcagagtgctgctgcagacagttcttgccctcacgtgaggatgggcttgagcatattagtatctgactgcaaatgaaatatgaattttctgtctttcaaggtttggcagagaccaaacactttcttaaagaccaaaaactttgatcttccctggaaggtagtacatctcataagacttgtaagacttgtcagtcagtaacattttattgattgactgctttgtgtaagacactgtgctaagtgctgtaagggttgcaaaaataaacaagccttggctgggcgcggtggctcacccctgtaatcccagctttgagaggccaaggcaggcagatcacttgaagtcaggtgttcgagaccagcctggccaacgtggtgaaatctcatctctactaaaaatacaaaaattagctgggtgtggtggtgcacacctgtaatcccaactactcagggggctgaggcaggagaatcgcttgaacctgggaggcggaggttgcagtgagccaagatcacaccactgcactccagcctgggtgacagagtgacattccatctctaaataaataaatgaataaagccttgttctcaaggagcttattttctaaaagggaagataatataagagaatgccataagcattttaggagaaggcatgaagtctgtggaagcagctgggagggagatctttccagctgtagggacttaggtttcatggagacatctaagctgggctctgaaggatctgttggcttctaatagtccaaaacagaaaagttgattctagcatggaggcgggaatgtacagagtgtatttggggacagcaggcagtgtaagttgtattggagtatataagttacaaggaagtagtggttggtgaggctagaaagataggttgggctaacttgaggaaaaaatgtggaccttcttgcttagacagtggggagtcactaaaggcagtaggcaagtggatatcctactctttttttttttttttttgagatagagtttcacttttattgcccaggctggagtgcaatggcgcgatcttggctcactgtaacttctgcctcccaggttcaagcaattctcctgcctcagcctcccaagtaactgggactacaggcgtgcaccaccatgcctggttaatttttttgtatttagtagagatggggtttcaccatgttggtcaggctggtctcgaactcctgacctctggcaatccacccgcctcggcctcccagagtgttgggattacaggtgtgagccactgcacccagctggatatcctactcttaagctcaggaaagggaactttcctggagtcaataaccttatcctctgtaaaacagttagaagtacctatcacttagggttccaaaatgcatgaagggagattgtaaagatgatgcacttaacacttcatgtcgtaatgcaaggatggttattagattgggggtagtgtaggagagagggaatcctgcttgcttcttggctaaagagactttcccaaaaaatctggaaatatcctacatttcaggtattcctcagcctttagttctgtctttcctcccaagtaaataatttcctaatatacacctatcatttttttttccagtttttcacagacctacgggatggcatcatctcagatatatttgataaaaaagaagtaagcacttgaaaatcatcagaattttatttatttcaatgttttatttcttactattgactctcactgtcattgcagaaaactcttctacagaaattactctcaaagaaacctgaggatcgacctaacacatctgaaatactaaggaccttgactgtgtggaagaaaagcccagagaaaaatgaacgacacacatgttagagcccttctgaaaaagtatcctgcttctgatatgcagttttccttaaattatctaaaatctgctagggaatatcaatagatatttaccttttattttaatgtttcctttaattttttactatttttactaatctttctgcagaaacagaaaggttttcttctttttgcttcaaaaacattcttacattttactttttcctggctcatctctttattcttttttttttttttaaagacagagtctcgctctgttgcccaggctggagtgcaatgacacagtcttggctcactgcaacttctgcctcttgggttcaagtgattctcctgcctcagcctcctgagtagctggattacaggcatgtgccacccacccaactaatttttgtgtttttaataaagacagggtttcaccatgttggccaggctggtctcaaactcctgacctcaagtaatccacctgcctcggcctcccaaagtgctgggattacagggatgagccaccgcgcccagcctcatctctttgttctaaagatggaaaaaccacccccaaattttctttttatactattaatgaatcaatcaattcatatctatttattaaatttctaccgcttttaggccaaaaaaatgtaagatcgttctctgcctcacatagcttacaagccagctggagaaatatggtactcattaaaaaaaaaaaaaaagtgatgtacaaccacttcggaaaacaatttggcattatctagtaaagttgaatccatgtatacccacatagctatcaattctattcctacatacgtgcttacaagaatgtccataaaaccctgtttataatagccaaaagaacagggaacaaccataatgcacatcaaaagaagaatggattaaaaaaattatattcacacacaggagtactatatagtattgaaaacaattgaagtacagctaaatgtaataacgtaacacaatacaactctcagaaacataatgttaagcgaacaaagcaggttttcagaaaatatatgcagaataattccatttatataaagttccagagcatgcaaaactaaatcattttgtataaaaaacccaacaaatgtgatgagacaataatgggaaggaagggaatgagaaatattaaattctggatggtggttatctttgagggaggggaatgatgtgattggggaaatggactttcaaaggtaatggtaacttccttaagctggatggtaggtccactagtgtttgctgcatagttataccttttatcttaaatacattttgtatctattgtaacaaccactttaaagacaaccgtgctgtaaggcagtagctaaaaacagaaaatagtccatcgggaagggtaagatggctttctgctgagcacagggctagaagtgacagcccagtgggccttccaactatatgccagggtgttagatgagtagagaggagaccacccaggaagtctggacaaggggtctggcatgagctctggagaagatatatttgaggaacatggggtatgctagtttgttgtcctgaattgctgtagagaagataatttaaattgcatcttagaagacgaccctgagggtgaatttcaacttagggcaattgttttagtttgtttcttattggtttaaatggatacttgaagctggataatttataaggaaaagagatttatatgacttacagttctgcaggctgtacaagaaacatggcaccagcatctgcttcttccccggctgcttccactcatggtggaaggtgaaggggagccggatgtgcagagatcatatggcaagagaggaagcaagagagcgagggagaaggtgccaggctctttttaaataaccggctcttgagggaactaatagattgagaactccttgcttctcctccccagcacaccccacccccagggacggcattaatgtattcatgaggggtcttcccccatgacccaaacacctcccatcaggccccacctccaacactgggatcaaatttcaacatgagattttgggggacaaacatgcaaactatagcagcaaccagctaccattctaaaactgccatatgattttaggatttttaaaaagggccaaatttaggttaagcaaaaagtgaaaatacagtaagagaaaatagttttataaaggctttaaaaagtgttcataaagagcagttcatagatttttcacgtaacgttcatcaatagatgctaaaactattggatgaaaagctattgtggaataggatcttctacaaggatttaaatataatcctacagaagaggtatcaattatacaggggaaaatgtacctttacaatggtcaccacaataaccaagtgattcaatttagcatcacccaaggtggaacaccctaacattatgcccctcctgatgtgacttaagaattttacctatttagttttcttgcacaaagtgttaaactggaatttaatcatgaggaaattattagacaaatcctgaatgtagtcattctataagatgattgacttgggcttctcaaaaagtcagtgtcatgaaaaaaaaaaaaaggggagagacttgtaagatacaatgaccaaatgcaatgtttgaatctttattgtattctggatatttaaaaagacaaaagctggacgcagtagctaatgcctgttatcccagcatttttgggaggtcaaaaggggaggatggct

SEQ ID NO: 17324 - DNA, 26434 bp, Human; identical to SEQ ID NO: 12338

SEQ ID NO: 17325 - DNA, 28843 bp, Human
  misc_feature (1)...(28843): n = A,T,C or G
aggataaccaagggatcttcttgccctggggagaaaaaaaactcaaactatccatgcttagggcaggggagaggtagagaatgcctaggaagcatgtgacactcctaggcctagaggtcaggatactgtcttctaaatctccagtcacttcctccccaccctacatagtagcacaaagtggcacaactggggagtcagctgtgcctgcagtgtctggggatgctctgtgtccatccgcaagcattctacgtgacctccactctgtgcctgcaattggtgggttgtagaagaggtagtcacgaagggcccctgggagacccagagtcaagaggaagagaggcctaaaaaggagaaaagatagagaggggacagctggagaagagccacagacaggcaggagccagcaaagagagacagagagatgggggataactgaggagttctggggaggaggggagcagaacggcatctcccctgcactcccacgcccggcatgttgctggctcctcctgtcagctggagggtgctgggggggcgggggggaagggagctgcaaagcactttacctctcactccaaacctgcccaaggtgcagagcccccaaacagaccaacatcctgttctgtgcagagatgcatacatggatgcgtgggcccacatttaccaaaagaacacgggggataatcagagcctcagaggcataggcacatacccttagactcagtgcagaaggtccccaaaacttcccctcctctttctcactactcatccactgtcaatgaccctaggagttgaaaagtccttctccacttctacctttatctctcaatctgcagccatggggagactctgggagctacctaagaacagaggtgctgatggtagcagagtgtgaagctccagggttgggcaggagtggaggatggcgagacgagacggcagaagagggaagggacagctgcttgccctctccatgccaggtgccacgtgcaccaggtgggggggagtgggcgagtcacgaggctgtggcatggctgactcctgctctgctgtttaccagctgggaacgagagcaggaggaggtgccagggagcctcttgctgcagcctggcccctggccagttgcttgttgggtaaccaggagagtcaggcccagctaatcaaactctgggcccaggccatgcaggagaaaagcagcaccaggatccccagaagcctcgtcctcttggcccccttcagagccttcactgcaggcctcagtgtgggccactaggtctgggagcctctccttctcccaatgagtccagtgcagcatctctcctctcctcttccccaccatggcttctctgcctccaggcactcctccaggcctgccccttgccccaacagatgaggagcacgtagaagcatcagggggtcagggagtcctggcaagagcagcaagggttaggggcaggggccgagcaggcagaggcctcagggaactgaacagtcactgggaggagtctgactgcatcctagagaagagacacagtcccccaaacctgccctctccatctcccctatgcctgtcacctgtcttaggtagaaatcacaggattctaaagtcacaaagacttgggtccaaatcatagctcacccatttattgttcttgtgtgagtccttgggcaaaatcattaatatctctgagaatccctccactcactgatcaatctggaataataatgtttccctgtggtgggtgctgtgaatatttacacaaagtaaaagcatggatttacataaagtgtcctgcaaagggcccagcacacagtaagtgattaataaatgctagttcccttcctttctcctgtcctgtttctcctcaaggctccatgcactggtccactggtctctcctcatgtcccctcctggtgccaggacactctgccagccactccttttccctgcctgctggagggccaggtgctcccgccttccaccctccgccctcctccctcccctgggccctgctccctgccctcctgggcagccagggcagccaggacggcaccaagggagctgccccatggacagggccccacagagacagcaccgagcctcacggggtaagaggcccatggccctgcctgcaggtggaagagactgctggaggttcagaggagggcagaaatggcaagagactgggcaagaagtgaggaggggagggagggacaagagtgcagaggagaaagccctgggttggcagggagtgaaactggaggagaaacaggaggaggggctggggagatgacagaggagaagaaatcgcaaaaggagagaaacaggaaagaaagggagaagcgggagaaggaagaaacaggttggagggtagatggggagggaagagccaagtcaggggagccagatctagacccagcgaggggtcagaatgtggacaggccctcccaggtgtgggcttaccccccaggaggcacagggacactgcttccttgatctggccaggaccccagacagcagtggccgggaggctggctgctccacgttctgttcattcaccagtggagaaacctgtcctttaaggagtgacagacttggggagtgtggcagggggaaccacaccctgtcagctgcccatgaccacgtagcctggtcctttcctcgccactcacccagggatgtgggatttcatctctgcagagaatgtggggcactgggccatcagcagggaaggacagaatgtcaggccgtccttggccccacccatggtccaagtcaggaaccccctcagagcaggatcgcagggccacaggcttggtcagctgtgagcatggaggaggaaagtttgagggccagagccaccaagctccagggccacctggtggaggaagaactggctgcctgggtgagcaaggggagcacccccaccacaggactgctctgaggtgcaaggctagaggccaggagccggtgccacgtcagggaggaagctgggtggggccaggcaggagcaaggggaggtgggcggggctgggtggggccttgccacctcggggcagtcttttctcctccctcaccccagcagagcccaggccatcaggccactcgcctccacacagcctagtgaccacggcctgccagtggggagcatctcccgggcagaagggcactgtatgtgtgtgtgtgtgtgtgtgtgtgtgtgtgtgtgtgtgtgtgtgtgtgtgtgtatgtcaggtgtcaagactgaacagcagaaggaaaaaaataacagaatagagtcagaggttagggaagctatagggggtatagggcatggttgaannnnnnnnnnnnnnnnnnnngcagtcttttctcctccctcaccccagcagagcccaggccatcaggccactcgcctccacacagcttagtgaccacggcctgccagtggggagcatctcccgggcagaagggcactgtgtgtgtgtgtgtgtgtgtgtgtgtgtgtatgtcaggtgtcaagactgaacagcagaaggaaaaaaataacagaatagagtcagaggttagggaagctatagggggtatagggcatggttgaagggctttctgagacaaaagactggccatgtgttctgtgatgagctgctatgtggatgtaggaaatgggccaaggtctggcaggggaatcctctttccaggggctccctggctaggtgtttcatagatgttaactgcatgaatgggtgacacccccccacccaccaaccatgctccagctaaggccctcccctcaacggctgctccccctggaggtccgagtatccatgtgacccccatcgacccactcatgctccctactgcccaatctccacccagacccggccacgcagcagcagcagagaagggaggccttcctcttcaggctggtaggccagggaagcctggcccgtggaagccagagaggggtctgtatttgcaactctcccctcctcttcctccaaacatcctctccccctactcccaacccccacatctctgaagccctggtgttttcaggcatagataagcaaccaagagatttcagtcccacagagatttaactctggctgtaggatatttcttgtgcacctccaatgaaattacaaagtaaataagaccaacacagtccctgccttcacagggctttacaatttggcaggaaagacccatttcatagacaatgacacaattacagcagttaggtgacagttggtgacatggtgagtgccaggaaataaaatgcaaggagctaaatgtgtcagcacaagggcaggggaagggggtgtgtgtggcttctccaaggaagaaacataatcagagacctgagggagaaagagaagttggctagattaaggggtacaggagggacaggcattctaggcaaaggagcagcttgggggagtcccagaggcagtgaggagcctgacacttctgggtacctggaagagggccagtgtggcccaagggcagaggaggagagaggggcactgcagggggtggcctgcctgcccttcagacgccaggctctgagggaaggagtgcggcagtgggatcctaggagtggggaaagtgtctcagcccctcatgatcttcaacctttgacgtcaaccccctctcttgtctttacagagctgctggctgcaaagaagacccacacctgtgagtagggggtccggggcaagaaaatggctggggcataatgagatggagaataattcagcaagtgatctgtggggggactgaggttggacagaggtggaggagtcaggaagagatggcaggcaacaggaaagcaaggggaggtgcgaggaaaccacagatcagggcagtgggaggagatgaggaagaagcctgaagcatgaaaggaaacactgtaaagaaactaggagagaacaaaggaaaagggaaccgccttgtgaaaaaaggcgaggagaaatgctggacagaggcagggagatgggagggggtggggccgactgccaggccggggaaggaaggagatagaggtaggggggtgtgcggaggcggggtggcctcaggaactcaggaactcagcgctgctgccaagggagacagggagcctgcaccaggcttttttttttttttgagacagagtctcacactgtcgcctgggctggagtacgatggcacaatctcggctcactgcaacctccacctcccaggttcaagcgattctcctgcctcagcctctcgagtagctgggactacaggcacccaccaccacgcctggctaatttttgtatttttagtagagacggggtttcaccatgttggtcaggctggtctcagactcttgaccttgtgatccacccctctcggcctcccaaagtgctgagattacaggcatgggccactgtgcccagcctgcaccaagctctgtggtcctgagccaggtttggtgttcatctctgtggttaacacatcctgaggtgtgaacaagcctggagccagcctgtgcaggactagagagcaggagagctttatctctgtaggaaacagaatggacaggggcactctgtgtcctggggccctgaaagccagactacagcaggtaagaagggcactagagctcagagaggacttcccagtggacgctagtgaataagaatcctctctagggaccactcagcacatcagctctcctctcctagtttgtggcaaaggctagtcccccagagaatgcacacagtcccaaagctatgcccatcagggccatgcgtgcccttctgtgagcatgggtccctgaatcgagaggatccctccagggtaggagtggccacaccatttctccatagccgtcccttgactgccttgccagttcctcctgagagctcactgccatctcgcccaatgccaaaattgtctagagcctccctgttccaagtagagacatctcagagagcaaagcattgcccttctccatgagctgggcagcccagggctgagggccatccaggatgctacctcctcctgggtgggggttgctttgctcagcataatcctgatcagtgtctcgcctgcccctagccacagggccccacggaaatgctgagcagggccccgggaggaaagcgggtcagggagtgacgcgggtgagctgggggaggggggtcacggaccttatgtgggtggggggagtagggggactttcggagcagcaggaactgggagaggtcaaaccctattcctacccttaacccctgacctcagaaacctcagccaggactatacctccttatccctttcccatcccaccagtcctcgtgtccccaccccaagagtgttgtcctgaggatccaggctgacagcctctcccccactccacggcccagctcctgaagccccaggaaggcccaggaaggcaaggaaaggcctgtgcctggatgagagggtctggagtcccagcaagatcagacacctctcaggagtttgccccacagaatccaggagacattaaggcctcccccaggccgagagactctgaaaattggctcctgaattgagacaaccccaagatgggggtccaagatggggaacccgggggaactccccagaccaagagggagcctgaatactgaggggccctgaagagggactctcaaagccaatgtaccccacaaagcacctaagaggctgagaaggtctctggaattgtttggcccctgagaaggacccccctcccccaggccaaaaaacactccagagagactcacataccgagggacctcccaggctgagacaccctcaaaagcagacttgaaccagagaaaccctcccatccttcaagtgggatccgaagccagtctgcctgggcttgaatcctgactctgccacttactagctgtgtaaccttgggcaagttacttaacctctctgtgtctcactttcctcctcgaaatgaggataatggtagctacttcataaagtttttttattttttctttttgagacagagtcttactcagttgctcaggctgtagtgcagtggcattatctcagctcactgcaaactccgcctcccgggttcaagcgattctcctgcctcagccccctgagtagctgggactacaggtgctcgccaccatgcctggctaatttttgtatttttagtagagatggggtttcaccatgttggccaggccggtctcgaactcctaacctcaggtgatccacccaccttgggctcccaaagtgctgggattacaggcgtgagccactgcccccggcccacataaagtattttgtgaggattagattatccacataaaacatcgagaaccatttctgacacataatagtaagcactattattatgattatgagtatgatgatggtgatgatgatcattatctacactccaatttcagcagtttggctcctaaggaaatttctggtttccttctgtggattgtgggtatttgcctggtgattattactgcttctatcatttccatgtattccctagcgcaagatatatgtggtgtctgcagggaggagcgtgggcatgggagtggtgggacagccccccaggctgcaccacactgggtatggctgttggcagtccacagggtgtcaggtggcacatgccaccaccccaggcagacatcctgtgacttacctctgaaaacatccctgtccctgaagtcacctggcaaagagggtcaggcttggaaggtcctcgggggtaggaggagtagaaatttggcttcaggctcgtgtgagctccattctggctccccagccagaactaccctggcgggtggaaacagcttttaccgcgtgtggctgtcgcatgtggttttggaattttccaacgccccctacgattggctgcccctcccctcacaccctgccccaggcccagattggccacgtggggcgcctgtcatcctactcactgcaccccttgggggtggggtggggggttgtcacttggccacctgtgtggtgcagagcttaaaccccccagtccagaagcactgggggagagagctaggtgcagagcttcaggctgaggcgctgctgagagggcctcgccccgcctctgccgccagctgcaccccactcctggaccacccccctgctgagaaggacagggagccaaggccggcagagccaaggctcagtcatgagaagtaagtgaatggggccacctgggggcgggggagcctggaccctgtcgtcacccctctggaaaggaggatgtcttgggaacagtgtgagcaaatctgagcaaagcagggtgcgtcctggtcaaggtcaagatctgttgggagatgggtggagcagctggggagtcctgctggccaggcggctccctgacagcagcaatggtaagaggactgttgaggaattcctgagttccaaaaagaacctccaaaagtatctgaggtatccaggcccttaattttacaaaaagactgagagccaaggaggccgcgtacttggcccaatgttacacagctggtatctgatgggggctggtaattactaggggccctgaacgcactctcctgttacagtgtttcccttgttacagtgtttccctctgtgcctccagcctgcttgtgagtaaaaggaggccagagcagttgctgtgctctgaagcaacaggacagcgagagtcaactgaggttggcaggcagcagggcacagaatccccgcgtccaggcctcaaagccaccaggctttctgcccaatccagggacatgaggactatgtggaatccagtcagggtgcacccgggcacatgcctgcgtgtgtgtgcatgtgtgtgtgtgcgtgtgtgtgtggggtgtgtgtgtatgtgtgtgtgtggttctccagggtcagtcacccatttgaccggggaagcaaggcaatggagatgggattggaaagacctcggcctcacccttttcctggcttggagccctgggccaacagttggtgggcagatgtctggggttcctgtgccttccagcagagcaagggtgggcaacctcaggaagtcccctgtatttgttgtgaagggaagccagggaagccagagaagctctcagagcacaaggtgaaggaggaaaagggaagccccatgcccctgtggctgaggcctgaagcagccccagcttcaacctggggtcttcccacaagccacagaagggaggccgtattgagtcctggaaagacccctggactgacagtgtaagaccaggcacttgtgccgcctatcactggctagccatatagacttagacaagccaagtcactgggccctggtctaccatccgcaaaacaagggagctgaattttaagatagaacaacaaaaccaactatggagagtctcccattccaaaggcccagggccaagagagagcccagtgccctaaggcaggcatccccaagggtgatgatggagactcagctctcccagaggttagaaggaagggaaaccaaggaaagaaaagaattccacttctgtgacagggactgaggccacagtgcaggcatatgagctggggtggataaggagggctggagagaagagccaacagcttctacacagaggaaagggccccttggagcttccgtttcccttctagcttctctctattagcagcaaacgctggcagactggtcttcccagagatggcccctaatgagcaaatcaaccctgggatgaaatgactaggtgtgcttctagcccagcagcggggcaggagtccccaggaggggctgagggagacacttggccagctctccattattcccacccccaccacacacacacagccccacccaggcggggaagtaggagagagggcctcctccaacgagggggtcagtgccactggtccttctcacttggacatttacaggtatctcatagccccaagttatctgaccccaatgagtgccaaccaccaccagcccctccaaccgccgatggcaaaagtcaaagcacatggggcttgggactgtgacacacccagagaccaagggcccgacaaaaggagcagaaacaaatcaagaaataaggagagatgcagaggcccaactcagagggcgagtttctggaacacctagggagagagtaatgtccagctggaggtgtggttggagaaacaccaatagagccaaacgcatggaggtgcagccgggcgtggtggctcatgcctataatcccacttcaggaggctgaggcttgaggccaggagtttgagaccagcctgggcaacaaagtgagccgctgtccctacaaaaaaagttttttttaattcgctgggcatggtggcgtgtacctgtagtcccagctactcaggagactgaggcaggaggatcgtttgagcccaggagttcaaggctgcagtgagctatgatcaatgtcacagcaccctagcttaggtgacagagcgagaccctgtctcttaaacaaacaaacaaacatgaaggtgtgaagcccagaaacagagctggaatgcagaagatcacaaggcacatagacacagggagaggcggagagaaaagataactggcagtaaagggaagacagggagacacagggtctaggcaagcggtaagagggaagtagggtggctctgacaaggatggcaccagcaccctgccatccgacctgctgctgtcaagtggagataatgtgtctgtacgccaaagagactcccagccagccagacagagggtagcccagacatcttcccctaagggcatggccagcgtggcgccaataggcactcaggccctggcatttggtctggatggggaggtgggaggccgaggggtgtgaggtcactgtctatgagctgatctttcttaggtttggtcatgatcatgaggaacagtgggccagaaaggactccaagtccccagggtacacagatatcaccctgagagcccagggccatcttaggactccgtgaagggcttcttccttcctttcatcactccagcacccttctctttccccgtcttcccattcctaacagaaataccaaaccaccgagcccaaggtgctagactctgaaaagactcagcttgtcccagcagaatgaaaatattcggtccctaccaagggctcctccccatcccctgccgctgtgctgctgactcaaactaacagggaacaggactttccaagggctaaggtctctcccaggcgggcagcccaaggcccgcgctcctgttcccatatagctagtcctttctgaagtctcacctccacgcctgctgctgcagtgcagccccttccctggggctctgaggctcaaaaaggatggagatgtctatttcgggggagggacagtaacaaggcagggcctcagggccagagccaaggtctttctgggtccactaccctcctggagcagtgaaggtgctctgggatgagggacagatggccctgaaggcagggaaggtgctgatggtgacgtctgggctcccactcgccagagcttcctcctagtgattcatcccctcccccattcactggttgttttcactcgcctttctccagtcccagactgtgggggtggcggaggcaccaggagggggtttcgggtggctggctggctgtcattcatggcttttcaaaaccccagactctccctcgcccacctgagttttagcttcactattttctcagccccaggatctgggtgtttcagcagaaaattctcaccaggagctgcggtgagggccctggcctgggctgggggtagtgttcgccaggtagaaccacttctcccccagtccccacccagccctcccgctcctgctcccctgtggtggcacccaccaccttggtttccagctttgcagaagctgggggaactgagagctgagaaaggagggaggctggtgacaggttggggtgtgcaagtgacccctgaccggagctgtggtctcggtggggatcgagacagagagttctggctgtggggagaggaggagctcaagctaaggaaagagatgcattcctctttctcactcattcattcattctgcaaagggaggcataccaagatgtatggaaacctagtctataccctaaaggggctgtggtgttcctgaggagtccccgggaaccctgttgttgatatataagtcatcccacttggccttagagaaagggttaagggcaggaggaggctgggacctcagaggaagagttgggacagagggaataatatctcttgggatctttatacaaacaggagtcctggctttagttctgtgggtttcctctgtgaattctgttcctagaccaccacaatcacctcacacttttacccctacagccaaataaccatgtcctctacccaggtctccggtgtgcatttgggcgtcttatcctcataaagtatatagcttaaggcttgagggcactggctgcagaattacagagatctaggttcaaatgccagatctgccacttctggctgtgtgaccttagtcaagctgtttattctctctaggcctcagttttctcatctgtaagatgaggatgatactagcagggcctatttcacagggtggttgtgatcattgaatgaaaatgcatgtaaagcctggcacagagtaagaattcagccaatgcttatgtctatcattatcctttctccttaatcagtatccactggagaaaaaggagagagaaagaggagaggaaaaggcccagctctagattgacgaggcaccaggaggagatgaggaccccggggtttctctgtgtgaacccattctctaccatgatggtgggggggtggtggttctggggtttgagaggagagatccccctgggttgcagcccctcccctgctcctaccacttcctctctgtggcatagggcacctggacagggcccagggttggcttcctaagctggcacagggccaggctctggaagtactcaaagcactatcattgaatctcacagctgtgagaggctcgattagaggaggatggaggactttgcctctaccgtatttcccctcataggaggagctactaggatgctcctgggggtacttcagtctctaaagcaattcagaggagattcagtttctttttctagtattgtctcagaatgaagtcttagaggtcacactggatggcagaaaagatgcaagaatgagctcaggaaaagatcgccaaccccagccccactccctggaaggagcagcctggcaaaaaggcaggaatagggactaagttcttgctactcaaagtataagctgaagaccagtaagcttaggcaccaactaagagctgaccaaagtgcagaatcttgagtcccacctcagatccccaggtaatcttgtttgagatgcagaaagccatagtcattcagtcattagatgacttaaggagctggcgggtgcatttgggcatttgtctctccttttggaagatgtggaattggagttttcttttggagaaagctctctctcaggagagagctacagtgagagagctgcaggtgagatgcaaagatctttccaagacagcaggcgagggtagagttagggctgccatgggagcagtggtgcaggggctggttcgaggttcctgacctttgcttggctctagttcctggcactggcaggcccttagatggtaagttcctggcaggcctggctccagggcaacagtttgagtaatcctgtgattactcagctccttctccccaatctgagttcccaccacctgctgcttcagggacgtgtctcccaggggtagcttttgaaggtgagttatcatcagaggtgttttcagctcctctcaccaacccccaagtctaccagcccccttcccgttctcccccaccccttctctacaagtaacacacaccctcatgtacacagcactggtactttctttctgaggtttgggtggatggcattgaagggagtgcaggtggcaggggaaggaggggggagcaggactagagggcctgaagtgctgagggggccatgggttgggcaaaggccaggatacaagcgtggattttctgtgtttcagtgtttccgcagccgtctctccatccctagatctatgtctctgtttttcctggacccaaacctcttggtctctccagctcagtgaggctagggggtctgacattctagctcagagtctttggccttgtgtgtctgtctcactgggtacttctgtcttggactgggaggatggaggatgggctgaccaggtggctggagtccaaggctttggtgttgcccaaacatgggtatttgcgaagggggtccttgactggccgcatcttcctatgagaaggtcaaggtcttggtgacactgttgtgaggttcctagggccaggagaagcagtgggtcaagcatggggcagggagatgtgtctggggtcaccatgtggtcagcacacacacgcacgcggatgtggctcttggagaagggaagaggcagggaggcctgtggttgactgctgggccagagcccgagttcccactgcggcttggcctaatctccctcccgcttacttttttgggtggcccacgttggtttctcccatctctggtcttaggccactgaaaagagagatgccacagtgttggagggggaggtgttgggcaagaacagagtccacagggcccgagtgctcctctcagccttgccaggcccactggtcttctcagcctgacctctgctcaggagtaacttgaatacacagtgctttccatgggtgatatcatttcattactctctgttacctacaatcaccccatggacaggcaataatacttttatcctgatcttgctgacaagaaaacgtaggtctagagggagaatctaagtgactagaagtatgggggccccaacgttttctgcccctgttccagacacccagtgccctcttattctctcttcccctccatgtattaaaatctgctcttaatttactggaaagaacctggaaaactcacttaccgcctggtcctggggggaccacagcttacagtgtgagcactggaagcttgctgctgggcaggcacgtgtggctgggggttgggtgaggaattgagtgctaatgaagggatttcagatacccatgtgccctgtccccgtcagggtcagctactgcctctgactcacctcaagtctggcctgagggatgatggtttaagaatgatggaaataatattttggggaatggcgggcaagccatggtctccctgcccacttcacatcaacaggccctacatgtgaccagtgtccaggccagggactggaggtgagatcacagcaatgtgcattcgccctccagagaggctgccacttcttttgcccctttggtgggagacacgtcatagattaaaaggggctttggcccttctcttcacttttctggcctgtcccgccccagggctccccactcagaggggaggcagcaggtcagtgatggtggaaaagagacccatgtgctctgggaaatgctaaaaacacctacagtaaccagggatcccaagctttgcccagctacctttcaaggaagagctgggagaaggcctcctgtggtcccatgaagctcagcagagagtcgtgggcattgacaggaacagggcaaagcagagatgagcctagggccagcagcaaaccacaggggtagggaagcaggtacaggttacagtgagttcagtgggagagagaacctggggtcctagtgccccatgagcagacactaacatacaaatatgcacgtgtggacgcaggagcaaccagatatgtcgtaggctcacaaatgacacatacttttcttgcatatgcacacccacaagcacaccttcaaacatgcccactgaaatgtgtacccgaaaagacaggtacacagaacagcataatggaaagctcaggggaactgggatgtagatccagctctcaggcaaactagcctatgaccctggcccaaccgctttgcctcatctggcttagtccttcatcggtaaatgaagaggttgaatgagatggtctctagtctcagccatttttaacattgatgattcatgttcacacaaatggatacagatgcctttgtacaaacataagtgttcacactcagacacacggatgtacacaaagccaccctctctctgctctggggccaagagcctaagagccctggctaattctttccctaggctctcaggcatccagcagagctggggtgttgaggccccgtttcctgggttcctccctgccatcccctcaccctgtctctgtatagcacctccctgagccttcactgtctggctgggaaggactggcatctctgcctatcccccaccccttgtgtaccacatcttcctgctataccctacactttgcccatgggagctgagccccagcgagggagggaggcacagaggaagccccttcggcgggaagcaggtgttgtgaggccgtgaggagtcctatgtcccaaggcgggagggaggcaactggagcttttcaactcgaagggctgagcaggtggcccctctgcagctgctttctctgcctccatagcactgatacaactcccggccacccctccacactcccctcctctgtgaaacaaacacagcttcctcacaccctttgctgagaagcatttggcatttcacttccccttccattttgcaagagggaaacagcaagctggagctggttggagaagtagtggaagcaccaggtacctgtatctgcagcccaggtacatggtggttgaatgcagaaaagcctcctgggctgacctacttctctttctctcttccagcacaaattgaagtgatcccttgcaaaatctgtggggacaagtcgtctgggatccactacggggttatcacctgtgaggggtgcaaggtgagtcataggcatgtgtatgcctgcatgtgtgcgtgtgcatacacaagcgcgcgcgcacacacacacacacacacacacacacacacagtgtctccttagagataaacaagggggttaatggcctttgttctgactccagggatgatctcctgggcagccaggaaaatgcctgagtagcgccttcctgcagggccctcaacactggcagggccctgtcttaagctggggaaatgactacaggataaattgcaattacacaaatagatggaggagagagaaaactgacaggtcgtgggatgtagaaaagctgccagagcttgtgggctggaggcctttgtgagtgagctgggcctgaccaggataagcagtcttgccctccacctgctttccccagggcttcttccgccggagccagcgctgtaacgcggcctactcctgcacccgtcagcagaactgccccatcgaccgcaccagccgaaaccgatgccagcactgccgcctgcagaaatgcctggcgctgggcatgtcccgagatggtgaggccaagtcgacagccccctggggttttcctggtgtctccagaggggcagcctggcctgctgagctagacaaggcttaacctgcaagacggcccatcctctggtctcctctccattcctccccgttacaaccccttgtctcctcccctccagggatggatgggtcacccccatcaaagttctttggagtccccaactttaggctttgctagaacaaacatcctctttccaaggtcccatacctcttcatctcttcttacttggaacgaattctcctcactctgctgccctctggcccagctcccatgcagctctggcaccttcccctgctaccctgttgttgtagttctagctctatctccttttctaatcccccattcccatacttggacacaggactatagccaggaatggaaacagaattggcctgagaacaaccagagggtggtcgtgggggagggctggtgttcctggtgccttatccaccctcctcacccaccacctcctcaccagtctccctgcacacctccaccaccacagaaggagcctagggtggagctgggggggcatgaggtgatgaggagccagaaggagcccgtcagcacttttcagtgcccaaaataacaaagcaaaaggaagcacgcaggggtgcaaaggggcaggcggggcgtaggctgtgcccctacacctgggaggggtggcggggggagtaaaaaggcaggaaagagagagcagaagaggatgttcagaaacaagccgcggagcccgggttgggctgtggtgagtatctaggtcaccagggagcctgcaggcctgaccacagggagacctgtgttctcagctctcctcttcctccgaccctcccaaagaggcgaggtgaccccaatacagcttgaggccctctgctcgaccacccccagccccaagatctggaggccagaatccccagcctagactcattgcttgaattctgccatgattcaaatctgatttagaacttagaagattttgcttagcagattgaaatggcagactggacagaccccagaagcaaacaagagtgagaggtggacggggtcttgagcataagttccctaaaggctagagaagctgtgcttggagtcagccattcagagagcagcaagttaatcctttaatgaccaaatgcctcctgaccctgccctgtgccatgttctcctgcctcataaacccctggtccctggacctctttcagctgtcaagttcggccgcatgtccaagaagcagagggacagcctgcatgcagaagtgcagaaacagctgcagcagcggcaacagcagcaacaggaaccagtggtcaagacccctccagcaggggcccaaggagcagataccctcacctacaccttggggctcccagacgggcagctgcccctgggctcctcgcctgacctgcctgaggcttctgcctgtccccctggcctcctgaaagcctcaggctctgggccctcatattccaacaacttggccaaggcagggctcaatggggcctcatgccaccttgaatacagccctgagcggggcaaggctgagggcagagagagcttctatagcacaggcagccagctgacccctgaccgatgtggacttcgttttgaggaacacaggcatcctgggcttggggaactgggacagggcccagacagctacggcagccccagtttccgcagcacaccggaggcaccctatgcctccctgacagagataggtgagcagctggggaggtggagagggtggtagagatgagggaggggtttccaccagtaccccgtatcaatcaaacatgcgcctgagggaattgaggggtccagacgaggggcggagggaggaggcggagcaggataggccaggctgagaagtgcccttgcatgggtaggcgtaggagctggctgagatcaagccatgccttccttctccggccccagagcacctggtgcagagcgtctgcaagtcctacagggagacatgccagctgcggctggaggacctgctgcggcagcgctccaacatcttctcccgggaggaagtgactggctaccagaggaaggtgaggccaggagacctgcaggaagggaacgtatcccacccccaccgggagagttcagagatggctacctgcgcacgactgggtcctggggcagggcgggacatcacagacacaggctggccaacaagcatgtgcacaccttttatgtacagttgcgaatgtgtgtatctgtctacaccccagcagatggatgagcgcttttccttagttcttgcctattaaaattgtacctggccttcatcctacctcctctaccatgcagaccttggtgcaccctccttcctcctcttccatcaacaataacaataatcagaaccctgattaccatttgttaaacaccccttctctgccaggcattgtgctaaacgctttatgtaaattatcctcagcccctaccacaaccaacctatgagggtggcatttattcctacttttaacagacagaaactgagcctagaggggttaataggtttcctcaaagtcacaaagtggtggaaccaaagtcaaattcagattcatcaggctccaaagtttatgctgccttttcgatcacactctcataccacctgctctaaacacactcgtttggcacttcacatttgcttctccaggttattgagaccttgggcataacctttgtgggggaaggggcagctgtatgtcctgttcacctcaacgagatataccttgttggagggcaaagctgtatctcatactttttggattccctcacaacagctaactcggtgtcagcagccggtaggtgctcagtgtgtgggactcactggcaggaatctgtgcatttgtgctaagaccaggcttttgaaaatgctagttgagaacataggagttcagagcctaccccttgcagtttattaggtggggctccagggctcaggaggatcacagggccacacagagcgctacagcgggaccctcctccctccctgcagtccatgtgggagatgtgggaacggtgtgcccaccacctcaccgaggccattcagtacgtggtggagttcgccaagaggctctcaggctttatggagctctgccagaatgaccagattgtgcttctcaaagcaggtgcccagggatgggtgggcaggcctggggacaaggggacagagccaagtggagggaggtggcttaaggaaatcagggggacagagtcagatcctggctttgcttgacactgtccctgcatcttctctccccactgcccaggagcaatggaagtggtgctggttaggatgtgccgggcctacaatgctgacaaccgcacggtcttttttgaaggcaaatacggtggcatggagctgttccgagccttgggtgaggggcagggagaaatgagagggaagattctgatgccaaccccaggcaaagctttgtgacccagggcaccctcttttcagggcgaattgccccctctgctctaaacacaataagggcggtgtcctcgggcaccatcgctccagccactctctcacttttctcatttccactccatcaggctgcagcgagctcatcagctccatctttgacttctcccactccctaagtgccttgcacttttccgaggatgagattgccctctacacagcccttgttctcatcaatgcccgtgagtgttgctgggcttgggtgaaggacattcaggtggcaggggcatggcagatattgaagaagagtctagaccttcagatgtagttaaatctgggaaattgctttaaatagcagaatgagccctactcagtattgctataaaataaaatgagttaaaataaagattcagaggactctcagagagggacaagagcagcataaggtggggttgtgggaagtggggagaaatgaggttgagaggaaatgagccactttcctgacagaaatgtgtctgattgttagtctatggcagtgatttcattgtagcacacatcagaatcacctggggagctttaaaaactattgctgcctgggtcccacttccagagattccagtgtacatgtgctccatgacttatgatggggttatgtcccaataaacctatcgtaagttgaaaatatggtaagttgaaattgcatttaacacgcctaacttactgaacaccatagcttagcctagcctaccttaaatgtgctcagaatgcttacattagcctacagtctggcaaaagcatataacacaaagcctattttataataaagtgttgaatagctcatgtaatttattgaatatggttctaaaagtgaacagcaggatggttgcatgggtattcaaagtatggtttctactgaatgcaagtggctttctcaccaacataaaatcaaaaaatagtaagtcaactcatcataagactgggaccatctgtaattgataaggggtgcactgaattttaacagccacccccaggccaccaagattaagaatcactgctctgtgtgaactaattttaaggctgtatgcctataataggaagactctggatatcctatccactcccctggcatggagtagctgggctgagccagatgaatactaaatattcagagaacctagggaagtgggtcaagctgctaacctgagtttgcagatcgagactatcagtcttctggctctgccagtgagtggacacctaaatatgcccttcaaactagaagataaaaactttaaagatgacttctggatattttatagaatcagggcaaaagttagtcacagattgctgcaagccccctggtgcaggcctgggcaccttcaggaaggccacctcctatcaggagcccttttcgtacatgggggagctcttttccaactcttgttacccctatgacagaatcctagtgcctagcattgaatgagctatgtggaatatcaggttaccagggagaaggtagcttggagtcaggagatcagaaattctcatacctttcatctcttcccagttttccttgtagacagctagccaagcccaacgtccagagcttaccattatcaaaccaaggcacacacatgcacgcgctcagcttagaagacctctatccagcacagatgtccacaaagatacacccttttgttgggagttaatgtccatgttctttcttgttctcattacggtcccaccccctcctccagatcggccagggctccaagagaaaaggaaagtagaacagctgcagtacaatctggagctggcctttcatcatcatctctgcaagactcatcgccaaagcatcctggcaaaggtaggagcagtccctggggtagaagaggccaggcccatcgctagctctgtaacatcagagtttgcgagggccggggtctgtgggtacagaggagggagtgcgggagtaccactctctgttagagagcttgcatcagcagtgggaactaagggaatgaacagctacttccacgtgcataaagactggaaagttagagggcctgggattgggagggacctccagggaacaattcagtttaatatagccagcacttacccagcacctgcttgtacaaggcactgtggaaagacacagagatttggtcgctgcccccaccaagagattttaatctggtatgaagaagagatctgtgtatcactaactctaacatagagtagaatgtggtatgtgatataataataatgcaattaacagagtgcttttgctgacatgctttctcatcctcatggcaacccagtcaataggacaggtgttcaaatctccctgtgtagcagccgggcacagtggctcacgcctgtaatcccaacactttgggaggccaaggcgggtggatcacctgaggtcaggagttcgagaccagcctgactaacatggtgaaaccccatctctactaaaaataaaaaaaattagccaggcatggtggcaggcgcctgtagacccagctacttgggaggctgaggcaggataatcgcttgaaaccgggaggcagatgttgcagtgagccaagattgtgccattgcactccagcctgggcaacaagagcaaactctgtctcaaaaaaaaaaaaaaaaaaaatctccttgtagctatcaggagacttcagtgacttaaatgcaagattgaatcccagtgctctttgcgctctttctatccctgtgtcccctatgtataactataataagtgacaccaggaaaatgttatgagagtataaaacagggattaaaaataatttgggggtaaaaggagtgggtcataaatacttcccagggaagatgacatttatactaggccatgaatgatgtaagattttaacaggcattcatgggggtggggcaggcattccaggcttagggaacaataggagcaaaacaaaaaaaatgaaaaaaaatccttttcctgaggtttaaccaaaaaaatggatgagatgagtatgagaggctggggataattgttttatgggatttgggtgtgggactagggtacaatgaagaccaagaacaacaggagaaaaataaggaggcaaaatagtgtgtatgtggagaatcactcatggtacatcctcactaaagtgtaaaatcaggagctgggatagactggtggggcagaagagcaccagatgatcagcctgaaaattaggtcaggggcaaatcagagaggactttcaatgccatataagagttaaagctttatttctaggccacagggagctccaaaggctagaaaaatgacacaatcagagctgtcatttaggcaatttactttggaaccagtataaaggaaccatttatgtaattattcaagcaggcctttgctatgtgccaggcacagggctgggtgttaaggatacagcaatgacttacacggtctgtgctctcaagaacttgaactttaatctgctacaggatggatttgaaggaggagagacaggaatctgggagagcaattggaaagcaaatccggttggatctgctttcaaaatacatcaccttccctactattaccaccaccctggcccctaccagctctcagctttcacttggactttaagagaggcctcctaactgagcccctgttccaccctcatctgccctgtagcaaccacacctactccgcacccacggtagcccttttaaaaatgcaatctcatcatgccctactcctgtggtttttttcttgtttttgttgttgttgtttgtttgttctgtttgtttgttttgaggcagacttgctctgtcgcccaggctggagtgcagtggtgtgatctcggctcactgcaacctccacctcccaggttcaagcgattgtcctgcctcagcctcctgagtagcttggattacagggattacacgcccggctaatttttgtatttttagtagagacagggtttcaccatgttggccaggctggtctcgaactcctgacctcaggtgatctgcccaccttggcctcccaaagtgttgggattacaggcgtgaaccaccacacctggccttgactcctgttctcagccctcctgtagctgcctgtgatgccgagaatcaaatctagagtctgcgtcatggtcaagtggctcataacatgatccctgccttcttttctcacttgatcttccactgccccttcaaacacccattgcagccacacttgcttccttgctattcctcgaacacatcaaacccagtcgcagggcttttgtacctgctattgtagtcacctggagggttcttcccccagttttccaaatggcttaccccatctcttcattcgggagaggtttttcctgaccagtaaccccatacaaaaagctttagttttctttaaagaacttattatctgatacactacatatttattttctgggcccctcaccagaatgtaaatttaatcaaggtacagattatactttattgactgatatatctgatatatcactagaggccatcacagtgcctagctcagatccagatgtgttctcaacaaatatttgttgaatgaatgaaggaagctattgccatagcccaaaaaagctcagaataaagcagtggtgaggaagagagagaatctaggagatatgaagggatcacaccctgctgcctgcttttctctgactgcctctttccaaggaaactaagctgggggagggaggcaatggcaggcaagagacatttttaagcctcttggttgtagaggagactgcaagagataaattgttctttcagccttgctccagtgaggtctccctgcctccgtctgctcactggtttctgtgcctttttcatctcccctttggctgagtgctggcagcattggtttgctacttgcagtgttaggtgcctgcttagaaagtctgtttagttcaaagagttattaagcatgtgccatgtgctaagcattatgataggtacagaggagacagggaaagagagacctcagccaaggagctgaaatctagggtgggaaggcagacaaattggaccattttcctgcaatgtagtaagtgctacacagaggaaagcccaaaagaagggcccttaatccagatgggaggcagttagggaaatagtcttaggagaggtgacactagagggtaaggattagtaatgggaagaggggaacaacatgcacaaaggcagaggcatgtgacagcatacaacaagagtcacagacaatcactcttataaaagcaggaagtgcacattagagtctttgacaaggttcattctagaagtattgggaacataaattgagggcttcacccagaaaacattcacctgtgccccacccactctcacttccctccagtgtcctgaacacacacgtacttctaccagtgggatttggctggtgccaaagtgccaagtacataaggggaaggcaaggagggtttgtcctagcccaggaagaataagcggacttctttgctctgaggagagctgaagtattgaccctcccttccccattaacccatatccagctgccacccaaggggaagcttcggagcctgtgtagccagcatgtggaaaggctgcagatcttccagcacctccaccccatcgtggtccaagccgctttccctccactctacaaggagctcttcagcactgaaaccgagtcacctgtggggctgtccaagtgacctggaagagggactccttgcctctccctatggcctgctggcccacctccctggaccccgttccaccctcacccttttcctttcccatgaaccctggagggtggtccccaccagctctttggaagtgagcagatgctgcggctggctttctgtcagcaggccggcctggcagtgggacaatcgccagagggtggggctggcagaacaccatctccagcctcagctttgacctgtctcatttcccatattccttcacacccagcttctggaaggcatggggtggctgggatttaaggacttctgggggaccaagacatcctcaagaaaacaggggcatccagggctccctggatgaatagaatgcaattcattcagaagctcagaagctaagaataagcctttgaaatacctcattgcatttccctttgggcttcggcttggggagatggatcaagctcagagactggcagtgagagcccagaaggacctgtataaaatgaatctggagctttacattttctgcctctgccttcctcccagctcagcaaggaagtatttgggcaccctaccctttacctggggtctaaccaaaaatggatgggatgaggatgagaggctggagataattgttttatgggatttgggtgtgggactagggtacaatgaaggccaagagcatctcagacatagagttaaaactcaaacctcttatgtgcactttaaagatagactttaggggctggcacaaatctgatcagagacacatatccatacacaggtgaaacacatacagactcaacagcaatcatgcagttccagagacacatgaacctgacacaatctctcttatccttgaggccacagcttggaggagcctagaggcctcaggggaaagtcccaatcctgagggaccctcccaaacatttccatggtgctccagtccactgatcttgggtctggggtgatccaaataccaccccagctccagctgtcttctaccactagaagacccaagagaagcagaagtcgctcgcactggtcagtcggaaggcaagatcagatcctggaggactttcctggcctgcccgccagccctgctcttgttgtggagaaggaagcagatgtgatcacatcaccccgtcattgggcaccgctgactccagcatggaggacaccagggagcagggcctgggcctgtttccccagctgtgatcttgcccagaacctctcttggcttcataaacagctgtgaaccctcccctgagggattaacagcaatgatgggcagtcgtggagttgggggggttgggggtgggattgtgtcctctaaggggacgggttcatctgagtaaacataaaccccaacttgtgccattctttataaaatgattttaaaggcaagaagtgtgtgtgtcagagggtgggggagattcttaaattagattacctgcatgcctgctctccagtctcattcctgggtcaagactcaggtttccagctcagcaatccatcagcattatacagatccaacccaccctcacccgacccctgcagtttctccccaggtggagcagtccctcagtgaggactgtgaacgaatcttcaggaacccccactgtaggagcctcaaactgagccccacgggagatgctctagactgagaacttcccataaatgatacccacggggaacgtttagatttagaggttgcacagaattgctccacatctgggagaccaaaagacagtcctctggaaggtggctggcccaagctccccagtgggggaatcaggatgtcagagagatcctctagaacctgctgttcttgctattgcatgacccctccctggcaccagagcctccctcctggctccctcccctgtcacttgccagcctgtagtggtgcttgctgcagccctccctggttgctttatttatttattttgcaccaacagggttgctgcagactcattcttgcctggtttaaaaagagagagagagagagaggaaaaaaaaaaaggagaaatgctttctggctcttttctccacctcagtcttggcagcagcggccgcagcagcaacagcagcagcagcagcggcaggcagcagccgggcagccaggcagcgggggttgaggcacacagggaaggtgcaggggcctgaggtgcagctcgaatgggacagggcccccagcgc

SEQ ID NO: 17326 - DNA, 8764 bp, Human
catcaataagttacatgaaatattcaacactttattataaaataggctttgtgttagatgattttacccaactgtcggataagttgtctgagcatgtttaagataggctaggctaagctatggtgtttggtaggtgtattatatgcattttcaacttatgatactttcaacatacgatgggtttatcaggacataaccctattttaagtcaaggagcacatgtatttccagaatccagccacttgtcaccacctccaatgctctaccttggaataagacactactttctcctggattactgcaatagtcccctaaaagatatcccttaattctctacagtttataattctatgtagcttatttatagcagccagaatgatctttttaaagcataagtcagatcatgtcattcttccacccaaaactttgtaatgacttcctcctttactcaaggtaaaagaaaaaggccatcagatggtctacaaggccatacatactctgaccccattagctcctctctaatttacactgctccacccacagtggcctccttgtttcttgaaaacaccaggcacgtttcctgctcagggcttttgcactggctgcttttgcgttggatgctcttatcctcagatgctggcttggttaacaacctcacatcctccaagtgtttaattaaatgtcagtttttttcagtgagagatcaccctatttcttactgtaaccctgacccatccccttcacattccttatcttcctttatcttgctctattccccccaccccatagcagttaccttctaacatactaaacaatttactatgtttattttctaggtttgtcctctcacttttagaagatacgttccatagggcagggatttgttttgttcactgatgtatcatctcaagcacctagaatagtgcctggctaatagtagaccctcaataaatatttgttgaatggataaatatgcagaggtctcaaagtggcagtcccagaaccaaattttgcttacaatgttgtttttttatcaacaattttttagtagttgattttttttttttttgagttggagtctcgctatgttgcccaggctggagtgcagtggcacgatctcagctcactgcaagctccgcctcctgggttcacgccattctcctgcctcagcctcccgtgtagctgggaatacaggcgcctgccaccacgcccggctaattttttgtatttttagtacagacagagtttcatcgtgttagccaggatggtctcgatctcctgacctcgtgatccgcccgcctcggcctcccaaagcgctgggattacagacgtgagccaccgtgcccggcccagtagtcgatattttttaaaattggtgagatttactacaaaactgtctttccagtttctgttcaaaaatcatacgatacagcaccatcaagtctgcattcttgcatggaactggatggaattgagttgtgtggacttcctttagataacgtgtgagctttcctattttgctacagccctaccctgccactccactaatttccataagctgtctaggcccctgaaggggcctagacaattagtttgcaattcctaccctacaaggatcctgggttattaagggtagggatgataataaaaatactcaactggtatgaactgggaaccaactaatcaggtcaccactggatcagagccttggaagagtcagataccaactctttacttgctggattttgggggaaggggagtgtccacagaggagcagggtgggtgggcacaagtgctcaggcagggcttttggccaaccagtacagaagtcttcaagttctattttttaatcattcatacagccataacatgcatactagtcgaatatgagccttggataagggattagggtagataagcagcagagtggagtcctgaggtgacataagggctgaccccttatccatgtcatagtgcccactgggtcacaatgccaccaggttgcctaaacctctgccacccacctgtgaacttcactttgccacagggaggcactgaactgaaaaactgccttgtaagaggtgtcgcccctctgtctactccctttcttatatcaagaggggaaaaacacgtaactacctctacccgatctggtcaccatacgcctattacctttactgttacaagtaccggatcactctccgggagaagatgctgcctcgttgttataaaaggtacttgttttcatctctatttgtagttgtttatataaaatgtaaggaaaaagtaaaagaatttgaaagaatttcccaaatggcaagaaataacaacagaatagggggtggaaagctggcatggaactttagaatttttccatctggttgggcccaggaacatagaaacaggctggacaacagaaaatacagaagatcatgccagagcctggtactgtgtatcttcccacctcagattccaagataaactaatttgggtctctttcccaaccagcatcacttataaggaagaggaggacttgacactccagccccgttcctgcctccagtgctcctgagtccctagtaggcctccaggagggcaaaagcaccgagcagggtaaccacgaccagcttaaagaactgtattcggtaagtggactgtgagctagtgctgtgacagggcaacccttttcttgcataccttgcagaggagggacattagcaagttggaagatgaattacagaggtagatggaatcttggaacgcatgtgtaaaagctacttgctatatagacaagcattctggcccacagactgtaaaatcaaggtcatacagatggtagtgaaaatcaggattgggaaaagagggagtggggacaaaggtaaaacaaactctgtaggacttctgggacataaagctgtttatgccaagatcctgcttaaagatgctaagcaggatctggaatccagaacttgcccacatatcatattgcaataacaagcctggttgtaaccatggcattttaaatagaagaatttagagaaaacccatataatgaaaaaagtggaaattattagtgagaaaggaagcacattataaagctttgtttaaatcctaagctctctgatgtaaacatttctaagttcctaaatggttattgtactcctgggttgaagtcaacaggcagtaatactgcctcagctggattgtttgatataaaggagaactccacaataggcataggctattagttcctgggactaagggatattattgcatctttaagatcttggctccaattctcccaggctctccccatcaatgcccaccttgcttcaacggacacaccccaatctgcctgaggtctgatttgaagactagaggagcatttttactccttttccaggctgggaacttgacggtgctggctactgaccccctgctccaccaggacccagtacagttagactttcacttccgccttacctcccagacctctgcccattggcacggccttctctgtgaccgtcgactcttcctggatatcccatatcaggccttggatcaaggcaaccgggaaaggtgactgagcctggatgggagaatggggagggaataggtaggggatttcacccttctatcatgtcatagtacataaggctaattctggagctagatataagcaatccattcacctggcatgcagacaagcctgtgagctgagccaggatctggggttcaagggataagagtccatgggaagctggactcagatccagaaatagttgaataacgggaagtactttctagctgttcatctcagtagtcctttctccccagaccccttctgtggcttacatccagtgatgtgcaatctcttggcttccaagaaaaatctaccaaaactagtttagcaactttcatttcctggcttgggtgggtggagggcagaaaacgaccaataatatttttactgctccaagtaggtgtctttctggattctgagttggccaaatttttttttcccagtatttattgatcattcttgggtgtttctcacagagggggatttggcagggtcataggacaatagtggagggaaggtcagcagataaacaagtgaacaagggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacgtttcagagagcatggggttgggggtaaggttatagattaacagcatcccaaggcagaagaatttttcttagtacagaacaaaatggagtctcctatgtctacttctttctacacagacacagcaacaatctgatttctctatcttttccccacatttcccccttttctattcgacaaaaccgccatcgtcatcatggcccattctcaatgagctcttgggtacacctcccagacggtgtggcggccgggcagaggggctcacttcccaaaaggggcggccgggcagacgcaccccccacctcccggagggggcggtggccgggtggggactgccccccacctccctcccggacggggcggctgaccgggcgggggctgccccccacctccctcctggacggggcggctgaccgggcgggggctgccccccacctccctcccagacggggcggctgaccgggcgggggctgcccccacctcccggacgggcagctgcgggcggagacgcccctcacttcccagacgaggcggctgccgggcggaggggctcctcacttctcagacagggcggacgggcagagatgctcctcacctcccagatggggtcgcggctgggcagagacactcctcagttcccagacagggtcgtggccgggtagaggcgctccccacatcccagacgatgggcggctgggcggagacgctcctcacttcctagacgggatgacggccgggcagaggcgctcctcacatcccagacgatgggcggccaggcagagacgctcctcacttcccagacggggtggtggccgggcagaggctgcaatctcggcactttgggaggccaaggcaggcggctgggaggtggaggttgtagcgagccgagatcacgccactgcactccagcctgggcaacactgagcactgagtgaacgaggctccgtctgcaatcccggcacctcaggaggccgaggctggcagatcactcgcggttaggagctggagaccagcccggccaacacagcgaaaccccgtctccaccaaaatacgaaaaccagtcaggcatggcggcacgcgcctgcaatcccaggcactcagcaggctgaggcaggagaatcaggcagggaggttgcagtgagccgagatggcagcagtacagtccagcttcggctttcacaactttggtggcatcagagggagaccgtggagagagagggagagggagaccatggggagacggagacggagagggagagggagagggagcggccaaacattttaactgtttttctgtggctcctagtttgactgcaaccctggagtacgtggaagagaagacaaatgtggactctgtgtttgtgaacttccagaatgatcggaacgacagaggtggggatctgctgttcttccttgcttttcgcgctgaggcagctggataactccttttcctttacaggagaccctcttcccctgtctttaaaaatgcaccctcaggcatttcagggattcttttcttcccacctaccacgaaggtgggaagttgtaacttgttccatcaagttacaactggactctgaggaagcccctgcaggtggtgttaggggccagactgaaggagcactggtgaaattacacagaatccattcaagggatgtggccagcaggacaaaatggatctcaaacatatggagcacctacaatgtgaaagggtcagacataaggccaagggaacggggacatatttaaccggatgcctggagcatatgttacagaaactatagcctcttgcctcaaggagctcaaactctgttggatataagggatggtgaataaccattcataagtgatagatactatttcagagcttactatgccatcattgtattagtatataggtagacctcactaatctctagtgttaagcacttcatgaacatctcatttcatcttaaattctgtgaggaggaaggttctatgatttataaatggaaaattctatagatggaaactgaagttctgcaggactaactcacagaacaagtgttaaaaccagagttagagcctaggtctgttggactaaagcacatcctatatgcctgcactacactgcttcccagggccactccctagtggaagaaatcaaatctgggggcatacatgtattgagttttaaagcatgttctaatcatttgttctatcctttcacaggtgccctgctgcgggccttcagctacatgggctttgaggtggtcagaccagatcaccctgccctccctcccttggacaatgtcatctttatggtgtatccccttgaaagggatgttggccacctgcccagtgagcctccttgaacatgcttattccaacgctttgaggggctggaagccttgacacatggaatcaggggcccgggatgtgattcaggacactttccatcctaggaataaagggtagtgcaatcatcaagtgttcacggtttcttgggggggtgggtaatagggttgactggagtgggatatacaccttaacagagctaaattcactgaaaagatcacagggacctgaactacggaggaaagtacctaaggatttttggttccctttgccttcctccatgccccaaactatttccccatttattctaaccatttactgagcactaatcagtgaacttcctagttcagaaagactgagctttgttaggctgtttttatccatatatttcagttgaggtgctatagatgtggagaaaaccagagaaggcacatagatctcttggctttggcccaagttgggggatctcaacggacagaataggtaacatagaagagggcattccaggcagcaggaaaagtactgggttatactaacagaatgacaaagaacccatcagaatgggctgtaaacaggtaagacttaaaggcatattaaagaaaaagacttttatacatagtaacaaactgcaggtaagaatgagacattactcattttccagggtaggaagtcttatgaatgatttatatcagggaacctctaaagagtaaaggttccctacggaactctggtagcaccagttccagggctgagcatgcttcagcgagttcattgcaggcaacatctgaaacatcaaataaatggaagctccttaaagattcctccaagagtacctgaactactcaccagaactgttccttcactagagcctttctgctaattgggactgagatttttcttttctttttttggagacagcatcttgctgtgtcacacaggctggagtggagtggtgcaatcttggctcactcactgcaccctctgcttccctgggctcaagcgatcctcccacctcagcctctcaagtagctaggaccacaggcacacaccaccatgcctggctaatttttttgtatttttggtagagatggggtttcagcatggtgccaggctggtctcgaactcctgagctcaagcaatctgcccgcctcggcctcccaaagtgttgggattataggtgtgagccaccggtgcctggctaatactgagatttttctgagaaaataaattttgagaattgtggttgtgagaaaatatagctgccatgtagtatagaggtagacgttactaatccctaaatttaaaaaaaagacctgtgtaaggcatccttatgtgctagttttaaattttctagtttatcttgctttatccttaaaaaaaattcacttgccatttttctaccatccacattactatacatttatatttactttcaagcacctcaagtacttcaagcctcgcatttgagcctcacagtactgtcagaaagatgctataaggaaacacgttaaaattttgcaaaaagtttacagtggagatctactccttaaagattcctccaagactacatgagctacttaccagagctgctcctagaatccaggtttctagaatcttaatctgggccttttcttttgaatagtataggtggggtcttactcacacagcctaaacctaaattggttctggttcctagtgaatttttttttatgagacaaggttgtgtggtggtgcaatctgggttcactgcaacctccgcttcccaggttcaagtgattcttgtgcctcagcctcccaaatagctgggattacaggtgcctgccaccacgcccagctaatttttgtattttgtatttttgtatttttttgagacagagtctctctctgtcacccaggctggagtgcagtggcatgatctcagctcactgcaacctccacctcccaggttcaagcaattctcctgcctcagcctcccacgcagctgggacaacaggtgcatgccaccatgcctggctaattttttgtatttttagtagagacagggtttcaccatgttggcctcaagtaatctgcctgccttagcctcccaaagcgctgggattacaggtgtgagctaccgtgcccagc

SEQ ID NO: 17327 - DNA, 45842 bp, Human; identical to SEQ ID NO: 12550

SEQ ID NO: 17328 - DNA, 21211 bp, Human
aaacctgggagggtcaaatgagaggcgggatcttatgagacacatctgaccacacaactcccccgcccacacttgccttccaagctgagagctcctgtgtggccagatgtaacagtacacggggagacataagctcttctccagactcttcctagcacaccttcagcaggccttggcttcccttgcacccctcctacctctgcttccagcttcctgggtgaccttgagcaagccacttgctctttctagacctcagttacctaacctgtaatgttgagattataaatcctgaccagcccacctctcaaggtttgctgtgaagatggcaatatggaaaataatggatggggagaacctgtgttctccaaaggccataatacaaagtttgtattattattattatttattattattattattggagacagagtcttgctctgtcgcccaggctggagtgcagtggcacgatctcggctcactgcaacctccgcctccgggttcaagagattctcctgcctcagcctcccaagtagctgggactacaggcgcccaccagcacgcccagctaatttttgtatttttagtagagatggggtttcaccatgttggccaggatggtctcgaactcctgacctcaggtgatccgcccaccttggcctcccaaagtactgggattacaggcctgagctaccacgcccagcccaaagtttgtattattaataaatcctacagcttcagttccctttgcagcgccctctcctggaaggatgcccatatgcaggctttgcctcagacctgagccctggactccaacctccgtctggagtgggtttctgtttctcttctttcccttccatacccaccttccctgtacctccaataccagcacactgaaccactcatgccaagggggtctccagggttgggactcaggttttcagggcccaggtgggaccctggacctctaggttcaacccgcctttcccctcagccctagtccctgtcccacaaccccagcctcacaccaccagcccatttatctggaggacccctagtctgagacagcgccaagaatcctgaataagccataggatggcagaggcccattgccaggtggggaatcccattccttccctgtctcctccctctctgtaacccttctccccctccctgcccccactcccacctgctctgtggcctccgtccccatctctggctacacaggtttctgaggtatagccacagggggtagaagttaaactactagcgggacaggaaggaagaggcggggagaggggccgagagggaggtggggattagggtctacggggtcactttcccattccacctcctccaaaagacttcactctcttgtgcaggatctggattttacgaaaaaaaaaaaaaagaagaagaaaggaaggaaagaggaaagaaagaaataaagaaagaaaaaaaggaaggaaagaaagaaaaaagaatgaacgaaagaaagaaaaaataatttactgtctttgtcagtgaagaaagaacgggcttcggaatataatcatttgctgtgtgatattgactaagtttcttgacctctctgagcctgaggtttttcatctgcaaagtggagtagggcaaaaatgctaaattcacagtgcccagcaccactcctagagcataatttgccttccgaaaatgttaagattcttttacttacccttcattccatttccaggcacccctcccccaaaccacctcccttttcttgaaattttcaggatgcttctggccctaggttccctgtcctcactcctgtggccctagtcccgggcagcctcgggttacttggggttttcccggtggcgagaggctctctacccccgccctttcgcagcagggctgaggcacgcgcttgcgcggggtccgggaaaccggcgcgtgccaggagacagaggctggggaaggggggaggtgagaggaaagagggtggaaaggagaggatagagagagaagagcggaggaccaggaaccagagagagagagagagaaaagagagaggagagacagagcgcttgggggcgaaaggagagagggagggaagggtgggtaaggaggagagagcggtctgctgcaaaccccaggaggagagcttggagcccaagccagaactcgagccctagccggagccgttcacagggaggcggctgccgggaccgtcagccctgcatgatgcatctccggctcttctgcatcctgctcgccgcggtctcaggagccgagggctggggctactgtgagtgttgggcttggaggcaggtggggttgggcccaggagtccagagcctgcagggcggccccgaaccgcattgcggctgggtggtcgcgggtccttcccggccggcgcgcgcccgctggctctcatcttttcctgcctctcccccgcgctccgcattgcagctctgaggctgccgcgcgcgcccggggctggggctgggctctgggaagaggatgaagtcagcgggcagggatttggggttgggatccaagcaggagctggtgcctgggtttgaggctagggctgggggataagtgtatactggtgaccgatactaggattaaggttttgccagggcttaaggctggactttggagctggccaaggggtggggtttgtggctagggctggggtttgtggctggggctgggttttgtggcagggatccaagcaggagctggtgcccctgactgatgctaaggctggacatggagctggtgatggtgctagcactggctgaggttgggtgcaaggcctgtatttggggatggtgcaggttttgggggccgagttggattgaggctagggttggagctggattggtgtcttgggttgacttaggttgtggaagatgctgaggtttaggattgagtttgggaaagtactaaaccagggcaggtattgggctagctagggagggtctggccttgggcctataggtgtagcctaggggtttgcctagaaggagaaggcagcctcctctgagcatgcagctgttgctgcagccaggattgaatagatggctttaaggtagggctgggtgtgcctctgggggcgggggttgggggcacggaaggggaagcttcggtcgctaagtgggccggcctttggaagggtctgggaggggccagcgctgactaacatgtcggtttccctaccctagacggctgcgacgaggagctggtgggtcccctgtatgcacgctccctgggcgcctcctcctactacagtctccttactgcgccgcgattcgccaggctgcacggtgagctccgcggaacatcagctgccaactggcagcgcaccgcggaagggtgggggcctccggaggacttcggggagagggatagccggttaaagctcctgtcctttctataggcataagcgggtggtcaccacggattggggatccgaatccctggctccagatagacttaatgaagaagcaccggatccgggccgtggccacacagggctcctttaattcttgggactgggtcacacgttacatgctactctacggcgaccgagtggacagctggacaccgttctaccagcgagggcacaactcggtactctgggcgccaaggcggtaacacttggggagcttcctctgctccaggctctgggccgggcaccagcctctgggaaaatggagggggtggtggtgagggctcggacaaggagcagtgactccactccagggactctgtccagagggactgtcagcttaggacgtgcgcgaaacactcggttcacagggtttaacacactttagggtaaaacctgggagagcttcctaaggaggtgacatttgatttcaggtctgaggaaataataggattgtgggacagggcactttatggaaactgtgcgggcaaagccgccaagcagggaagaccaaggagtgtttactttccagaagtcgagattggctgggtgtgaaagttgtgggctgggaggctatggagaaagaagcagaggggggccgggcgcagtggctcacgcctgtaatcccagcactttgggaggccgaggcaggtggatcacgaggtcaggagttcatgaccagcctggccaacatggtgaaaccccgtctctatgaaaaatacaaaaaaatcagccgggcgtagtggcgggcgcctgtaatcccagctacttgggaggctgaggaagagaattgtttgaacccgggaggcagaggttgcggtgagccgagatcgtaccaccgcactccagcctgggcgacagagcgagactctgtctcaaaaaataaaataaaaaaaagaagcagagggcgggacgtggttactactctcctccacccccgcagaccttctttggtaacgtgaacgagtcggcggtggtgcgccatgacctgcacttccacttcactgcgcgctacatccgcatcgtgcccctggcctggaacccacgcggcaagatcggcctgaggctcggcctctatggctgcccatacagtaagtgtgcagagagcgcggagggggcctgggagacagcctccccagttcccggcccacctacggtcctttgcgcagaggccgacatactctatttcgacggcgacgatgccatctcctaccgcttcccgcgaggggtcagccgaagcctgtgggacgtgttcgccttcagcttcaagaccgaggagaaggacggtcttctgctgcacgccgagggcgcccagggcgactacgtgacgctcgagctggagggggcacacctgctgctgcacatgagcctgggtgagctcggcgaccatgtgcgatgcggagccaacccctgaagctctctcaccgccctcctcgtggcacctcctccgcgcatccgcgctcagcctggtcttccacttctctaaggcctggaccaaactgcccctttcttgtagcatttggtgctagcaaaacactggagttgagtgagaactggattccagtctcagctctaccactacacagagatgtgacctcggatggggcacttccgagcctcagttccctccttgtaaacacacacacacagacgcacacacattgtatctcattagcttttcataacacccgcacatgaaatagaagcagctcatgtgttcccagttttacagacaggaagccaggctaaatggcttaccctgtcacacactcgccaatggctgttgatctattcgcccactctccctgattgccctgggctttgttacacgctgctgctctgcctaggagcttggactccatggagttctcctggcttgaggtttcactctgtcctgccccaccctcaggcagcagccctatccagccaagaccaggtcacaccaccgtgagcgcaggcggagtcctcaatgaccagcactggcactatgtgcgggtggaccgatttggccgcgatgtaaatttcaccctggacggctatgtgcagcgctttattctcaatggagacttcgagaggctgaacctggacactgaggtgagagactagggaggtgctatttcgtggtagggtagatgctggatgagtgagtgcaggtcggtctctccctttctcttttcctctgtctctcagaggaaagacctggcattcaggctgtgggtggtggctcatgcctgtaatcccagcactttgggaggctgaggtgggaggattgcttgaggccaggtgttcaagactcacctgggcaacatagtgacatcctacctctatttaaaaaaaaattttttttcaaagacctcgcattccaattcctgaatatcctagcagcccttggcaaacttgccactcaccagaaaaaggcctgtttttttttttgtttttttttttttttttgtgggtgttgttgctgttagcatgcagactcccaggcactatttcagaactaatgagatggggtttggaaattcagattttggggactaggcaaggtaggaaaattgttcccttggatcctcccacaactttgtggagttgttaaagaccctgaccccatctgcagataagaatcccaggcaggctaattgacttgcccaagggcgtgcagccgatttgtgttggagtcagagcttgaactcaagccttgaaaggcctagcgagctttagtaccgacactggggaaatgtgtgttttaagtcttttacaaaaccccatctggcatttgggaaagcatacggcggggacgcgcgagaaaggcaggcgccctcctgtgcccaagaggcctcattccccacgcctcccgcagatgttcatcggaggtctggtgggcgccgcgcggaagaacctggcctatcggcataacttccgcggctgcatagaaaacgtaatcttcaaccgcgtcaacatcgcagacctggccgtgcggcgccattcccggatcaccttcgaggccagtgggcaggggggtctgggaggacaggatatcaaagcgtcgtggaaagcaaagaggtggagcgggaagagatattgaacatcagataaaagcggagaatccctctgtccccagccagatgctcaagttgggaggggagcgggtctcacctgaggtgcatgagccacgcaggcccctagttaagaagcagtggtcgggtccaatcaccttcttagttcatagatgaagaaagtaaggcgcagacacagggagtggcttgtccaggggtcgtgcagctgcacggtggctgagtagggacttgaaccgatggcttctctgatatgcccccctcaaccctctccgactctggagctctgttgggaagctggcaggagccaggtctgtggtccaaaattgcctctcgatactggaaggagagaagcggtcgaatcgcagacggtggagatcagcgagagcaagcgagcagagttccgagggccgactgggttggggccccctccacagatggacgagcttggaggggaagaggtcacgtcatggttggagatctcacccccgccaacaccgaaggagggcggtgaccagggtcttagaccggtgtgaaaactgaattcccagctgaggcagaggcggctcacgggtgttgatgcgtcttcacttttgcccctagggtaaggtggcttttcgttgcctggacccggtaccgcaccctatcaacttcggaggccctcacaacttcgttcaagtgcccggtttcccacgccgtggccgcctggcagtctcatttcgcttccgcacctgggacctcaccgggcttctccttttctcccgtctgggggacgggctgggccacgtggagctgacgctcagcgaagggcaggtcaacgtgtccatcgcgcagagcggccgaaagaagcttcagttcgctgctggtgagggcgtttcgggggaggcacaagaagagaagagaagtgtagaggatcccaggaaagttgtaggcctggactgaggcctttacattctggagaggggagaggagtgaagggggcagggcaggaggccccagggtactgggaaaaggtgggagtggctagaggcagtgaggaggcgaatctgagggactaagtattcttggagaagggggaagcctgggagtcctggtattctccagttccagaaggcccctggagatttggttactcgtttataactgtgcagactctgtggcagttgctgggtcatggataatgaagagacattcagagaggtctccactgggtgtgagaagtgtaatcacgggggcacacaggctgctactgggacacagtggggctgctgcttccccactcagaacattcttctaccctagttgctgcttccctccacccacaccatcatccattcttgtccagggtaccgactgaatgacggcttttggcacgaggtgaattttgtggcacaggaaaaccatgcagttatcagcattgatgatgtggaaggggcagaggtcagggtctcatacccgttgctgatccggacagggacctcatatttctttgggggtaagtgggggccaacctgaccagacctctgtttctgggtgggaaggctccatctaagtccacccagatggggccacatggagaattttggagggatcaagccctcttcccctctggggcctcagggagtggaaggtcattgccatctacactttggttgtagtcccctttcttcctttatgtctggctccccctcagcatgtccctgggggagggtctttggggtctcccctggggaggatctcacaggggtggttgctccaggttgtcccaagccagccagtcgatgggactgccactccaaccagacggcattccatggctgcatggagctgctcaaggtggatggtcaactggtcaacctgactctggtggagggccggcggcttggattctatgctgaggtcctctttgatacatgtggcatcactgataggtacccagaagcccctaacaagagatgacccctccaaagccctcttccctggtctcccagtaggaatggcctctttcaataatctcccttctccttgtctctgctccttagtcccctgcttggggatgattcttctttgatctcttacctcctatttcttcccttaaggtgatacatgctcaggatggaaatgacacatttgcttttggtcctagaggggttttttgtgctagggggatgataggggtagaataaggcatgttttgatgttttcaggaagggggaatagtagtacttgagccctgaggactgcctagtgcccctgcatctgtgcttatacccggctggctaggcggggtgtgtctcaccgggttctggggcttcaaggagctgggagtgaagcttgcagggatcagaccccactctccagctcccagtaaggctccttcccttggtcctgaccccttccctaggtgcagccctaacatgtgtgagcatgatggacgctgctaccagtcttgggatgacttcatttgctactgcgaactgacgggctacaagggagagacctgccacacacgtaagccagatgtggtatggggggagtcagggacaagggaggtcaatagaaggttgctggggatcatcaggctgctagagatggcgaggatggcccttccagccctctcgctttttgtttttggtttttttgagacagagtcttgctctgttgcccaggctagagtgcagtggtgccatctgggctcgctgcaacctctgcctcctgggttcaagcgattctcctgcctcagcctcctaagtagctgggactacaggtgcgcaccaccacgcctagctaatttttatatttttattagagatggggtttcaccatgttggccaggctggtctcgaactcctgacctcgggtgatgcaccaccccggcctcccaaagtgctgggattacaggcccgagccgccgcacctggccagccctctaactctctaactgcctttatctcaacctattatctgccagctttgtataaggaatcctgtgaggcttatcggctcagtgggaaaacttctggaaacttcaccattgatcctgatggcagtggccccctgaagccatttgtagtgtactgtgatatccgaggtaagtgtctctgttgggtggtgagggggtgaggggagaaccaggaaggatagagtggtgggtgggggccagttagactaaacaagtgagggtaaaggaggacagaggggaagggcatactgaggaatttgtaacctagccttaaaagtaaatcccaagccaggcgtggtggctcacacctgtaatcccagcactttgggaagctactcgggaggctgaggcaggagaatcacttgaacctgggaggtggaggttgcagtgagctgagatagcgccattggactccagcctgggcaacagagcgagacttcatctcaaaaaaaaaaaaaaaaaaaagtatatcccagcttccttacccattccagctatcttatttccagcctacaatgcagagtgcccagggcagaggtggaatggagctgctggccacgttcagtggctctgagttgcagcagcggtggtggaggtgggcagggagatgggtagagaatgcccaactccagccaaagctctgtcccctcttgtctgccagagaaccgagcgtggacagttgtgcggcatgacaggctgtggacaactcgagtgacaggttccagcatggagcggccattcctgggggctatccagtactggaatgcatcctgggaggaagtcagtgcccttgccaatgcttcccagcattgtgaacagtggatcgagttctcctgctacaattcccggctgctcaacactgcaggttagggctggggtcagggaggtggcggaactggaggagacaccaatgggggcctgggagaaggaagccagagagccagctggggccttgggttggaagattcaaggaggggtctgaactcgctggaagggcgagaggagcccagaggctaatggagggacagggcctggaagctgcctgcacctcttccccaggaggctacccctacagcttttggattggccgaaatgaggagcagcacttctactggggaggctcccagcctgggatccagcgctgtgcctgtggtctggaccggagctgtgtggaccctgccttgtactgcaactgtgacgctgaccagccccagtggtgagggggcaaagggacagggtttttaggactccgggagtgggaggagctgagtggctggggctgagccatgacatcctgcccccacaggagaactgacaagggactgctgacctttgtggaccatctgcctgtcactcaggtagtgataggggatacgaaccgctccacttctgaggcccagttcttcctgaggcctctgcgctgctatggcgatcgtgagtggcagtccccttttgtgtgccctcccagagctgactctccagtttccaaaatctaggccgcatgtcactggtggtctctagctggggtgcccgacccccagctcctgctgtgatgcgatctcattacccctctgcacctggctcctctttcattccactccttagtctcccctccgtcacctcaaaccctccccctttgcccaaccttccctgcccccaaccccaggttctcttcctcctccaccctccaatctccctgacaagaccttcctccatctgcttttctaggaaattcctggaacaccatttccttccacaccggggctgcactacgcttccccccaatccgtgccaaccacagcctggatgtctccttctacttcaggacctctgctccctcgggggtcttcctagagaatatggggggcccttactgccagtggcgccgaccttatgtgcgggtggaactcaacagtgagcaggcagactgtgggagggcctcggggtagatgaaagtgctgtctggggagacaggggtaggctggggttggagccaagggcagatgcccttttgacaggcagcatgggaagggttgagataccctatgttctagccctcactcggtcttgacggctggctgggtgaccctaggcattcacttggcctctcttggccttaagccccttccttgtgccataaggaagctggaccttcgagtccctctcaccgctgattagccatgcttctagcctgggaagtgaggctgggaagctggcttcagggatctgtgatgtggggagagacaaagggtatgaggtttttaagcagctggtaagtttcaatgcaagctacagacaaattggagggatattcaagaagctccaaagaggtgagggaaagaggttatattgggcaaggatctatgaagggtcttgtaggtctgagtccttttctcccctaccctgcatcacactgtccagcatcccgggatgtggtcttcgcctttgatgtggggaatggggatgagaacctcacagtacactcagacgactttgagttcaatgatgacgagtggcacctggtccgggctgaaatcaacgtgaagcaggcccggctccgagtggatcaccggccctgggttctgcggcctatgccactgcagacctacatctggatggagtatgaccagcccctctatgtgggtaagcagcaacccagaggcaagtctgaagcctcctttacctccccatcctccaaggccactcgccttgtttccaggagcctcctgtcttaggtgccagtcccctctgcttcagagcaagccagtgtctcacttgtccctccaggcctttgtatcctattctattcttccagccctcttggctccctttccaactacaatacttcatcctgtctctggctctgcctccatttcttttcttttttttttttttttgagacggagtctcgctctgtcacccaggctggagtgcagtggcacgatctcggcccactgcaagctccgcctcctgggttcaagcagttctcctgcctcagcctcccgagtagctgggactacaggcgcccgccaccgtgcccagctaattttttttgtattttttagtagagacggggtttcatcatgttagccaggatggtctcgatctcctgagctcgtgattcgcccgcctcggcctcccaaagtgctgggattacaggcgtgagccaccgcgcctggccctgcctccatttcttgacctgttgcctacccttcccaggatctgcagagcttaagagacgcccctttgtgggttgcttgagggccatgcgtctgaacggagtgactctgaacctggagggccgtgccaatgcctctgagggtacctcacccaactgcacaggccactgtgcccaccctcggctcccctgtttccatggaggccgctgcgtggagcgctatagctactacacgtgtgactgtgacctcacggcttttgatgggccatactgcaaccacggtaagtgctgctggttatggggcaacagggagccatagggtgtaatgggatgtagggagggcagggaaggaaatagcatgtaaagcccatatcatggaaaattagagttgtccctggattcctgagctctgagtttggggagttaggcagttgaagatcatgggtgactccaaaggcatggacaaggaagggatggtacagatagctggtgcaaaaatatctcaaaatcaccaagtatgctttgggagcccaaggtgggaggattgcttgaggctaggagttcgagaccagcctgggcaacatggcaagaccctgtctctacaaaaaaaattctttttttttttatgagatggaatctcgctctgtcacccaggctagagtacagtggcacgatctcggctcactgcaacctccgcctggttcaagcgattcttttgcctcagcctcccgagtagctaggactacagatgtgcaccaccatgcctggctaatttttgtatttttagtggagatggggtttcaccacattggccaggctggtctcgaactcttgaccttgtgatctgcctgcctcagcctcccaaagtgctgggattacaggcgtgagccaccgcgtctggccaaaataatttcttttttcttttttttttttgagactgagtttcactcttgttgcccaggctggagtgtaatgactcgatctcggctcactgcaacctccacctcccgggctgaagcgattctcctgcctcagccttccaagtagctgggattacaagtgtgtgccaccacacccggctaatttttgtatttttagtagagatggggtttcaccacgcttgccaggctggtcacgaacttctgaccgcaggtgatccacccaccttggcctcccaaagtgctgggattacagacgtgagccacagcgcctggcaaaattttttaattagctgggcatggtggtgcacacttaggcctagctactcgggaggctgaggtgggaggatcacttgcacctaggaggtcaaggctgcagtgagctatgatcgtgccactgcactccagcctggggggcacagcaaggactgtgtctacaaaaaaaaaaaaaagcaaatcgcttctccatcttcccaccatcaccatggtaacacaggcgaactcccttgtcaatgtatttgatgattgctgcattcctaaaacatgtcaatgacccagttcttggttaaggtgagccttgacattccccatagcaagatcctacacacatgccaagactgcatcctccctaaggctggcctatagggaggatatatgagcaggtgggttactggtgggaggagtgtgggggactagggagatataagacttagggaccaacagatttctggtggtggtttggaagtgtgagtagtggcacatatactacatggggtcaggatatccccatcacccaggctggagtgcagtggcatgatcttggctcactgcaacctctgccccctgggctcaagcaattctcctgccttggctttcctatagtagctgggattacaggcatgcactaccacacctagctaagttttgtatttttagtagagatggggttttgccatgttggccaggctgttctcgaactcctgacctcaagatgatctgcctgccttggcctcccaaagtgctgggattacaggtgtgagccactgtgcctggccttactgcgtgtctttaagcaagtcactactcatctctgagcctgtttccccatttgtaaaatgcaggggttggatcagatgatctccagtttcccatggctgtaagattctgttctgtgacagaggggctcaaggggacctaaaagtaaatggagggttgtgagggtggcagaaactgaagtaagtctcaggatgtgtgtatggatgacataaaacctctgaattggggagtgagcagtgtgggggccctaacctccctgcttctacctgcagatattggtggtttctttgagccgggcacctggatgcgctataacctacagtcagcgctgcgctctgcagccagggagttctcccacatgctgagccggccagtgccaggctatgagcctggctacatcccgggctatgatactccgggctatgtgcctggctaccatggccccgggtaccgcctgcccgactacccccggcctggtcggcctgtgcccggttaccgtgggcctgtctacaacgttacgggagaggaggtctccttcagcttcagcaccagctccgcccctgctgtcctgctctacgtcagttcctttgttcgtgactacatggctgtgctcatcaaggatgatggtaagctctcccgggctctctcaccccactccagcttcaccccggtgcccctaattctcctattgattcacaaatacaaggacccacgtgctgttagaagataggagtcatggggcctgagaccccaaatttcttctccccaccccacagggacccttcagctgcgatatcagctgggcaccagtccctacgtgtaccagctaaccactcgaccagtgaccgatggccagccccatagcatcaatatcacccgtgtttaccggaacctcttcatccaggtatgcatagagggaggtgagccagttcagatcataacctcatggtctccgttgtggcatccaggaaaacatcaaatacttaatatttgtagatcacatttgaatgtatagaggattttcacgtgtgtcacctcatgtaaccctcacaatagctccaaggggacaataggcatttttttttttttttgagatggaattttgctcttgttgcccaggctggagtgcaatggtgtgatctcagctcactgcaacctctgcctcccgggttcaagcaattcttctgcctcagcctcccgagcagctgagattacaggcatgcgccacaacgcccagctaattttgtatttttagtagagacaggagttctccatgttggtcaggctggtctcgaacacccgacctcagatgatccgcctacctcagcctcccaaagtgctgggattataagcgtgagccaccgcgcccagccagacaataggcattcttatttaagtgttttacaaatcagtaaagagcctcagaaagtaaagcggtttcagctactcaggagggtgaggcaggaaaattgcttgaacctgggaggtggaggttgcagtgagctgagatcgtgccactgcactccaggcctaggcgacagagtgagactccatctcaaaaaaataaagtggtttacccaaagtcaaaccgctggtaagctgcaaagatggggcttaaaaccagggttttaaaaaatatataggccaggtgcagcggctcacacctgtaatcccaacactttgggaggctgaagtgggaggactgcttgaggccaggagtttgagaccaacctgagcaacatagcaagacctcatcttcacaaagaaaaatatttaataaataaaataaaataataataataaaaatatatataccaaatcctacatctaggcccaggggttgcccacttcagattgagctaggactcacccagctggcaccgccagtttggacagaatgagagatctccagtatctgcccccaagtatattcccagggtccacacagttccagtccagcccacaggcatctgcttctggtccccgctccctcatcgccctccccctccccctccccacctcaggtggactacttcccactgacagagcagaagttctcgctgttggtggacagccagttggactcacccaaggccttgtatttagggcgtgtgatgggtaagctgcgggtgcggacgcgttttaggcaaggagctgtggcatatgttcctggatcctcaaggaaagtgaaggccctgggaatggctgagggcagtgggaaggatgagtgggaaacctgtggacagtgagagtggcagggcctttgggtccaagtccctctttctgggcctgcctctctctcagagacaggagtcattgacccggagatccagcgctacaacaccccaggtttctcaggctgcctgtctggtgttcgattcaacaacgtggctcccctcaagacccacttccgaacccctcgacccatgactgctgagctagctgaggcccttcgagttcagggagaactgtccgaatctaattgcggagctatgccacgtcttgtttcagaggtgccacctgagcttgatccctggtatctgcccccaggtacattcccaggacacagaggacggaagggagggatgacacggaagggaatgattcttaacatggaggaggcatctcctaactggtgctttctcctctccagacttcccctactaccatgatgaaggatgggttgccatacttttaggctgtgagtagcactgatcactaagctgacctcccaagactaccctctgactgtcagcatcctttccctgcccctgatccccaaggctgcaggatggcaaaggcactagatgcacaatggcacaaaggatgatgagacaggctatgctgaaggtgccatataactgggcagagatttttagatgtttgaggatgagacaggctatgctgaaggtgacatataactgggcagagatttttagatgtttgaggatgctacagatttttaaataaaatattaaaatgagactatagctaagggatgggaaaatggggatacagtaacacctagagagataagaaattggggtaactaccagggatgtggaaagagaatattagaaacagaaggtggcagggggtaagccaggaattcaaacctgccagacacttgagatgagtttagtgtggtcgaacagctaactgagggtcatacattatgcttttggccaaaagtaaatgtgtgtgtgtgtgtgtgtgtgtgtgtgtgtgtgtgcaggtgaaatcccaaagtgtgtgtatgtatacaggtgaaatctcaaagagtgcgtgtgtgtgtgtgtgtgtgtgtgtgtgtgtgtgtatacaggtgagatcccaaagaatctgaattgtcccttttcttcttttcagttttggtggcctttctgctgctggggctggtgggaatgttggtgctcttctatctgcaaaatcatcgctataagggctcctaccataccaatgagcccaaggctgcccacgagtaccatcctggcagcaaacctcccctacccacttcaggccctgcccaggtccccacccctacagcagctcccaaccaagctccagcctcagccccagccccagccccaactccagccccagcccctggcccccgggatcagaacctaccccagatcctggaggagtccaggtctgaatgagtcagaagggcttctgggaccaattccagctcctgacattcccccagtcctgcctctcccccatcctatcagggacatttggctcctcttagctggctctgctcatccagaggatattcccccatcccccccccatcaagtttggtgggcagagctacagatgggacccaagggagtggccgagcctcactgcctaaaccaatgcccttctcatccctgtttccccaggctcctggctgtttatctgccccaaaggagaagcctcatggggttgacataggtcctttctgccatctctgttccagctgctgtcagggattaacaacagagtgtaggggagattaactgcctcccttccaatagacactatcagcagggacagatgtgtgggagtgcagggctgcagagggtatggggggaggaggctgctaaaccctatcccccagcctcccccctgccctgaagatcttccatttgcttccactcagctggaggctcaagagggcttgatggctgtcccctgcccccctccttttgttttgtacacagagaccaagaggcctcagtttagcaccttagtacctccgctgcttcacttgctttagccaaagccataaaaaacctgcaacgtagagaaaataatgcagataccctgactagccagccctctactcctccaaccttttccaagatatgcaatggcctttgtgcctgcccaaaggcttcgccccctccagtgcatgaggaaccctctttcctccgctcagagatgctgcttcatttacccaggaggtcatattctttatatatattttttgttgcaaagtgtctctctagagaaactctatatattattcgaatttttaaattatttgtttatatataaaagaaaagctcaattggctgtgctgtcctgtgctgtgctgtgcccacagtctgtagtttgcctttcctgtgttggaagtgtcgtgagtcctgctggtcacccaccagcctggtccggcctccactctgaagcagggttgagcctgctgtgctctcagacgcggagccgttccaataaagcagagtggcagagccccagtctgtgtgtggtagctggcgtcgtggttaggggataagtgggatgattttaagggaactaatctgagggctcaggaatttctagaaggagctctcagaatccttgcatcaccttccagggacttgactgactggctcttgccagaacccccatctccccctttcccagatctcagtgggtaagtggggatcagaatgctgatgcttcggcccaacctgctcctggaccccatccctggatccttccagccccaaagcacacagtacacaacttgccaaaatggattctaacactttattaagaggtcacaagccacaggactttaaagtgcatgaaatttattggcaatgaagccgcatgtataccaggctcccctagtccccaccaccttgccccatccatcatgacgtggtggggaggggttgagacccatctttaaaagtgggggacagcagggacaaaggatgggaaactggaggaacaggagtattcatgaactgaagctgggacaggagactgaccacagtgattctgctcactgaaggaagggtggggtcagtctagtctctcaaaggctggtgaaaagttttttttcacctattcctcacagcgagcccctggcatttcaaatagacctaactcctcctcttcatctttctctggttttctcctctatgagtaatttggaacccacagtccagcttgagggtatccctgatatgcacaatgaatacaaaccacggcggatgcagatttcaggatcatgctggggcctggcccatttgggtgggaggagctttctgtcaggagttgctgggtgcggggtacatgtgtgccctccagtgtggtgagtgagagcatgtgagtgtgtgtgcatgtcccataccaaaccgtaagaggcagctgggtcaggaggaaccccacttcttccttcatgggacaacaagtggagtgggaagaagcggggctctgagtcccagaaagaagggagaagcctgctccctactgtaacactcccaggccaatctatacccgcccacaccctttctactcaacatactgctccttgttcccagccagcccggcacacccaccatggacacagggcagctcttgctggccccattcacatgaaattcttctgtgtgaaactcactcgtctgcctctcccaggagatgagacaggactggaggagaatctcccaccctctcttcttccccctccctcaggagtgggatttaggcagggaccctagagaccttaggccaaactctaccccaatctatagaccttttaaaagaaatggttaaagtgctttgctctgcatgaatgccagagagggtggcaccacagcctgggacaggtggtctacctgcttcttctcccacttcagataccctctgccagtgtgccctgcacacggggtgccagcctaaacgcgtgcaatttagcccctcaccaaccttggaacatattctaactcaccctttccaaacagcaggcactacagacaggaaagcagattacaccaatctttctcctctctagtccaagcctgtgcccacctaccctgaagcgataagcaacactggccattgggccttgcctctatggggaatggaaggcctgaaaacacccacaaatccagcgagccaggatgctcacacctgccaggcatacccctaatgcttcttcaatagcagcataatgcttgcctgcagctgctaagccagaactttggaggagctggagcactggtgtctgttcccaggaatctgaaaacacttctccatctatctccagagtacacagagaaggct

SEQ ID NO: 17329 - DNA, 14037 bp, Human
tcaaatcggatctcaaaagttcccagggaaatgtgttaacagaaaacatgtaaaagggggaaaactgatagagcatgatgttatatgtggccttctataagctgaaaaggactttgagcttgaaagcaggaatggaaataattactgtaatttaaggagtaacctcttcatgctaagcattaacagatcacttacttacctgacagtggctactatttattttgtgtctaagcactgtgctaattgttttacatatattatttctaatattcacaacactacaaaattacatactattatttattactaattattaaaattccatcttacagatgagggaatcgagactcagcatttcaataatttgcccaagattccagttagtaaggagctgaggtgggatttgaagcccaggtctctgatcccaaaggccatagtcagtcttctgtgctttactccatttaattgtgtattcccctcattttcctagcacttagtagagaggccagcctaggataaatgttcaacagcaagagcgaccccaaaatacaaatctgatgacctccttttgcacttaatctagattgtttactaacaaccctcctcaccctcagctcactagtctttgtcttcaagacaatctctttccttccctagagcatttgcctgagctgcccttatacctctcaaggctcttctcactctttccatgctaacctctttatatcctttagatcacagcttgcctgttcagaggccttccttggccattcgatctaaaatagatctctcgtattttctatgtcatccactttttccctaacatttatcaaattttgcagttaccttgtcagtttactttctggtgtttttccaatattatgccccatgggaccagcgaccttgaatcttgtttgcctttgatttcccagagctgtgctcttcaatacagaagccagcagccacatgtggctactgagcactgtactacaaatgtggtgttgccttattgagatgtgcagttaagtgtaaaatacgcactggattttgaagacttggtatgagaaaagaatgcataagatctcgatttttaaatgttgattacatgttgaaatacttgtataaactgggttaaatgtatgactaaaattttcacttgttttactttttaattgtggctactagaagatttcaacctacatatgtgactcacatatttctagaatctgacacagtgccctgccccattttattgaatgatatatccaatgtcgagagagagagatcgaatgaatgggtgcatgaagaggtatagtctcatgcttccactaggcaaatagatacagcactgccgtagaagttaggagatctgggttctggctcaggatgtactggaaacgccttggacaagccctaccctactctggggatcaatttgccaattaggtagttgatctttgaggtctggaagcttacgagaatcagttggcagggaaatgtaccaggaaagcttggtacaacggcgcttgtctttttcgctctagcctaaacacttgagcctcggcaaacgggcagaggcagcgggaatcagggactacacccccgaacccagtacccgggtccccgacttccccgagcctacgtcactggggcgcgacggcgttgtccccgggagtgcagcggctgagaaggtcccttcggtgaaggcgagttccgggacaacagagagggccgcaccgtttccgagtctctcggaggctcagttctcagcgcaccattccccacagctctcctttttactttacccctacccgacacttgaccccggcagtgtgaaccccgctgggagcgtccaaagccatgcctcatcgcggctgcgcagcgcacgtgcacagcctcgcaggagtctcggcgattggctgtgacgcagtttccggcgtgagcggcgaaagccgggagggcgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggtagcggcaccggtccggcctttttgcccctcgctttgatcccccagcagtctgaccggcttcctactccccatggcgtctttgtctccctggggataccagctctgagcttccgctcggctcagcccagcccccaactcccggggtcggcttcgcgggagaggaaaatataggatggctttctgtaccgcgtctgatgatggagagtcccggggacacctccgcggacacgtgttggactcagggctttaggcccgtgacagctggtaatcccccagcccaacaacgtccctggacactgcccctgcccttggcggctggcctgcctagtatcatagactaggtctgggtgggggttggcacgtttgtgagctcacatcttccctaactacctgtcttttgtctgcttatcaaattcagacagcttcagacacaggaggaagggagggaagggggaggacagaggagacaggcaggtgctgtcctcaaagccctgcgttcttctgagatggaaaaatggatcctcaaaaaaataaagtatttgcagtctgggggcctctcagcttcttattacagttacaaggtgagggaaagacagttggattgggattctccatcctgctcttacctctgtccccaggtactgaattgctctctttgttaattttaggttgattctttcagggagcggatcacaagtgaggtgagtgaaataaatagaaaaatggttgttggttgagaatttcccaaagaggagatacctggagagagagagagagagagagagagagagagaccttcccacagatattaattcagctgtattttccctcttccttaggcagaagacttggtggcaaattttttcccaaagaagttattagaacttgatagttttctgaaggtgagagaccctattctttcctcaaattccccaatttttttggccctggtattactgtcaactgggataaactgttgattcttcttctttttatttttttaaactgtaaaagcactttcatttcttgctcttcaaatcaaatacttctttgttcagcttgaaaagattaatgttttggggtgggtgtctttcaggaaccaatcttaaacatccatgacctaactcagatccactctgacatgaatctcccagtccctgaccccattcttctcaccaatagccatgatggactggatggtgtaagtgtcctatatttatctttgtgttcttgagcagtaggtcctctgtcctctgtttccttgtcagtttaagatgtacagagggaacagtgggatttggatctgggaactaggactctgttacagacatgatgactctagtatagttcttttatttcttatttatttatttatttttgagaaagggtgtcactttttttgcccaagctggagtgtagtggcgggaatgctgctcactgcagccttgacctcccgaactcaagcgatccttcctcctcagcctcgcaggtagctgggactacaggagtccaccaccatgcccactgatttttgtattttttgtagagatggggtttcaccatgttgcccaggccggtctcaaactcctgagctcaagtaatccacccgcctcagcgtcccaaagtgctgggattacaggcgtgagtcactgcacggggactccagtatattccttttagaccctcagtttcatttacgacgtgaagtgaatgtgctaatgctactgtcagtgttagagtgagtttcaaataaaagagaactagcttaggccaggcaccttggctcacgcctgtaatcccagcactttgggaggccgacgtggacggatcatgaggtcaggagatcaagaccatcctggctaacaccgtgaaaccctgtctctactgaaaatacaaaaaattaactgggtgtggttgtgggcccctgtagtcccagctacttcggaggctgaggcaggagaatggcatgaacccaggaggcggagcttgcagtgagctgagattgcgccactgtactccagcctgggcgacagagcgagactctgtctcaaaaaaaaaaaaagagaactagcttcatcaggttacctggtttttcccatggctctgaacaagactttgcttatatttgtttgcatgtcttgagtagtgttatgggatatgcagttctcgctatgtaactgcaattgctatctttgctttgcatctctaacacctagtccttatcagtcatgtgtccacatgctactataacactgatgataccgtattgttgtctgtagtactgcctcattgttgaacttgtacatctggaaggcaggaactatctttttttttttttttttttccttgagacagagtctcactctgttgcctaggctgggtgcagtggcgcgatctcagcttactgtaacctccgcctcccgggttcaagtgattctcccacctcagcctcccacgtagctgagattacaggtgcacaccaccacgcccagccaatttttttatttttagtggagacagggtttcaccatgttgtccagactggtctcgaactcctgacctcaggtgatccgcccgcctcagcctcccaaagtgctgggattacagccatgagccatcgtgctcggccggcaggagctatcttaatctttgtattcccagcacctagtgttgatcctggtccctagcaattgctgaatacatgtttgttaactgaataatgtgttcctttgtggaaccagcagatttgtacgtattcccttaattatcttccctgctttgattggttcttttttcctattctttataatacttaatgtattgtgtttctggaaagattggtcttcccaactagagcgtaatttgctttgtggtaagaaccttttctttctttctctgagggggaacccagtctcactctgtcacccaggttggagtgcagtggcttaatctcagctcactgcaacctcaaactcctgggttcaagtgatcctcctacctcagcctcccaggtagctgggactacaggtacatgtgccatcacattcagctagtttttgtattttttgtggagacagggtttccctatgttgcccaggctggtctcaagctcctgagctcaagcgatctgtgtgccttggcctcccaaagtgctgggattacaggtgtgagccatggcgcccagcccaagaaccttttctttatttccttttttttttttttgaggtggagtttcactcttgtcacataggctggagtgcagtggcacaatctcggctcactgcaacctctacctcccaggttcaagcaattctcctgcctcagccttccgagtagatgggattacaggtgcctgccaccacacccggctaattttttttatttttattttttggagatggagtcttgctctgttgcccaggctggagtgcagtggtgcaatctcggctcactacaacctctgcttcctgggttcaagcagttctctgcatcagcctcccaagtagctgggattataggtgcttgccaccacgcccagctaatttttgtatttttagtggagatgaggtttcactgtcttggccaggctggtcttgaactcctgaccttgtgatccacctaccttggcctcttaaagtgctgggattacaggcatgaaccaccgcgcctggctaactttttgtatttttagtagagatggggtttcactatgttggctaggctggtctcaaacttctgatctcaggtgatctgtccacctcggccccccaaattgctgggattacaggcatgagccaccgcgccttgcctccaataacctttcttaaagctttgtatgtacttaggaaattgtgcagaaattaataacataagctatgaggctgaggaagggattaaacttgcttgaagggtatcttgtgatggagatgtgggtgtcaaaactaggctcatccctgcctctttgtatccttagcccacttataagaagcgaaggttggatgagtgtgaagaagccttccaaggtaagaggcacccttacctcacctcccctcaccccatccctgacttgcaaccctgagaagcaggatggatctagtgttctcctgaccaggaggcaagatctaatcttacttcccagaggtagcattcccagctcctccaaacgtgcttgttattgagtgctctaaacctggttttccaataaacagaggatttaagacttttgttatgttttagacgctcatctgtagttctttttttccatacattctcgttgattctaatagtggtgtcatggtaggattgtgacaaaggcagaggtcatagcatctgataggtatagggaaaatgagagagaggcaggggatgctgtgtccttccctcttccctgatcatttgaccttcacatctctgccaggaaccaaggtgtttgtgatgcccaatgggatgctgaaaagcaaccagcagctggtggacattattgagaaagtgaaacctgagatccggctgttgattgagaaatgtaacacggtgaggcacaggctggtgacctatgggccggccccaagtaccccacctgaagtgcaaaaaacagtggatgtacgggtggtatgggaattggcagactaggtttttttgagttttttttttgagatggggtctcgctccatcacccaggttggagtgcagtggcgccatctcggctcactgcaacctctgcctcctgggttcaagtgattctcctgcctcagcctcccgagtagctgggattacaggtacctgccaacacacccagctactttttgtatttttagtagagacggggtttcaccattttggccatggttagccaggctggtctcgaactcctgacctcaggtgatccacccgcttcggggtcccaaattgctgggattaccggcatgagccaccatgcctggccagactaggtattttgacttctgtgttcctggcatctggctccagccgtctgaattgtgtacttcatggcttcagccttcaggcaaaggtcctcatatatgttttgacctccaggtcaaaatgtgggtacagctcctgattcccaggatagaagatggaaacaactttggggtgtccattcaggtaatgtacttgaattacatactgggaagagtggcttgggagatactctcatctcccctgcgttacctttttttcctttttctttggggctgctgtggatgacatggaagtggcttttgatgcacctgttgtttgtttgttttaggaggaaacagttgcagagctaagaactgttgagagtgaagctgcatcttatctggaccagatttctaggtagggctgcttgggcttggccgaggcgttgggggctgatgaggtggtgggcaccatcaagggtctcctgcatcttcctcctcttctctctctttccagatattatattacaagagccaaattggtttctaaaatagctaaatatccccatgtggtaagtaaggggtttgtggcctgagggtggaggtggcaggatagtgaagagtgactgttactgggaaggagctgtctggaaacaattgggctttggggactagctttttcctgtaccctccttgcaggaggactatcgccgcaccgtgacagagattgatgagaaagaatatatcagccttcggctcatcatatcagagctgaggaatcaatatgtgagtaatctcagtccttgtccatagttgctgtggcttctcttagttctgttgagagtattgttaaaattctctgaagggctgagatgagggtctgaggtaaaatgaatagaccaaattctattcatcacctgagtgttgagaaccatgaagtcatctagcagggtatctctcttttttctacctgagtggaggggtgtgcagtacaatatggttaagatataggtgtcagagtcagacagacttaggtttgcaaccaggctctacctgtgttgtgtgacctcgagcaaattgttcaagcttaaacttcaatttcttctttaaaatgggactgggctgggcgcagtggctaatgcctgtaatcccaccactttgggaggccaagccgggtggatcacctgaggtcaggagttcgagaccagcctgatcaacatggcgaaagctcgtctctactaaaaatacaaaattagccgggcctggtggcacatgtctgtaatcccagctacttgggaggctgaggcaggagaatcacttgaacccgggagttggaggttgcggtgagccaagattgctccattgcactccagcctgggcaacaagagcgaaactccatctcaaaaaaaaaataaaaataggctgtaatcccagcactttgggaggccaaggtgggtggatcacttgaggtcaggagttcgagaccagccttaccaacatggaaaaaccccatctttactaaaaaaaaaaaaaaaaaatttagccgggcgtggcggcacatgcctttaatcgtagctactgaggaggctgaggcgggagaattgcttgaacccgggaggcggaggttgcagtgagccgagattgcgccactggactccagcctgggcaacaagagcgaaactccgcctcaaataaaaataaataaaataaaataaaatgggactgaagaggccgggtgtggtggatcacacctgtaatgccagcactgtgggaggctgaggcaggtggatcacatgaggtcaggagtttttgaccagcctggccaacatggtgaaaccccatctctactgaaaatacaaaaaattagctgggcatggttggcggacccctgtaatcccacctaatcgggaggctgaggcaggagaatcgcttgaacccaagaggtgtaggttgcagtgagccgagatcgtgccactgtactccagcctgggcaacaagagcaaaactccgtctcaaaaaaagaaaacaaaactgaagagtacctactgcacaaaattcattcgcttttttaaaataagtgagataacacattgaaggacctggtacaattcttactatgttaagtgcacaatacatgttagttgttattagacacttggggccttggaaatacccatttatacccagttgaagtataagagaggtggtgctgccaccctgaatgcaggctcaagtgagattaaaattacagtaagttggccgggtgcagtggctcacgcctgtaaccccagcgctttgggaggccgaggcgggcggatcacgaggtcaggagatcgagaccatcctggctaacatggtgaaaccccatctgtactaaaaataaaaaaaattagccgggtgtggtggcaggcgcctgtagtcccagctactcaggtggctgaggcaggagaatggcatgaacctgggaggcggaggttgcagtcagccgagatcgcgccattgcactccagcctgagcgatagagcaagaccgtgtctcaaaaaaaaaaaaaaaaaaaaatacagtaagtcttcacttaatgttgtccataggttcttagaaactgcgactttaaaaatgatgtatatcaaaaccaagtttttttttcattaacattgtaacaaaatgacatcgaacaaaatgatgttatttgaaaccaggttatttgaggaccttctgtacttgatttgcttacctgctgtactttaatttccttcaagtcgcagttgctaagaacctattgatgacattaaggacttaccgtatgcagatgattgcttggggatttgtgaaggggtctctcattttcttgatgaggtaagggttgtacagatatgtgattcccctgatccctcttctctcaggtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgcagaccctggtgcaatgctctggtggctagggatgtactcatgctcatatgtgtgcacgcttggacacccacctccatggacacctagccaccctgttgtgtgtccttatgccagttgagctgaatcttttccccagtatagtggaaagactgaggcttctgcctactgagcaaggttgggtgcttcatttgtgttcagtctgaattatgggaaagttagctcttcccagacctaagctgccttctctccctactttcagaagatcctagttccttccttcccgagtgatacccatgaactgccagtagaggctgctatcgttccatgtgtaaggaatgaactggttcaaggcgcgtcctacccagtcattttctttaccttatactaattcttcctgaataatgtcttcagtttcttgaggagactcctagttttggttttcaaattacttggagggctgcctaggaatctatctccctctgaaataaagtttcctcatcttccaccttgcaagtagccttctggtttccaatgatcccctcgttgtctctgtaaaaagagtttaaggtcttgaacaatggaggagcagctgctctgttctgtttcagagatgactaccaaaagctagcggtttgtgagtgcctcccctgtgccaggctgttaagtacctaatgtgcatgatcacatttaatcttcaggaatctataggatagttgtatctatttgttacagatgaggacactgagactcaggataagtatttccgctaaggttacacagctgagggaactgggattggtggacaaacctgattactaagcccaggccctcagccactccactggttggaaatggcctgactacaaatcaagggcttggcattaggcaacaagtagaattcagtgcttactgctgaacatggcagtgaatcctggagctgttgggatgcagttcctgccaggaggtaggaaaatggacagcttagtgcttgcatgcaggctgcagaacttaattgggcatctgaggtttgtactcttcctgagacccattccaggtggaaactggaggttagcatcgttaacccagattccctttcatctggtctaaatgatggaaatcagtagttggtactgactgctaccagtgggagttcaggggcaaggaagaggctatgcatgtggaagcagtgccctgggccaaaccacaggacagaaaattggaacagaattacataaatcaaggtcagaaatttcctgcccaacccatggggtggagttttctcccttcctatccatcctagcgaatataaaccccgacttgatgtcagtaactggaaggagcagctgttagaattctgatttcagctctcagcatccaccatgcatctcaagatagtcctggcgttcctggcactgtccctcattaccatctttgccctggcctatgttttgctgaccagcccaggtggttccagccagcctccccactgcccctctgtatcccatagggcccagccctggccacaccctggccagagccagctgtttgcagacctgagccgagaggagttgacagctgtgatgcgctttctgacccagcggctggggccagggctggtggacgcagcccaggctcagccctcggacaactgcatcttctcagtggagctgcagctgccccccaaggctgcagccctggcccacctggacagggggagccccccacctgcccgggaggcactggccatcgtcctctttggtggacaaccccaacccaatgtgagtgagctggtggtggggccgctgcctcacccctcgtacatgcgggatgtgactgtggagcgtcacggcgggcccctgccctatcaccgtcgcccggtgctgagagctgagtttacacagatgtggaggcatctgaaagaggtggagctacccaaggcacccatcttcctgtcgtccaccttcaactacaatggctctaccctggcagctgtgcatgccacccctcggggcttgcgctcaggggaccgagctacctggatggccctctaccataacatctcaggggttggtcttttccttcaccccgtggggctggagctactactggaccacagggccctggaccctgcccactggactgtccagcaggtcttctaccttgggcactactatgcagacttgggccagttggaacgggagtttaagtctggccggttggaagtggttagagtccctctacctccaccaaatggagcttc

SEQ ID NO: 17330 - DNA, 10948 bp, Human
caggtcctgggaaaggaggacctgacagctttttccttgggaagccccctaccccgctacctctacctggctagcaaccagactaatgcgtggggtcaccagcgcgggtaccgaatccagatccacagcccccttggcatacacatacccctggagagtgacatggagagggccctcagctgggggaggtgaggagggccctggcctgggtggaaggaaaggacagcccctcccctgccccagtccttggagacaaactcccttcccacggctaccattcatccctgtacctcccctcaaacccaagttagatacacggtgggaaatggtctcacacagaatcggatctaagggactcctgggccagtaaaggcacttgacatttcccaaaaccaccttcttatgattcctggccagataccagcttgtggtgacccagagaaaggaggaggagtcacagagcagtagcatctatcaccagaatgacatctggacacccacagttacctttgctgacttcatcaacaatgaaaccctcttaggagaggttggttgccctagggacataggaaagggacacctgtgggcatggcatcttggctgcccagcctctggccaaaggttagagggaatggctgatttccagttcgcagattcagaggccatggagttttctgatgaccaacacaggtcatccctcctggggtgagattagctctgggacactggctcccccctctccccgcacagctgcttacatggattgctccacgtgttgtatgggcatgaggctggggagagtggaagccaggctgagactggaggctgggattgtgactgaagggtggttctttgggtcacgcttccatagtcctccagctcctccttcttcttgcaggatctggtggcttgggtcacagccagcttcctgcacattccccatgccgaggacatcccaaacacagtgactctggggaacagagttggcttcttgctccgaccctataacttctttgatgaggacccctccatcttctcccctggcagtgtctactttgagaagggccaggatgctgggctctgcagcatcaatcctgtggcctgcctccccgacctggcagcctgtgtcccggacttaccccctttctcttaccacggcttctagtcctgagggtgtggcgggcggcgtggttaggcacatgtacttttccctgtttctactttctattctccgtgtttttatcacacctgctccccagattcccaccccctcaatgttcctctcacacgaaacccccatcagtccctttggttaattcttacttcctgttcatctctaaagtgttaaattataaaaatgatttttaaatattcaaagaaaaatatcacaaatcctactactcagaaataggtggtcacattacatcagacatctctttatgcatgtgcattcaaaaggaagagtagatagaattttgtaaaacagatgttgtatgtaatttataataaaaagtattagaggaattttacttgaatttattgtttgacctgttaagtatctagagtcctctggagaatactaaggagtctggccagggaaattagcgctgggggccagagggcaagggggatagacctggccaaggaatgtcatttggaaagctaaaggggcagggggtgggggtctttggaaggaaaacgatagtttgaagttacaggaaaatatctggccctgactaagtgggggactggggaagaagctgggctgaggtcaggagaggctgctctgcacagatcctgctccttcccagtgctgcattatcttgaaattttccttccccttccccctagccccaactctccccaactccaaccctgacccagaaagtagagtgatttggaggctggaagacaaaaccatgtaaggtctgtggaaatcacagctgttcagacccgcctccaaccccggccaccccgcccccttgccctagccttcctgtgtccttcccacccttagtcccaggcatctgactaccgggaacctcagccagagtccgggagccccccaccccgtccaggagccaacagagcccccgtcttgctggcgtgagaatacattgctctcctttggttgaatcagctgtccctcttcgtgggaaaatgaaccagaagacaatcctcgtgctcctcattctggccgtcatcaccatctttgccttggtttgtgtcctgctggtgggcaggggtggagatgggggtgaacccagccagcttccccattgcccctctgtatctcccagtgcccagccttggacacaccctggccagagccagctgtttgcagacctgagccgagaggagctgacggctgtgatgcgctttctgacccagcggctggggccagggctggtggatgcagcccaggcccggccctcggacaactgtgtcttctcagtggagttgcagctgcctcccaaggctgcagccctggctcacttggacagggggagccccccacctgcccgggaggcactggccatcgtcttctttggcaggcaaccccagcccaacgtgagtgagctggtggtggggccactgcctcacccctcctacatgcgggacgtgactgtggagcgtcatggaggccccctgccctatcaccgacgccccgtgctgttccaagagtacctggacatagaccagatgatcttcaacagagagctgccccaggcttctgggcttctccaccactgttgcttctacaagcaccggggacggaacctggtgacaatgaccacggctccccgtggtctgcaatcaggggaccgggccacctggtttggcctctactacaacatctcgggcgctgggttcttcctgcaccacgtgggcttggagctgctagtgaaccacaaggcccttgaccctgcccgctggactatccagaaggtgttctatcaaggccgctactacgacagcctggcccagctggaggcccagtttgaggccggcctggtgaatgtggtgctgatcccagacaatggcacaggtgggtcctggtccctgaagtcccctgtgcccccgggtccagctccccctctacagttctatccccaaggcccccgcttcagtgtccagggaagtcgagtggcctcctcactgtggactttctcctttggcctcggagcattcagtggcccaaggatctttgacgttcgcttccaaggagaaagactagtttatgagataagcctccaagaggccttggccatctatggtggaaattccccagcagcaatgacgacccgctatgtggatggaggctttggcatgggcaagtacaccacgcccctgacccgtggggtggactgcccctacttggccacctacgtggactggcacttccttttggagtcccaggcccccaagacaatacgtgatgccttttgtgtgtttgaacagaaccagggcctccccctgcggcgacaccactcagatctctactcgcactactttgggggtcttgcggaaacggtgctggtcgtcagatctatgtccaccttgctcaactatgactatgtgtgggatacggtcttccaccccagtggggccatagaaatacgattctatgccacgggctacatcagctcggcattcctctttggtgctactgggaagtacgggaaccaagtgtcagagcacaccctgggcacggtccacacccacagcgcccacttcaaggtggatctggatgtagcaggtaagacattttggtggggagaaggcttctggaagaagggctgaaaagttgtttccattagctttgggttttatgtagattatcccagaaaggaagacgtggatttttgtacttccccttttgctggatgggagagagttggctgctgagttttatttggatcttagctcactggctgggtgcaaagctgcagccttcctctacgtgacctcatccaaagatcttgggaaatggccgagctcagggaggaggcaggatttgggctaacagtgtccccattgccctcttctctcccttgtacttatatgggctctgctgctgggagcagccttctgtttgtcagctcagttctgtgtctggcctgtggtggtggtgttttggaggatctctttgcattctaccacgtccctggcatgtgcaggtcagtcattccaggttgtacatttcctttggagatggaccctcctccctgattttccttctttctctgggcacaattcacctaagtgtgaggggtcacatggatcccgtggagcattctggatagatcctggagtctggtcacagagagagccaaggctacatgatggcttggagtcttcatctttgtcttttcactgtctttccccacattgagtcagtcaccaggtgtttttttttggttttgttttattttgttttgtttctgttttgcacctgcagtatctcggcaggtcagactgtcatgccgtgcaggtgccagccctctctctgctgtttttgctcttgttgctctcagagccaagagccactctgcacccagagggcctcccatccacaccagcctgccctttactcagctctcactttcgtcatcacctgtgggatcctgtctgcagaaccccctcaaaactctttccttcacggtgcagctccaccctgccttgctgtgctctgcacagctacacccaaattctccatgtccctggacacgcacttcacatgttacagtcaggcatcctcctgtttgcttatgctttgtctctgcttagaatgtccttccatatcatcttttctggtaatgtcctttaaggccaggctgaaaagttgcccggaagggcccccttttcctgcctgcaactgtattcctgtgatccggaagttgcctaggccatgctcctctcacaggacaggccagtcagtggtttgtctgtctgcgtggaaagcaagagggtaaggatgatcattcatctctatccccagggacgagtacagtcctctctgctaatgaatgttgaaagaatgaatgagtgaaatggaatgaactccctgatgaagtattttaatttacaggtcaacagctttggctaaaggattggaggtatcctggggagagggaagagaaggaggggcacactcagttctgggctgctctttggcccccactctgaagccagatgggggcagagtccagaggggccagggcagttgcctgacaggccctcccctatcccaccctgagcaggactggagaactgggtctgggccgaggatatggtctttgtccccatggctgtgccctggagccctgagcaccagctgcagaggctgcaggtgacccggaagctgctggagatggaggagcaggccgccttcctcgtgggaagcgccacccctcgctacctgtacctggccagcaaccacagcaacaagtggggtcacccccggggctaccgcatccagatgctcagctttgctggagagccgctgccccaaaacagctccatggcgagaggcttcagctgggagaggtgagtggcgggcagtcagagaggaggggggcagtgagagtgggaaaggagtgttggcggacactcagctcacactgtaggtgaggggagagctctctcaggaaggcttttcttttccttttttttttttttttttgagatggagttttgctctgttgcccaggccggagtgcagtggagcaatctcactgcatcctccgcctcccagtttcaagcgattctcctgcctcagcctccccagtagctgggattacaggtgcacgccaccacacatggctaatttttgtatttttagtagagatagggtttcaccatgttggccaggctggtctcgaactcctgacctcatgatccaccctccttggtctcccaaagtgctgtgattacaggcatgagccacaatgcctggccaaaggtttttctagttatccaaagaaaccatgatgggcacattttccccttggaggctaaagcccaggagtgagaactctcttctgttttggatgggagaggggttgtactgttaaatggctggggataaacaggaggacttgaccccccttagggtgacgtcggggattctgtagcgccgagtcagttgtgtgactgcaattggggaagctgagctctgagcactcagttccctttcatcataatcaggcagcaggatggggtcaatggccatggaggcctgaccagtgcctccctaggtaccagctggctgtgacccagcggaaggaggaggagcccagtagcagcagcgttttcaatcagaatgacccttgggcccccactgtggatttcagtgacttcatcaacaatgagaccattgctggaaaggtcagctggccggggtagagggtacaggatgagccttgctttctcttgggagggtccctgaaaaccacctgcacttctcaggggtggtgctgattcctgccttctgcacttcagtatatctgatcattatcctttgagggaaccttcctgagctgggtgtccatatgcagacactgagtgaggccctgggcctgtccttgagatcttagagccctcttagttccagtttcatggactgagtcctttccaggctccaggactcaggagggatggaagttaccagggaaaatgacatctcctgtatctgaagcttctcccattcctgacttgatgaatttcacaatgttggcctggttctgcttcccaagcgctggttctttttcctccacccttctttcctcagttgtggggaactcttggagagttaggggaagaggagctgaagtagcctgtgggtgtcaccctctgggggtagataggcaatgggcgatatgatgggaaatgtcagagatggaggctgcaagccagggacagggaagcaggtgttcctaatatgaaatggactacttatgctttgactcctacccagcaggaaaaaatgtttaaagactcatgatccttgggctggtgagctgaatccctaccagggcatgtcctcagcaaagccagacctcgtgatcctctttcttctcccctgctaggatttggtggcctgggtgacagctggttttctgcatatcccacatgcagaggacattcctaacacagtgactgtggggaacggcgtgggcttcttcctccgaccctataacttctttgacgaagacccctccttctactctgccgactccatctacttccgaggggaccaggatgctggggcctgcgaggtcaaccccctagcttgcctgccccaggctgctgcctgtgcccccgacctccctgccttctcccacgggggcttctctcacaactaggcggtcctgggatggggcatgtggccaagggctccagggccagggtgtgagggatggggagcagctgggcactgggccggcagcctggttccctctttcctgtgccaggactctctttcttccactaccctccctcgcatccgcctctgagccaggagcctcctgaccctgtgatgcctgacacaggggacactgaaccttgttgatgccagctgtactgagttctcatccacagaggccaggcatggcccagcctggagccgtggccgagggcttccctagatggttccctttgttgctgtctggctttcccgaatctttttaggccacctccaaggactctaaaagggggctattccctggagaccccagagtagggttgccagtcctgcaagtccatagctgagctggaaaggatgcttctgctcacattccctctcatccaggtcctttccttctcgtcttcctctctctcacctacttcctcctcctcctcctgttcctgccttctcttctatcctgcaatttctcccgaatcctgaggggatatccctatgtcccagcccctggtactcccccagccctcagttttcagtcaagttccgtctcctctccagccctatggaagtctcaaggtcacgggacccctaatcagagtggccaatccctgtgtgtcgttcccttgtgtctgttgcttattgggagtaggagttgctcctacccctgtcctggggctgggtgtgtttcaggacagctgcttctgtgcatttgtgtctgcctgcctcatgctctctatagaggaggatggtcatcgtgacagcagcagctcaagttagcatttcaagtgatttgggggtgcaatgataatgaagaatggccattttgtaccagggctctgtattctgcaacagcctgtttgggaggctggagtggaaacaaagggtgggcatcaaagatgagaagccaaagcccctacaactccagccacccagccaggaggggctgtccaatcacattcaggcatgcgaatgagctgggccctgggtgaggtgggggtctggcctagtggggaggggcctggcctgggtggggcagggcctggcctggtccaggcttgggctccattcccatcactgctgtccctcctgaggtctggattggggatggggacaaagaaatagcaagagatgagaaacaacagaaacttttttctctaaaggactggttaaatcaattctgatacagccttacaatacaatagtatgcagctaaaaaataattgtatgtctttatatactaatatgtaataatcttcaggtgaaaaaggcaagccacagaaatgtgtatagcgcacttcccatttgtgtttcagaaaggagtagaatataaacacataattgcttatgtatgcctattcagaataaatgggtaacactgattacttttgggaggggaaccagtaggttgaggacaggagagggaagggtcttaacacttacacccttttgtacattttgaattttgaaccatgtgactgtattacctattcaaaataaacaataaatgggcccaaacaggaattgactttttttttttactgacacttttttttttggtggggaacaggttgggggtagggtaaagtgggttaaggaatgggaccagggatgaaattttctccagttcttgagatccagagaagcaggtgtggcctctagtaactccttttgccttctcatgcttgtacatctttgaggaaatgttaaacctcggttaattccctgacacacacacaccccaccctttccctctctcctgtcttctctctctctcaatgaggggcaatgagaagcagtgaggaggggtgacttctgcttgccagaagcccaggccagggcaggaggtaaagtgcaggaaacattctggatgccactcagcttctgaccagaaaaagaccagaatatgttctgggagctccagcatcatggaagcttctgctaccttctgttctgccccaagcccaagttctgccgtaggtcagtggaacaatggatggggaggaatcaatgagctggagagaaattaggctctaaagaacaggaagaaagccttcagtaaggagcagggggccttcaatggcatagtaattcataatatggccaggagtggaggcaggagtgaaggaggacagggagagatggagagaagggcagactcaagacagagatgcaggagaaagggggatgctgtggcctgctgggacactgatgcaggcttcataatccctctgacctgaggacttgaactttcttttttttttaatttttaatttttgagatggagattcactcttgtcacccagactggagtgcaatggcacgctctcggctcactgcaacctccatctcccgggttcaagcgattctcctgtctcagcctcctgagtagctgggattacaggtgctgccaccacgcccggctaattttgtatttttagtagagacggggtttcactatgttggccaggctggtctcgaactcctgacctaaggtgatctgcctgccttggcctcccaaagtgttgagattacaggtgtgagccactgcacccggcctgaacttctcatttcaatgcatatcctcttgtccccacctccttacggctctttcttatggctacttgcaccatcatcagtgctgggggaaggggagcaaaggaattcagatatccacccccgcaccctcaccatcttgttcactggaatttagttgccttgaaacccatctccagaccaaagtgtttgtatgtgttgtgtgtgtagttgtatgtcaattctcacaagcttttatatgaaaacgtgactggttgtgtctgcttccttatatctcagcatggtgatgatgccacctgccccaggccccagatgaggggaggcagaatggacatctagattgttagaacatcagttcagctcgggtcaggagggccgcaaggtggacctccagccccacaccccaatccaatctcttccttagaccacagaagttgtctggagtcttggcttcagacttgtggtcaattgtctaggagtgattactggctgaggatgtcaggttctgaaggaactggtgctgccaaggctcagatcttcaggacttggggcccagtggcctgagataaaggagttggacaagggaatccctgaggcttgggtcagagggcatgactaggacttctccaggaatgtgaacatggcaaccccctgtgaggacatgaggtgtgcccactcgcctcacctcttttattttttttattttgagatggaatttcactcttgtcgcccaggctggcgtgcaatggcatgatcttggctcactgcaacctccacttcccgggttcaagtgattctcctgccttagactcctgagtagctggtattacaggcacctgccactacgcccggctaattttgtagttttagtagagacggggtttcaccatgttggccaggttggtctcgaactcctgacctcaagtgatccgcctgccttggcctctcaaagtgctgggattacaggtg

SEQ ID NO: 17331 - DNA, 17370 bp, Human
  misc_feature (1)...(17370): n = A,T,C or G
ggaatgctgtcaacttttgccacagattcattagctctgagtttcttttttctgtccccagctaccccttacatgtcaatatggacttaatgatgggaaattcaggcaagtttttaaacattttattccccctggctcttatcctcaaaaaatgcatgaatttggaggcagtggctcatgcctgtaatcccaatgctttgctaggttgaggcgggaggatcacttgaagccaggaatttgagaccagcctgggccgcatagtgagaccccgtttctacaaaaataaataaataaataataaataatagtgatatgaagcatgattaaatagccctattttttaaaatgcatgagttcgttacctgattcattccctggttcctttcacagtcctccgtgacccaagtgttagggttttggtctctctactatttgtaggctgatatatagtatacacacacacacacacacacatatacacacacacagtgtatcttgagctttcttttgtatatctacacacatatgtataagaaagctcaagatatagaagccctttttcaaaaataactgaaagtttcaaactctttaagtctccagttaccattttgctggtattcttatttggaaccatacattcatcatattgttgcacagtaagactatacattcattattttgcttaaacgtatgagttaaaacacttggccaggcatggtggttcacacctgtaatcccagagctttgggaagccaagactggcagatctcttgagctcaggaattcaagaccagcctgggcaacatggaaaaaccccatctctacaaaagatagaaaaattagccaggcatggtggcgtgtgcctgtggtcccagctactcaggaggctgaggtgggaggatcacattagcccaggaggttgaggctgcagtgagccgtgattatgccactgcactccagcctgggagacagagtgagaccctgtttcaaaaaaaagagagagaaaatttaaaaaagaaaacaacaccaagggctgtaactttaaggtcattaaatgaattaatcactgcattcaaaaacgattactttctggccctaagagacatgaggccaataccaggaagggggttgatctcccaaaccagaggcagaccctagactctaatacagttaaggaaagaccagcaagatgatagtccccaatacaatagaagttactatattttatttgttgtttttcttttgttttgttttgttttgttttgttttgttttagagactggggtcttgctcgattgcccaggctgtagtgcagcggtgggacaatagctcactgcagactccaactcctgggctcaagcaatcctcctgcctcagcctcctgaatagctgggactacaagggtacaccatcacacacaccaaaacaattttttaaatttttgtgtagaaacgagggtcttgctttgttgcccaggctggtctccaactcctggcttcaagggatcctcccacctcagcctcccaaattgctgggattacaggtgtgagccaccacaaccagccagaactttactaattttaaaattaagaacttaaaacttgaatagctagagcaccaagatttttctttgtccccaaataagtgcagttgcaggcatagaaaatctgacatctttgcaagaatcatcgtggatgtagactctgtcctgtgtctctggcctggtttcggggaccaggagggcagacccttgcactgccaagaagcatgccaaagttaatcattggccctgctgagtacatggccgatcaggctgtttttgtgtgcctgtttttctattttacgtaaatcaccctgaacatgtttgcatcaacctactggtgatgcacctttgatcaatacattttagacaaacgtggtttttgagtccaaagatcagggctgggttgacctgaatactggatacagggcatataaaacaggggcaaggcacagactcatagcagagcaatcaccaccaagcctggaataactgcaagggctctgctgacatcttcctgaggtgccaaggaaatgaggatggaggaaggaatgaatgttctccatgactttgggatccagtcaacacattacctccaggtgaattaccaagactcccaggactggttcatcttggtgtccgtgatcgcagacctcaggaatgccttctacgtcctcttccccatctggttccatcttcaggaagctgtgggcattaaactcctttgggtagctgtgattggagactggctcaacctcgtctttaagtggtaagaaccatatagagaggagatcagcaagaaaagaggctggcattcgctctcgcaatgtctgtccatcagaagttgctttccccaggctattcaggaagccacgggctactcatgcttccaacccctctctctgactttggatcatctacataaagggggaagacagaaaaaatcctaccagtgagttgaaaatacaggaaagcctatttcatatgggttaaagggtaggacagttgaatttcgtgaaaagtctgagttatataggctttgagcaaagagttttattagtatgaagcagaagaggtaacataaagaaagatgtatggggccaggcatggtggctcacacctgtaatcccagcactttgggaggccgaggtgggcgaatcactcctgggtgaactcaggagttcaagaccagcctgggcaacatggcgaaactccatctctacaaaaacattacgaaaattagctgggcgtgttggtgctgtagtcccagctactcaggaggctgaggtgagaggcggaggaggttgcagtgagtcaagatcatgccactgcactccagcctgggcaacagagtaagaccctgtctcaaaaaaaaaaaaaagatagatgatgtatgctgtatgaaaaaaggaaacacacagatgattcaacagcctgttttgtggggtaatgaaaagtcaccctgggaactgggctccagccctcgttctgccacccaccaactacatgtccttggcaagtcatatcaattatctgagtttctgttttataatctacaaataggttatctctggcagcttaataataatcagggttaacatttattaaacagtgtgtgccagtccatgtgctatgtgcttttctgtgaggtagttactgctatttacagaaacagtagatgcagagaccaaggtgctgagttaaatgattaggccaacaaggttagtacatgccgagccaggatggaagcccaggtaggcaggctggcttccgcggcaatgctcttatgaactatgttacgtccagtgctgataaactgactctctggggagcaggggaaagccctgagtttagcatttgccaatttctatcacgtaaacattcccattctggccactttctttctttctttcttttgtttgtttgtttgagatggagtctcgcactgttgcctggctggagtgcaatggtgcaatctcagctcactgcaacctctgcctctccggttcaagtgattctcctgcctcagcctcccaagtagctgggattacaggtgcccgccaccatgcccagctaattttttttgtatttttagtagagacatggtttcactatgttgactaggctggtctcgaactcctgacctcatgatctgcctgccttggcctccctaagtgctaggattacaggcgtgagccactacacccagccgcatgattctaaaaaataaaaagatgaagtgttattccaaacatctgatctccattgaagaaccatgcaatctctctgggttgatagaggccagagttagtggctctccctgatttcggtgagaaatcactattccaccatcacgggataaaaggcatcctgactggcggttgacacctatttccacagtgaaagatatatctagtacttttaaaggggaagtggtttgtctgagatactctgtttcaaagtagagaggatacagaacaagcatctgaagctatatacatccttacagagagcaattctgatggaaatgcaggccatgtttccctggggggggctcgtcctaggggctggagtgcattctctgatgtcagaggaaatgcaagattccctgaggcctgagggaacccatggtatatgcaagtccaagtttcaaactgtagttccatatgcattcttccaggacaaatacttcttgaggttaaaaaaaaaaagtcacatagctgccattttatggatttcaggatttttttttttttttttttgagatggagtcttgctctgtcacccagcctgtagtgcagtggcataatctcggctcacggcaacctccgcctcccaggttcaagcgattctcttgccttagcctcccgagtagctgggattacagtcacgcaccaccacatctggctaattctttatattttttggtagaaacggtgtttcaccatgttggccaggctggtctcaaactcctgacctcatgtgatctgcctgccttggcctcccaaagtgctgagattacaggtgtgagccaccgcgcctgcctggagttcagaatcttgggcttcattatttgtgtttaaatagatcatacagtcaggcacgnnnnnnnnnnnnnnnnnnnnnnnnnnnnnnnaggtgggaggattgcctgagttcaggagatggagaccagcctgggcaacatggtgaaaccccgtctctactaaaaatacaaaaactagctggatgtggtggcacacacctgtagtcccagctattcaggaggctgaggtgggaggatcccaggaggtagaggtcacaatgagccgagattgcgccactgcactccaggctgggttactgagccagatcctgtctcaaaaaaaaaaaagataatacattcaaacagttcaaaatgcaaaagttacatacataaggaagtgtcatgaaatatctccctctcacacttctccccagccacccagttctcccttctagaggcaacatgtgaaatccttctcaggctacactcttcttgaaggtgtaggctttgggcaaaagcattcattcagtaaccccagaaacttgttctgtttttccataggattctctttggacagcgtccatactggtgggttttggatactgactactacagcaacacttccgtgcccctgataaagcagttccctgtaacctgtgagactggaccaggtaagcgtcccagcccctgcagacagaagctgagtggacctcgtttacctgttatggatgaaactgaccttgaggggacatgaggagagccattcctttgtacttttgtcatgctcttcaattggcacaaattaattcacttctgcaatactttcctgaatagcacagtagtattggaaatctgcctattacagaacctggatggagtccagagaggcacgggcatccatgggcaaagggctcgtgagagtcaccgccctgcagcgctgtgtcctgagaaaggagggggcagaagcctgagcttctgggggtccttcccaatggcctggcccactggatgtgccctcctgagctgaccgtccaatcccttgccctctctgtgcctacgttttattagttacagccagatggttactgtcaaatcaaatgatagatttcattttcagtatgtaataggaagcccctccctcaccctaaagtctcagctgccctctaagactagtactctctaaggtactagtatcccttcctcagagaccctttccctgaccccaaaactagggaaggtcccttagttatttgctctcacagaccacgcatttacctcagagcatattcactcattcagctgttacttaccaagcacctactgggagctatacactgttctatgtgctagggatacctctgtcagtgaacaacacagacacaaagatccctgcccttgtggagctgaaatctgaatagaggaggtgaaatatacaaaaattataataaataagtaaactaggccagttgtggttgctcatgcctgtaatcccagcactttgggaagccaaggtaggtagatcacctgaggtcaggagttcaaaaccagcctggccaacattgcaaaatcctgtctttactaaaaatggaaaaattggtcaggcgtgatggcacacgcctgtagtctcagctacctgggaggctgaggcaggagaatcgcttgaacctgggaggcagaggttgcagtgaaccgagatcggaccactgcactccagcctgaatgacagaacgagactctgtctcaaaaaaaaagtaaactattaatatgtaggataggccaggcacggtggctcaccctgtaatcccagcactttgggaggctgaggcgggtggatcacctgaggtgaggagttcaagaccagcctggccaacatggcaaaaccctgtctctactaaaaatacaaaaattagctgggtgtcctggtgcatgcctgtaatctgagctactcaggaggctaaggcaggagaatcgcttgaacctgggaggtggtgagccaagattgcgccattgcactccagcctgggcgacaaaatgagacaccatctgaaaaaaaaaaaaaaaaatatatatatatacacacacacacacacacacacacacacacacacacacacatataatactagaaaatgattgtttataggcaaaaaaaaaaaaaaagaagaagaagaagaaaaggaaaggagaaggaaagaaggaccaaacatcttttgtagaaatatgtttgctttcatcataacagcttgttatcaaggatgaatttctccctgaaattaatggaggcacagactggaaagtttaaagtggctttaagaggttattttatttagtcctctgtcttaatagaagcaaattattatctctgctccttaggtagagtagctaaggctcagaaagtaggccgggcgcggtggctcacgcctgtaatcctagcactttgggaggccaacgcaggtggatcacctgaggtcaggagtttgagaccagcctggccaacatggtgaaacctcgtcactaataaaaaaatacaaaaacttagccaggcatggtggcgggcgcctgtaatcccagctacccaggaggctgcggcaggagaatcacttcaacccgggaggcagaggttgcagtgagctgaaatcacaccactgcactccagccttggtgacagagaaagattctgtcaggaaaaaaaaaaaaaagtttaaatgaattacccaaggtatataattgttagtgttagaaggaagaagaagggagggaggaaggaagggagaaagaaagggaaggaggaagggagggagggaagaaagcctttatttatctatggggttccctggaaagcaggctgaaatggagattcacgtgcaggagtttagatactctggggaactatacttgtagaagggaaggaacaggaacagggcagaaggagaggtccggttgtgattctgcctcatccaaccccacagcgagctctgaagctggggatggctcctcagagttggtccaagttgggacaagggaatcagaccctggggagagcgtaaccttgatcaaggcgactctctttagcccagggcaatgccaggagaaggctgagagcagaaagccatctaccatcacactctcaacagctacgaaataagtcctgcagttcaggagggaggtctgggcggcacatctcaggaccctctatctctcagggtagaggaattaagaatgggatgggaaccagacgggccatggtggctcacacctataatcccaacactttgggaggccaagggtaggaggattgcttgagcccaagagttcaaaaccagcctgggcaaaaacaatcaaacaaacaaacaaaacacatttaaaaaatttgctgtgtgtggtggtgtgcacctgtggtcccagctactcagggggctgaggtgggaggattgcttgagtccaggaggtcgaggctgcagtgagctatgatcatggcactgcattgcagcctaggagacaaagcaagacactgtctctaaaaaaacaaaaaacaaacaaataaaaaaacggaaccggttgcaagcagggttaaatagcgtggtcagagtaggactcactgagaatatgagatctgagtcaagtcttcaaggatgtgaggaagtaagtttctggcagaagagctgtgaagggctgtctggccagagaagattgcaatgcaaaagccctgaggtgggaacgtgtttggtgtgtttaaaggaaagcaatgaggccagtgtagccagaacagagtgtgcaaggagagaaggaacagaagatgtggagggcagatcagtttgtaattgtacgcccagtatgctgattctttgtgtaatctccagactgtattaaactgcaagagcagggcccctctctggctttgctcaccattgtattcccagagccttgcacaatgcttggtgcataggagatggaaatttgttaaataaatgaattatggataacgaatggatggtaagatgggtggatggatggggggtgaacggatggatggggggtgaatggatggatgaatgggtagatgggtggatagggggatggctgggtggctgggtagatgatgcactgtctcccagatgaggaccttttcacctttactccattctctttcctgccctttagggagcccctctggccatgccatgggcacagcaggtgtatactacgtgatggtcacatctactctttccatctttcagggaaagataaagccgacctacagatttcggtaagaactcaccactggggtgtaggtggtggagggcaggaggcagctctctctgtagctgacacaccacgtattcttcctcacatccccctagcccgctcccacacctgggcagccgctgattaagagttgtggcactttggatagggataaacctcagagtcagggaatgtttgggctgaaagggatccagtagtgcaatccgttgttttacagataaggaaacaaagcccaacaccatgaagggacttataaaaataaggtagtgaagtagcagcagggcttaaataaaaacccatgtctgtaccaaccacagagtcacccatccaggttaaaataaccagagaaacagaagatattcctactacagagaattccgggtgtgcagccacagtgcaaatcctttttatttttatttttgagatgcagtctcgctctgtcatccaggctgaagtgcagtggcacgatcatgtctcgctgcaacctctgcctcccaggctcaagcgatcctcccacctcagccatctgagtagctgggaccacaggccacacaccacacccagctaatttctcgtatctttttgtagagacagagttctgctatgttgcccaggctcaggctggtcttgatctcaagcaattggcttgcctcagcctcctaaaatattgggattacaggcatgagccaccgcgccagccatgcaaatccttaattatcaaacagataaaatagggaagttaaaattcatatacacaagggttaaccacttgccacaggcattttttttttttttttgagacggaatctcgctctgttgcccaggctggagtgcagtggcgccatctcgcctcactgcaacctccgcttcctgggttcaagctattcttctgcctcagcctaccgagtagctgggactacaggcacgtgccaccacacctggctaatttttttatttttagtagagatggggtttcaccatattggccaggctggtcttgaactcctgacctagtgatccatccgcctcagcctcccaaagtgctgggattgcaggcatgagccaccgcgcctggccttttttttttttttttgagacggagttttgctcttgttgcccaggctagagtgcagtggcgcagtctcggctcactgtaacctccacctcctgagttcaagcaattctcctgcctcagcctctcaaatagctgggattacaggcgtgagccaccccacctggctaattttgtaattttttttttagtagagatggggtttcacctgttgatcaggctggtctcaaactcctgacctcaagtgatccacccacctcggcctcccaaagtgctgggattacaagcataagccaccgtgcctggtcaattttgatcttttttaaagagacaggggtcttgctatgttgcccagactagtcttgaactcctggcctcaagtgatcctctcacctcggcctcccaaagtattgggattacaggtctgagccgctgcacccagcccccaacaggcatctttggacttttgagtactggctttaatttacaaaaattccactgagagcacctaagtttgccaggctccaacatttctgcaggggctgttttctttgctgaaggatctgcacctgtgttctgttatggttgcctcttctgttgcaggtgcttgaatgtcattttgtggttgggattctgggctgtgcagctgaatgtctgtctgtcacgaatctaccttgctgctcattttcctcatcaagttgttgctggagtcctgtcaggtatgggctgatctgactcccttccttctcccccaaaccccattccgtttctctccctaatcaggacaaaatcccagcattccagccacatcctgtgtgtaatcagtactgttagcatttctgtgggttgaaagtcaagaatgagcaacttgaaatgattaatttctataagagtgcccagatctatagaatgaattgtgtagaagttaccatacatcaaattaacgcaccaaattgaattagcttgaaatctcagagctttttacaatctttatttcttactggtcttcaacaggccctaatttacttttcagggaatctgccaaatttaacaaattaacacgatgtcctaggaaagctgttcatttaaatacattcatttgcaaacctaatagataactgcagttgatctcttttataggttcagagttttgaatatgtttttttttgttttttttttttgagatggagtctcgctctgtgacccaggctagagtgcagtggtgcgatctcggctcactgcaagctccacctcctgggttcacgccattctcctgcctcagcctctccgagtagctgggactacaggcgcccgccaccatgcccggctaattttttgtatttttagcagagacggggtttcaccgtggtcttgatctcctgacctcgtgatccgcccgcctcggcctcccaaagcgctgggattacaagggtgagccaccgcaccctgcctgaatatgtgttttcttagatccaattaacaagggtaagacaagatttaagttaagcataagaaagattttgtgggaggcactggaatataagaccttaacaaaactgtggaatttctcccctggagatttgtaagaacggaacatagcagcattcaaagaagaatgttgagaacaagggagataatggtttcatggtaatcacaaaagtaacacagcatttagtactgggttccatgtttgaggaagaacctggaagccatatcacatgaaaaacctgggaatgtttaggttagagagaataactgtgttcaaatgtgtgacagagggactagattcatcacttactaactcctgcagaaagaactgagaaaaatagacagtattagagggggaccagtttcacacagacaaggaagaactattcagcaatcaattccgttcaaagataaaatggactgttatagtgggggtgagctccctacctctgagggtatttcaagtagagataggaggacctcctggtaggaaatttgcatacggtgggagattgtacgtgatatggcacctccatctgaaagagtctatattgagggcaggctggagtcacacatgggaataagccaggcgaccctcccatctgccatctgtgatttaattccacagtcgcagaacggatggcatgtcacccactcctccaaacccacctctagcaaaggtcccaaatccttcctatctctcacagtcatgctttcttccactcaggcattgctgttgcagaaactttcagccacatccacagcatctataatgccagcctcaagaaatattttctcattaccttcttcctgttcagcttcgccatcggattttatctgctgctcaagggactgggtgtagacctcctgtggactctggagaaagcccagaggtggtgcgagcagccagaatgggtccacattgacaccacaccctttgccagcctcctcaagaacctgggcacgctctttggcctggggctggctctcaactccagcatgtacagggagagctgcaaggggaaactcagcaagtggctcccattccgcctcagctctattgtagcctccctcgtcctcctgcacgtctttgactccttgaaacccccatcccaagtcgagctggtcttctacgtcttgtccttctgcaagagtgcggtagtgcccctggcatccgtcagtgtcatcccctactgcctcgcccaggtcctgggccagccgcacaagaagtcgttgtaagagatgtggagtcttcggtgtttaaagtcaacaaccatgccagggattgaggaggactactatttgaagcaatgggcactggtatttggagcaagtgacatgccatccattctgccgtcgtggaattaaatcacggatggcagattggagggtcgcctggcttattcccatgtgtgactccagcctgccctcagcacagactctttcagatggaggtgccatatcacgtacaccatatgcaagtttcccgccaggaggtcctcctctctctacttgaatactctcacaagtagggagctcactcccactggaacagcccattttatctttgaatggtcttctgccagcccattttgaggccagaggtgctgtcagctcaggtggtcctcttttacaatcctaatcatattgggtaatgtttttgaaaagctaatgaagctattgagaaagacctgttgctagaagttgggttgttctggattttcccctgaagacttacttattcttccgtcacatatacaaaagcaagacttccaggtagggccagctcacaagcccaggctggagatcctaactgagaattttctacctgtgttcattcttaccgagaaaaggagaaaggagctctgaatctgataggaaaagaaggctgcctaaggaggagtttttagtatgtggcgtatcatgcaagtgctatgccaagccatgtctaaatggctttaattatatagtaatgcactctcagtaatgggggaccagcttaagtataattaatagatggttagtggggtaattctgcttctagtattttttttactgtgcatacatgttcatcgtatttccttggatttctgaatggctgcagtgacccagatattgcactaggtcaaaacattcaggtatagctgacatctcctctatcacattacatcatcctccttataagcccagctctgctttttccagattcttccactggctccacatccaccccactggatcttcagaaggctagagggcgactctggtggtgcttttgtatgtttcaattaggctctgaaatcttgggcaaaatgacaaggggagggccaggattcctctctcaggtcactccagtgttacttttaattcctagagggtaaatatgactcctttctctatcccaagccaaccaagagcacattcttaaaggaaaagtcaacatcttctctctttttttttttttttgagacagggtctcactatgttgcccaggctgctcttgaattcctgggctcaagcagtcctcccaccataccacagcgtcccgcgtagctgggactacaggtgcaagccactatgtccagctagccaactcctccttgcctgcttttctttttttttctttttttgagacggcgcacctatcacccaggctggagtggagtggcacgatcttggctcactgcaacctcttcctcctggttcaagcgattctcatgtctcagcctcctcagtagctaggactaccggcgtgcaccaccatgccaggctaatttttatatttttagaattttagaagagatgggatttcatcatgttggccaggctggtctcgaactcctgacctcaagtgatccacctgccttggcctcccaaggtgctaggattacaggcatgagccaccgcaccgggccctccttgcctgtttttcaatctcatctgatatgcagagtatttctgccccacccacctaccccccaaaaaaagctgaagcctatttatttgaaagtccttgtttttgctactaattatatagtataccatacattatcattcaaaacaaccatcctgctcataacatctttgaaaagaaaaatatatatgtgcagtattttattaaagcaacattttatttaagaataaagtcttgttaattactatattttagatgcaatgtgatctgaagtttctaattctggcccaactaaatttctagctctgtttccctaaacaaataatttggtttctctgtgcctgcattttccctttggagaagaaaagtgctctctcttgagttgaccgagagtcccattagggatagggagacttaaatgcatccacaggggcacaggcagagttgagcacataaacggaggcccaaaatcagcatagaaccagaaagattcagagttggccaagaatgaacattggctaccagaccacaagtcagcatgagttgctctatggcatcaaattgcaacttgagagtagatgggcagggtcactatcaaattaagcaatcagggcacacaagttgcagtaacacaacaagactaggccagctctggaatccagtaactcagtgtcagcaaggttttgggttatagttcaagaaagtctaaacagagccagtcacagcaccaaggaatgctcaagggagctattgcaggtttctctgctaagagatttatttcatcctgggtgcagggttcgacctccaaaggcctcaaatcatcaccgtatcaatggatttcctgagggtaagctccgctatttcacacctgaactccggagtctgtatattcagggaagattgcattctcctactggatttgggctctcagagggcgttgtgggaaccaggcccctcacagaatcaaatggtcccaaccagggagaaagaaaatagtcttttttttttttttaatagagatgggggtctcactatgctgcccaggctggtcttgaactcctgggttcaagtgatcctcctgcctcagcctcccaaagtgctgggattacagtgtgagccactgcgcttggccagaaatggttttgatctgtctgaactgaaccctactgcttaggcatagccccatccttgataatctatttgctcccaaggaccaagtccaagatccttacaagaaaggtctgccagaaagtaaatactgcccccactccctgaagtttatgaggttgataagaaaacataacagataaagtttattgagtgctaactttatgccagattctgttctatgtactttatttatacaattaactcgcttagttctcccaacatctctgtgagttggctactgtcatttatccttatattacaaataggtccagaggggttagtcatcttgtccagaatggtggaaccaggttaaggatcaggcagtctgggctgggcatggtggctcacatctgtaatcccagcactttgggaggctgaggtggcagattgcctgagctcaggagttcgagaccagcctgggcaacatggtgagacccccgtctataccaaaaatacaaaacattagccaagcgtggtggtgcatgcctgtggtcctaactactcaggtggctgaggtgggagaatcccttgagctcagaggttgcagtgagccaagattatgccactgcactccagcctgggtgacagagtgagaccctgtctcagaaaaaaaaaaaaaaaagaagcaagcagtctgggctgggtgctgtggctcgcgcctgtaatcccagatacaaaataatcattttgtaatatatcctgcttattagacagaacattttgatcactcatctgttccctaagttatagatttacgtccactttagaaatggcttgtgaggcaagtttaagtgaccgatgacagttttaaagcaaggtccatgtcatgttatggcataatttggtagaatgttctagtagtgtatcagttttcaggtggtaggcttgaggatgatacacacacacacacacgcaatgcaattctattattgcccaaagaaaatagacccattaaggaagtccaacttctgctgcgtggaccagtgctgccacatcacacatagaccaaaggcttaggtttttgtggttttggttatttattttatctttttattttattttatcttattttattttattttattttattatttgagatggagtctcactctgtcacccaggctggggtgcaatggcgcaatctcagctcactgcaacctccaactcctggggctcaaatgatcctccagcctcagcctcccgaatagctgggactacagatgcgtaccaccatgcctggctaatttttttattttttgtagagacagggtctcaagcatcctcccgccttagcctcccaaagtgctgggataacaggcatgagctgctgcactcagccatgtttttgatttttaacaaaattgtaacaccttaaaaaaaatgtataacaaggccgggcacggtggctcatgcctgtaatcccagcactttgggaagccaaggcaggcagatcacctgagatcaggagttcgacctgaccaacatggtgaaaccgcgtctctactaaaaatacaaaaaattagccagacgtggtggcacatgcatgtaatcccagctacttgagaggctgagacaggagaactgcttgaaccggggaggcagaggttgcagtgagcccagatcacaccattgcactccaacctgggcaacaagagtgaaactccatctcaaaaaaaaaaaaagctgtataacagcttgagatataattcacaataccatacaattcactcatttaaagtgtacaattcaggggttttcattccactccaacccactcaagcctaggcaaccactaatctactttctgtctcatagatttgcctatttggggcatttcatataaatagactcctacaatatgtggccttttgtgtctggcctctttcacttagcat

SEQ ID NO: 17332 - DNA, 7634 bp, Human
gcaggcgcctgtagtcccagctacctgggaggctgaggcaggagaatggcatgaacccaggaggcagagcttgcagtgagtcgagatcgcgccactgcactccagcctgggctacagagcgagactccgtctcaaaaaaaaaaaaaaaaagttaaggaacagtcccaaaacttgaacttacatcagatttggagttaactcatatcagatttggagtcagccacctgtggactggagtccaactacattgtgtctcaggctctgacatctaacccaggcagggatgagacttaattcactgtggtcttgcagtggcaaagtagaagcatggagaccaagcctttaaaactttctgactttggtgttaacgttctgttcctcattttcccttctgtaacatagtgatgatgctgcgtgctctagttatatttatatttttatttttttgatacagggtctcactctgtcacccaggctgagcgaggtggggcgatcacagctccctacagcctcaaactcccggcttcaagcaatcctcccacctcagcctcctgaatagctgggaccacaggcatgtgtcaccacgcccggctaactttatgttttactgctctttgcagagcagggctaccccataggcagcgtgcctagagtggccaaacctagctaagttttgatttttttttctagagagagggtctcgctaatgttgcccaggatggcctcaaactcctgcacgcaagcaagccttggcctcccaaagtgctgagtttacaggcgtgagccaccgcgcccagcttctagttatctttacagaattatttgcagcatatattattgactcgaattgcctcgatataaaaaagcactttttttttttcgaaactctattgcacaagctggagtgcagtgaggcaatctcggctcactgccacctccacctcccgggttcacgccattctcctgcctcagcctcctgagtagctgggattacaggcgcccaccgtgcgggtttcaccgtgttagccaggatgatagtctcgatctcctgacctcttgatccgcccgcctcggcctcccaaagtgctggtattacaggcgtgagccaccgcgcccggcctattgtcagactcttaatcaagcctgacttttgggtttagctctggctccagcagagcaactctggcggttggttctttctcttccttatctccttgtccccaagcatccaccagaggacgcagctcccccaaaactttccacccagtgcttggctggaggaactcagtccacgcttctctgctagtctaggccggcggttaagtcaatgtaaccggagacccggctgcccgttgccatggggacggaaagctatgatgtcaccaccgtccgggtgggtgtgctggggttcaccctcccatttccccaagaccccctgccaggacataggcggacgcgggagagaaaaccaaagaggctccctccttccccttagcatctctctcccgccgtgttcaggaagtggatggctgccccagctcttgtccgcactggtacacctgcgtgcacgcgtgggtacacagcaggcccgagcttcgcgcttgtgccgctcatattctacccctaagaacttcgcttgaactctgacctgcccttatatccgagaaagtcaaataagcccagttcggcctgtcccaaaccggcaggggcccctcagaccacaccggcgggctggaccccggctctgaggcctctgttcccagggctccgccagatcttctggccccgaccccggctgcgggggtgggaggagggccggggggcgcggcgctggctgggggcggggcggagggggggccgcggacccggggcgggggctcggcgcgggcccgggagatgccggtgttggcggcccgagcggctgcagttgcaggggcgggagaggcgaaggaggggaccgggagaggggtggcgtgggggaccggctcgtagccgggaccatggaggggcagagcggccgctgcaagatcgtggtggtgggagacgcagagtgcggcaagacggcgctgctgcaggtgttcgccaaggacgcctatcccggggtgagggacctgcgtcttgggagggggacgctaaggctgctggggggtgggtgacaggggccctggcgacggatgggaatgggtactcgggtaaccagggacaagagacagggggtcggaggacgcggggaggccttgagggctcaggaaggactgcagaggattggggtgggaggaattagggagcagggtgagatagatggggtttgggagaaccagagcatccgggagggagggcgaggggaatgtcggaggtcctgggcaatggagaggggaagaactagggggctgaagggaccagaagggaacaggaggaggtcttggagcttagcagagattctccgggggggggggggggggggcaggagctcccgggatctcccctttgcccaatcccagaccaacttgtgtccaggggctgggctggacggggtgtgggagtgaggagggcatttatctggggtgaggacttggagagatgatctcatctggatccatccgtgtctgcagagttatgtccccaccgtgtttgagaactacactgcgagctttgagatcgacaagcgccgcattgagctcaacatgtgggacacttcaggtagccaagtccctgggggtcaccctgacttccaaggcggcccactctgtcccctcccttggttagacccttaggttccaggtaagcccagcccatccatccaattccaacaggaagggaaaaatcaatattctgctaaaatccagggaaactgaggtagaacttgcagagcctgacagaaaccatgtcctgaaggagaaagcctaggatctgagcccctcagctgggtcctgcctacctgggaaagttgggaaggaatggcttttaatttggaacatgttccttcagagataagactgggtttagaaaagacatttagaggccaggcacggtggctcacgcctgtaatcctagcactttgggaggctggggtggggggatcacctgaggtcaggagtttgagaccagcctggccaacatggttgaaactccgtctctactaaaaatacaaaaattaatcgggcgtgtggcacgtgcctgtaatctcagctaccaggaggctgaggcaagagaatcgctggaacctgggaggcggaggctgcagtgagccgagatcatgccgctgcactccagcctgagcgatagagcgagactccatctcaaaaaataaaaaagcagaaaagacatttagaatgtcttgagtgaggggtggtcaggaggctgtttctctccattgaactagataaatctgaggtcaagtcccaggagaatgggagagtgctctccctgccactgctcttttcctcctcccaacataaggagggtttttatttttacaagagttcccttcagggctttagactgccaaagcccagaaagcacatgcaacattttatgagaatgtctatagattttatgagcttctcaaaggggtccaaacctcagtcaagaataaaaattattactttttaaaccactagggaagcagagagccgtttcccaccatgtgacctcccttctgcccgctcccccacttgggaaacccagactccatgatgggtattaatgatgggtattaatggttgctcttttccattctctgctcccagcatcccttgaccaggatctgtaaggtctcccattcccttccaggcctcccatccactcaggcccctcatgccctgtcttccttcaggttcctcttactatgataatgtccggcctctggcctatcctgattctgatgctgtgctcatctgcttcgacattagccgaccagaaacactggacagtgttctcaagaaggtgggagcctggggaaatagggcagctagactgagggggaccagaccaccatggtcctgacataacatgggccaggaggagggagtgatggctggggtatggccatcagctggttagcgagtgaagctctcatccctgccacccctgcctccagcccccatccctcccagccacccctttcctgaaagtcctcagagctggatacagcagctaggggaggtgggggagtgaagggagaagcactcacaggattccttctctgctcttccaactccttggcagtgggagtcccagatggaggggatgggatgggaagcctgatcctggagctcaggaaagccctgtggcctcctctccaggccccagtttccatgacaaaagccaggggtgaatggacagaagtcagctagggcagccccagttcccaggtgggggaggggagggtgggataaatttgttcccaggagagagtatgggaaaggcgagtgggaatgggaagtttccaggctggcagacccttcatagccactgagggagaagagtccacaggcccacgccagccctctcctccccgctgcttctctctcaccccatcctgctctcaaaccaagcctagcattctcacctccttcctcatgtgggagagtcctgagggatacatggtttctgcgtgcttgaggaagagagggcacactgctggcatggcacaaaggctcacgctgtgcctccctccacccctccacaattctcttttcttctcctacatagtggcaaggagagactcaagagttctgccccaatgccaaggttgtgctggttggctgtaaactggacatgcggactgacctggccacactgagggagctgtccaagcagaggcttatccctgttacacatgagcaggtgggacccttgacgtctgacctcatcccagcctagacctgtcacctctgccccttcagtctctgatttgaaaacaccttacctggctcatcctttgttctggtctgtgacctctgacctgatcccttgactgcccccagccttgacattcaaccccagcccacagcctccatgcccctttctaagctgcaggctaagacctataactttctcccatgcactccttccttttccagggcactgtgctggccaagcaggtgggggctgtgtcctatgttgagtgctcctcccggtcctctgagcgcagcgtcagggatgtcttccatgtggctacagtggcctcccttggccgtggccataggcagctgcgccgaactgactcacgccggggaatgcagcgatccgctcagctgtcaggacggccagaccgggggaatgagggcgagatacacaaggatcgagccaaaagctgcaacctcatgtgaggggctaggagagggcagagtgtgaagaggggtggtgagggacacaattgttcccctgcctgcgcccaggcttcttgacctcctgatcctggctgggaagttagggcaggcagagcgagcaattctgggcaggggagctggagggcagaagggtatcatcgtttctcatctcctcctccctcctcttctccagtggatgttgagggagctaacagggctggcatctggggcatgaactgggatggggcaggtgggcgttagggaagctggtatcaaatggtgaccttggtggagtctcctatgtgaagagtaccctccctctccacccccagtccccatatcctggttctggcccaaggaaaatgtccattctatgaccttctcttttcctctcctctcacttctgcagctattctcacacatctaacctctaggcaacatgcactaaattcaaaagcaaggagaagcccttgccccccatcagtccaccagccctagaacctcccttgcctcaacagtcacctaataaagcccacctccatggaaaacggctgtggctttagttttgttgctttttaaaaaaatcaatctaccaatctttagcagtaagagggaaagttagacctcagctggggaactttcctgtccatgtccacagatagagcagaggacaaagccataggttggatcagaagtgtccttttaggagtcagagttgggagaaggagacatcctgggactgttcatcctagttaatgaagtgggcaattctcaggccattagggggttttagagcagaccgacatataattagtcagcatttctcagcccagccaggcctgctgctagtgtgggaggggtcctgctcaccatctgtacccctggcttggagcctgctggtaccctgggggttgtggggataaggaggcatcaggccgggcgcgctggctcacgcctgtaatcccagcactttgggaggccgaggtgggcggatcacaagttcaggagatcgagaccatcctggctaacacggtgaaaccccatctctactaaaaatacaaaaaattagccaggcgcggtggcagtgcctgtagtcccagctgctcgggaggctgaggcaggagaatggtgtgaacccgggtgaacctgggaggcggagcttgcagtgagccgagattgcgccactgcattctagcctggatgacagagcaagactctgtctccaaaaaaaaaaaaaaaaaaaaaaaagaaggcatcaaaagcctccacatcacagaagctacccctgtacagcgtgaagtttcctaagaggtcagtagtttgattctggggtctccttagaggctcaggccagggacctttctctcctcccatgctgagtttcatgatggctttcaggggagcatcagctgttagagtcacccctaccctgtcccttaaaggaaagacggtggagaggacggctgagcgcctgttgtcaggaaagacagtactggtctgttttctcgggagtctggtttcagattgtcctgtattcccttcctggctctggtcccactggcctcttttcggtgacattctcccccaggaaccatccctggcccttccctcccccagccctagccagttctcccagacacactggaagagaacactgaccttacccaactatctgctgggatcccacccaaatttatagcccattcctccctcattcattcattcagcaagtatgtactgaacaccaactgtgtggcatacactggcttgggagattgcaaggaccagtctctaagcttttggaggccagcccagtgtggaagagaggtacctcaggtgtgagggtgccatggctgagggatatttgtacatgtatgggatgctatgggagctccttgcagcctgagaagccagtcctgtgagccaggtcctgagggttgaagaggagttttccgggcagggaaagggtaggaaaggcactctgggcagagggtacagcatgtgtaaacacgtggagatgagaatgagcatagcactgttggggctcccatggcagggagaatagaagacaaggctaggaaggtacactgaggctactgcagggtccacagaggaatcagaatttcattctgaggatgaatgaaatcatcctcagaggatgaagccaccaggaatttcaggcagagagtgaagtgatcagagttgttttttggatagatggttatctggatgtggtgttggagctgggagatttggctctgaggtgtgtcatttaaaataatagcttctcggcagtggctc

SEQ ID NO: 17333 - DNA, 17714 bp, Human
  misc_feature (1)...(17714): n = A,T,C or G
tcccagtgttaaggaagagacattaaatagctgacacactcttaattctgtagtcccagttatgagtctctatcataagtagccagctcttcattgcaggattattgtaatcacccacaggggaaatagtagaatttccagcggtaaaaaaatacactaaggcagtacatttagtgtagtgtaatgtagccatgataactacaataactgtgtagcaacatagaaaaatgttaaatttaaaaagcagaagcctgggcaacaaagtgagaccccatctctttttttttttgagatggcgtctcgctctgtcaccgaggctggagtgcagtgtgagaccacatctctacaaaaaattttaaaaattagctgggcatggtagtgatcacctgtggtccctgctacactggaggttgaagcaagaggattgcttgagccaggaagtcaaatctgcagtgagccatgtttgtttgttccgcttcactccagcctgggtaacagagtaagacactgtctcaaaataaaaataaaatagacaatactacatacaattttgggttaagcagtggtttcttttacaccaaaagcataaacattggactttattgaaatgaaaaacttttggccaggcacattggctcacacctgtaatctcagcactttgggaggccacagtgggggattgcaaggggagatgggaaatgttctaaaactggattatggtgatagttgggcaactgtgtaaatttactaaaaattattgaactgtacatttaaaaagtgtgagtcttatggtatgtaaattataccccataaagttgtttttaaaaatgaagtaagtccctctgctcaagacccagtcatctcatctcattcaaagtgaaagccagagctttacaatccctataagagcctaggtggtagctcaacactcttacctccctcaccccattttctgtatctcttttcgttgcccatcttctagccacaccagcctctgctaatccccaaacaggtaccctctgtgctcttgctgttcccttggcctagaatgctcttccttaagatgcaggtaagaattccttcctcaccttcttcaagcttttatttgaatatcactttctttttttgttggttttgtgtgtgtgtgtggggggggggggtttgagatggagtttccttctgtcgcccaggctggagtgcagtggcatgatctcgactcactgcaacctccgcctccgggggtcaagcgattttcctaccccagcctcctgagtagctgggattacaggcgcacgccaccatgcccagctaattgtattttttagtagagacgggatttaaccattttggccaggctggtctcgaactcctgaccttgtgatccgcccgcctcggcctcccaaagtgctggaattacaagcgtgagccaccatgcccggccttttgttgttgctgttgttgttctgagatggagccttgccctgtcgcccaggctggagtgcagtggcccgatctcggctcactgcaacctccacctcccaggttcaagcgattctcctgcctcagcctcccgagtagctgggattaagctgggattataggcgtgccccaccacgcccggctagtttttgtatttttagtagagacggggtttcactgtgttggccaggctggtctcgaactcctgacctcacgtgatccgccctcctcggcctccccaagtgctgagattacaggcgtgagccaccgcgcccgccgccccctgaatttagagaatagcggagcctccccattctctgcggccttggctcctacacttcccgtggtaaccttgttcatccgctgaagcccgctgcttttcccagcccggcctctgggggccgctgccgggcctgtgagcctgtggaccaggagctcctgctgccgtcgtagcgtcacgtccggtctcgggcggaagttttccggcggctaccgggaagtcgctgaagacagagcgatggtagttctggaggcctcgctccggggccgacccgaggccacagtgcctccgcggtagaccggacttgggtgacgggctccgggctcccgaggtgaagagcatcgggggctgaggtgggaccttagaagggagtctgggaaccctcacggctcttattggagtcccttccctgaccctgggctctaaactgcctttgctcaggctgtcccggaagcaggtcctccccgtatcataccattcctagagggaacggcgcaggttgggacttccctccctttaccatcgtcaccaaggcatgtggtaaccccgggccggaggtcaagggcgtcgcttctccctaatgttgcctcttttccacggcctcagggatggaagggtctaagacgtccaacaacagcaccatgcaggtgagcttcgtgtgccagcgctgcagccagcccctgaaactggacacgagtttcaagatcctggaccgtgtcaccatccaggaactcacaggtcagcgagacccttggaaagagggtggtcaagaatgtggaaggtgggcagctttggtgatataattcttatggtggctgtgtagtctgccacaaactcatcgtgtgaacctaggaaagtcacttcatctggctccctgttttctccttggaaacataaagcattctgacattgtggacttctgagagctttccgaccgggcgcggtggctcacgcctgtaatcccagcattttgggagaccgaggcgggcagatcacctgaggtcaggagttcgagaccagcctggccaacatggcgaaacccctctctactaaaaatacaaaaattagccgggcgtgatggcacgtgcctgtagtcccagctactcgggaggttgaggcaggagaatcgcttgaaccggtgaggtggagtttgcagtgagctgagatcgcaccactgcactccagcctgggcaacagagcgaggctccgtctcaaaaaaagagagctttcagtagcaaaagaaagatccttattttctgctcctgctgtttcagagaaaaggaatatgtatatataataataaatggtattttttgaggacttactatatagtaataccaagtgcattacacgtattacttcatttagtccctgtaacaacccgtacggggtataccgtcattacatcatttttcagatgaagaaccgaggcacagagaggttaagtgacttacctaaggtccaacagctggtaaatggagtagagtcttaaagtctgaagaatttgctggatgtgatggctcacgcctgtaatctcagtgctttgggaggctgaggtgggaggatcgcttgagcccaggagttcaagaccaacctgagcaacctagcagagatcttgtctctaaaaaaaaaaaaaaattgctgggtgtggtgggtggtggaggctgaggcaggaggatcacttgagcccaggaggtcaaagctgcaggaagctatgatcatgccactgcactgcagcttgggcaacagtgcaagaccctgtctcaaaaaataaattaattaaaaaggccaggagtggtggttcacacctgtgatcccagcactatgggaggctgaggcaggtggatcacttgagcaggagtttgagaccagcctgggcaacacagtaagaccctgtctctataattaaaaaaaataaaaaaccccaaaatcccgcaaagtcagaagaattcagattaagtcagacagtaaaagagaagactgaataggcagcttaaataagcttatgggcctggagtcagcctgcttgggtttaaatcctggctgtcatttactagctgaacaactttttgcaagttacttcatttctccaagccttggtttctgattttttctgtaaaacgttaaactgcctcataaagaatttataaagttcaaatatgacaaaccacagaaacacttaggaatttgctgggcaaatagtattcaataagtattagctgctattattacctggtttctctttcttgaggggaaattagctcttttttttgtttgtttgtttgagacggagtctcactctgttgccaggctggagtgcagtggcgcgatctcggctcactgcaacctctgcctcccgggttcaagtgattgtcctgcgtcagcctcctgagtagctgggactgcaggcacacaccgccacgcccagctaatttttgtatttttagtagagacggtttcactatgttggccaggatggtctcgatctcttgaccttgtgatctgcccgcctcagcctcccaaagtgctgggactacaggcgtgagccaccgcgcctcttaaactcttttaataacaatttttgactttttattatggaaaatttgagacatatatagtcaagagaatagcatagcctgccttgtattcatcatccagcttcaataatcagccatattctcacattcttatgttgtctacacctccattcacctcccatcctctgctcaattattatgtttttcacacctttttagaaaggtaaattgtcatgacttgaaatgtatgaatcttagctgtacatttttgacaaatggatacactgatgtaatctggatcgttgcaatttagcaatgtttcatcttcctagaaagtttccttatgttccctccttgctattctgggggaaacaggatgtttgcttttgtgatggaaaatttcagagtatatcatgaactcctgtgtacccatcacctagttgcaacaattatcaacacatatttaatcaagttttgtctacagccccatccattccttcccactctgaattgttttgaagcaaatcccaaacataaatactgtaaatatttctgtatttttgacagataaggattcttaaagataaatgataccggccgggcgcggtgactcagcctgtaatcccagcactttgggtagctgagacgggtggatcacgaggtcaggagatcaagacctggccaacatggtgaaaccctgtctctactaaaatacaaaaaaattagctgggcatggtggtgcacgcctgtagtcccagctacttgggagactgaagcaggggaatcactcgaacccgggaggcagagattgcagtgagccgagatcgtgccactgcaccccagcctggcgacagagcaagactccatcttaaagtaataataataataataataatgataccattatgccttaaaaaattgaacatttctttaatctgatttaatgggggtgaggaagaccacagattcttttggtgtaaatggtactttaagaaaaattggaggtgagggtggtgatgagaatatttcacattcttttcccatactttcagatgccctcctgctttaataagactgtttctgacccaatattttccttgcccttagctccattacttaccacagcccaggcgaaaccaggagagacccaggaggaagagactaactcaggagaggtaatagaagtgccctctcccctatcctcctcatgtagtaaacattccaaatgagagatatgatatgaaaacaggaatgcaggcttggtttctgcaggctacttggcgcttctagagctcccggacttttgggatctctgggtaatgagacattctacatgatcaggctgctatgcaccattggaggtacagatctgcacctgaggtcacagggttactgaattagtcattttaaaatgttggaaagggctctttatttgaagcagaattataaattattgtaggttggagatgggatgacctgtgtgtccaggtcgttctagagcattgatttgcatctgttgttctagctagttgttaatatccactcctttccattctcaaaagcatcctggttaggacagtgaattgtatgattgccctggacagaaagaattgtcagtgttagagaacatgtcattttaagctgtgataatatcagggatcctgtggagcaacatcctgtgagatactattgaatacacacctgagatttcttctcaagtagcaagggagctggagtatttatttacccacagctgccagtcactgggggagtgctgatgtcaggtttagtggaggtcattaattctggccagcgccccctgcaggcagtgaagagtccaggagccagagaagcctttaagcaaggaggcaaaggggtctggcatttgaagtcaatagatgctgtgagattttggtcacatatgagtaatctcaaaatactgaaaacatataaattttctactttgtactgtggcagacttcattgcagtctgatctggctttttccttgtactatgatttagggcattctgtcctctgcccctgactgctaagtgttgagaaatgcaaatttaaccatacatagagtgtaacatagttaggaaatgctgttccccacaaaaaaaaaatcaaatgggacttaaggtttgtctgtatcgtgggtcctttcttagtccacatacacaaggattgcttcgataatacccattttttaagtctctgtggtttatcaagtcttgtggttatcaagactaaagccatatagttctgaggctgtttgggagatgaactctacctctaagctgccagagttgtaatgccctcttatttctttcccaggagccatttattgaaactcctcgccaggatggtgtctctcgcagattcatccccccagccaggtgcctactacttctcagcccccattccttgccaaaggctagtagaattttaattaaatccaggaatcgagacctggagccaggtgatagagatgcatcatcacctagccttttggccctttcagaaaagatgtattcccttatacctggcccgtcaccttccagtatggattttttcctgtagctgttcacagagtgggaaaggatagtagctttaatgatgaagtattgaaaaaaattgagggagtgattgaccaatcaccaagagatgggctcttgagaagtttcaaactagcaaatgttgttagatgttcaggtccttagttctcattgctgcaggtaaagagcttgctggcaaggggtataatattttctaaaatggcctttcctggttctcccttcttttccactgtagacatatgaattttttatgctccctctccctccttagtccaccaaggccaaccttcatgctgagtgtccctgtggaagaccagcatggccttcctttgggagagaggtacccttgggaggtcagtcgggctaggagtgggtatgttccttgaggcccctcagctggtgcttgagagtctctgccactggcattgtagtaggtggaggaagcctctctgttccctcatgtggcccgtgggcggggggctgtctgcaggatgatgtccacagaaagtgccaacagcttcactctgattggggaggcatctgatggcggcaccatggagaacctcagccgaagactgaaggcaagtcggccccattccggtggcaagcagtaggcctggctgggagagtgggtaattgagcaggaagcatgggggaggccctaccctgactctcccacacttccaggtcactggggacctttttgacatcatgtcgggccagacagatgtggatcacccactctgtgaggaatgcacagatactcttttagaccagctggacactcagctcaacgtcactgaaaatgagtgtcagaactacaagtgagtgtctccagagccagggctcagagctgttactgctctgagactgcttggcccttacccaagagccgtactccactcaggcaaatggagctctagtaagtatagtctgcctgtgtctttggcagacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtgagtgctcaccctgttctatcttctcacactcgaggctccaggagaggaaatggcttccagctgaatgtgtctgaatagtttgtaaactagtcagctgtcagtcagcagcatgcctgccccagatcctgcatattgcttccatgccctttttctagaggtttgttgggagagttacctatgaagagtcagcatgattaagtgaaaaaagtatgttggttaaatagtgcagaaaccagagctccagtcttggctctgtcctgtagggaatgggctcatttggatgaatcagccactttctagccatccttagctgaaaagatgagctaattagcctacatttgttccctccaagcttaaacatttcatgggggccaggtatggtcgttcatatctgtaattccagcactttgggaggccaaggcagaaggatcacttaaagccaggatttaaggccatctggggcaatatcaagtgagaccccatctctacaaaaatgaaaattaaaaaaaaattaggctgctgtggtagacctgtagtcctagcaactacttaggaggctgaagtggaggataacttgagcccaggagtttgaggttacagtgtgctgtgatcacacctctgcactccagcttgggcaacagagttgagaccctgtctcaaaaaataaaaacattatagatgtccttgacctgagagaaccctctctctagtggaggacacacagtgtccatactaactgaagttgtggaaatgaaggatagagaaaagtccatttttttcacacagtagtataacaagtttcactggaagtggggtatagtaactatttaaaggacagtaagtgtatagaaatgaagctttagaaggccaattatggccagttcatggaagaagccactgtttttttgttttttttttttttagaaacagagtcttactctgtcatccaggctggagtgcagtggtgcagtcatgactcactgcggccttgacttcctacacctaagcaatcctcccgcctcagcctcccaagtagctggaactacaggcgcgcaacaccatacctggctaatttttgtattttttatagagatggagtttccccatgttgcccaggctggtcttgaactcttgagctcaagtgatccacctgcctcagcctcccaaagtgctgggtttacaggcataagccaccatggccagctggaaaaagccactgttttttgtttttgattttggtttttttttgagacagagtctcactctgttgcctaggctggagtgcagtggcatgatctcagttgtctgcaacctccacctcccaggttcaagcgattctcctacctcagcctcccaagtagctgggactacaggcgtgcgccaccacgcctggctaattttatttttttagtagagacggaatttcaccatgttggccaggctggcatctaactcctgacctcaggtgatctgcccacctcagcctcccaaagtgctgggattacaggtgtgagccactgcacccggcccagaagaagcagaagccactcttttttttttttttttttgagacagagtctcggctctgttgcccagtctggagtacagtggtgtgatagctcactgcaacctctgcctcctgggttgaagcaattctgccacttcagcctcccaagtagctgggactacaggtgtgcaccaccacgcctggctaatttttgtatttttagtagagacagggtttcaccacattggccggactgctctcgaactcctgacctcaagttatccacccgtcttggcctcccaaagtgctgggattacaggtgtgagccaccacgcctggccccaagaagccactcctaacccattcacctcacttctgaaaaagatcagaaataagaggttttttgccctggtttgggagaattcttttttcctccacctttttgcatatgggcagctggaatttgagacatttctgttccttccaggcaaaacagctaggacatacatgttcctcagaatgggatctatgccaaatataaaagatgcgagagctagatgtaacgatgatcactaaagaatcgttcatagtgtggtgagagagaaactttagcccccaagctaacagccttcaatggcccccttggctgctcacaggtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggtaatgagagctaggggatgaggagcactgcacatatctagaccttagctgttgaccactaagcctgggtgcccacttcccacaaaagagggactgtaggttatcttcacccaactaggtttctttcattcatagtgatgggataggcacagtagggattggaattctagagcttggtgacatccgcccttctaaagaaaggaaaaggcctgagcccttcagccacttaaaaacctggtaagctgtctggtgctgatttcttatccccacggtgtttgatgttccattaatttaataactgttgagtgtctactctggaaaaggcactgtgctgagtgctaggagggcaacagcaaaacagtatgcagtcaaccttctagttgcatataatctggtggaagagatggataaataacaagcagttgtaatgcagtgtgatgatggtaaacccagggtgctgtgggaacacataagggcacttgatccagtttggggaggccatatggagagtttccccataggggacttacgtttaaactgagaggtaaagtagaagtctgcagagagggggttgttcctagcagagagaacattatgtgcaaagaaatgggaaagagggagtggtgaattcagagaacagaaaggagcttattgtgactgaagattgagtgtaaaggggagagtggccggatatgaaactggagagttaccagttcctgaaggatctcgtaggcctcgttaagaggtttggacttcatccaaaaggcagaggagacactgaagcattttagctagggaagtgacgtaattacacttgtattcgtgaatgatggcttttcctgcaccatggggaatgacttggggtaaaggggtggaatcgttggaaaggatactcatcagtaggaatctaaaggaaaagaatagtagcattgaatttggagaaaagtggaaagatccaagatatttagcaggtagaatcaggagaggttggcagttttgcacggaaggagctgagggagcattcaaggataccacccaggtttctgctttggcatctgagcagcagggaaaaagatgatgactcaagttttggacatgtatttaaagtgccaagtacagcttgcatatatggacttgaagatagatttaagctaggtttggggtgagagtgggaaatgtcaaactttttaagtaatccctgtatttccccccacctttctgccttcctctgtaggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagaggtaggaagtgtagccctttcttggggagtgatgtgcattgatataatttgtatctccaacctggtactgctgtccaccatgtcaggagcccttgctgcccacagactgggagttttctgtggctgaagagctgtcagcatctgattttcccctcatcacagggctctctccactgatcacacagtcactgagttgcgtgactatagcatagttcccagcctacagtccccagagccttagtgttcctcaggatattttcagtttttgtttcttaaatttaaaccaaaacataacatttgttcatggaaggcccccaggcaattatataataaatgtagtttgttcattaaacaaaatcttttaaacatggattcaatggggaggtgggagagggagttgagcataataaaagaagcccttggccagaatgaagagtgaaatcattgggttgtaacttcccaataatcactttgggaggagtcctgtatccatctctgtttgtatctctattttagataccgacttgttccttacggaaaccattcatatctggagtctctgacagacaaatctaaggtactctgtgaagctccattttcactggaatacagagttcttatatctcttaagaaaatggatggtttgctttgatattggcattcaatttattttttagacctagatatgaagagccagtatattgttcaatatcttgtctagttcaggtttagttttgggggtcttgtagacagaaatcaggttttgacagtctgttgagaagggatatgggcaggtcagaagagggtgtgtgcactaggctaggaaaagaatcaccgtgagatagatgtttacaggttgagtatcaccagaagtgttttagattttggattttttttttcagattttgggatattggcatatagatactaagatatcttgggaatgggacccaagtctaaacacaaaattcatttatgtttcttcttctgagacagagtcttgctctgttgcccagactggagtgcagtggcacgatctcggctcactgcaacctccgcctcccaggttcaagtgagtctcctgcctcagcctctggagtagctgggattacaggtgcccaccaccaggcccagctaatttttgtatttttagtagagatggggttttaccatgttggaccaggctggtctcgaactcctgacctcaggtgatccacccgcctcagcctcccaaagttctaggattacaggcatgagccaccgtgcctggcctgttttatatatacctgatacatgtagtctgaggtaatttcatacaatattttaaataattttgtgcatgaaacaaagcttgtatacattgaatcatcagaaagcaaagggccgggtgcagtggctcacgcctgtaatcccagcactttgggaggccaaggcgggtggatcacaaggtcaggagattgagaccatcctggctaacacagtgaaaccccgactctactaaacatacaaaaaaaaaaaaaaaatcagctgggcgtggtggcaggtgcctgtggtcccagctactcgggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcaaaaaaaaaaaaaaaaaaaaaaaaaagcaaaggtatcaggtatggaattttccccttgtggcatcatatcaatggtcaaaaagtttcaggttttgtagcattttttattatttttatttatttatttattttgagacggagtctcactctgtcacccaggctggagtgcagtggcgtgatctcggctcattgcaggctctgcctcccaggttcacgcagttctcctgcctcagcctcctctcctcccgagtagctgggattacaggcgcccaccacaatgcctggctaattttttgtatttttggtagtgacggggtttcaccatgttatccatgatggtcttgatctcctgacctcatgatccacccgccttggcctcccaaagtgctgggattacagacgtgagccactgtgcctggcatatttttatttttttttcttttctttttgtgggttttttttttttttgaaatggagtttcgctcttgttgcccaggctgaagtgcaatggcatgatctcggcttactgcaacctccgcctcccgggttcaagcaattcccctgcctcagcctcctgagtatctgggattacaggcatgcaccaccacgcccggctaattaggtatttttagtagagacggggtttctccatgttggtcaggctagtctcaaactcccaacctcaggtgatctgcccaccttggcctcccaaagtgctgggattacaggcgtgagccactgctcctggtctatttatttatttttcttttcccatgtactcttcctggaaaggttttgtagcaatttggatttttggattaaggatgctcaacctatggtacattttcattgatagtgaaacagttctaagtgcattgttacttgcccaagcttattgtagttgttcaaatctatggaagatagagtccagctacaatacaagtttccagtgggatacagacagaacatgacttgagagattgataggattgggaacaatctctggaagcctttcttggtgccagatccatagccagttttctcttcttgggcaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggtcagtatagcgcaatgctgagtgaacttgtataggaccaaattgaacagaattgaagcagcagtaataatggaggcaaaacagtataaatggtgggaaagcaaaaaaatggcacagaatcacatgacattgatgggcagagactgacccagtactgcaagcaggacagaatgtgaccacctagtccttggagtagaagaatgttgccttagatggtttagggggttttcttggcatagagctcaagcctcctctccagtttcaagaaggtttttccctgaagcccttggaaatacacaggaatgcttcttttgatttttctaggatcccattgatggatggaaactctagtttttacttagagtaaggctgcttctatcaccccaaaacaaagcatttcttttcttctgcctcctttctcccccgccaagttcagggatgcctaggaaaacagcaagaagtactgtaaccctcactcacccctactccaggcttctcttctctttgggtgtgtgtcctgtccctgtactctgcaatgacaatgaggctcttgtgacagtcttcttgatttttggctttcaagcaaatccaaaatacactatcattcctcaccaagtgttctttaatagataaaatgacgtgaatggtcccatgatcaagtccctgccccgaacttacttaactcagatctcagttactaatgagttttgctctgtccatctgcaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatcagatgcttgaaatttaacacttttcacttggttcttatactgaatgccgactctgctctgtgttagagatatgaaatggtgtttgatactgtttgagacattatggagagatttaattatttgtaataaaagatttgctgcagtctgaaaactgcccaggggtgcactgttgggtttttctttaaaatagagtactttgtattctgggagaatcaagttctaatgaatgcaggtatgtggaaattctgttgaaacttctttagagttagttttagttttaaaaaaagactctagtaaaaatagatagctgttgaggaagccttgtttgtgtagatctgaataatggaacagagatgttaaactaattttaaggggaaataaaggctacctccttgatgcttagtcaaggtcacccagatagtctgtatttgagcccctgattaatactgattgcaatgcctgatgttcctcttaatgaaattaagctaaaagtataaataccttgttaaacaaaaatgaaacaactaatctgtctccacctagctttttaacattttcaggctgatatgacaaaaagggcatgctcgtccaccttaactctctctgataaaggaaaaataagcatgaaattggcatacaaaatacagttcaaaagagacttggaatttttgtacccttagtatgaaagtaaacagagggaggcatgagtgcagtgacggatggctgtttatatttggtggattcagcctccctcatgtgttagaggaagcaacagtcttcagagctctggctgccaggtggggaggaatagactgctgtctccccggagtgttggctcccactccgtgagtcaggattgcataagagaactcagcaatgcttgccaaggcaataccagtgatgctctgcaaatgccccacaaccttcagaaatagagacagatttcttattactaaaaaatctcaacacattttagtgcacaaacacacacattacttgggatgttctctcaaggcaattgtaaattcatttttctgaaatccagattccagtgtttgccaatggccaaattatattaggatacctttgccctgataatgttagcatggaaactttctggtagacatttccctctgctggagataagttttgtgaaatataagaatgatatttgggccttgacattttcattatttgagaagatataattgttggactttgttttgttttgaaacagggtctcactctgttgcccaggctgccaggctgcaatgcagtggtgtgatttttggctcactgcagcctccacctcctgggcttaagtgatcctcccacttcagcctctggagtagctgggactacaggcgcaagccactatgtccagctacttttgtttattttttgtagaaatgaggtctcactgtgttgcccaggcttgtctccaactcctgggctcaagcaatcctcctgccttggcctcccaaaatgctggagttacaggcgtgagcaaccctgcctggcctttgttgttgttgttgttttgtttgtttgtttgagacagggtttcactctgtcgcccaggctagagtacagtggcgcaatcatggctcactgcagcctccaactcctgggctcaagtgatcctcccatctcagccaagtagtccac

SEQ ID NO: 17334 - DNA, 84875 bp, Human
tcacaggggttgggagggggctcgggcatggcgggctgcaggtcctgagccttgccctgtgcagggcggctggggcccggtgagaattcaagcggggtgcaggcgggccggcagtgctgggggacccggcgcaccctctgcagctgctggcccgggtgctaggcccctgactgcccggggccgggggtgcggggcccgctgagcccgcgcccacccggaactcgcgctggctggcgagcgctgcgcgcagccccagttcccacacccgcctctccctccacacttccccgcaagcagagggagccggctctggcttcggccagcccagagaggggcccccacagcgcagtggcgggctgaagggctcctccagcacggccagaatggacgccaaggccgaggaggcgccgagagcgagcgagggctgctagcacgttgtcacctcgcattctgaaccacagactctccaactctccggcgcttttcgcccactcggtccctcagaacacgaagggctctctcatcctgtcactaaaacgattagctgtccggagacacggaaaaagtcgcccctcttctttgcaggattcctcccttgaacttctccaaaccctcttagtgtgacgtgaccccacccctagctaacccaggctgcttccttaccagcttcccgccccctggggaggcggcaatgcaaagaccgtccgctgccagctctgccgctatctctgtggggtgaatctaacatggcggacaaagacagtaactagtcccgtttctccgcgttttcgccaagaagattggctcttaccacttgtccctcaaaacgaccaccccattgactggtggcgattgcgtcgacggagacggggcaaaagcaagctgaacccgaaaaataacaaacactggggctgaggggtggaactacgagtgcgcagacatgggccagagcgcatttcccctgccccaggcaaattcggcgctcactgcgtccccgcaggccactgaccttacaggactacttgccccagactcctggggctggatgggaattgtagtctccctaaagagttgtacgtatctttttaaggcctagtttctgctttcaaaatacgaaaacataacactccagtccataactgttgacaagtacaagcgcgcacaggtctccaatctatccactggatttccgtgagaattgtgcccgctctggtattggatgttcctctccataagactacagtttctaaggaacactgtggcgaagacctttcattccgcaacgcatgctggaaataattatttccctccacccccccaacaatccttattacttatatttaccgaaactggagacctccattagggcggaaagagtgggggattgggacctcttcttacgactgctttggacaataggtagcgattctgaccttcgtacagcaattactgtgatgcaataagccgcaactggaagagtagaggctagagggcaggcactttatggcaaactcaggtagaattcttcctcttccgtctctttccttttacgtcatccgggggcagactgggtggccaatccagagccccgagagacgcttggctctttctgtccctcccatcctctgattgtaccttgatttcgtattctgagaggctgctgcttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctgggtaaaggtagtagagtcccgggaaagggacagggggcccaagtgatgctctggggtactggcgtgggagagtggatttccgaagctgacagatgggtattctttgagggggggtaggggcggaacctgagaggcgtaaggcgttgtgaaccctggggaggggggcagtttgtaggtcgcgagggaagcgctgaggatcaggaagggggcactgagtgtccgtgggggaatcctcgtgataggaactggaatatgccttgagggggacactatgtctttaaaaacgtcggctggtcatgaggtcaggagttccagaccagcctgaccaacgtggtgaaactccgtctctactaaaaatacaaaaattagccgggcgtggtgccgctccagctactcaggaggctgaggcaggagaatcgctagaacccgggaggcggaggttgcagtgagccgagatcgcgccattgcactccagcctgggcgacagagcgagactgtctcaaaacaaaacaaaacaaaacaaaacaaaaaacaccggctggtatgtatgagaggatgggaccttgtggaagaagaggtgccaggaatatgtctgggaaggggaggagacaggattttgtgggagggagaacttaagaactggatccatttgcgccattgagaaagcgcaagagggaagtagaggagcgtcagtagtaacagatgctgccggcagggatgtgcttgaggaggatccagagatgagagcaggtcactgggaaaggttaggggcggggaggccttgattggtgttggtttggtcgttgttgattttggttttatgcaagaaaaagaaaacaaccagaaacattggagaaagctaaggctaccaccacctacccggtcagtcactcctctgtagctttctctttcttggagaaaggaaaagacccaaggggttggcagcaatatgtgaaaaaattcagaatttatgttgtctaattacaaaaagcaacttctagaatctttaaaaataaaggacgttgtcattagttctttggtttgtattattctaaaaccttccaaatcttaaatttactttattttaaaatgataaaatgaagttgtcattttataaaccttttaaaaagatatatatatatgtttttctaatgtgttaaagttcattggaacagaaagaaatggatttatctgctcttcgcgttgaagaagtacaaaatgtcattaatgctatgcagaaaatcttagagtgtcccatctggtaagtcagcacaagagtgtattaatttgggattcctatgattatctcctatgcaaatgaacagaattgaccttacatactagggaagaaaagacatgtctagtaagattaggctattgtaattgctgattttcttaactgaagaactttaaaaatatagaaaatgattccttgttctccatccactctgcctctcccactcctctccttttcaacacaaatcctgtggtccgggaaagacagggactctgtcttgattggttctgcactggggcaggaatctagtttagattaactggcattttggcttttcttccagctctaaaacaagctccatcacttgaaatggcaaaataaaatcatggatgaggccgagggcggtggcttatgcctgtaatcccagcactttgggaggccaaggtggtaggatcacgaggtcaggagatcgagaccatcctggccaacatggtgaaaccccctctccactaaaaatacaaaaattagctgggcgtagtggcatgtgcctgtaatcccagctactcaggaggctgaggcaggagaatcacttgaaccaggaggcagatgttgctgtgagccaatatggcaccactgaactccagcgacagagctaaactccatctcaaaaaaaaaaaaaaaaaaaaaaaaacatggatgatcggtgtcgttgagaggataggtatttggaagaacctttgtttgaaactggctctgtacatacaatgaaattacatacttatttacatacaatgaaatgcagaggttttttttttatataggatctctgtcgagaggctggagtgcagtggtgctatcacagctcactgcagcctcaacctcgtcaggctcaagcaatcctcccacctcagcctccagagtagcagggacgataggtgtgcaccaccatgcccagctaatttttgtatttttttttctttttttgagatggagtcttgctctgttgcccaggctggagtgcagtggcgcgatctcagctcactgcaaactctgcctcccgggttcatgccattcttctgcctgagcctcctgaatagctgggactacaagcacccactaccacgcccggctaattttttgtattttttttttttttttagtagaggcgggatttcaccgtgttagccaggatagtcttgatctcctgaccttgtgatccacccgcctgggcctcccaaagtgctaggattacaggcataagccactgcgtccagccattcttgtatttttctgttgtagagatagggttttgctatgttggccatgctggtctcaaactcctgacctcaagtgatctaccctcccttggcctctcaaggtgctgggattacaggcctgagccattgcacccagccatggtctaaaaatcttgattgaaataccaccttttcatttccagacacccctatttaaaattaccacacccccagcacacactttatcttctattcctgctgcttctccataacactgattactagctgacattctatgtaatgtatccattttttatctctagtcccacagaatgtaaactccaggatgggatttttgttttgtttacatacatctgtatgttcagtagttagaacggtacttgggacctagttgccactcaataaacatttgtcaaataaataataaactaaactaaattagttctttaatttttttaaatatggtgatggttagtagtgagtaacattcaaaaaataagttgaaaagttgtaccattgcctcttacccacaataaaaaagggtaaattcttttctgctttatgaaagttgtttttcatatttgaagtcaagttaatcagattaaggaaaatgtatgttgtgttttcagagcgatacaagatttataaataaccatcctctcccttgcccttcaacattatagctaaacaaaaataagaggaaaacaggattcacaatttatcaatttattgaaaatcagagccagagaagcaggaaatgacattgtaggaaaaaactgcttttgaaaaagcacaaaacttactcatgacaatcagtgatcaggaaaatcctcaatagtgtggcatttggatacatttatgtttcatttccatgggagagagtcataaaaataggatgttctttctcattctggcaaattaaaccatcaattaaaaactcagatacataaaaattaaagatgtaagaatgaaaatgctaaattgttattttcaatcaactattatgttttctagcttttcattgcttttttctgtttcctgttaagattaatttctttttttttttttttttttttttttgagacagactttggctcttgttgcccaggctggagtgcagtggcacaatctcggctcactacaacctccacctcccgggttcaagcaattctgctgcctcagcctccggagtacctgggattgcaggcatgtgccatcacaccagctaattttgtatttttagtagagacagggtttctccatattggtcaggttggtctcgaactcctgacctcaggtgatcctcctgccttggcctccgaaagtgctgggattacaggcgtgagccaccgctcccagactttttgttttgttttgttttgtttttttgagacacggtctcgctctgctgcctaggctggagtgcagtggcgcgatcttggctcactgccagctccgcctcccgggttcaggccattctcctgcctcagcctcccgagtagctgggactacaggcgcccaccactatgcccggctaattttttgtatttttagtagagacggggtttcaccatgttagccaagatggtctcgatctcctgaccttgtgatccacccgcctcagccttccaaagtgctgggattacagtcctgagccactgcgcccggcctggacctttttttttcggggtggggggttggagtctggctctgtcgcccaggctggagtgcagtggcgccatcttggctcactgcaacctccgcctgccaggttcaagttcaagcgcttctcctgcctcagcctcctgagtagctgggattataggcgcacgccaccgtggccggctaattttgtatttttagtagagatagggtttcatcacgttggtcaggctggtcttgaagtcctgatctcgtgatccacccgcctcggccttccaaagtgctggcgtgagccactgcgcctggcttaagattaatttttgtttgttttgtttttgagacggagtctcgctctttcacccaggccggagtgcagtggcgccatctcggctcactgcaagctccgcctcccgggttcacgccattctcctgcctcggccccccaagtagctgggactacaggcgtccaccaccacgcccggctaattttttgtatttttagtagagacggggtttcaccgtgttagccaggatggtctccacttcctgacctcgtgatccgcccacctcggcctcccaaagtgctgggattacaggcgtgagccaccgcgcccggccttaagattaatttttatggtgttttacattcatttgtatggaaagttctaggatagggatcatatttcacttccttttaatatagtacagtatagcacaatttgcagttatgtcttaatatgtgatcaggaatgatcatgactggaaacagtgttatttgtggtagctatagggtaggtaaggttttcagcctgttttaggtttcttgaactaaaattccttctgctgtcttctaagtcaatattggcagctatttctgacaattggtagttctttgtaactttttacctatgactataacatttttgactttcagaagaatttgctaaaatgtgttccccggtgggttgttgtttttcaacctaaacctagctgctttttccagtcacttatccgtattggaagctcaaaatgcaaatatacagtaggcctaaaatattgcctggtttgaaaagtgtttaaaatatttgaatcatttttatagtaaacatttactctcatcaggacctagaaggggaacattttaattttttttcttttcccttttcacagtcttccttcaacattcattacctttttacatatcggagttttcatctgttcaaagtttgtgtttacagtgtgtttatatagtttagattataattaccatactgaaatataattgtttcagaattgagtcagtggtgagaatgaaagccatctggtatgataactgaatccaatttttcttttacggagaatttctttgaaatgtagcttatctcagaaatagggatttagtaaccaatcagagttttctttgtcaaggttgtttttctttttaaagtcacatttggtcccagtaataataccaatgttggtacaagttatctcaggttgtgaagcatttttcccaagtcatctcaggttgtgaagcattttcccaagtagcatttaattttattcttgcaatagcccaaggagtctggcagggtgaatggcaagagaaggaaacaggttcaggtagagtggttagcccaaggtggctctgcttatatacacaactggtagtagaaacccagcctcctgacttagttcattgtttttcttttcactgccctgtgctatgtcaaaaaccccatgattacaagagttgtattacaacccttcacaataaggttactgtccacaagcttttcttgtgatccttttctttttttttttctttttttgagatggattctctgtcacccaggctggcccgccttggcctcccaaaatgctgggattacagcgtgagccaccgcacctggcccttgtgatccttttctaaaaagttaaatatttaaggaaaaaaccacattcttgtcacactgccaggttagtcgttctttgatatcttgcctggactttatccaaaaaatccgtttcaaaaattcacatttagagctaagtgtagtggctcacgcctgtaatcccggtcgaggcagatggatcacttgaggtcaggacttcaagaccagcctgggcaatatggtgaaaccccttccctaccaaaaatacaaaaaaattagccgggtgtggcagcacgcgcctgtagtcccagctacttggaatgctgaggcacaagaatcacttcaatccgagaggcagaggttgcagtgagccaagaccacaccactgcactccagcctgagcagcagagtgagtgagactccatctccaaaaaaaaaaaaaaaggttcacattcagaagaaagctaaaggccgggtatagtagctcacacctgtaatcccagcactttgggaagccgaagcaggaagattgcttgatgccaggcattcaagaccagcatgggcatcatagtgagatcctgtctctacaaaaattaattaacattaaaaattaaaaagatggctggcatggtggctcactcctgtaatcccagtactttgggaggccaaggcatggtggtgcatgcctttagtcccagctactcgggaggctgaggcaggagaatcacttgaattcaggaggcggaggttacagagagctgagatggtgccactgcactccagcctgggcgacagaacgagactctgtctgaaaaaaaaaaagaaaattaaaaagaccagaataaagctaaagatttaaaatagcctataggttcctaccagaagttaccagctacctctctgatagtctttccctacaatatcctcctggattattacattttaacaccttgacctatctgatgtcctgcatacacaggcatggtcctgctccgggtttgccttctctgctccctctttcttggaatgctcttcccctaattgttgcatagtgtgtttctttacattattaagctatcctctagtctcacctcagtgaaacctttcctgactccccccatgtacatctcacccccacatagatattgaactacctgtttccccttaccctgcttaatttttctctttaatgcacttattcccatgtattctttaattccgtatcaactgtctaccacactagaatatgagctctatgagagcaggctttattttgtaaactgctacatttctatctcctagaatagtacttgaatatagtagtagatacttaataaacacttgttatattagtataataaatgaactaatctcaggaatgccttggttttgtggatagacaggtagggatgggaacttgggtgatgtattttctgaagtttttatttttaagcttattattattttgagatggagtccagctctgtcgcccaggttggagtacagtggcgcgatcttggctcactgcaacgtgcacttccccggttcaagcgattctcctgccttagcctcccaagtagctgggattacaggcgcatgccaccatgcccagttagttttggtatttttagtagagacagcgtttcactgtgttggccaggctggtctcgaaatcctgacctcatgatccgcccgcctcggcctcccaagtgctgggattacaagcatgagcccccgtgtctggccttattttcttttttttgagacagagtcttcctctgtcacctaggctggagtgcagtggcacgatattggctcactctgcaacctccacctccaggattcaagtgatccttctaccttagtctccaaagtagctgagaccacaggcatgcgccaccacgcccggctaatttttgtatttttagcgtagacagggtttcaccatattgtccaggatgatctggaactcctgagctcaggtgatccacccacctcagcctcccaaagtgctaggattacaggcatgaggcaccatgcccggccttaagcttatcattttctaaatttcctttagtgagtacttattacactgtttttacaaagtaatcacaaaccaaacatcatgcctcttctgaagtgatctaataagagtacacagtaccatctgtaaagtgttcttgccagaaagttgaacctgaatgattaagcctgtaagtctagtttataggaaataaggctagaggaacaagttaaacctcaccatagggttatacaatcagcaaaatccagaatgggggaaactccacaggtcaaatgacctaattttaaaaataaatgacaagggagaaaaagtaagagacacctatagatcagaagacacttggggctgggcatggtggctcacacctgtaatcccagcactttgggaggccaaggcaggcggatcacctgaggtcaggagttcaagaccagccggccaacatggtgaaaccccaactctactaaaaatacgaaaaatcagccgggcgtggtggcgcacgcctgtagttccaactacctgggaggctgaggcaggagaatcacttgaacttgggaggcagaggttgcagtgagccgagatcgcaccattgcatgccagtctgggctacaaaagcaaaaccccatctcaaaaaaaagaagacacttgggtttgggtgtgttggctcatgcctgtaaaccccgtgctgggaggattgcttgagcccaggagttcaaggctgcagtgaggtatgtttgcaccactgcactccagcctaggtgacagagtgtgaccttatcttaaaagtaataataattaaaataatctggggtaggggtggatatgggtgaaacagcttggccatgagttgatggttgttggaccagggtgatggtccatatagttcattttattattttatttacttgaaattttgaaatacttgaaattttccatattaagttaaaaaggcatttacagtaaacaaaaaaaaagtgctaggaaggaattcaaaagaaatataagcagaaaattttgtctttatggagcttaaagatgagatgtgcacccacagtgatagtgcagaaaaatatatcactggaaatgaattcgtacgaactattatcaactaatcttttaaatgctgatgatagtatagagtattgaagggatcaatataattctgttttgatatctgaaagctcactgaaggtaaggatcgtattctctgctgtattctcagttcctgacacagcagacatttaataaatattgaacgaacttgaggccttatgttgactcagtcataacagctcaaagttgaacttattcactaagaatagctttatttttaaataaattattgagcctcatttattttctttttctccccccctaccctgctagtctggagttgatcaaggaacctgtctccacaaagtgtgaccacatattttgcaagtaagtttgaatgtgttatgtggctccattattagcttttgtttttgtccttcataacccaggaaacacctaactttatagaagctttactttcttcaattaagtgagaacgaaaaatccaactccatttcattctttctcagagagtatatagttatcaaaagttggttgtaatcatagttcctggtaaagttttgacatatattatctttttttttttttttgagacaaagtctcgctctgtcgcccaggctggagtgcagtggcatgatcttggctcactgcaacctccgccccccgagttcaagcgattcttctacctcagcctcccaggtagctgggactacaggcacccgccaccatgcttggctaatttttgtacttttagtagagataaggtttcaccatattggccaggctggtctcgaactcctgaccttgtgatccacctgcctcggcctcccaaagttctgggattacaggcgtgagccaccacacccgactgacatatattatctattaggatgtaacatcattttgaacagtgttttgtattttttgtgtccatcagtgaaagcaaactgcaagcagttttgaaataagcacattgtgtttgagccttcccagtttctcctttctgttcatttctgcatatccttatgcattcccccttctaagggtcagtgtttgcccgctttgtaatcattgtgaagacaggaaaggacctgataccagtttctatttaggccaaaattcatttatagcagtgattcaagttatatttacgtatttgatgatcttgtcttttgaaatgaaaatgtttgtttcttaataaaagaatttcagaaaaagtagagtaggtaatttagtagaacaagtgggctttctccttttctttatgttaagctatggctcacatcttaccttaaatgtcaactaatttgtttttaagtatttatgtacctggtacataacctggtaccaggtacaaactatgtacttggtaaaaagtttattagcacaaaaaggtatatgatgcaaagtatacttccctcttaccctacaacccctgcctccctgttccctccccagacaaccacaatgatcaatttcttatgtatcctttgaggaatttttaaattccagagttcttaacttggggtttatgaatagtctttatgaatttcctagaattatatttaaattgtattcaaaactatggccatgtacatttttctgggaagatagtccataattttcatctgagtgagctaagatcatgccactgcattccagcctgggcgacaagagggagactcaaaaaaaaaaaaaaaaagtcccagtatttactacagagagctaaagattaacctttaaagccctggggctttcaatttatctggatgagaatctttctggaatgaactgtatgttttcttgtcagcttgagtaacaaatgctgaacatactatactattattacagggactcaagggcccagtgtggtagctcctgcccataaccccagcactttgggaggccaaggcaggaagatcacttaaggccaggagttcgaagctgtagtgagctatgatcacaccactgcactccagcctagatgacagagtgagaccctgtctttttttttttttgagatggtgtttcactctattgcccaggctggagtgcagtggtgtgatctcggctcactgcaacctccacctcctgggttcaagcgattctcctgcctcagcctcttgagtagctgggattacaggcatctgccaccacacccagctaatttttgtatttttagtcgagacagggttttcaccatgttggccaggctgctctcaaactcctgacttcagctaccttggccttaaaaagtgttgggattacaggtgtaagccaccgcgcctggctgaccctgtctcttaacaaaaaaagagagattaagttatgaatatagttgctttgagaacttgtggaagaaggaaattataggcttataggcagagataataatacgagcaaatgtacaaataaaagaaaatagaggacgggcgcggtggctcacgcctataataccagcactttgggaggtcgaggtgggcggatcacgaggtcaggaaattaagaccatcctggccaaaatggcgaaacactgtctctactaaaacacacaaaaaactagcctggcatggtggcacgtacctgtagtcccagctacttggtaggctgcggcaggggtatcacttgaacctgggaggcagaggttgccctgagccgagatcatgccaatgcactccagcctgacaacagagtgagactctgtctgaaaaaaaagaaaagaaaagaaaatacatccaggaaaaataagctaactttgcatatgtgtataggagttgtgttagaaaaggaagaagccctcaaagatgggaagccatttgcaagaaagagaaggtccaagaggaggcagaagggattggaaatagaaaaaggatgtaagaaagagttgattattactcataaacagtaatgaaggaaaaggagagtaattctacaggaagatgctgaggtgctttgagcccagtgaagttggaggtaaagacagctgttgaggccgggcacggtggctcacgcctctaatcctagcacttttggagcccaaggcaggtggatcacctgaggtcaggagctcaagaccagcctgaccaacatagagaaaccccatctctactaaaaatacaaaattagacgggcgtggaggcgcatgcctgtaatcccagttacttgggaggctgaggcaggagaatcacttgaacctgggaggcggaggttgcagtgagccgagattgcgccattgcactccagcctgggcgacaagagtgaaaactgtctcaaaaaaaaaaaacaacaaaaaacagctgttgagattgagaggattagagttggcaactggagaagagtgagaagcttgaaacccctactgatgaagattgtgatagtcaggaaagaaccagtcataaagatatatgtgtgtgtatacatataaatatgttatatatatgtgtgtgtgtgacacatatatatttttgtttgtttctttgagacagtgtctccctctgacacccaggctggagttcagtggtgtgatcatagttcacttttaccttgcaatctgggttcaagcaatctctcatctcagcccctcaagtagctaggactacaggtacatggcatttgcccagctaatttttaagtttcttgtagagatgggccagccatattttaaattgtgttttgaatgttatattagaattaaaagtccaaagccgggtgtggtggctcacgcctgtaatcccagcactctgggaggctgaggtgggcggatcacgaggtcaggagttcgagaccagcctggccaatatggtaacaccatctctactaaaaatacaaaaattagctgggtatgggggcacatgcctgtagtcccagctactcaggaggctgaggcagaggaacctcttgaacccaggaggcagaggctgcagtgagttgagatcgtgccactgtactctagcctgggtgacagagcaagattccgtctcaaaaaaaaaaaaagtccagtataatgcccatgtgatagatcgactttttcatgaaatctcttctgtaatatcaatataatctgaataacactttgatctatatgatgagaaagctgggagcctgggagcgatacccccatgcttttgttgtattaattgtattttctacggataaactctaattgctaaaaataaaacaactttattgacccaagcaagcctaaagttctgaaatcttttttttatttttgtttgtttgtttgtttgtttttgtttgttttgttttgagacggagtctcgctctgtcgcccaggctggagtgcggtggtgcagtctcggctcactgcaagctccacctcccgggttcacaccattctcctgcctcagcctcccaagtagctgggactacagacgcctgccaccacgcccagctaatttttttgtatttttagtagagaaagggtttcaccgtgttagccaggatggtctcgatctcctgacctcgtgatctgcccgccttggcctccctaagttctgggattacaagtgtgagccaccacgcccggctgtttttttttgttttgttttgagacggagtctcactgtgttgcccagactggagtgcagtggcatgatctcagctcactgccacctccatctcctgggttcaagcaaatctcctgcctcagcctcccgagtagctgggactacaggcatgtgccaccacacctggctaatttttgtatttttagtagagacggggtttcactatgttggccaggctggtccaaaactcctgacctcaggtgatctgctcgccttggcctcccacagtgccaggattacaggcatgagccaccttgcccagccagttctgaaatcttttatgaagcctataaaaaaagataataataccaatctagaaaatatttcttaaggcagtcatgcattagtttgaactttccaaacaaaaaaatgcaatgtgtaatacttttttttttttttttgagatggagtcttgttctgttgcccaggctggagtgcagtggtacaatctcggctcactgcagcctctgcctccctggttcaagtgattctcctgcctcagcctcccaagtagctgggattacaggcgtgcaccaccatgcatggctaatttttgtatttttagtagagacagggtttcaccatgttgacaaggctgatctcgaactcctgacctcaggtgatccgcccacctcagcctcccaaagtgctgagattacaggcattagccaccacgcccagccttttattttagtagagaccatgtttcaccatgttgaccaagctggtcttgagctgacctcaagtgatccgcccacctccacctcccaaaatggtgggattataggcatgagccaccgcacccagcctgtaatacttttttgaagatctagaaccacattgttcaaagagatagaatgtgagcaataaatgtaacttaaatttttcaacagctactttttttttttttttttgagacagggtcttactctgttgtcccagctggagtacagtggtgcgatcatgaggcttactgttgccttgacctcctaggctcaagcgatcctatcacctcagtctcccaagtagctgggactgtaagtgcacaccaccatatccagctaaattttgtgttttctgtagagacggggtttcgccatgtttcccaggctggtcttgaactttgggcttaacccgtctgcccacctaggcatcccaaagtgctaggattacaggtgtgagtcatcatgcctggccagtattttagttagctctgtcttttcaagtcatatacaagttcattttcttttaagtttagttaacaacctttatacatgtattctttttctagcataaagaaagattcgaggccgggtgcggtggctcacgcctgtaatcccagcactttgggaggctgagatgggcacatcacgaggtcaggagatcgagaccatcctggctaacatggtgaaaccccgcctctactaaaattacaaaaagttagccaggcgtggtagcgggcacctgtagtcccagctactcaggaggctgaggcaggagaatggcgtgaacccaggaggcagagcttgcagtgagcagagattgtgccactgcactccagcctgagagacagagcgagactccgtctaaaaaaaaaaaaaaagattcgaatccttatcttggttgatttttgcgtatctagttccactgaattatttatataattgtatagactacagcacgagacagcttagcttgtcactctactgtactatattctgcagtactatcataagggaatttcctccctacccctgctctgaattgttcaattgtactatttgctggagtaatgcttgatgccttcttgatccattatactagagtatatgtagtatttgtagattctgaaggagtgggagcctctattctgagttttaaaggtacttatgtacagtggaggtagctttttgacagcctcatcttccaaactatagagtcattgttttgttgagtgcaatatggtacttgaagcatctatatcggcgaagaaggacccaagtctccttgaccttacctacctacattcactttctctggtaggaagattgtgggtgcctctctccagacttagtttccatgtcaaaaaagaaaaaaggaagattgtgggctttgctacaatccaattctggatccaatataaccttcattgcttaattactgtgtgatctgggacaagcctctactctataaaaatgaagataaggccaggcttgatggctcatgcctgtaatcccagcacgttgggatgccaaggcaggaggatcacttgaggtcaggagttcgagaccagactgggcaatatagtgaaaccacatctgtacaaaaataaagatagaaagtagcccagcgcaatggctcacacctgtaatcccagcactttgggaggctgaagcaggcgatcacttgaggtcgggagttcaagactgtagacagatagataggtaggtagatagatagagatatagatatagttggggtttttttgttttgttttgttttgtttttgagatggagtttcgctcttgttgcccaggctggagtgcaatggcgcgatctcagtttactgcaacctccgcctcccgggttcaagagattctcctgcctcagcctcctgagtagccaggattacaggcatatgccaccatgcccggctaatttttgtatttttagtagagacagggtttctccgtgttggtcaggctggtcttgaactcctgacctctcccaaagtgttgggattacaggcgtgagccaccgctcctggccttttttttttttttttttttttttttgagacagagtcttcctctgttgcccagggtggagtgcagtggcactcttctcagctcattgcaacctctgccatcctgggttccagtgattctcatgcctcagcctcccaagtagctgggactcaggcgtgtgcccaccacgcctggctaattttgttgtatttttagtagagacagggtttcaccatgttagccaggctggtctcaaactccaggcctcaagtgatctgcctgcctcagcctcctgggattgcagacatgagccactgcacccggccaagagagggtaataaatgttaaattacctggctagtaaaaaatattctctaagtgtcttttctcacaattcccaatgccttttttttttttttggcacaatctcactctgttgcccaggctggaatgcaatggtgcaatattggctcactgtaacccccgcctcacaggttcaacttattctcatgcctcagcctcccgagtaactgggactacagtgcaccaccaccacacccagctaatttttgaatatttagtagagacagggtttcaccatgttggccaggctggtcttgaactcctggcctcaagtgattcacccaccccgcaagtgctgggattacaggtgtggaccaccgtgcacagccctagtgactttttttttagccccttaatcttttctttcctgggtctcttcattgtcagtgtctgctatttactccctacctagtcacccccttcaccagtatattatgtcctttatgttttattttgcaggatcttattttgcttttctattgaatcccctccatctagaatagtactagacatagtaaatattggttgtatgagtgaatcgctgcttttaattatcatcaccattgctctctctacttctggtctatgatccactttgagttaacttttgttatttggtgtgagataggagtataatttcattcttttacatgtggttatacttttgtctcaacactgtttgttaaaaacacaaaaagtattattttcccatttaatcatctttggcctgggcacggtggctcatgcctgtaatcccagcactctggaaggccaaggcagatggatcaatttgaggccaggagttcaagactagccaacatggtgaaactaaaaatacaaaaaattagctgggtatggtggtgcatgtctgtaatcccagctactcgggaggctgaggcacgagaattgcttgagcctaggaggtggaggttgtagtgagctgagattgtgtcactaccctccagcctgggtgatagagtgagtctgtctcaaaaaaaaaaaaaaaaaattaagaaaataaaaatcgtcggccaggcatggtggctcacacctgtaatcccagcactttgggaggcagaggcgggcagatcacgaggtcaggagatggagaccatcctggctaacatggtgaaaccccgtctctactaaaaataaaaaaattagccgggcatggtgctgggcgcctgtagtcccagctgctcgggaggctgaggcaggagaatggcgtgaacccaggaggtggagcttgcagtgagccgagatcgtgccactgcactccagcctgggagacagagcgagactccgtctcaaaaaaaaaaaaaaaaaaaaattgtcttggtatttattattgttgaaaatcgcttgatcacagatgtatgtatgagtttatttctgtactgtcaattccattttattgatgtatgtgtctattcttatgctattaccacactttcttgattactatagctttgtggtgaggtgttgagattttaaactaattataagcatcttacatgaactacttaccgtttatatttgattatgcagcatgaaataattatgaatatatcattaaatatgccatattaacttttattaagttttatgtgatcataacagtaagccatatgcatgtaagttcagttttcatagatcattgcttatgtagtttaggtttttgcttatgcagcatccaaaaacaattaggaaactattgcttgtaattcacctgccattactttttaaatggctcttaagggcagttgtgagattatcttttcatggctatttgccttttgagtattctttctacaaaaggaagtaaattaaattgttctttctttctttataatttatagattttgcatgctgaaacttctcaaccagaagaaagggccttcacagtgtcctttatgtaagaatgatataaccaaaaggtatataatttggtaatgatgctaggttggaagcaaccacagtaggaaaaagtagaaattatttaataacatagcgttcctataaaaccattcatcagaaaaatttataaaagagtttttagcacacagtaaattatttccaaagttattttcctgaaagttttatgggacatctgccttatacaggtattagaaacttactgcctttctctaatgcttctagtgtaaaaacttgcagacttatgtaaagtagggctgtatcgccgtgcccccattgtctgttaatcttgtttttatatttttgattgtgtttccttttctttttttttttttttttaagacagggtcctgctctgtcactgaggctggagtgcagtggcgtgatctcggctcactgtagcctctgtctcccagcctcttcctgccttagcctcccaaatagctgggactacaggcacacgctaccatgcccggccaatttttgtattttttgtagagatgaggttttaccatgttgcccaggctggtaactcctgagctcaggtgatctgcccacctcggcctcccaaagtgctggggttcacaggtgtgtgtttatttctatctaattatttacacaaacacaatgtatttatatattgtgtatctcttctgctacaatgtaaattctatgagagtagtaattttgtctgtctcaacactgtttttcctaagtttggtacatagtaggcactcagatgcttaaaggaatgaatgaattgtgctttaattccactttactaaacccaaatctccctttggacattgttatctatgtgttttcaaagaagtataatcataatttgacagaaatccttgagaggcagaactaagtgagggattgggcagggttcagatgttaagaacagtaagctcagcagggtgtgattgctcatgcctataaccctagcactctaggaggctgaggtgggatgattgcttgaggccaggagtttgaaatcagcctgggcaacatagtgagaccccatcactaccaacaaaataaataaataaatgtacatggtggcatatgcccatagtcctagctacttgggaggctatagtgggaggatagcttgagtacagaagtctgaggctgcagtgagctatgattgtggcactgcatgctagcctgggcaatagagcaagaccctgtctctaaattaaacaaaaaaaaaagtactctagttttctatgcaatgcattatatctgctgtggatttagggcagtattatatcagataattttaggcatttggtaggcttaaatgaatgacaaaaagttactaaatcactgccgtcacacggtttatacagatgtcaatgatgtattgattatagaggttttctactgttgctgcatcttatttttatttgtttacatgtcttttcttattttagtgtccttaaaaggttgataatcacttgctgagtgtgtttctcaaacaatttaatttcaggagcctacaagaaagtacgagatttagtcaacttgttgaagagctattgaaaatcatttgtgcttttcagcttgacacaggtttggagtgtaagtgttgaatatcccaagaatgacactcaagtgctgtccatgaaaactcaggaagtttgcacaattactttctatgacgtggtgataagaccttttagtctaggttaattttagttctgtatctgtaatctatttttaaaaaattactcccactggtctcacaccttattttatcaatcgtaaggtgcacatttttcacatcttaacatctctgaaattgggaacattttactattgagggtgtgtcatttgtttaatttgtgtgctttctttcttagtgatacagaaaataatagtgcaacttacattgttggtgtcttagctttagtgaaatacagtattgataggcaaatttcttagtgttaaggtagaaaacaaggactctaaataactttgatggtctgtgtatttgtttttgtttcctaggagtaaaatttccagttgattttttaaaatttgatttttaaaaaaaatcacaggtaaccttaatgcattgtcttaacacaacaaagagcatacatagggtttctcttggtttctttgattataattcatacatttttctctaactgcaaacataatgttttcccttgtattttacagatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttggtaaaaccatttgttttcttcttcttcttcttcttttttctttttttttttgagatggagtcttgctctgtggcccaggctagaagcagtcctcctgccttagcccccttagtagctgggattacaggcacgcgccaccatgccaggctaatttttgtatttttagtagagacggggtttcatcatgttggccaggctggtctcgaactcctaacctcaggtgatccacccacctcggctccccaaattgctgggattacaggtgtgagccactgtgcccggccggtaaaaccattttcatttattctggcaacatctctttattgagcattgtgaatatgttagtgaatgtgctagatgctcatagatttatataaaaagttagtgaagaaggaaagatggtatattaagtggttagacaagtgttctaatcagttagagttcagagaaggtcagggtacctgatataatcaagagagagaccttacagccaggtgaggtgaatgtacctataatcccagctacttaggaggctgaaatgggaggatcacttgagtccaggtttgagaccagcccaggcaacatagcaagatccccatcagatacaccaaaaagacagatttcttttttttttttttttttgagacagagtctcgctctgtcgcccaggctggagcgcagtgacacgatgtcagctcactgcaacctccgcctcccaggttcaagtgattctcctgcctcagcctcctgagtagttgggactacaggggtacgacaccagacctggctaatttttgtaattttagtagagtcggggtttcaccatattggtcaggctggtctcgaactcctgacctcaggtgatccaccctccttggcctcccagagtgctgggattacaggcgtgagccaccaagcccggccaaaaaagagagctcttataggcccttccttgctttggagctttatctgctctgtgatgcttatctaaaatagccataaggtcactgatatttttaagcatttggaaattacttcagctgggtgccatggctcatgcctataatcccaaccctttgggaggctgaggtaggaggtcctttgagcccagcttgggcaacacagtgagacactgtctctgcaattaaaaaaaaaaaaaaagtagctgggtgccgtggctcacgcctgtaattccagcactaggaggcttgaggattgcctgagctcaggagttcaagaccagtttgggcaacatagcaagtccttgtctatattaaaagtttttttaaattatctgggcatggtggtgtgtgcctgtagtcccagctacttgggaagctgagacagaaggatcacttgagtccaggagatgtagactacagtgagctatgatcactccactgcacttcagcgtgggcggcaaagcaagatctagttgcaaaaaaaaaaagaactggctgggtgcggcggctaacacctgcaatcccagcaccttgggaggctgaggccagtggatcatgaggtcaggagattgagaccaccctggccaacatggtgaaacccggtctctactaaaaatacaaaaattagctgggtgtggtggcacgtgcctgtaatcccagctactccagaggctgaggatggagaatcacttgaacctgagaggtcggaggttgcagtgagccgagattgcgccactgcactccagcctgggcgacagagcaagactccgtctcaaaaaaaaaaaaaaaaaaagcttcacgcctgtaatcccagcactttgggaggccgagtcaagtggatcacgaggtgtggagatcaagactatcctggctcacatggtgaaagcccgtctctactaaaaacacagaaaaattagctgagcgtgatggcggactcctgtagtcccagctactcgggaggctgaggcaggagaatagcatgaacccgggaggtggagcttgcagtgagccgagatcccgccactgcgatccagcctgggcgacagagtgagactctgtctcaaaaaaaaaacaaaaaaacttagctgggcgtggtggtatgcacctgtggtcctagctacttgggaggctgaggctggagcattgctttaacatagagagtcaaggctgcagttgagctatgactgtgccactggactccagcgcaggtgactgagaccctatcttttaaaaaaagggaaaattacttgaacttaaaaggtgtaattgttaaagaaaatgtagtgatttgctctgttgttacttatatgtgcatgaatgatggagatcttaaaaagtaatcattctggggctgggcgtagtagcttgcacctgtaatcccagcacttcgggaggctgaggcaggcagataatttgaggtcaggagtttgagaccagcctggccaacatggtgaaacccatctctactaaaaatacaaaaattagctgggtgtggtggcacgtacctgtaatcccagctactcgggaggcggaggcacaagaattgcttgaacctaggacgcggaggttgcagcgagccaagatcgcgccactgcactccagcctgggccgtagagtgagactctgtctcaaaaaagaaaaaaaagtaattgttctagctgggcgcagtggctcttgcctgtaatcccagcactttgggaggccaaggcgggtggatctcgagtcctagagttcaagaccagcctaggcaatgtggtgaaaccccatcgctacaaaaaatacaaaaattagccaggcatggtggcgtgcgcatgtagtcccagctccttgggaggctgaggtgggaggatcacttgaacccaggagacagaggttgcagtgaaccgagatcacgccaccacgctccagcctgggcaacagaacaagactctgtctaaaaaaatacaaataaaataaaagtagttctcacagtaccagcattcatttttcaaaagatatagagctaaaaaggaaggaaaaaaaaagtaatgttgggcttttaaatactcgttcctatactaaatgttcttaggagtgctggggttttattgtcatcatttatcctttttaaaaatgttattggccaggcacggtggctcatggctgtaatcccagcactttgggaggccgaggcaggcagatcacctgaggtcaggagtgtgagaccagcctggccaacatggcgaaacctgtctctactaaaaatacaaaaattaactaggcgtggtggtgtacgcctgtagtcccagctactcgggaggctgaggcaggagaatcaactgaaccagggaggtggaggttgcagtgtgccgagatcacgccactgcactctagcctggcaacagagcaagattctgtctcaaaaaaaaaaaacatatatacacatatatcccaaagtgctgggattacatatatatatatatatatatatatatatatatatatgttatatatatgttatatatatatataatatatatatatgttatatatatgttatatcatatctatatatatatatatgtaatatatatgttatatatatattacatatatatatgttatatatatgttatatatatatgttatatatatgttatatatatatgttatatatatatatatacacacacacacatatatatgtatatatatatacacacacacacacaaattagccaggcatagttgcacacgcttgtagacccagctactcaggaggctgaggcaggagaatctcttgaacttaggaggcggaggttgcagtgagctgagattgcgccactgcactccagcctgggtgacagagcaggactctgtacaccccccaaaacaaaaaaaaaagttatcagatgtgattggaatgtatatcaagtatcagcttcaaaatatgctatattaatacttcaaaaattacacaaataatacataatcaggtttgaaaaatttaagacaacagaaaaaaaaattcaaatcacacatatcccacacattttattattactactactattattttgtagagactgggtctcactctgttgcttatgctggtcttgaactcctggcctcaagcagtcctgctccagcctcccaaagtgctgggattataggcatgagctaccgctcccagccccagacattttagtgtgtaaattcctgggcattttttccaggcatcatacatgttagctgactgatgatggtcaatttattttgtccatggtgtcaagtttctcttcaggaggaaaagcacagaactggccaacaattgcttgactgttctttaccatactgtttagcaggaaaccagtctcagtgtccaactctctaaccttggaactgtgagaactctgaggacaaagcagcggatacaacctcaaaagacgtctgtctacattgaattgggtaagggtctcaggttttttaagtatttaataataattgctggattccttatcttatagttttgccaaaaatcttggtcataatttgtatttgtggtaggcagctttgggaagtgaattttatgagccctatggtgagttataaaaaatgtaaaagacgcagttcccaccttgaagaatcttactttaaaaagggagcaaaagaggccaggcatggtggctcacacctgtaatcccagcactttgggaggccaaagtgggtggatcacctgaggtcgggagttcgagaccagcctagccaacatggagaaactctgtctgtaccaaaaaataaaaaattagccaggtgtggtggcacataactgtaatcccagctactcgggaggctgaggcaggagaatcacttgaacccgggaggtggaggttgcggtgaaccgagatcgcaccattgcactccagcctgggcaaaaatagcgaaactccatctaaaaaaaaaaaagagagcaaaagaaagaatatctggttttaaatatgtgtaaatatgttttggaaagatggagagtagcaataagaaaaaacatgatggattgctacagtatttagttccaagataaattgtactagatgaggaagccttttaagaagagctgaattgccaggcgcagtggctcacgcctgtaatcccagcactttgggaggccgaggtgggcggatcacctgaggtcgggagttcaagaccagcctgaccaacatggagaaaccccatctctactaaaaaaaaaaaaaaaaaaattagccggggtggtggcttatgcctgtaatcccagctactcaggaggctgaggcaggagaatcgcttgaacccaggaggcagaggttgcagtgagccaagatcgcaccattgcactccagcctaggcaacaagagtgaaactccatctcaaaaaaaaaaaaaaagagctgaatcttggctgggcaggatggctcgtgcctgtaatcctaacgctttggaagaccgaggcagaaggattggttgagtccacgagtttaagaccagcctggccaacataggggaaccctgtctctatttttaaaataataatacatttttggccggtgcggtggctcatgcctgtaatcccaatactttgggaggctgaggcaggtagatcacctgaggtcagagttcgagaccagcctggataacctggtgaaacccctctttactaaaaatacaaaaaaaaaaaaaaattagctgggtgtggtagcacatgcttgtaatcccagctacttgggaggctgaggcaggagaatcgcttgaaccagggaggcggaggttacaatgagccaacactacaccactgcactccagcctgggcaatagagtgagactgcatctcaaaaaaataataatttttaaaaataataaatttttttaagcttataaaaagaaaagttgaggccagcatagtagctcacatctgtaatctcagcagtggcagaggattgcttgaagccaggagtttgagaccagcctgggcaacatagcaagacctcatctctacaaaaaaatttcttttttaaattagctgggtgtggtggtgtgcatctgtagtcccagctactcaggaggcagaggtgagtggatacattgaacccaggagtttgaggctgtagtgagctatgatcatgccactgcactccaacctgggtgacagagcaagacctccaaaaaaaaaaaaaaaagagctgctgagctcagaattcaaactgggctctcaaattggattttcttttagaatatatttataattaaaaaggatagccatcttttgagctcccaggcaccaccatctatttatcataacacttactgttttccccccttatgatcataaattcctagacaacaggcattgtaaaaatagttatagtagttgatatttaggagcacttaactatattccaggcactattgtgcttttcttgtataactcattagatgcttgtcagacctctgagattgttcctattatacttattttacagatgagaaaattaaggcacagagaagttatgaaatttttccaaggtattaaacctagtaagtggctgagccatgattcaaacctaggaagttagatgtcagagcctgtgctttttttttgtttttgtttttgttttcagtagaaacgggggtctcactttgttggccaggctggtcttgaactcctaacctcaaataatccacccatctcggcctcctcaagtgctgggattacaggtgagagccactgtgcctggcgaagcccatgcctttaaccacttctctgtattacatactagcttaactagcattgtacctgccacagtagatgctcagtaaatatttctagttgaatatctgtttttcaacaagtacatttttttaacccttttaattaagaaaacttttattgatttattttttggggggaaattttttaggatctgattcttctgaagataccgttaataaggcaacttattgcaggtgagtcaaagagaacctttgtctatgaagctggtattttcctatttagttaatattaaggattgatgtttctctctttttaaaaatattttaacttttattttaggttcagggatgtatgtgcagtttgttatataggtaaacacacgacttgggatttggtgtatagatttttttcatcatccgggtactaagcataccccacagttttttgtttgctttctttctgaatttctccctcttcccaccttcctccctcaagtaggctggtgtttctccagactagaatcatggtattggaagaaaccttagagatcatctagtttagttctctcattttatagtggaggaaataccctttttgtttgttggatttagttattagcactgtccaaaggaatttaggataacagtagaactctgcacatgcttgcttctagcagattgttctctaagttcctcatatacagtaatattgacacagcagtaattgtgactgatgaaaatgttcaaggacttcattttcaactctttctttcctctgttccttatttccacatatctctcaagctttgtctgtatgttatataataaactacaagcaaccccaactatgttacctaccttccttaggaattattgcttgacccaggttttttttttttttttttggagacggggtcttgccctgttgccaggatggagtgtagtggcgccatctcggctcactgcaatctccaactccctggttcaagcgattctcctgtctcaatctcacgagtagctgggactacaggtatacaccaccacgcccggttaattgaccattccatttctttctttctctcttttttttttttttttttgagacagagtcttgctctgttgcccaggctggagtacagaggtgtgatctcacctctccgcaacgtctgcctcccaggttgaagccatactcctgcctcagcctctctagtagctgggactacaggcgcgcgccaccacacccggctaatttttgtatttttagtagagatggggtttcaccatgttggccaggctggtcttgaactcatgacctcaagtggtccacccgcctcagcctcccaaagtgctggaattacaggcttgagccaccgtgcccagcaaccatttcatttcaactagaagtttctaaaggagagagcagctttcactaactaaataagattggtcagctttctgtaatcgaaagagctaaaatgtttgatcttggtcatttgacagttctgcatacatgtaactagtgtttcttattaggactctgtcttttccctatagtgtgggagatcaagaattgttacaaatcacccctcaaggaaccagggatgaaatcagtttggattctgcaaaaaagggtaatggcaaagtttgccaacttaacaggcactgaaaagagagtgggtagatacagtactgtaattagattattctgaagaccatttgggacctttacaacccacaaaatctcttggcagagttagagtatcattctctgtcaaatgtcgtggtatggtctgatagatttaaatggtactagactaatgtacctataataagaccttctgtaactgattgttgccctttcgtttttttttttgtttgtttgtttgtttttttttgagatggggtctcactctgttgcccaggctggagtgcagtgatgcaatcttggctcactgcaacctccacctccaaggctcaagctatcctcccacttcagcctcctgagtagctgggactacaggcgcatgccaccacacccggttaattttttgtggttttatagagatggggtttcaccatgttaccgaggctggtctcaaactcctggactcaagcagtctgcccacttcagcctcccaaagtgctgcagttacaggcttgagccactgtgcctggcctgccctttacttttaattggtgtatttgtgtttcatcttttacctactggtttttaaatatagggagtggtaagtctgtagatagaacagagtattaagtagacttaatggccagtaatctttagagtacatcagaaccagttttctgatggccaatctgcttttaattcactcttagacgttagagaaataggtgtggtttctgcatagggaaaattctgaaattaaaaatttaatggatcctaagtggaaataatctaggtaaataggaattaaatgaaagagtatgagctacatcttcagtatacttggtagtttatgaggttagtttctctaatatagccagttggttgatttccacctccaaggtgtatgaagtatgtatttttttaatgacaattcagtttttgagtaccttgttatttttgtatattttcagctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctctgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtggtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtattggaaccaggtttttgtgtttgccccagtctatttatagaagtgagctaaatgtttatgcttttggggagcacattttacaaatttccaagtatagttaaaggaactgcttcttaaacttgaaacatgttcctcctaaggtgcttttcatagaaaaaagtccttcacacagctaggacgtcatctttgactgaatgagctttaacatcctaattactggtggacttacttctggtttcattttataaaagcaaatcccggtgtcccaaagcaaggaatttaatcattttgtgtgacatgaaagtaaatccagtcctgccaatgagaagaaaaagacacagcaagttgcagcgtttatagtctgcttttacatctgaacctctgtttttgttatttaaggtgaagcagcatctgggtgtgagagtgaaacaagcgtctctgaagactgctcagggctatcctctcagagtgacattttaaccactcaggtaaaaagcgtgtgtgtgtgtgcacatgcgtgtgtgtggtgtcctttgcattcagtagtatgtatcccacattcttaggtttgctgacatcatctctttgaattaatggcacaattgtttgtggttcattgtctccttaaattagactgtaagcaccttgatggaactcatactaccttttatttcacacacacgcacacgcgcacacacagcctacacatacactgcctagctcattgtagcatactaaatactgattttaatgaataagctaaaccttcgaaacccatttgctaatcccagcactttgggaggccaaggtgggtggatcacctcaggtcagaagtttgagaccagcctggccaacatggtgaaaccccacatctactaaaaatacaaaaattagctgggcgtggtggccaatgccttgtaatcccagctattctggaggctgagacaggagaatcgcctgaacctgggaggcggaggttgcactgagctgggattgtaccactgcactccagcctgggtgacaaagtgagactccatctcaaaaacaaacaaacaaaaacacatcatttcccctatagcaaaaacatgacggcacttactgtatcaagagaggtgagaaaaaggagccacagcaggatgattcaagggactctgcatagctccattttaagaatatgcctactgcaggtcagagaaggtaagcaaactgcctaaggccacacagccaggtacagaactctcaccaatattattgccagcaatcgcaattttggtgtttattcttggtaccaagttggagactatagggttctcttcctaatagagaccatctagcctttcactgttttgtggatacttctttctcttcttctttttttttttcccttttaaaatctagttatttttttctttttggtttctttgacacagggtctcttactctgttacccaggctggaatggagtagtgcagtcatggttcactgtagctttgacttcctgggctcaagcgatcctcctacctcagcttcccgagtagctgggaccacaggcgcccaccaacacctccagctaatttttaagtttttactagagacaacatctcactatgttgcccaggctggtctcaaaatcctgggctcaagtgatcccacctcagcctcccaaaatgctgggattacaggtgtgtgcaaccacgcctggcctattttttttttaattgctcataaatcatcttttttctttaaaaaaaagaaagatgggaggctaaagcaggagaatcacttgaacccaggaggcggaggttgcagtgagctgagatcatgctgctgctctccagcctgggcaacaagagtgaaactccatctcaaaaaaaaaaaaagaagaaagtacacaattttactttctggacctaatggtcaaggccaataatttggtcacctatgaagtaaataaaagctttaccatatatatgaccatttgataatgtaatatgaaatgtttatgtactaaaggcagaatagtctagaaaaaacattctgtatcacaacgtctaaaaattaatatcatcttcatcatagaaccaggctctttctcctaatttttttttttgagatggagttttgctctgtcacccaggctggaatgcagtggcacaattttggctcactgcaaccttcagctcccaggttcaggatcaagtgattttcgtgcttcagccttctaagtagctgggattacaggtgactgccaccacacccagctcatttttttgtatttttttagtagagagagggtttcaccatgttggccaggctcgtctcgaactcctgacctcaaataatccacccgtctcagcctcccaaagtgctgagattacaggcgtgagccaccaggcctggcctcctaatttttatttgtagaagtggcaccaaaattttccaagttctcatgcaaaaattcaggctcatctcagtttatttttttcatttatttatctcccactaaattgacaacttctaataattaggttggttctttgtattcccagcacagggttctatgcagaatacacacacagcagttgctggcaataatattggtgagagttctgtactgggctatgtgatcttagacagtttgcttatgttctctgacctgccgtaggcacattcttaaaatgaagctgttcagaccccctcgattcatcctgctgtggcttctttttcccacctaaatcttaaatacccttttagctgctagtaagtgaatgatgtttttttatgaactttctgaagtcagattagatgaagttgagaaaagcctgatattcttataaagttatatatgtgcatcatagaaaacttagaaaatacagataaacaaaaatcatccatggacgaaccttgaagacattgtgttaactgaaataaaccggacaccaaaggacacatgttatatgcttccacttatatgagatacctagaatagttacatttggttactctgggtacattgcctatagataagccttgctccacaaggagcagttaaaaaaaaaaaaaagataaattcataggatggaaggtagaatagtggttactagggacttggggagggggaaatggggagttactgtttgatgagtgcagatttcagtttgggatgatgaaaaagttctggagatagatagtggcaatggtaacacaacagtgtgaaaataatgccactgaactgtacacttaaaatgattaaaatgataagttaattgtaatttgtgttatccagaaatggttagcaatttattggtgtatattcttttagtattcctgtgtgtgcacaggggtgcttgtatatactttatctttaaaatatatccaggaagctaggcacagtggcttacacctgtaatcccagcactttgggagggtgaggcaggaagattgcctgagccccggaggtcaaggctgcagtgagttgtgatcacgctactgcactctgttctgggcaacccctgtctgggaaaaaaaaaaaaattagtgaggcttagtggtgcacacctgtagtctcagctacttgagtggctggggtaggattgcttgatcccagcaagttgaggccgtggtgagccatgatggtgccactgcactccatcctgggtgatatggtgagaccctgtctcaaaaacaagaaatccagataattctgtgcattataatctagcttttactggatcattaaaattcttttttctttttttttttttttttctgagatggagtttcactcttgttgcccaggctggagtgcagtggtgtgaccttggctcaccgcatcctctgcctcccgggttcatgcgattctcctgcctcagcctcccgagtagctgggattacaggcatgtgccaccatgcccagctaactttgtatttttagtagagacagggtttctccatgttgaccaggctggtctcaaactcctggcctcaagtgatccacccacctcggcctcccaaagtgctggggttacaggcgtgagccaccgcactcagcctgggtcgttaaaattcttaagtgacttcatttttaattactatatgggattctatctttccagtgtatcatgatttatttgacctattgctgaatgttggaggtttcagggtaagaggcacagtttgctattatgtacatcactatagtggcatcctgatagctaaatatttgcctacatccctgattatttccttagtctaaattactgggactaggattttggtgtttgatacatgttactaaattgttttttagaaagattaaaccagtttatgctcttccagcccctgtggtatatgatagttcccattttcctgtaccttgccaacactgggtgatatccagttttaaaatctaaatcttgcattgctatgagaactacaattagagaaggcttatcttctactgcccattctctgtacagagcaaatccctctagacctgaagccccttggagttgtcaagaaacctttgagatgactccccactctgtatctgagctgtcaccagtattctccacttcttcaggattgccatggcaactaaattgatgaaaagatttaggaggccttttctctctttgcaattcctatgatcctttttgaatgtgggtttgggactctgtcaatatacccatcatctaattctgtccattgtgttttaaagtttaaggttgcaatttctgattacatctgccttagccatactgtattatatttgacattcaatatacaatgtccttgtttttctgtatttctaatcttattcccagagatgtgtctatttgttcaggattcattttgcaacgtgtttttactaagcatctacccaaaaccgttgaagtcagatttcaggctgtcttacgtctaaagtagcacaggcaggaaaaactattgaagtgggatttttttttccctttttgtactgaaccgagaaaaagtatatagatgatagagaattcctaatttggtatcattgatatctgggtttttgtttgtttttacagaagactgattaactatacttatttattaatttatcttctcattaataaacacttgctgagtgcttactgtctgctaggcattagggagacaaatatgattaagggaagcttcctcctatcaaggtcatgtgttccatttgggtatactaatgcattagcaatgtaaatcaagtagtgagagatcatctgttcccgataggagatggattattggtggggacttctgtgtgtgtgtgtgtgtgtgtgtgtgtgtgtgtgtgtgtgtgtgtatgtatgtgataaaataaatataggaaatgttaattatagattctaagtagtagatatataaacactcattgcaaagttgcttcaagttttctgtatatttgaaaatattcacaacatgtcgacaaaactagcatgataaagccactatttgtgctaagacttcagcttgtatctggattaggcttattatgtagtagtaggaacattagaaatagttttaactcattaaatacacatgttttatgggaaggttttatatatatatttatatgtaatgaatgtgaacaaacaagggtcagatatacactctgcttccctccagaccagttccggctgctctgctgcacatttcaggagtcttattagaattagccacattctgcccacttgcccttacttctcatatttcacaactcctcctggtggggacttaaggagacattcaaactaggccttgaaagatgagaatttttccaagtggaaaaagaggagtggcagcaagtaaggtaaaggtacagagtcatggaattcccaggaaacgtaaagttgtcatgtgttataggaaaacaacttgtgtgaggggtgttgggagaaatgagagataataccagggtataaagggccttttgaatgctatgttgaggaattttatcctaatggcagtaatgactaacaattatatagtgttcaaaaagtataaatcagcagtggtataccactaagggtttttttcttttctttttttttttgagacagagttttgctctgttgcccaggctggagtgccgtggcacgatctcagctcactgcacttccgccacctgggttcaagtgattcttctgcctcagccagtgtttcactgtgatggccaggatggagcactaagggtctttatggaagaaaaagacatgataaacaaggcttttagggaacttctacagtaatgtagctgtattaaaagtagagatcagagcagcatagtagaagtagaaggctagagctaattgaaggagcacttcagaattagaatcaagaagtcttagaaacctattggttttattctccctaatgtatttggccacttacctgctggggaatttgtctaagttataaaaaataattcctttgggaaacccaaaggaaagttatctattaataattaccccactactttttctgatttatgtaatggccacgtagaggttagatgtgatggttgtgacagtagtgactaatacagcctgtgaagcattttggtcagatatctatgtgctttcattccaggttgactgaggcaagactttggctagggtttgatcagtgatgtaactactcacgagtaccacgtggtggcaatggcattgctgcagaccttggcagcaaagcagtgttagagtagcagtagaaacctttgtgaagctaggaatacattttctggtcataaaaacctcctgaaaattgtgaactcagtgtagcaggagaaagaagatggcttgtttttagtaaagggcaaagtcatttttaaggatcagaagaagaaacggagagtgaaacaatgtgttcctgccctactcccccactggactttttggcaaccattgctgttccttctaaaagtgatttttaaacatgtatattttgaagccaggcacagtgactcacgtctgtaatcccagcactttgggaggccgaggcgggcagatcacctgaggtcaggagttcaagaccagcctggccaacatggtgaaaccccgtctctactaaaaatacaaaaattaggccaggtgtggtggctcacgcctgtaatcccagcactttgggaggccgaggcgggaggatcatgtggtcaggagatccagaccatcctggctaacacggtgaaacaccatttctactaaaaatacaaaaaattagctgggcatggtggcgggcgcctgtaatcccagctactcaggaggctgaagcagaagaatggcttgaacctgggaggcggagcttgcagtgaaccaagattgcgccactgcactccagcctgggcaacaaagtgagactccgtctcaaaaaaaaaaaaaaaaattagtcgggcatggtaacaggtgcctgtaatcccagctacttgagaggctgaggcagggagaattgcttgaaccaggtaggcggaggttgcagtgagccaagatcgcaccactgcactccagcctggggcaacagagcaagactgtctcaaaaaaaataaataaataaaataaattcttaagaaggatattttggaaaactccttacatacctaaattctttgtttatcaaatacttggacttagcacactcttctttgaaatggaccaataaacaacaggagcccataagcaaaaagaactcattattttaaaaacagtaactatccttacaggctttctcagggctctttctgttggatccttccctctcacaggtccttgctaatgatctctaggtggacacattctagatgagatgtccctgtctagaatggcagcaccatgagggctatatcctcagtactaggacagcgcctggtgcttaatagatagtaaatagttgtctaattaactgagcaaacagatagattcatgaattagctttttgctttttctgttagaaactaaaggttcaggtcaggcacaatggcgcatgtctctaatcccagcactttgggaggccgaggcgggctgatcacttgaggtcaggagttcaagaccagcctggccaacatagtaaaaccctgtttctacaaaaattaccaaaattagccgggcgtcttggcaagcacctgtaatgccagctacttgagaggctgaggtgggagaatcgcttgaacctgggaggaagaggttgcagtgagccgagatggtgccaacctgggtgacagagggagacttaaaaaaaaaaagaaagaaagaaagaaaagaaactaaaggttcaaagaatcccagaaaaggaagagtcctcacaagccagtaatctaggcaggattactgatagtatttttatatttgttgtatttttataaaatgccatagatagagggcttttttcaacattacatcagtctaaaaatcacacatttttatatgaactaacctaaatgtctgatgaatctcacaacaccaagtctttgaaatgtgcccatataaataaaatgttaacagattcatgctaattttaaatatcgatagtgtttaaatgccttaattattttttcactccctagctttaaaagaaaataaccaacttcaaaaggacatcacaataacatcaagtctatttgggggaatttgaggattttttccctcactaacatcatttggaaataatttcatgggcattaattgcatgaatgtggttagattaaaaggtgttcagctagaacttgtagttccatactaggtgatttcaattcctgtgctaaaattaatttgtatgatatattttcatttaatggaaagcttctcaaagtatttcattttcttggtgccatttatcgtttttgaagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaaggtgtgtattgttggccaaacactgatatcttaagcaaaattctttccttcccctttatctccttctgaagagtaaggacctagctccaacattttatgatccttgctcagcacatgggtaattatggagccttggttcttgtccctgctcacaactaatataccagtcagagggacccaaggcagtcattcatgttgtcatctgagtacctacaacaagtagatgctatggggagcccatggaagatacatggtatacaacatagctcttgctctattggaagctaagtggaatgggagaaattggtgacaggcaaccccataatttcagaaagctatgaaaaagtactcagacatattccttataacactggtgtcacatcacaaagacctatttaatgtgcttctgatttatagggagagacatcctatacttcaggaactgcactttgatccacagaaagcctagtgatgtagagctcctgttagttcaaaaggaaaagaaaagaacaacacagaaagcctaattatgcaatagagtcaagtgctttatagcaatgttacagttatcaaaaaaaatccagatggacctctgagaggatgccattggagtaaccaggcagatgcagttgatcagagctgacttcctataagaagtgagcactgagctgaggaataatggcataaatgaaggaaagtgagatggaaatttgagtttttaattggaaagacaatacatcaggcagatttttaaataggggcaaacaaacagacacataggagatgctaggcatggggtccccactaggatgctgcttagaaacatgcaggggtggtgagtactcccaaagtacacttcattcctagctcagtgattcttatctgagtgttaaagttccttcttcagcaccccgttccacagtccaactgggaactttaagacctttcttggagtctttctaggaactcaagtctgctacttatacagaacagtggctttggtccccagttgtgccttgcagtatttttgtgttcaggaagaaacagtagctcttggataaagaagctagctagaaactctgttgctatggcagtgcttcaaaatgtatttccttaaatgctttctttgtaactatcttcatttagttcatctctcagataatgagagatcagagtcccatccccagtataatactcttctttagggtactttcaccatcttcagtctaaacacagactagactttcaattataatgtgtaagatttaaaatgttattattgtgtgactttgaatatctgtgtaaatctactatctcctctttggtatatacgtgtgtttatttttttctggagatctgtaactgaaatgcttaatttctgaattgttttggatatcacaacttaataccaacataagttttgagcctttttctccctaaatctggtgtgagtctaactgaaactcaaatgaactttttaaaaataattttttcttttctttaattttttttttaagtagagacagggacgcactgttaactaggctggtcttgaactcctgatcttgagccatcctccccgacctgagcctcaccttatagagagggtcttgctctgttgcccaagctggagggcagtggcataatcacagctcactgcagcctctcgacctcctcaagcgatcctcctgccttagcctcccaagtagctgggactataggcgtccaccaccatacccagctaatttttttttttattttttgtagagacaaggtctccctatgttgcccaagttggtctcaaactcctggactcaagcagtcctctcacctcagcctcccaaagtgctggggttacaggtgtgagccatggcacctggccagaacttctagtaaaaagaatattgttgccgggtacggtggctcacgcctgtaaccccagcactttgggaggccaaggcaggcgaatcacctgaggtcgggagctcgagaccagcctgaccaacatggagaaaccacatctctactaaaactacaaaaaattagccgggcgtggtggcacatgcctgtaatcccagctacttgggagctacggtgcctggcctagtttattatttcttaatatctgttgtcttccagtgtcttccttaattcttcacaataccctgtacaatgcttagcacacagtgggcagtctgtaagtttattaaatgtttggtgtggcccatacttcctatccacaaagaatgtaacatgttaagacatctagatgagggaatgatttaagaggaactacaataatattctgaaacttggactctggatctctgcatttagactttcctaaaccagccagcaagtagatcatcatgtcacaaggcttaggttgggcttgctgttcagagaatgaattaaggattaaggagaaaaaaaagcagaaaggttttgctctgtttttcaggttctattgagttgttaacttctaacaagttatcttatttgcttcattgcatgaggcccattgtagtaagaagaggaatttatatgctaaatgttctggtgatagaatgacttttctttttttttacagtccaaaggtcttttttttttttttttaacacctattatgccatgaattcatagggaataggttccagctgctcaggctccttcccattggttctcacaaagtgtgcttctctgggtggagcaggctggtgcttcagttgaacccacgtacctttctctttggcttctttctttttctgatcattttccttcacgcgtttcaggaagctgtcttggctcttagagtgtttaatgtgctcaatacgcacattaattctcttggcaagaatcttgcccttaacttgtttacagcgatgccaacagcatgctgggtcacgttgtagacttttccagttttgccatggtaacacttgtggggcattcctttttgaacagtacccgttcccttgatgtctacaatttcacctttcttacagattcgcatatacatggccaaaggaacaactccatgttttctaaaaggcctagagaacatatatcaggtgcctctcctctttccctttgtgttcgtcattttggcaaattactgaaagatggtggttctggccaaaaggaggaatgactttttaatagctgtgtttgtatctgagccttccctctgcctttcattttttttgttttgttttgttttgtttttgtttgagatgaagtttcacttttgttgcccaggctggagtgcaatggtgtgatttcggctcattacaatgtccgcctcagcctcctgggtagctgggattacaggcacccgccaccacgcccagctaatttttgtatttttagtagagacagggtttcaccatgttggccgggctggtctcaaactcctgacctcaggtgatctgcccacctcggcctctcaaagtgctgggattgtaggcgtgagccacatcacctggccacttttttaactctttccaatggttaattccgtttgatatggttccttggaacttgcacattaccctttatcaattatcaccctgtattgggggtggggaggatgatacctctcttcatagttagatcctacttactttcaacagagttcttaacaatcctagaaactcacaggtccagaaaagacaagcataaaggaaactataaataatgcatttgaagactaactcaggaaatcaatgattatttccccccaggctacccagtgtcttaaaaaaacagtttaattaatacaatcttttgtttcaattttctacctatatttatggcttttagcttttctaataaaagctcaaaatgaattacagtcatcagtgactttttaatgaatagaagacatttgcaatttttcactatttgtttttacttattaaatatttccgccttggccaggcatggtggctcacgcctataatcccagcactgtgagatgccaaggcaggaggatcacttgagtttaagagttctagaccaggctgggtatggtggctcatgcctacaatcccagcactttgtgaggccaaggttggcggatcacccgaggtcaggagtttaagaccagcctggccaacatggtaaaaccccatctctacaaaaaatacaaaaattagccaaggggtggtggtgggcacctataatcccatctttttgggaggctaaggcaggagaatcgcttgaacctggaggcagaggttgcagtgagccgagatcatgccactgtattccagcctgggtaacagagcaagactctgtctcaaaaaaaaaaaaagtttgaaaccagcctggtcaacacagcaagacacccatctcgttgaaaaataacggtcgggcgcagtggctcacgcctgtaatcccatcactttgggaggccgaggcaggcagatcacctgaggtcgggagttcgagaccagcgtgaccaacatggagaaaccccatctctactaaaaatacaaaattagttgggcgtggtggtgcatacctgtaatcccaactacttgggaggctgaggcaggagaatagcttgaacctgggaggcagagaggttgtggtgagccaagatcacgccattgcactgcagcctgggcaacaagagcaaaactccatctcaaaaaaaataaataaataaaaataaataaataagtacttctgcctttaagccacttcctagaaggcagtggcacaaagtgatacatttggaggagtaaatatattacaaaatgaattaggctgggcgcagtggctcatgtctgtaatccccgcactttgggaggccaaggcgggtggatcacttgaggtcaggagttcgagactagcctgatcaacagggtaaaatcccatctctactaaaaataccaaaaaaactagctgggcgtggtggcaggcacctgtaatgtcagctactaggaaggctgaggcaggagaatcgcttgaacccaggaggtggaggttgcagtgagccaagattgcaccattgcacttcagcttgggcgacagagtgagactccgtctcaaaaaaaaaaaaaagaactaacatgccagaactttgccttcagtatgttttgtgatttttcccttcttgtgccatttcatcattagttccatgtattatttaagatttcttatcaaccagcaccttgggatttttttgtgtatgtgttggtttagggggtttatttgtttttttcttttttttcggtaattgaaaatgtgaagcaaaatgtcacctgttttttctttcatgtctgacactcatgtcttgtttacccccgacatgcagaagctgaaatccccatttcatacagtcttcaatgtggaggcagtagggatggagaaaataatgtactttgtgctctccggtactctttctttcctattgtctgaggggatttgggcataatttattttgctgcagagataaaaatttgttatatatattttttatcattcagggccaaggaatatagattttttttttcagccttgtctcagctgggtgtctttatttactctgtcttaaagtgttccttttattatcattattattttttaatcattgaattccatttggtgctagcatctgtctgttgcattgcttgtgtttataaaattctgcctgatatacttgtttaaaaaccaatttgtgtatcatagattgatgcttttgaaaaaaatcagtattctaacctgaattatcactatcagaacaaagcagtaaagtagatttgttttctcattccatttaaagcagtattaacttcacagaaaagtagtgaataccctataagccagaatccagaaggcctttctgctgacaagtttgaggtgtctgcagatagttctaccagtaaaaataaagaaccaggagtggaaaggtaagaaacatcaatgtaaagatgctgtggtatctgacatctttatttatattgaactctgattgttaatttttttcaccatactttctccagttttttgcatacaggcatttatacacttttattgctctaggatacttcttttgtttaatcctatataggttttttgaacctataacataagctacaacatgagaaatgtgcggttagatagatatgtcccttctgaaggtcagaaaaaaatataatggaggtaaaacctgaacaagcttggaaactgatggtagacttcttcaaggcagcccttgccctaattaaaattcttgtctttctagaaaaagtctagctgttgatttaccacagaaaataataataataattactattattattattttttgagacagggtcgccctgtgtcacctagattgcagtggtgcagtcatggctcactgcatcctccgtttttcaggctcaagcaatcctcccaccttagcctcctgagtagctgggtccacaagcatgcgccacccacacccactaagtttttgtatttttggtagagatggagttttaccttgttgcccaggctggtctcaaattcctggactcaagtagtccgcccgccttgccctcccaaagccagaaaacatttagaatatctttcagagatgtgtatttacaccactattaacacagggctgtatagcagtccagtactggactatgtagtccagtactattcttttccttactggagggccaggcgtggtggcaggtgcctgtaatcccagctactcaggaggctgaggcaggagaattgcttgaacctgggaggcagaggttgcagtgagctgggaccgtgccattgcactccagcctgggcgacagagcaagactccgtctcaaaacaaaaaaaaaaagagagagagagcagtaattcaggtctcacccatcttcaatccagggggcctagccttagtatttgacccatagtaagcacccaataattgtttaaattaattaacctctgaggccctttaaatctgttgataagtatcttattttgcaaagtcctaagcacttggaagagcagaggaactatttactgggtgtgtatgcttttctaacaatattttatagctggcttttgtttttagaatgaatttgaacattgaaaaggcaggcaatagggatgattctgtgaattctgctaaaactgagtagaaagaatgagtgtagagatgtcgacattgatcaactttctatcttcataagagatctgattctaacatatccatttagactcaagtagaatattgtgtatagagtgagtggcagtgagtaatttggtaaaaatttgctgacctgcttttattctttcctcctttctttcttcctttccttccttccttccttccgtcctttcctttcctttccctcccttccttccttctttccttctttctttcctttctttcctttcttcctttctttccttcctcccttccttttcttttctttctttcctttccttttctttcctttctttcctttcctttctttcttgacagagtcttgctctgtcactcaggctggagtgcagtggcgtgatctcggctcactgcaacctctgtctcccaggttcaagcaattttcctgcctcagcctcccgagtagctgagattacaggcgccagccaccacacccagctactgacctgcttttaaacagctgggagatatggtgcctcagaccaacccaaccccatgttatatgtcaaccctgacatattggcaggcaacatgaatccagacttctaggctgtcatgcgggctcttttttgccagtcatttctgatctctctgacatgagctgtttcatttatgctttggctgcccagcaagtatgatttgtcctttcacaattggtggcgatggttttctccttccatttatctttctaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctaggtaatatttcatctgctgtattggaacaaacactttgattttactctgaatcctacataaagatattctggttaaccaacttttagatgtactagtctatcatggacacttttgttatacttaattaagcccactttagaaaaatagctcaagtgttaatcaaggtttacttgaaaattattgaaactgttaatccatctatattttaattaatggtttaactaatgattttgaggatgagggagtcttggtgtactctaaatgtattatttcaggccaggcatagtggctcacgcctgtaatcccagtactccaggaggccgaggcaggtggatcagctgaggtcaggagttcaagacctgtctggccaacatggtgaaaccctgtctctactaaaaatacaaaaaaattaactgggtgtgctagtgcatgcccgtaatcctagctactctggaggctgaggcagcagaatcacttgaacccgggaggcggaggttgcggtgagccaggatcacaccactgcactccagtctgggtgacagagcaagactccatctcaaaaaataaatatatatatatatacacacatatattttatttcaactgttagacaagagtccaaaggccaaagaataaagttttaggccagtcctttattagaaaatgagtcaaatcccaaagcaagttttttttatgagttaatgaatataaatgactacatattttatgccttaaaaatcacttttaatgaatggtgttttatggcttgtaaatcagagttttaatcagtaaagaaagtttttaatcctcaaaaacacgttatcataaaagacactgtttggcatcaaatgtggtatttggccatgttcattagggtcattttaggaatctcatacattctacttagctatgcttaattcctgataccatggcattttctgaaatgtttcaaggatgacatctctgctgtttttaatttggtaatgatatctgctgatttattaagtgaaaaaagtaatggtgtcattaccttggatgaagaaacaaaaataaagcatttgccacatttttcaactttgttttcctttcttacaaaattgctataagctcattgcccccaaattggacaatatagggaataaaaaagataatttggggtggggttagacacgggtcttgttatgttgccgaggctggtctctaactcctggcctcatgcaatcttcctaccttggcctcccaaagtgctgggattataggtgtgagccacttcaccaagctgagatgccacctcttaaaagagagaataaggacagattacagccactgctcatgcctgtaatgtcagtactttgggaggccaaggtgggagaattgctcgaggccaagagttcaagaccagcctgggcaatgtagcgagacctgatctctatgaaaaggggggtgggggggaaaactagctggggccaggcgtggtgggtggcttacgcctgtaatcccagcactttgggaggccgaggcgggcagatcacctgagggcaggagttcaggaccaacctgaccaatatggagaaaccctgtctctactaaaaatacaaaattagccaggcttggtggcttatgcctgtagtcccagctactcgggaggctgaggcaggagaatcgcttgaacctgggaggcagaggtttcagtgagctgagatcgcgccattgcactccagcctgggcaacaagaatgaaactccatctcaaaaaaaaaaaaaatcagctggaaggtggcaaacacctgtggtcccagctactcaggaggctgagacaggaagatcacttgagtccaggaggtcaaggctgcaggtgagccatgtttgtgccactgcactgcagcctggatgacagaccgagacccttctcaaaaaaaaaaatattacccgtactcttttttgagacggagtttcactcttgttgcccaggctggagtgcaatggcgcaatctcggctcagcgcaacctccgcctcctgggttcgagcgattctcctgcttcagcctccccagtagctgggattacaggcatgcaccaccacgcccggctaattttttgtatttttagtagagacagggtttctccatgttggtcagactggtctcgacctcttgacctcaggtgatccgcccaccttggcctcccaaagtgctgggattacaggcctgagccaccgcacccggcctgtactcttattctttaataataaaatatttctgtgtttctttagtcattttacataaacttttatttatttatttatttttatttatttatttttttgagacggagtctcgctctgttgcccaggctggaatgcaatggctcaatctcagctcactgcaagctctgcctcccgggtacacgccattcccctgcctcagcctccctagtagccgggactacaggcgcccgccaccacgcccagctaatttttttttttgtattttcagtagagacagggtttcactgtgttagccaggatggtcttgatctcctgacctcgtgatccacccgtctcggcctcccaaagtgctgggattacaggtgtgagccaccgtgctcggcccataaacttttatttttaaaataatgtcatgataaataatattgcttaggtgtctttaatatattagtaacatttctgttttattgtacatcaacatttatattcaaattaatgggtgaagagtactccattggactaggtatatcgtaatttaatctcctattattggacaactacattgtttctaaaattatactattcctatgactaaacctttgcatatatcttttatctccctaggatatatttctaaaactagcattgttgactgaaagtgtaaatacgtgttaaggtgtttgctacataatgccatatttcctttttaggaaactaagctactttggatttccaccaacactgtattcatgtacccatttttctcttaacctaactttattggtctttttaattcttaacagagaccagaactttgtaattcaacattcatcgttgtgtaaattaaacttctcccattcctttcagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttgtgagtgtatccatatgtatctccctaatgactaagacttaacaacattctggaaagagttttatgtaggtattgtcaattaataacctagaggaagaaatctagaaaacaatcacagttctgtgtaatttaatttcgattactaatttctgaaaatttagatctagataaagctatagtgtggattattttatgtatatttacttgagaaaataattattaaatattagtggaaaagctatactttgggtatgatataggactttcgaattggaattttcctttctatctgtaaaagcaagtaggtatagttttattccccagaaggcatctttttctcccccttgtctcacatgggtgaatttaccagcatatttaactaaattcagactggttccaaatgtactgccagatagtagcatttctctagtgtttgttttcatcctggcttgtaagaatgccctgccacttctgccctgcaatatcccttgctattaggattttggcatcaccttgggtccttaatgccagaaatgggaattgcttcatactgtggaaaaatacccattaaaatattaagaccagtaaaacctcgtttctgcttgggctatttgtggatttcagacatcctgagaagtttaccacccctgtaattaattgtcattgtcatcacttcataataaaaataattgcatggccgggcatggtggctcaagcctgtaatcccagcactttgggaggctgaggtggtcagatcacctaaggtcaggagatcaagaccagcctgaccaacatgaagaaaccccatctttactaaaaatacacaattagccgggcgtggtggcgcatgcctataatcccagctactcaggaggctgaggcaggagaattgcttgaacccgggaggcggaggttgcggtgagccgagattgcaccattgcactccagcctgggcaacaagagcgaaactctgtctcaataataagaagaagaattgcgtgaatatttctttaaaactatgatgagataacataccagattatcaaatggattcagtagtgggtgtgccatttattgcacactgagagatgaccaagtcattctgaaatatctttattaatatatccttcctaggatttttcatcctaacttctccataggtagttacttagcataacatctctgtggccagatgtatcccactactaaaagggcaaagtaagctgtggctgccctggtagatacaatgagtaagtgcacagtgatggctataaatgttttcatctcataatcccatgtccagaccagcaatttgctctgaaagctcttacctgtgtctgtttcaatggctcttgatcacttgcctgcacgtccagaattccttatttattcattgaaaattagcgttctttatccctttgttttgcaagttcagctttttagagatggctaaaatggtctaatctttcttggcaaaggcaattctgagctgcagattagactacaagtggcttgggtacatgttgtctttaaacaagcgaagaggaaaactttgagctctattcagacttggtgaagtgtggtaaatttatgatgaaagctactgactgtattacacatgattaattctgaagcccatattaagatgatcttttcagcagttcagcattgctcttctaactgaacagtttcaaggctgggatttcagcaattaatcagttcagaattgctaatgatcctggcggagggtggtagcaaaagggggaggatgtcattagcttctctagcctgccttttttcagtgccctgtggcagtatggagtgaggcaacatgaaagaaagatggcctgaccttcatggcagtattgtgcaacacgtaaatactggtgtgagtggctgtggctatggctagtaaatgatggcccttggtaaacaaagttatttatcagacaatacctaccagctaggtcaactgtgcccataattgatctggttaatttcttttgctgcctattgatttttatttggttgatagataatagctagaggactctaaatttctttggggaagaacatgaaccccttctaagccttcttacgagagaattgatcgcttttgcactgacctttagtaacatcctgatttcagtgttttgtaactatcagagggttgagtcttggttttaagccatgtatatctgtagcataactttctgtgtaggctagttacctctcagcttataaagtgtaggctgataaatttatagtacagtagagtgtcactatgcaaagaaacgatcttagggaatcgaatgatatctgctattaaagcaaaattaatatatattttttctttttacttttttttttttttaaagacatgaaatctcactgtattgcccaggctggtcttggtctcagactcttgagctcaagcagtcctcccacctcagcttcccaaagtgctgggattataggcatgagctgccgtgtctggcccagtatatattttttaagttttaagttttgtggtacgtagtaggtttataatattattttgaatccttagttgtaattttatgtctgctgatgtgtacataatttttattaaactatttatttgagacttcaggtatcttttttttttttttgagacggagtctcgcactctcgcccaggctagagtgcagtggcgccatctcggcttactgcaagctctgcttcctgggttcacgccattctcctgcctcagcctcctgagtagctgagactacaggtgcccgccaccacgcctggctaattttttgtatttttagtagagacagggtttcaccgtgttagccaggatggtctcgatctcctgaccttgtgatctgcccgcctcagcctcccaaagtgctgagattacaggcgtgagccaccgcgcccagccgagacttcaggtgtcttagaattttttaaatgtaccctttctgagaaaaacagagacttaaagctaggataactggtattctattttttttttttttttttttttttacctccagcctgggtgacagagcaagactctgtctaaaaaaaaaaaaaaaaaaattcactttaaatagttccaggacacgtgtagaacgtgcaggattgctacataggtaaacatatgccatggtggaataactagtattctgagctgtgtgctagaggtaactcatgataatggaatatttgatttaatttcagatgctcgtgtacaagtttgccagaaaacaccacatcactttaactaatctaattactgaagagactactcatgttgttatgaaaacaggtataccaagaacctttacagaataccttgcatctgctgcataaaaccacatgaggcgaggcacggtggcgcatgcctgtaatcgcagcactttgggaggccgaggcgggcagatcacgagattaggagatcgagaccatcctggccagcatggtgaaaccccgtctctactaaaaaataaaaaaattagctgggtgtggtcgcgtgcgcctgtagtcccagctactcgtgaggctgaggcaggagaatcacttgaaccggggagatggaggttgcagtgagccgagatcatgccactgcattccagcctggcgacagagcaaggctccgtctcaaaaaaaaaaaaaaaaaacgtgaaaaaataagaatatttgttgagcatagcatggatgatagtcttctaatagtcaatcaattactttatgaaagacaaataatagttttgctgcttccttacctccttttgttttgggttaagatttggagtgtgggccaggcacggtggctcacacctgtaatctcagcactttgggaggccgaggcgggtggatcacctgaggtcaggagttcgagaccagcctggccaacgtgttgaaaccccgtctctactaaaaatataaaaattaggtgggcgtggtggcaggcacctgtaatcccagctactcaggaggctgaggcagcagaatcgcttgaacccaggaggtggaggttgcagtgacccaagatcgcaccattgcactccagcctggggacaagagcgagattcttgtctcaaaaaaaaaaaaaaaaaaaaaaggtttggagggtggtgagctgagatagtcaactattaactcctatctacctgctgggactacactggtgaggtggagcctaagtcctaaaacaacaagtgaggcagctggacgcggtggctcgcatcagtaatcccagcactttgggagcctgaggcgggcagatcacaaggtcaggagttcgagaccagcctggccaatatggtaaaacccagtctctactaaaaatacataaattggctgggcgtggtggtgtgcgcctgtaatcccagctacttgggaggctgacacagaagaattgcttgaactctggaggctgaggttgcagtcagctgagatcctgccactgcactccagcctggcgacagagtgagactctgtctcaacaacaacaaaagaaagaacaagtgaggcaaaacctggagaccccagcttcatgtaacacctagtttgagtattgttgagagtttttcaggaaaaaagtctgataacagctctgagatagtcttaacatatgaaaaagcaaaaaagggaggagacagatcatttgtcctatacctttctcttttaaggttttaattataacttgtgtaatacaggagacctctgggtgtttttagttgactataaactaaatctgagtacacatttcagggctgctaaaaatgcttatttgaaactgggccgtattaacacaagcagaggctctggagcaagtgaagtacagatccagagccccactgtattctccaatggagtgattgcctgaaagatgatgtcagttttaagcaccgtgcttggtttttaacatggtcactgacaaattggagagtgtttatccagaggtagatggtaaagatacataaaagtaacttgaaatactgtcttttgaagaagaaatgagaagatttaaggaaataagacactgtcttcaagtatctgaagaaccgttacccagaagagaactgttatctggaacaggattaagactcactcatggggctccagaaagcagacgagtgcatggaggacgcagaagatgcagattgtgtggctcaactctaaaatctttctaacaaaattagttctctggatgtgttccagttcacttgatgatgattcttttgtttttgtttttgtttttgaggtgtagtttttcactcttgttgcccaggctgctggagtgcaatggcacgatcttggcttgctgcaacctccccctcccgggttcaagcgattctcctgcctcagcctcccgagtagctgggattacaggaatgcaccaccatacctaattttgtatttttagtagagacagggtttttccatgtcagtcaggctggtcttggactcccgacctcaggtgatccacctacctcggcctcccaaagtgctgggattacaggtgtgagccatcgcgcctagcctatgatgattcttttcacagagatacaggcacttaaggagaggatctaaaccccttggacacattgccgttgaacttctaagatcttaggtttccacttactcatgaaaattataccacagggtcagagggtagtgttcattggagccaggtgccagaacaagttattacaaactactattttagagaaaaatgtcattaaagtttaagataccttaagctataggtttgcatcaaagttaatgaaaggtaaaaagatgccaagcgtggtggctcaggcctgtaatcccagcgctttggggggccaaggcgggcagatcacgaggtcaggagatcgagaccatcctggctaacacggtgaaaccccatctctagtaaaaatacaaaaaattagccgggcatggtggcgggcatctgtagtcccagctactcaggaggctgaggcaggagaatggcatgaacccaggaggcggagcttgccgtgagctgagatccagccactgcactccagcctggctgacagagcaagactgcatctcaaaaaaaaaaaaaaaaaaaatgcaaatcaaatctaaagtagttcagtctttaaactcaaagccaatacatttgctttgaactacaaatgaactgaagtttttaagtgtaataaatgttactaaatcggcttttgtagcagttaaacaaaaaacttcaaaaattgtaaggattctgtgagggagcatggctgctgctgctgctgctgcttgcagatagcctgctgtgtttaggatttagttaaatacatttctcctgtttaaaactaaatggtctttccttagtttgcttagttcttcagaagggcctttgaaacactgggaaataaacaagtgattctttagctactgctttctgaaatacttatataaaagctctgcactgtattctcccatccctctcaggggaatattagagggttaggactccccaggtagacattctaggggtgaaaatttgtcattacattgacatttcagatttaggttttcaacaatactgttttcttctttcacatattgccatctagtaatatagatgttctccgtccacattaatcaaaactattgacatggataattcctaattccttgaacactataatggagatctatagctagccttggcgtctagaagatgggtgttgagaagagggagtggaaagatatttcctctggtcttaacttcatatcagcctcccctagacttccaaatatccatacctgctggttataattagtggtgttttcagcctctgattctgtcaccaggggttttagaatcataaatccagattgatcttgggagtgtaaaaaactgaggctctttagcttcttaggacagcacttcctgattttgttttcaacttctaatcctttgagtgtttttcattctgcagatgctgagtttgtgtgtgaacggacactgaaatattttctaggaattgcgggaggaaaatgggtagttagctatttctgtaagtataatactatttctcccctcctccctttaacacctcagaattgcatttttacacctaacatttaacacctaaggtttttgctgatgctgagtctgagttaccaaaaggtctttaattgtaatactaaactacttttatctttaatatcactttgttcagataagctggtgatgctgggaaaatgggtctcttttataactaataggacctaatctgctcctagcaatgttagcatatgagctagggatttatttaatagtcggcaggaatccatgtgcagcaggcaaacttataatgtttaaattaaacatcaactctgtctccagaaggaaactgctgctacaagccttattaaagggctgtggctttagagggaaggacctctcctctgtcattcttcctgtgctcttttgtgaatcgctgacctctctatctccgtgaaaagagcacgttcttctgctgtatgtaacctgtcttttctatgatctctttaggggtgacccagtctattaaagaaagaaaaatgctgaatgaggtaagtacttgatgttacaaactaaccagagatattcattcagtcatatagttaaaaatgtatttgcttccttccatcaatgcaccactttccttaacaatgcacaaattttccatgataatgaggatcatcaagaattatgcaggcctgcactgtggctcatacctataatcccagcgctttgggaggctgaggcgcttggatcacctgatgtcgggagttcaagaccagcctgaccaacatggagaaaccccgtttctactaaaaatacaaaattagccgggcttggtggcacttgcctgtaattccagctactcgggaggctgaggcaggagaatcacttgaacctgggaggcgggggttgcagtgagctgagatcgcatcattgcactctaacctgggcaacaagagcaaaactccatcaaaagaaaaaaaaaatcgggtgcagtggctcatgcctgtaatcctaacactgtgggaggccaagacaggcagattgcctgagctcaggagttcgagatcagcctgggcaacatggtgaaaccctgtctctactaaaatacaaaaaattactcagcgtggtggcatgcgcctttagttccagctactcaggaggctgaggcaggagaatctcttgaacccgggaggtggaggttgcaatgagccaagatcgtgccactgcactccaacctggcaacagagcgagactccgtcttaaaaaaaaaaaaaattttgcagcgcaaaccaggatatcctctgttctcatttgttctagatttcaaaagaaacagtcctttctttggggaaaagagaaaggaaaaggagttttataaaaggaaagaaaagattcataagaacaagaagtgggcccacttgcatatacctttgtagaaaactgttcactgttgttgaagaaaagctcttcatattaatatgcagtccagatgcagtggctcacacttataatctcagccctttgggaggctgagacaggaagattacttgaggccaggagtttgaaaccagcctgggcaacatagtgagactctgtctccacaaaatttttttttaattagccgggcatggcagtgtgcttctgtagtcttagctactgaggaagctaagccagaagaatcacttgagcccaggagttcaaggctgcagtgagctatgatcataccattgcactcttgcacttgcacagagcaagaccctgtctcttaaaaaaaaaaaagtgtgtgtgtgcatatgcatatatacatatatatacatgcaaatgtatctgtttataattcagattgcttcaaaaagatgttgcactttatgatactgagaacagtgagaagtaaataagatagagtgtaggaggaggaataatttcagaacagccatctgagaacttctgtgacaacagatcaggcaaaatgaaatgtgaaagtaattttataggccaggcgtggtggctcatgcctataatcccagcactttgagtggccaaggcaggtggatcacttgaggtcaggagttcgagaccagcctggtcaacatggtgaaaccttgtctctactaaaaacacaaaaaaattagtcgagcgtggtggcatgtgcctgtaatcctagctgctggggaggctgaggcaggagaatcacttgaacccgggaggcggaggttgcagtgagcctagattgcaccactgcactccagcctgtgagacagaatgagaccctgtcttaaaaaaaaaaaaaaagtaattttataaactattgtgcacaattcgatgtattcataattaattaaatgattatttttgttggttttaacttttattcagtggctatttattgggagcctactgtgttctgggcactaggaatgcaacagtaaataagactaactaagtccctggtaggattcaggttctgtcgaggggagatacacaataaagatgaatttaagataacaataaatgctatggagaaatatacagaacagtggaatagtattagctgtcaaaggttgttgattactttcgtttaaggaggccagggaaagcctttctgaaaaaattgagctgagacctaaataacaagaaataattgtccttgaaaaatgaagggaatgcatcttataggcagaggaatagcaaacataaaggtcttgaggtaataatgagtgtggttttttgatttctgtattttggtttttttgagatggtgtctccctctatcccccaggctggagtgcagtggcacaatcttggctcactgcaaactctgtctcctgggttcaagcaattctcctgccttggcctcctgagtagctggtattacaggcacgcgtgctaccacacccgactagtttttatttttagtagagatggggttttaccacgttggtcaggctggtctcaaactcctgaactcaagtgatccaaccacctcaacctcccaaagtgctgggatcacaggcgtgagccaccatgcccggccagagcttggtttattttttaaaagataggccaatgttggtcgtgtgtggtggctcgtgcctataatcccagcactttgggaagccaaggcaggcaaatcacttgaggtcaggagttcgagaccagcctggccaacatggtgaaaccccatctctactaaaaatacaaaaaactagcatggtgtggtggtgtgtgcctgtaatcccagtgcctgtaatcccagctactccagaggctgaggcaggagaatcacttgaaccgaaaggtaggagttacagtgagccaagatcgcatcactgcactccagcctgaacgacagagcaagactcctgtctcaagaaataataatgataaaaggttcgggcacagtggctcacacctgtaattccagcactctaggaggccgaggcaggcagatcccctgaggtcaggagtttgagaccagcctggccaacgtggcaaaaccccatctctactaaaaaatgcaaaaattagctgggcacggctgggtgtggtggctcattcctgtaatcccagcactttgggaggtcaaggcggacagatcactgaggtagaaaccctgtctctactaaaaatacaaaaatttgcccagcgtggtggcgcgtgcctctaatcccagctacacgggaggctgagacaagagaatcacttcatcaacccgggaggtggaggttgtggtgagctgagatcgcaccattgcactccagcctgggcaacaagagtgaaactccatctcaaaaacaaaaaaaaattagctgggaatggtggcatgtgcctgtaatcacagctacttgggaggctggggcaggagaatcgcttgaacccaggaggcggagattgcagtgagctgagattgcgccactgcactccaggctgggcgaaagagcaagactccgtctcaaaaataataataataataataataggccagtgtagctggagtaatttgcaaattatgtgtggaggcagagattacacaaggaatgggagaaggtcatagatgagggccagatcacatagtatttggtggtaaggaattcagattttatccttgtggtaattggtggtgtggagatggttaaaaacaaggttggtttgggatgggtttgaagagaggacttgctaatggattaaatttggaggataaggtaaagagaaattgaaggagtgacacttgggttttggcttgaacaatagatcttgttagtaatattaaattagatgaagaaggcatggtagggaatatgggggagtgggaaaggcaggaagcaggaatggaaccaggaactctgttttagatgtgagaatttgttgttgttgttgttgttgttgttgttgttgttgttgttgttgtgacagcatctcgttctgttgcccaggctagagtgcatggagtgcggtagcacgatctcagctcactccaacctccgcctcccggttcaagtgattttcctgcctcagcctcccgagtagctgggattacaggcacctgccacaatgcctggctaatacttgtatttttagtagagatggggttttaccatgttggccaggctggtcttaaactcctgacctcaggtaatccacccacctcggcctcccaaagtgctgggattgcaggtgtgagccactgtgcccggccagatgcatgaattttgagatgtatactagacttctggatagagaagttaagtaggcagttggacacattgtatgaagctcaggggtacaaggaggactatgaacatgggagtcttctgacaaatttatcactagactcctcattcaagtaactaggaaatgtcagatattcttcccctagtaatagccagtggttatactcttgcctttagttttcttcacaatactcttggcaacacataaggccttccctacaatctgagtttcagtcagaattgtttctgagcgttcttcctcaaatttctccccagtctcattattctttattctcatgtccatgaccagtcataatagtaattatgaaaaacctctaactttctttagtgcattgaatgtatattttatcattttggttgtgttaactgtaaatctctcagtggaaatctgaaaagcctttatttccttagatgataatatacaattgatttaggagatagggaatttttcagttacctttataacagcacagtattagcagtctaatctaaatgctaagtgaatgttttgagaggagatagatgttgaaaattaaaatacattaagtcccagtgaggtgaaaagccgattgttaagttctgcacacaaaagatttgcttcagtgaattgatttcaacagctgagatcctagtcatttcacctggtctaccaaaaagaatgattttacttgcttttggtcaaatctctgcccagcaattctttttctttctttcttttttttgttttatgtgtgtgtgtgtgtgtgtgtttttttagcagagtctcactttgtcacccaggcgggagtgtggtggtatgatcacagttcactgcagcctccaactcctgggctcaagtgatcctccagcttcagcttttcaagaaattgggactgcaggcacatgcaactatgcctggctgaggttttatgtatcttttttctagagaaggggtctcactgtgttgcccagctgggtctccagctcctggtctcaagctgtcctcctgcctcagcctcccaaagtgccaaagtgctagggttataggtgtgagccattggtgcccagctactgcctgcctggcaattctgaatgccttaaatttttttttttttttttttttttttttgagacagagtttcactctgtcacccaggctggagtgcagtggcatgatcgtggctcacagcaacctctgcctcctggattccagcaattctcatgcctcagcttcccgagtagctgggactacaggtgcatgccaccacgcccagctaatttttggtttttttgtttgtttgtttgtttgttttgagacggagtctcgctcagttgcccaggctggagtgcagtggcgtgatctccgctcactgcaagctccgcctcccgggttcacgccattctcctgcctcagcctcccgagtagctgggactacaggcgcctgccactacacccggctaatttttttgtattttaagtagagacggggtttcaccgtgttagccaggatggtctcgatctcctgacctcgtgatccgcctgtctcggcctcccaaagtcctgggattacaggcgtgagccaccacacccggcctaatttttttttttttaattttatttttaattttttgagatgcgagatggagtctcgctctgttacccaggctggagtgcagtggcaccatctcagctcactgcaacctccacctcctgcattcaaaagattctcctgcctcagcctcccaagtagctgggattacaggtgcctgccaccacgcccaactaattttttgtatttttagtagagatgaggtttcaccatgttggtcagactggtgtcgaactcctgacctcaagtgatctgcctgcctcagtctcccaaagtgctaggattacaggggtgagccactgcgcctggcctgaatgccttaaatatgacgtgtctgctccacttccattgaaggaagcttctctttctcttatcctgatgggttgtgtttggtttctttcagcatgattttgaagtcagaggagatgtggtcaatggaagaaaccaccaaggtccaaagcgagcaagagaatcccaggacagaaaggtaaagctccctccctcaagttgacaaaaatctcaccccaccactctgtattccactcccctttgcagagatgggccgcttcattttgtaagacttattacatacatacacagtgctagatactttcacacaggttcttttttcactcttccatcccaaccacataaataagtattgtctctactttatgaatgataaaactaagagatttagagaggctgtgtaatttggattcccgtctcgggttcagatcttagctgataagtggaagagctgggactttaagcagatgagaatctaaagactttgctcttttcacttcactggggtgtctttctctctctctctcttgctctctctctctctttttttttttcccaagacggagtctcactccattgcccaggccagagtgcagtggtgcgatctcagctcactgaaaactcatcttgcccaggctggtcttgaacccctgaccttgtgatcctcccgccttggcctccccaagtgctgggataggcgtgagccaccgtgcccagccaataatagctaaaatttatataatgttcactgggccaggcacagcggctcgttcctgttatcccagcactttgggaagctgaggcaggcagatcgcttgagccaaggagttcgataccagcctgggcaacatggcaaaaccccatctctaccaaaaaaaatatacaaaaattagccaggcgtggtggcatgtacttgtagttccagctactcggaaggctgagttgagagtatctcttgagcccaagaagaggggactacagtgaacggagattgcgccactgcactccagcctagacgacagacagaagatctcaaaagaaaaaaaaaaaaaaaagatcactttatgctgggactgctctaaaggcccaaccatgttttaactaattaacaattttatgacaactctatgagctatgtactgtaattatgcctatattacagatgtgaaaattgaggctcagagaggttgaataagttgctcaaagtcacacaggtaataagtgatggaactagaagttgaactcaggaagtctagctccaagtctaaattctttgttaatttatttttcgggccagagtcttactctgtcacccaggctggagtgcagtgccactatctctgctcactgcaaccttcacctcccaagttcaaaccttgttcaattcttgtgccttggcctcccaagtggctaggattacaggcatgtgccacaacaactagctaattttttgtctgattctgttggccagtctggagtgcagtggcgcaatctcagctcactgcagtctccagctcccaggttcaagtgattctcgtgccttagcctcccaaatagctgggattacaggcacgtgccaccacaccgagatagttttttgtatttttaatagaaacaaggtttcaacatgttggccaggctggtctcaaattccagacctcagatcatctgcccgcctcaggctcccaaagtgctgggattacaggcatgagccactgcacccggccttaatttttatatttttattagagatggggttttgccatgttggccaggctggccttgatctcctggcctccagtgatccacccgccttggcttcccaaagtgctgggattacaagcatgagccactgcacccggcctccaattctaaactcttaacaacaatactatagtttcttgaaaagttgttgaaggcttcacggagggaaaaaaaatggagcattctaacaactttgcagatgagacccaagaagactcaatgactttctcctgatcatattgtagcagatgacttagccagaactctgacttcctcacagggagaaagtctgcaagatttcacacttacctgtcaggcctgagctggctgctttctcagctccctaagtgctatgttcccagtctgcttttcttcctttttcaagtgtgcactaccaggcatttcagaacatcccaggctggtcgcggtggctcacacctgtgatcccagcactttgggagcccaaggcgggtggatcacctgaggtcaggagttcgagaccagcctggccaacatggtgaaaccccatctctactaaaaatacaaaagttaactgggcgtggtggtaggcacctgtaatcctagctcaggattactcgggaggctgaggctagagaatcggttgaacccaggaggcggaggttgcagtgagccaagattgcgccactgcactctagcctggggacaagagggagacttcatctcaaaaaaaaaaaaaaaatcccagctgggcacagcggctcacttctgtaatcccagcactttaggaggccaaggcaggaggatcacttgagcccaggagttcaagactagcctgggcaacatagtaagaccctgtctctacaaaaaaatttaaaaattaattgggtgtcgtagcacactcttgtattcccagctactcaggaggctgaggtgagaagaatgcttgagtctgggaggtcgaggctgcagtgagccatgatggtgctactgcactccagcctggccaacattgtgagaccttgtctcaaaacaaaacaaaacatccttctactgagcactttctgtccctttatagaaacttaagagggaaccagtagaggtaatttcctaaggaaaactgctttgggacatgatcacaaatgaagcctggagttttgaactgctgaggtcagcctgtttttaccttctgagcctatcaagtaattgttccagatgccaagaaaagctgctggccttatttctgcttctgcctttaccacaggggagcgccatgtgagccagtcctctgtttttcctccactgtatgctaggcagtattagcaccagattcttcccctctttaaaaagaaattctagtgctttggattttttcctccatgcagaatagcaatgatggaaagtatgtggtcaaagtaatgacattctgaaaatactaaatgtcaccatagtatttttctctggaagagaaatgtatatgtagaggtgaaacttcaaatttctttttttttttttttaagacgaagctttgctcttcttgcccaggctgaagtacaatggcgcgatcttggctcaccgcaatctctgcctccagggttcaagtgattctcctgcctcagcctcctaagtagctaggattacaggcatgtgccaccacgcccagctgattttgtatttttagtagagatggggtttctccatgttggtcacgctggtcttgaactcccgaccccaagtgatccacccacctcggcctcccaaagtgctaggattacaggccaccgcgcccggcctgaaacttcaaatttctttttttttttgagacagagtctcgctatgtcacccaggctggagtgcagtggcgccgtctcggctcactaccagctccactccacctcctgggttcacaccattctcctgcctcagcctcccaagtagctgggactacaggtgcccgccaccatgcccagctaattttttgtatttttagtagagacgggttttcactgtgttagacgggatggtctccatctcttgacctcgtgatccgcctgcctcagcctcccaaagtgctgggattacaggcgtgagccactacgccaagcccgaaacttcaaatttcttatctcataactaggcatccttatcactgagtgttagcctggatataaacattcctaatcttttgtacttttcatgtcagcatttggctccacttggctgcctggggagaacttctagcattatgagcatgcaggtcctatcaacaggttgggggtgcggtttattcatacaggtagtgagagtggcacagatggatgctgtcccttaaaacaaacagacttgtctttgggagcctgaggcgggtggatcatgaggtcaggagttcaagaccagcctggccaacatagtgaaaccccgtttctactaaaaatacaaaaaattagccgggtgtggtggtgtgcacctgtaatcccagctactagggaggctgaggcaggagaatcacttgaacccaggaggtggaggttgcagtgagccgagatggcaccattgcactccagcccaggcgacagtgcaagactgcgtctcaaaaaaaaaaaaaaaacacacagacttgtcctactgccatttcttttcactctggcggtaaagtaagagtgtgtgtgtgtgtgtgtgtgtgtgtgtgtgtgtgtgtgtgtttctgtccgtctgtctgtcaagggggagggtgaccactttctaaaaggccatccgtgtatttttagcttcctgatttttttctctatcgcagtctctttgaagccaggtgaattttaggccttggcaattttctttttattgcaatgggaaggtcaagacactgagagtcacccaaaacatatccatccaaaatgatacaattttagggtttatttttaagtgatacccaagttatttgctaagaacctatgccagtgtgtttatgagaatttgcactgtcccacactgttgccaccagccacatgggactgtttaaatttaaattttacaaattagccagtcatggtggtgtgcacttgtagtcccagctacttaggaggctgaggcaagaggattgcttgagcccggaagttcaataccgcagcaagctatgatcgtgccactgtactccagcctgagtgacagaatgagacctcatctcttcaaaaaaaaagaaaaaaattaaaatatgaagtttagttcttcattcaccctaaccacatctccagtgctcaataactatatgtgactcatggctaccttattagcatagatatagaacattgtgactatcacagaaagttgttttgaacagtgttgccaagccctgtaagtggaagaggcagtgcagtgtgatctgtgtcttcaggaaaccaggtagtcagactagttcaatgaggagaggcagaacctggcttcacttctagattaaaaactgcttaggtggcctaaagatacaatggccattctcagagtagtgagaaggaaggaacagatgtttagggggctagaagaaagtcagagagggccgggcgcagtggcttatgcctgtaatcccagcactttggaaggccaagacaggcagatcacgaggtcaggagttcgagaccagcctgaccaacatggtgaaaccctgtctctactaaaaatacaaaaattagccgggcgtggtggtgcgcgcctgtaatcccagctactcaggaggctaaggcaggagaatcgcttgaaccctggaggcagaggttgcagtgagcccagatcgcaccactacgctccagcctaggtgacagagagagactccgtctcaaaaaaaaaaaaaaaagtcagaggagacaaggagcatgtacacctaaaatcaacatagacccctctgttgatggggtcatagtgagtacttgaggtaccaagtctggataaacatcaaacttcagccaataactttgagtttctagccatccaagcctcttattaaacatacagaaggaccttttttcccttgcatctaacaagttaaagcacctgcagagatcattagggaggagccttggcctgattggtgacaaaagtgagatgctcagtccttgaatgacaaagaatgcctgtagagtgcaggtcaactacatatgcacttcaagaagatcttctgaaatccagtagtgttctggacattggactgcttgtccctgggaagtagcagcagaaatcatcaggtggtgaacagaagaaaaagaaaagctcttcctttttgaaagtctgttttttgaataaaagccaatattcttttataactagattttccttctctccattcccctgtccctctctcttcctctcttcttccagatcttcagggggctagaaatctgttgctatgggcccttcaccaacatgcccacaggtaagagcctgggagaaccccagagttccagcaccagcctttgtcttacatagtggagtattataagcaagatcccacgatgggggttcctcagattgctgaaatgttctagaggctattctatttctctaccactctccaaacaaaacagcacctaaatgttatcctatggcaaaaaaaaactataccttgtcccccttctcaagagcatgaaggtggttaatagttaggattcagtatgttatgtgttcagatggcgttgagctgctgttagtgccaacatgttagtgagaaaatatctttggataggtaaaaatcaaggaggagttctcctcttcctaaaccatcttaatttacttacatagaagaaagcacagcagctggcccaccatggacgggcccagagcaggggaagattctcggtgaacatttcttttttttttttttttttttgaggtcgagtctctgttgcccaggccagagtgcaatggcgcgatctcggctcactgcaacctccacctcccgggttcaagtgattctcctgcctcagcctcccaaatagctgagactacaggcgtgtgccaccacgcccgactaattttttgtattttttttttagtagagacggggtttcaccgtgttagccaatatggtcccgatctcctgacctcgtgatccacccgcctcagcctcccaaagtgctaggattacaggcatgagccactgtgcccagccctctccatgaacattttctaattaaacttgacacttaatacaatgttatgcttaggactgctataaagcttacctctggagttgcgcagcacaaaggccttggtgtgtgtataaatttggtttgttcttttcacagcaaaagctacccacctttgcctcctgtgcctgcttctgcccagggacttaggtcctcttacaccttagagaaaggccttagcatctggtcacaggcagatgagtgacagcaagaaaacctggctgcaatgtaattttgtttccatcctctttattagttatcaattggatttttatgaaatttccaagttccactcaaggatttctcagtgtttttttactttggtatagtggaaaccagggttgccagaaagtattattttgggggtgagttagtcaaccttcgttcagtcagacagacaggagcacctcagcaattcccagaaacgggctgatgggaaagagcaacatacatgaatgtcttgaagaacacagccaacagagcccattgggcagttctgattttccaggtacacagcatctccacagtctcttctgatttttattcccctgagtatatggattccagctcagcatgtagcctttccctgctgagtctctaaccaggataacatgtatttttttgactggatgaattatcttcccatctcttgacatttacagtaattaccaccaagtatggtattttcagtggccgtgattatcagttaccaacacagaattaggatgaagggaggaagggagggaaggaaggtgggtgttttttcacacagtgtcttagccagcaatttagcaaattaatggaaattagatctttgatttttttttctttcaagcattttatttgagagactatcaaaccttataccaagtggccttatggagactgataaccagagtacatggcatatcagtggcaaattgacttaaaatccatacccctactattttaagaccattgtcctttggagcagagagacagactctcccattgagaggtcttgctataagccttcatccggagagtgtagggtagagggcctgggttaagtatgcagattactgcagtgattttacatctaaatgtccattttagatcaactggaatggatggtacagctgtgtggtgcttctgtggtgaaggagctttcatcattcacccttggcacagtaagtattgggtgccctgtcagagagggaggacacaatattctctcctgtgagcaagactggcacctgtcagtccctatggatgcccctactgtagcctcagaagtcttctctgcccacatacctgtgccaaaagactccatctgtaagggatgggtaaggatttgagaactgcacatattaaatatactgagggaagactttttccctctaactctttttcccatatgtccctccccctcctctctgtgactgccccagcatactgtgtttcaacaaatcatcaagaaatgatgggctggaggctgggcatggtggctcatgtctgtaatcccagcactttgggaggccgaggcaggtggatcacttgtcaggagtttgagaccagcctggccaacatggtgaaaccccatctgtactaaaaaaaaaaaacaaaaagtagccaggcctggtggagcatgcctgtaatgccagctatttgggaagttgaggtgtgagcatcgcttgaacgtgggaggcagaggttgcagtgagccaagattgcaccactgcactccagactgggtgacagagtgagactttgtctaaaaaaaaaaaaagagagagagagagaaaagctaggtgcggtggctcacgcctgtaatcccagcactttgggaggctgaggtgggcagatcacgaggtcaagagatcgagaccatcctggccaaccaacatggcgaaaccccgtctctactaaaaatacaaaaattagctgggcgtaggggcgcacgcctgtagtcccagctacttgaggggctggggcaggagaatcgcttgaaccccggaggcggaggttgcagtgagccaagatcgcgccactgcactccagcccgggcgacagagcgagactccgtctcaaaaaaaaagagagagagagaaatgatgggctgggccagtgccccacccctgtaatcacaacactgggaggccaaggtgggagaatcgcttgagcctgggagctgaagaccagcctgggcaatacagtaggacctcatgtctacaaaaaaattattaaaaattagccaaggctgggtgcggtggctcatgcctataatcccgggggtgaagttgagcccaggagtttgagaccagcctgggcaacatggcaaaaccctgtctctaccaaaaatacaaaaaaattagccaggggtggtggtacgtgtctgtagttccagctacttgggaggctgagatggaaggattgcttgagcccaggaggcagaggtggcagtgagctgagatcacaccactgcactccagcctgggtgacagagcaagaccctgtctcaaaaacaaacaaaaaaaatgatgaagtgacagttccagtagtcctactttgacactttgaatgctctttccttcctggggatccagggtgtccacccaattgtggttgtgcagccagatgcctggacagaggacaatggcttccatggtaaggtgcctgcatgtacctgtgctatatggggtccttttgcatgggtttggtttatcactcattacctggtgcttgagtagcacagttcttggcacattttaaatatttgttgaatgaatggctaaaatgtctttttgatgtttttattgttatttgttttatattgtaaaagtaatacatgaactgtttccatggggtgggagtaagatatgaatgttcatcacaaaaacataaatcaaggccgggcatggtggctcatgcctataattccagcactttgggaggtcaagatggaggtcaaggtgggagcctagaagttcgagaccagcctgggcaacataaggagacttcatctgtacaacaaatttaaaaagtagctgggtgtggtggcagatgcctgtagtcgcagctacttgggaagctgaggtgggaggatcacttgagctcaggaggttgatgcttcagtgagccacgatcacaccactgtactccagcctgggcgacagagcgagaccgtgtctcaaaaagaaaaaagaaagtataaatttacacaaaaacaataaaataatcccagtaattccaccacttggagatgatcaccataaaactccaccaggcatatgtgcgtatatatacacgtgtattttataaaatgtgatcataattacactgttttgcttttttccttaagatattacatacatttttccacatcgttaaattacagtgctgttttcctggtggctttcctttaacagattgaagttcatgttaatacagttgccagaggctgtgggctttcactgtcaccaggagtcactcctagggcctcttcagagcaaggccttatgtcctgaagcattgccttttttttttttttttgaggtggagtctcactctgtcacttagcaggctggagtgcagtggcccagtcttggctcactgcaacctccgcctcctgggtttaaatgattctcctgcctcagcctcagggcggatcacctgacatcaggagtttgagaccagcctggccaatatggcgaaaccccatctctactaaaaatactaaaaaaaattagccaggcatggtggcacgcacttgtagtcccagctacttgggagactgaggcaggagaatcgcttgaacccaggatgttgaggttgcagtgagctgagatcacaccatcacaatccagcctgagtgacagagtgagactccatctgaaaaaaaagaaaaaacaattagcctggcatggtggcaggcacctgtaatccctgctacttgggaggctgaggcaggagaattgcttgaacccgggaggtggaggttgcagtgagctgagatcgtgccattgcattccaggctgagcaacaagagcaagactccgtctcaaaaaaaaaaaaaaaaaaaaaaaaaggccaggtgcagtggctcacgcctgtaatcccagcactttgggaggccaaggtgggtggatcacctgaggtcaggagttccagagcagcctggccaacattgtgaaacccccgtctctactaaaaatacaaaaattagctgggtgtgatggcatgtgcctgtaattccagctactcaggaggcagagacaggagaattgcttgaacccaggaggcggaggttgaatgagccgagattgcgccatcacactctagcctcggcgacagagcaagactccgtctcaaaaaaaaaaaaaaaaaattagcttctacctcattaatcctaagaactcatacaaccaggaccctggagtcgattgattagagcctagtccaggagaatgaattgacactaatctctgcttgtgttctctgtctccagcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaccatgaatgactgttcttgagacttaggccagccgactttctcagagccttttcactgtgcttcagtctcccactctgtaaaatgggggtaatgatagtatctacctcctaggatttattgaggcagcttaaataccttttgtatttcctgttgctgccaaaacaaattgttgcaaggtcagaagtctgaggtggctcaactgtttctttgtttcaggtttcatgaggccaaaataaaggtgttcgcagggcgtgttcccttctagaggctctgggtccttgcagttctaggactaagatccctgtttcccactggctgttggctgggcatcattctcagcttcttgaggctccccacattcctaggctcctggcctgtctgcctccatcttcaaaaccagcaatgggtggtcaagtttttctcacactgaatcttgctgactactgtatctttctaactcctgccagagacatttctctgtttctaagggctcaagtgattagattgcacccacttggtaatccaaagtgatcttcatatcttaaggcccatagccttaattatagctgcaaagtcccttcgcagcagtacctagattactgttggaatgaataaccagaagacagcaatcaagggaggacatctttagaattctgcctaccacttgtatttaacatgcttaatccacagatgacactctctaccattatttcctggtcctcacactgctcagagattggaatcctttttgagcaaagagaatgaagtcatcacatagttcagtcctgctgtatttgctggaaacagtgaaggaagatagagaaaatggagctaactgccaatattacattttatatcagtcttcatcatagccctatgaagtgggtatttgttacctcattggaaaaatgggagttgaatctcaagttccttgtttgtaagattttactcagatttgcacagctaaaaatgactacatggagacccaaagccacctttctgttcccatcatcagctttccatctgcctctgtcactgaccccgggacagaaggttcaagccttaagggaatttggagagagaactagattttgaggggaactcacactcacttcccttttgggccacagtaggagacagtaaaagcagccccatgtcaggcaaagggtcttacaggagtggatcatggctgctgtttccacttctctctggcttcccagcttatgactgtgtatcttagttgtcaaagccttccagttcatcctcacctacagcttgacttcccaagggcccatgccagctccctgtctacctgccagtgagttgatgagtctcggtgttagtagtaaaggcaggcgggaagcaagcagaagtgctactgggccttgagggtaagccaggcctcagccttctgaccccatcactgatgggttaataggaaaagcagtatccatctagtacagcctgccttttcaggaatagtgagtaaaagcaaagatgactaaaatacattaaagttttctgtaattgtctctaaggtctcccaacaaacatataccccatctgtttcaagctctgcataacctttcccagaagtcaagttcaggccctggcctcatggtgcctggcccaggttaagagtgctacctgatgatggagttaatacacgttgctttgacctctgactttaagatgtcctcccacttttccaccccgcaatctctagccctctctgggcacagcagcaattgggaactagttcctgtactgcctttatctcattttacaaaacaaacttctacaaagaagctggaaaggaaggaggagaaaggattatcatgcaggcacagggagggggcctagagaagagctctggcagattatgtccctcttaaaaaatgcaaccagaatcatcaacaaagtatcacctcaaaaatatgcaggagaaaaagaaaggaatcaatgttggggtggttggagcagaaggagccaa

SEQ ID NO: 17335 - DNA, 84875 bp, Human; identical to SEQ ID NO: 17334

SEQ ID NO: 17336 - DNA, 84875 bp, Human; identical to SEQ ID NO: 17334

SEQ ID NO: 17337 - DNA, 84875 bp, Human; identical to SEQ ID NO: 17334

SEQ ID NO: 17338 - DNA, 60110 bp, Human
gcgcatccaggacatcacatgtcaacgtgtcctctctggcgtggggtccccgcgagtctgggaaacgaggagctggcaagggagggcaagcgggggcggcaaagagggcccctggagcagggggcgcggacctcgctgcgctgcgcgctctaccgccgggctcgcaacgctgggctcagcgctcgcgcctccctcagctctctcctccgccccccttcgccctccccctttccctccctttctcctcctcctcctgccgccgcggccgctgccggacttcgccagatcagacccacggggctgccctcccctgcgcactcccctcgctgcccgggcccggagcgcagcgcggccgcacaggtaggagcccccaacggggggtcgccccgagcgagcccagtactcactgggccgcgcgcgggagagtgaggtggggtgagctgaggggtgttgagtacccgagaactgccctggactgtgcagggtgtctcgggcagagagggaggtggaggtgtgcagcctcggaatgcgatctgtcagcaagtgcgagtactcgggtgacatctgttgggatgggcatgtgtgtgcgcgccgacaaccagccggcagggctttgcccataaacgtggttttgaaagtttaggggaccagtgtgcgagatttaagccgcacctggattccataggagctggttagaagctgggacgctgagcagctccaggggaccgccgcgttagcttgctgttaagaaaggggacctcatctccctgccgggccaggccgcccgcccgaaactggtaccttgggctgcggtgcgatccctggttccggtcctaggcagcctgaaaccgaaggtagcgtgtcggggacccagactgataagacaaaagagaatcagtcgctttgggctgcccctccacacaacctgggacttttaaacaaagctgtgcgcagagaaaggcgtggaaatgccactttgagagtttgtgctgggggatgtgagaagctctgagacatgtgagaaggtctagtattctactagaactggaagattgctctccgagttttgttttgttattttgtttaaaaaataaaaagcttgaggccaaggcaattcatattggctcacaggtatttttgctgtgctgtgcaaggaactctgctagctcaaggtgagtatactgggaaagccttaacgttctagagaacagagttttgcagccccacctccatcccccggggtgtgggactggggggcaggaaatgcaccgtcccctttgaaatggattactgttttttcctttcgaccccctctttctgcagcctgctttgtaggtgcagtataaaatgcacgctgaatgtcttttgtatgtaaacagcgtagcaggatggagtaacgtgaaatgcaattctacagcagtttttacgtctttgctgcctcgttcgttggctaccgagaaggttcaggagggggaggggagatgagaaagcagattggaagttgagtatggtggagcctcagcctctcccaccctcctttcctcgcttgtgctcactgctaaagttttgttactttccccgcagcagatactaaacattagtttgtcctgtattttctttgagattcacaatgttgaaagcccttttcctaactatgctgactctggcgctggtcaagtcacaggacaccgaagaaaccatcacgtacacggtaaggggtgatggaatttgaaataagtacggttcagcgggattctgtgacaaaaaaagactttacacacccctgccagtgtatttgggctatactctgctgagggtgataaattaaacaacacttcattcatgcttcatatctaagattcgttgtaaattgcccccttgatcctttcaaaagttcattgggctcaccacctaagataggaaccaacatgtaatcatttgtgcagggctaaaaatgggatccgttcaaaaactaaaaccaaagaaagttacatgtttccaaaacattcaacaaattaatgggtgtaaggaactggaaaacctggactcctaccacatgcagataaaaccaatacgtgcagaataagactcaagtcaagtaagaacgttaaacaccataaagacacatggccttctttgtgtacatgacatgcattctcaagtaagtggcctttattgaatttataaaggctatatattcattctttttgtataacttgataattctaataaataaaggcagacaacagtttatgtgttaccaggatgcatattggctaaagtggttttaaaacgtaatgtgtgcaactccgttttgcattttctaattagcgtctctgatatttccaagtaatatttgattagttagttgcataggtgtaaccaatgtttaataaaatattaaaaagatcacctgacccctcccactgctacaaatagttgtggtgagaacagagaaggacagtactgacttcacttctggtgagtttgtttgcacctctgttctgtgttttcttgtctttaatcagtgttaggcaaatgacatttgtcctggattggaatatgaaaagcacatttttctactgctcccagtttaaaattaagtaatcctactcgaaagaatgtgaaaaatttttgaaaagaaaactcttaaaaatgaactaatgtcaattactgataataaacattatctcactttttggtaccacattatccctagaatgttagtattcatctggcaaatgttcctttctgttgttcagatccactataaataaaatagcttaatacaaatattttgttaacttcatgttaaatgcagttgcttcctctgctgaagataaattaagcaagaaaaatgaaggcatgtgctgtttatcttaaaatgaaaatgttttgttattcagactaaacttactgccttctcagggagctaaaattaaattcactacccacttttataatcatctcataaaagattttacttcttttccagttgcttatcttctatgcccttccctttgctaatcacctaaatcttcctcatttttaccagagaaggttccctgtggcttaaacatgatagttttaagaccactaactagggttcattattattgtaacaaattttccagatatgttacccttttgtgctaagattgggcctattctcctttaaattttgtatgcctaataattcatggttaaaggacaagataataactatttctgagtatcccgctgtggagacacgatctcctttgatccttgcggcaatgtgtaaggtaagtggcatcatcttccttctactaatggtagaactgaagatcagagagagtgtctaacttgcttagggctacatagccaagtggtgaagctaaactcagtctaggcttacttaatagtacactgacattaaatgtctagaagtaaatacctaaaacaaattgcaagtcttctctatttaccatacaaattattcaagtgaactgccatttttgcctggcttgaaagatacttttcagaagaatgggctcgtatccacataatagcctcatagtcctcttccatattaaagatggtgtccattcagctgtttactcaacaactatctgcataagcaattctcatcactattaaaagaatttgtttgtttactaagaaaattcagtctcctcttggagaatttagcctgggaagacagtgttgaaaactacaaagttcctaagcaaggacaaatgatactattatacagattatacaaattgccaaggaaatagaaaagcaaggaggtgattaatgttggtgccagcatattagaggagacagaactctgtgctggttcttgaaggaagtgatgaccttggttggattgatctagaaaggctgaagaggcacctgagtcagagagtggcataatcaaaagctagagctgaaagcacctgagaccaatccaggtggtgataaggtcagatcagctggaactgggtagtgggaagaacccagagatggtgatgatgagagatctgcaggtcactgtgaggtctcagagagaggagcaacataaccaagagcacaagaaagatcatggggtctgtatgcagcatgtagagatgcggggccttgcctactcatgggccagcaaaagcctttcttagtagacatggtagaaatggacacaaagtcagcagagatggaaggaaaataagtggagcattcagcactgatgttaaagttggaatcctgggtttcgaaaaaggtagtggtacctttaacactgtttgggaaacaagaaaaaaattagtctgagagacaaagtgaatttagttctcgctccagtaagtttcagacatcagtaaaatatctaaatggatctctgggcttccattcagctatttccttgtcaagcatccattgtgtacataagcagctctcagttatattaaaagaatttaagtttatttgtttgtttactccacttttgctcaatccttccttgggcttcttccttacagtgactttctcaaatgagcgtctgatcagattgtttcctgagcttaaaaattcttcagaggcctcttatcgcctgtagcaacatttctcaagaagtagttcctagacaacctgtatgggaatcgcctgggatacttgctaagaatttagattccaggccccctacccagacctacagaatcaaatcctttgggtgggcccaggaatcttcattttaacaagaaccctgaatgatccttagacacaataaagcttgagattcactgaccttcagggtagaattcaggcttccattcctaaagaaaggctttcttgttttggccctgcctacctctgtaacctcatcctccacctacccagaactccttgcagctccttcccttttcaaaaattttatgcctttgtcacaatagcctctcttcctagaattcccacattcacctggaaaaatcctgctcatcctgtaaagcctgatttactgtcacctcctctgtcaagtcttcccttctgccctgccatgctcacccatgcccccgggcagagtccattactccttcctgcatacacttgtagaaggcacctgccatcttgctgcaacttgtctacctatctgtctcctcttctggtctttgagctgcttgaggacagggacaaagtctgcatcatctttgcatccccaggccctaaaactgcctggtttcagaaggtgatccataggctgtttgttcagtgggtgaactagagaggagattgaagctgggaactgctaggaggaacacctctgttccttaggagctgaagctagggagcaggtcagggtgtgagatggaggtgcttgaatgctgtaagaggatttagagagagagagaagagtccagggctggttgggggtgggggcgggggagagggcgaggaaagagagagaatttggtcttttttttttttaacatttccaatgtgggaaaaaaggcaaattaataaagagcagtcagagaagttggagaagattagtctcaaaacagaaaagaagatggtactgggcaactgtaccaaaaagaacagaagagtttaggcagctgatggttgagaatggacccccgaagctgtccaatgcacagacttgtcttttgaaaaaaaagcgatagaatgttaaaccacccatctcatcatatatctaggactttagcacaaggattgttgccataagaatgaagcttttagagtgatttcttagggaatggacacaccaattaactgtctcctggccccacctttgatgttttcttcacagcaatgcactgacggatatgagtgggatcctgtgagacagcaatgcaaaggtgagccagcttcaaagacttccatgtgatcattgccttctgtctccatctcttgtgtcactcttcctgtcctgtctgtgttataccaaaaaggcatgagcattatatttacatgtttgatttttccctcttagaagattcctgacttattttattactgaccacagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaaggtaggaataacttattttcctaaccattgaaagcttttgcccaagtgcacctcgtggtgaggatgatgataatttattaaggacttctcgcgtgccagacatcatgctaagtgctttgtctgcattatatttaatcatcacaatattcctaaagggtagttgctgtagttgtcatcattgctttacaaatgggaaactgtggcttagaaagttcatcagtggttcccaaccctagctgcccatatttagagtcacttgggaacctttaaaacttctcgatggcgaagctacaccccagcccagttaaatcacagtctctgaggtgggttccaggcatcggcttttttttcagttcctcatgtgcggccaagtttgagaaccagaggtcacacaggtgctaagtgcagagctgaccttccaacccaggaaggcgggtgccaaagtcacagctggcaaaagtcaccatcaggttattcactgggaatttgaaattatgctgtcaagctactctacagatgtacccctttggtttctcaagtttcttttcatcgaacttgccacagacttattttcctcattcaggagtaaagaaatggggctcctgcttctcattaccttggagggattctcccccactcacgtttatatctcttttaagctctcatttgacgacgtttcacttatatcacttgcaccatggcatcatctgcctagggttttctgtttattttcacagagcatacacatcactgtgtattctagaaacagctgtaggctcgtattagcaaagtgataagaatctggggctttgaagacatgtaggatattagctaactgaactgtgctatgagattgtttccctttcttcttggcaaaccatttcagagcagcctggtgtggagactgtgttactgaaatggggccataggagcctccagactcctttctccctgccagaggctgattaggtagatcccatagtgcagaactccatgtcaccaccacatacgtgtatggcacacgtgggccaatggaaagggtccaggagttcttactttctaactggtcatgtgtaaggaagagagcaccttcctcccttaacaccaagggtttcaatagagaccactgagctgctacattaaatgaaagatgcattttcttgtgccctgggatgctgccccttattcacccgtgtttagttttatcttctgtgtaaaagatactcgagtttaaatggcttaaaaatgaagcaaggggctgggcacggtggctcacgcctgtaatcccagcactttgggaagatgaggcgggtggatcacctgaggtcgggagttcaagaccagcctggccaacatggcgaaaccccatctctactaaaaatacaaaaattctctatgaatggtggcacatgcctgtagtctcaaatactagagaggctgaagcaggagaattgcttgaacctgggaggtgaaggttgcagtgagccgagatcatgctactgcactccagcctgggcaacagagtgagactctgtctcaaaaaaaaaaaaaaaaaaaatgaaggaaacttgtcatgctctgactcttatttatttcatattttgtttgtaagctttaagtaccccacatcaagacctaacccatgttgtgatggtgtcacttttcagagggtgcatcgtattagcatctgtttcgtgttactgtcatgagtcagaattccagtattgatgatgaatgcttcagcatctgcttgatattctgatattgaatttaaggattatgtcaaggagataaaatgatgaggttattcttatacatgtatttgggttaatactgataaaaaaaatcttgagtttatttaagatagaccaacttttaattgtgttatttagttatataactagactggaaagtttggtagtatttttcccaaaatcaaaaaattttgctgaaaaattcttaagtatcaacttttatatactgaattattttgaatactttagatgtgtactttaatggtacttgggagaaaaaaaaaccagataaatgaatgagtcatttcccaaagtagtttgtagaccgtcattgacatttatggttgaattcaagaacaatgcccagaactaaatgaagaggtcctagaataaaatatattcaagacttacaacatgtattggttacggtagaaactgtactgtgattaatgaaaataaaatcctatttaacttttctagaaaatatttagactacctaacaaagtaagttacgtttcacatagtaaaacatttatagttctttcttctttgggaattttttttagttataagcagactattaagtgccttgcttatggaatatgctaaatacatacctgttgactgtgtgcacacaggttatttccaacccaaattgatctgtgtaattcagccagtttctaaaatttgggattggtgtctataccattgaaagcagggttaaaagttttttggaaggcttagggcttaagttggatttcttcccacctcacaattttgcaaagtgcccataaatgtggatttacttaattgttgataaaagggggttatttcatatgataacaacaggataatctgtctagggaatttgactaacataagtcgagtcacacttgtgcccatttcttattgagctaatcaaacatgcagtccagcttcttctaattgcctgcagatgtatgacattctcattccaggccagcagcacaaaataatattttataaccaatgtggaagtatggggacctctgtttagaacaataatgtgctctaaggacctatattattgacatcatcatggagtttgaagagtcttctgttttaataaagatctccactcccttttaaatgttgcatatttatgcccagtaatccagacacatttcctatggtctactggatagaataaatgaatcttacagatgagtcttatttgcataaaaattatttcttttttctatgtatattttttagcaggtatagtttatcattatataacctaaaactcaggacattttaaatgtaagaactgaaatctgtactgtgtttcagtcttcaaatcaattgtgcctttgaatgcactataccagtcacagatggcttctaaataatttaaataataccactagatattttaaatgtacactattttataaatatatcctttaaatagctgtccatttaactgtttaatgaaaacatgatatgtttattccccttcatgtatttttgggggtgttttcagttttgtacaaaaacaaggagtttgaaatacaacataacattcaaagatcaggtcacagtgagcaggtttttttcaggtaattttttgctaaatgaggatcatgctgtgggagccagtaacgctgggagtttcccatgactgacattattcttggcatctataaaatgaagatcatttcagtgttacatacctggggccatgtatagatagagttttcgaaattaattgtttccattagatatcatctgcctcaaagacaacagatactcatctacaccaaaaagaagttgaatgaatggggaatatattataatctgttgatggctcactttagttttctacacctttattgcatagtctctttctcctttttttttgagacagagtctcacgctgtcacccaggctggagtgcagaggtgctatcttggctcactgcaacttccaccttctgggtttaagcaattcttgtgcctcagcctcccgagtagctgtgactacaggcgtgcaccaccacaccctgctaatttttgtatttttagtagagatggggtttcaccatgttggccaggctggtctcgagctcctgacctcagatgatgtgcccacctcagcctcccaaagtgctggtgttacaggcctgagccactgtacctggcaatagtctctatataatctttctaaaggagatggagttagaaatcactagatgaagttgagaaaggattttttaaaatcatatataactttctaagacttccattcctgtattaaaaaaaaaaagtcatttgggaactgacaagaaagagaaagcattgattgccctaattgaagaaacttgtttgtttaattgaactttaaaaaaattaaaacacatggcattttgcatacctggtaattaagccactaataaaccctgtcaggacttacaggcatgactactaacttggtaaagaaactgtgccatcgagaaatgaactcagtacgaatgtccaataaagttgattgtaaaaccaaatcgagtacagtacctggcttatgttgtataaagtatcattgagaaatatgaaaaaaacataccctagggtttccaccatctctgtctaccaggactgtccagtttcaaaaccaaaagctccatgttcctggaaatgcctttgtcccaggcaaataggatggttgagcccctagcatacccacacagccaaatcgcctgcacctcacagacaagagtgaagaagtcctaacgttagagccattttttcaggttgaggcattgcttgtccagtgagactatttttacaatttgttttgtactttcaaaagacaaactgcattgatttttaagtagttggacagagtctttctttgcagttgtcgggatcccatttgccagtgtgccaatgagcaagtttctacattgttttagatgttttatgtgtaggatgcctggacattagaacctgcacacttagttatgtgtcatatgtgtcataccatgggaaagttagcaatcttttcacattcccacctagaaaaaatttcaccacacagccaaattaaatactatgtttcacctataaatttttcagtttgctaaaatttttattttttccaactttcagctatattttcaatcattttattttgtcattattacatgtgatacaggagtgattagaacactaaaaaatacatatttgcctcctgtaaagtctaaaggaacaaattacagtgtacatagggttcaaatttaaaaacctctatagtcttaggcatcatccatttatattctacatatttctttataaacataagggtaactaaactactcttttgaaaaaggaagaagttattatctgtacatctacctttgcaaagaggaacttgaagtaacatatacagcttctcagatgctagggatatctttctttgacttctttcattttaaacttaagtgatcttatatccagaagagaattagaaaatcatagtgtaaccaagtggcttagatacctggcattgtcattaccaaacagctttcaaacactgcccttttgttgattctcattaatgtcattagggtcgctggctgcatgggttagttttgtgaggaaatgcctaatttttcttccatataattatacagcccagtgaagacctgtgatctcagaaaatagatattttgcaaaaggaagactataattgagtaaattatgatgttaaccttaaaaaaaagtactttaagcagtaagaaaaatgggcatttagcctccttacagttcttcattgtttttagttgttaattatctcaagtacctgaaaattctcttaagttatataaatggataagagttgagtttacaggggagaaaattatttttcaaataagccgatgcagtgtatggaagtaattgatttactcctaaaaaaaatctagcattgtttcataatttacttttcaatatgctgcagccattaaatttctagtcaatttatgtcattttcaatacacatttgtgagcagtatttataggtatctgattcatacacagtcagaaagtgttcttaaaattgcttcataaaaattgaatgacaaccgttagaggtggaaggatagaagaggtcagtatgatcactctcctgcagcaggactgtgctacacacctccctaattcagtgggtctcaaagtgtagtccctagaccagatgcatcaagcatcatcaggtaacttattagaaatgcaaatttcccaggtcccaccccagactgactgaatcagaaactctggggccagcaccagcaatctggttctgggattatactgttttaacaatatattatataacatatattgttataataagacaattaaatatattgttataacaatataactacatatagttatataacatataactatatattgttttaacaatcccataatatggacgcctactcaagtctgagaaccaatgccttaacttaatcttaacttctgctatataaatcagagggcagggtcagaatacttcacatgggatatgggaagcagtgaaaagaaaacatcaaaaatatacattctgcctctagggtaagttagtatttctattttacttttctcactcttcttactgtcatcaccaatactccgattcctaaacatgggtggccatgagtcctgattaagactgtatccctgaaccaaggacatgatgtatgcaatctaaaggaaaaaaggacatattaacaagaaaacaggatacacatctctatgaaacctacaaatatgcaatcatataactattcttaaattgtcagtaggtgagactctaatttttattctggctatggcaatgactgatgctaagtgatacctatatcttctatagggctcctccttaagttcatggcacaaacttgtgagatgaggcaatgctgtagcggttcggtttgtgtagaaccacaaaagagaaggagattgactctgactttgactgtaaagtatccttcagtcaccaaagtgatatgagatcctttcaatatcagatgcacagctaaccatctctttccatttagactctgtaaatatcagatatttgaagaatattcacataagcatcttctttcaatttaaactttataagaaatttacttcccatcaaagacgaggagattctttttaagactagttaacacttaatctgtggaatgaatttcctcctccccattgaagcaagaaggagattagagtagaattgcaagcccgggtaacttcaggaaagtgcactggtactggctcattatttatttatccagcaggaagtctcaagctatattccctgaaatcaacaagttgccccttttgtaaggattgcctttgcacgtgttgaattgctggcacaattttattctttgaaaccaaagagtaaacaaaaattttcccaatgtgtttgattttacatgaatgtacaaataagtaattcacaccgcatctgaaattcattagcatgttgctttttccaggaggtaattgcaaatcgcacactcaaaataaaactgatcaagaaaactgcatttcaaatattggcaaaagaaaatgctgtcattgcaaaaatttaaaaagaattgcaggtttgtagtttaaactgaaatgatttgtaaacatttaataaaaatgaagtgaataaatgacatgaaaggaaggctgaatgctgagctgttagcataactacagattaaaagaagaaacagctaatcaatgtatataaatgtgtactaaatagactaaaaagcttgagatttgcactaagtcaaattctaaaagttcaactacctttcaaatgattgtacatctatcccatccagggtaactaggcagtattgcaagtgaaattgatcaaatggaacataaaaccattccattagagttcagtgaattcagtcaaatttgagaaccactttctgctgtagcttaatagagtcaaggtagaaggaaggaatgctcatagtctttagggaatttgtaataattgtcccatgagttatcaaataataaaagaaacaaacaacagttcaataaagtaacatgagacatcactggaagtacataatgaattgccaaaagtagatgtaaaactagtatgtgacacaggtagcaccacaattaactaaaatacatatttggacagaaaaagaaaacgtgttctcagaaatgtggttaaggacaaaagtctgtttcctcgctggaatggggcatttgggagagaatgatgaggggacattgggaaatctgacaaggaaattagcatccaaatatcagaggaaataatcatactgtaactgcacagaacaagtgagaagcattgtatcatgtccacattccatctgtcctagaatgatttcccaggagaggtccccagaaacagtgtgtttctgattggaatgctagcaagataaggtggggaagaaaaccaaatcagaaagaacaattgatgaaccactttgcagagcaaacatctatgactggttccatcctccgtaactccaccaaaatgctaatgaattcatttagctctgtctaaacatattccagaactgcattctgttttacttattattgaataggcaattagtatatgttgtttgtataaatgaatagattttaatcataggagaactcagacttaaaccatccttgaaaataagctaccaagtaccatgtgtatataaggtatatttcccaactataaatgttatacaatattagtgtggtccatcagtaattattaaaagagactgtcctgtcccttttaacatggaggtctcagataccttgtccccgttttaagcttatgctacttgaaagaaggattcataaaacctattctttatatcctggattactaggttttccataaatattagtgactaaacaggttggtgttattcctagaggaagactagtaattgggaacactagaattcttttttattttccaataagccatttaaccagggaatgcatttctgtatcaaatacatcctttttcagaaatctcatggtgaataatgaaaatacactttggttgggaaagtgttaatatttatgatacttgaggtcagataatcataagcctgaaaaatatttttgtttttataattttatttttaattgaaaaatatacatatttatggggtgcaatgtgatgttttgatatatgtatacactatgggatgattaaatcaagctaattaacataaccattacttcacttgtttttttgcagtgtgaatatttaaaatctacttgcttagcagttttgaaatatacaccatattattattaactatagtcactatgctatgcaacagatttcaaaatcttcctgtttaactgaaactttgtaccctttgattaacgtctccccatctccccccattctcaccctcagcctctggtaaccacatttttccctctacttctatgagtttgactttttcagattgtacatttaagtgagatcatgctgtaattgtctttctgtaagggtagaaaacattgatgtgagctctctgatactgcgaagaaactcaaggcttttgatgaacttctgtaaaataagatcaagggagaaggactctgagcagtccatcttaccttggacatttccctggctagaaattatccttctcaaatttgtttttagaatccaagaaagtcacttagttgtgtacaggtgatttaaaagaagagttttctgatcttgtcccaaagtagagaagctcgggggagctagataagtgagaagaaaaagtcatagctctcaggaacccaggaagaaagaacagagcttactgagagcccattgagaactgttaactagctgagacttgaactgtaggtgaaataagagtgacgtagggaagggaatccaagacagccataaaaactgcatgtgcttttatgtgtgcctagttaaaatgagaatcatgacaggagctggaactgcatgtagttaaatcgttgtggggaaggtggtgaaataagttttcactctaaacagccttgtgtgttgcaaggaatccaatcctactcccttgagtgaagccacagaacacaatccaaagtgggaaacaactcatggggtccaactcactgcccaccttgcagaccaagtctgtcacaacccgggttagggaagaatttttattcaatgatgatgttagatttcccttgtgaaatattttgcagcaaagccctcctcttgtacatacattcacaccagcatgccattaaattaacatttttactattttctgaaaacttatatatcccaatattttctaatataccagaatgacaaagggcagtgtaagtctgtttttcagagtttgctgtttaatcctcagaatcgtatttttacaatttgtaaatgtgtgatatcaaaagattccacttctaaaaaagaaaagtatatcccaagagaaataactaaaagacactttagaaacctgcctacgtaggctaaataccccttttcttgcctagtttattctaactatttatgcccacacatgtgcacacatacagatacctattcaagtacatgcctatacacatgcatatgtacaaacatgtgcacacattattttcagtaggaaggtaccatgtaccaaaatgaaactgatcatagttgatgatgcttctgaaatgactgaatgcagagagaggtttcctctcattattcctgtaacattaacactggaaactgctttctgaatacatgtgtttacctatcacaagagaacaggacaccctggacagttaactacactttttgctgaacaaagaattgtgttagatggattaaatagaaagtgttgacaaaaaagaagtgaaggtgctgaggtataacctctgaggctttgtcatcatatacttctgcagcaagatgatcatttcattactaatctttctcagagatttgcctggatttcatcctgacccactattttatattgaacaacttaatttttggcaaaattgacatttttgatgaactatcgtttaaggtggattcaaaaatgacttatctgggactgaactgaatctccaagctttttcattcttcagactttggtaaattatatagtcaggaagtagtctgaaatagaactccactcaacaagcaaggcagaaaattccagtcattcattatgaattaaactttgcagtaaaagctgtgggcaccttttgttaaaacagttcatgtcctggaatatcagaagaatcttaatccagggagggagccagaaaaaaaagtcctcccatacaagctggtaaagatgaagggttttggctgggcatggtgactcaagcttgtaatcccagcactttgggaggccgaggcaggcagatcacttgaggtcaggagttcgagactagcctggccaacatggtgaaaccccgtccctactaaaaatacaaaaattagctgggcgtgatggcacatgcctgtaatcccagctacttgggaggctgaggcaggagaattgtttgaacctgggaagcagaggttgcagtgagccaagatcacacactgcactctagtctgggtgacagaacgagactccgtctaaaaaaaaaaaaaaaaaaaaagatgcagggctttgttctgaacttcaatcatatgacctccctccttcagtgattgtcgtgggtcagggtggggggtaagctaatggtaaaaagaaactaaatggaagaaggaaatttaattgtcgtgcaatttaagcagataataatagttctgtagaacaggaaagattagtgaacagctcattcaaaaaaatgttaaatagcaaaactattgtaaattagagctcaactctaagtaaactgaaaaatattttcattgatttttcagtttaagcagaaaaatggattgtgtaagcatgccagagcattagtttccagtaaaccaacctatcacagaaggttaatacaccaaatggactattagaatgtcagtctgttagaaaaagagcttatactatctaatttcattgtaaaaacttggctacaaacagtattaggattctaatagagctttaaagaattattggaaaatcaggctgggcgcggtggctcacacctgtaatcccagcactttgggaggctgaggcagacagatcacctgaggtcgggagttccagaccagcctgaccaacacgatgaaaccctgtctctactaaaaatacaaaaattagccaggggtggtggcatgcggctgtagtccccagctactcaggaggctgagacaggagaatcgcttgaagccgggaggtggaggttgcagtgagccgagattgcaccattgtactccagcctgggcaacaagagcgaaactctgtcacacacacacaaaaaagaattattggaaaatctgtttacagtatcaaagtcaggaacaggcagactttacacattaccaaaagtattatgaacttactatgaaattttcttagtaaaatacatagtttctggtttcagattaaaggaaaagtttatagtgacaagagaaaatcaggaagaccttaataaagaagattacactaattatttaaaaatgtgaatggtatttttcattttctccatagcttcaaaaaattgagtaaaagtcctgagaagtggataaaactaactgcaagcaacagacctgtttatttttcagtgtaaatcttgataggctgagaagataggaaaagaagaatcagtgcaggttcaaattcataccaagcctttgcagttggagatcctaagttttgtaattattctaataggtaatatattattgttatgccaaagctgttgctcagcaaaaaaaaaaaaaaaagaaaaagaaaaaaaaaaaagccactatcccttagaagagaagaaataatttctctgtcacagttaggtgaacctctgtatttagtcaaggttctccaggaaaacagacccaataggatacatgcagagaaaaagagggagagagatttactgtgagaatttctcatgtgattatggaagccaagaagtctcatcatctgctgtctacaagctggaaaacaaggaaagccagtggtgtaatttggtctaagtctaaagggctaaaaagggtgtgggagatgggaactgctagtgtaagtcccagagtccaaaaaatctgagaaccaggagtagctccaatgctcctttcttaagggcaggagaagatggatgtcccctctcaagaagagaaaaagaaaattaatccttcctctgactctttgttctatttgggctttcaatggactagattacatccacctgctttggtgagggccatctgctttactcagtcaattcaaatgctgtctattctggaaacaccatcacagacacactcagaaataatattttaacagctatctaggcatcccttagcccagtcaagttgacacataaaattaaccatcacaaactcttaaccacaaagatcacaactgggtaacagcaattgctgaaaattcatgacttggtgttgcttgcctattggtcaatttaaaaaatatatactgcatgctattatcatgaaaaactcaagctattgatggtacttcctggatcttctgcaaatctcaagtttcagtgacactcaccctctagcaccacctaccaccaccacacagcactcaagtatgaaaatcagtcttctaaggaaaaagcaaaaattcagggagtacctgctagggtaggggccaggactatattcaaacatacatttgtggagaaaaagcaaaaacggagcaaacaactgagccatacctttatcttccaggcgctgcttcttaccctgaaagacaggaccccctgtaagagaaatgacaggcagaaaaaaagttgtggaatgtaactgggagggagaaagagagcaagacaagggagttgaggacaatgagcaatcacaagactataccaatcaaaagtagattctcctaaagtatctcataagatattgtaattaccaactgtccactcatatatgtatgtatacatatatatgtatacatgcatatatatttgtataaatgcatatgtccctcaaaagactgatgaaggaaaatagaaaaggtgacacctaataaattggttttgctgtttttataaaattggctaaagaagtctttagatttgggattcaattgtttaatatgttttttagaatctcctgtgtgttatgcattatagattagtgcttctcaaatattaatgaacatatcagttccctggggatcctgttaaaatgaaaattctgattctgggtaggtctgggttaaggcatgacattatacatttctaacaagctccctggttttgttgatgtatgcagaacctgtcttccagtagctgacagtatccttcctaccaagaaactgatatgtctaatggattcttcatcttctactttctgcagcagcaaatggggtataatctggatagagtcaaatttgcatgtggttacttttcaaaaatacatttttctcctttggttagatactgtttctccaatacaaattacattgtaacagctatagctataaatcacagatatttccctctcttactaattaatagaattttctcctgtagtggaatgtttttatgcttgaatgctcaagaggattccagaaagtagtctttggcagcaaagggtggtggaaaccccatgaaactaagcaagagacaaaagttcccatttgggtcttcccctaaatgacttgctgactttattaaatcagtttatcttgctggatagttttctcagctattaaaattaagagttgtcctttcagctcttacttgaaattatttacaaagaacaggaaagagaaagagacagagagaaaatgagtgcactttgtctaggctgtaagccttgtggatgtatggtgatgatatggttcttgattgatatatgcctggcatttaagctgtttccattgatagttcatttttgccttttggatggcatttttatcaggaaaacataccgaggcaagtcaaaatccaccttgggaagaatgcaggtgcattctgtgattataatagaattaatgactcagaagcaaaaaaccagctggttctaatcacctgaatctttattgacaaaacagttcacacctactactagttgtttgctaaaagtctgcaccaaatcactgaagctttaaaagctagatcactgcagtcttttccccaggcactgacatgggtaattacggtattgtggttcatgccacagccccagacttcatttcaatcctagcttggaaaggagttatttttattttggtgcgcaggaaataaactttttgcatatattaatataaccccatgtaaaatgtaaaggtgccagcactaaatgtgaccagccctttgttatgttcttgattcttgaattaaggtttcccatcttcactggagacgagtgcctttcggcaaagaactatctgtttaaagtctgaattagttcatttcaccttttggaatttctttcagcctccaactcaaaccatgcttacaaccaaagccatgagtcttgcctgagtttacgtattattttccatcacatatgaaccataaggaagtctatgtgctagttaatctgttactgcataacaaattactccaatgcttagtgacttaaaacaacaaacatttattacctcaccttttctctgggtcaggaatcaagttgtggcttagctgggtcctctgactttgggtctctgacaaggctgcagctcattcaaagctcgactggaaaagatccactccctagctcaaatactagtggttgctggcaggattgacttcctgcctctgtttctcataaattcttccaccttcaattccttgccacatacacttctccatagagcatctcacaacatggcagctttcttagcaagtgagggggcaagagaaggttccagcaagagagaggatgctaataagaccaaagttaagagtctttagtaacctaatcatagaagtggcaacccatcaattttgccatatactgttcgttggaaacaagcccctggtgtgaatgccaagatgttggcatcattgagagccatgtcagaagctgcctaccacaatctagaattaaaattctccctgagttgactccaaccatttagagttaaacctagaattttaaatgatttcaaaaagcaaaataggaattcagagcaaaatataccccctccccagcagtgcaagaggctgtatgactcatgcagataggcagcctaatgggtgtggtcagtagcacaggcaaagaagaacctggctgtttctagaagctccttttgagtaaacgtagccttttcttcactgacctgagtcttctaaaatgctatcaatcctcctcaaaaacactcataaatgattccatctccttcaattttaaaactagtttaaagtcttttactccactcaacaagtaattttcataaaacaaaaactttaaggacaagcataaaaactctttattgctgattaacatgtactcacatgcttgttacataaaagacatttaataaacactgctcttgctttatgttaccttttgtcctagacattccaatatttgtgtttgttagggaatcatggatatcacattctccatctctctcctagaaatccctgttctgttctgttcacatttttcttcccacagtctattcaaaaacctgctcctagaatcatcacctttatgtttaaatatgtttacatcgtttcttttgccccaaaagtctactagaagacatgcactgaacatatcctaagattacaataaataggttgtttaagagttaaaacttcagaagcaacaaaatctaacatgaattttcttggggtcccaaggaataggtatctcaataagaggcaggatagtggcttatttttcaacaaagcggcactaatgaagtaggatagcactctgaggaaaagaggaaagatatatgactaaaaatcgataaaggtagaaaccaatttaacaataatagcaggacctataatatgagatggtggcatgaagggacagctgccagccacatccagtttccccatgaagaatactctagtagccagattgtcaattaaccagagagaaaaatagagaaaaggctaattcagctattagaaagtataactaaaatccaaagcaaagttttgggtttttttggtaaagaagatagaaatagaccaaacattcttaaattgcttttaaaagtgcataatacagctctgtatggagcacagtacattttctccttagtttactctcccccagattattttccagatttctccaggtgtttctcatgccaataataaaaacctctgtgagccagttgagtgggttgtgggataaatgggtgcctcacagccaggtagaggccaacccggagcatcccgggaaggctggtctagtccacgaagaaggcagtgagagttggtgggggggatcgtgggggcagtcagatctgattccctttacagtgaagcccagaggggaaaaaagcattctgctcataagatttcctcatattcagccatccatttgctaatatattctcttgacataagtagccccactaaattcctctttcctcatcaccaactctaaaatgacagtttaaggattatcctttctgccacttaccacgaaactcagctccaagccagtttgttgtaggtttctgaacttaaccgcatagctcacaactgagtgtctaatcaatcattctatgactgaatccatctggaacaaatttgaagaagtggccatgtaggtttctttaggggaaaaaaaaattaaactgaaaccagagttgattttttcaaaagttcagaagaaaaaaaattataaaacttagcaatgacttcccccccagaaattgttcatgctctctgaataagacttattctgtcctaccccattctgcattgcatttaatccttcagagaggtgacctgtgaatgtgttgcagcagagtccactttcctgataatgagctcatggtcactacttgggtagaagggaagagggatatggtgtggccaggtggtcaccataacctcatgttgctcttaaattcccaaacacacagggctcaactgagagattatgtaaccaaaagagcctgtttctggtcaattcttgctagaccactggtttttgccccatacgcattaaaggataatttaaataatgcagccaggtagatttaagtactagatggtttttagaactccatctttcctttccttgctaggcccaaattgttaatgtaagtttaggatatacttctccatatatacccttaagtctgcaccatccatgcatttgttcaatctttaatgatttattcatcagttcatgcatcaatgcattcaattaacacgtgttcaaactgtactagaagcctaggcacaccacctttcttacaaggacttcctagtctgtctgaagatgtaacataaggtcagacttttaaaaattaaatgatacaaataattcagctcaataattcaagtcaacagaccctagttgagagcctcagtccccacatcatcagtggtaagtggcgattactgaaaaattctggagaagtcagaggaggaattggtgctgccaccaggtagccagttaggacttttctgagagaatggatgtgatgcagttaatgaaggatgaaccagaggggaacaaacctgagaagaacaggacaggctttggtgggtggacaccctaggtgcagcataatggtgacagtattgtccttgtgtatcaaactctcctttcatgtctcttgctagcatagttaccatacgtacagtacttgaaagtaatgcaattcttttttgagaaactcactcccttttccataaatcatactgacgtcagccctcaccaccactgttccccaccccagtcccagtgtcactgtttgggttgaggcaaggcaggtactgtgggtgcagcaggaaacaagatcggaaaattccattggaagacagttgaggtaggacccagaattcttggttaagccatttagatttattactgtcacaattagtgacagattttgagcgaagagtgacataatgaaaaccctatctccagacaggtgtaggatgaggaggaaaaaaatacatttacacatatggttaaatgtgttaaatcatcttaatgggactgaggtggggagcattagtggtaagggcctatgtcagtctgatttatggaaaagggagtgagtttttaaagaaagaattgcattaactttcaagtactgtacataaagtatgctagtaagaggcataaaaagagagtgtgctacgtaaggactattttctggatcataataattagtttaaaattatttataatagataattcattattttgccacagagcagcttctgctgtgtgaaacagtgattctaaacaagtttgactctaagtagggtgaacagtttgtttctaatattattgagcaatatatttattcgtaggtattacaaagataagcatcaattacaaattaacaagatggtgtaatttcaccccccacacttcatgaaataaccaatttggagttaaataggcccttcaatggtctactgaacaatcagcctctctgcctcatgctcacattcattaaactgtaaaatgttcgttaatcgtagtgtatgactgaaggaatatggagcaagtctctaaatataaactatgtctaaacagtctgttaacaacaattactcttattttagcatgtttaaggcagtcaccctgcaaaatacgatgaattcaacctaagcagagtcattgtaacaaggtttttgcaatattggaaattatagcaggaggcaattatccataggcccattctaccccacaacccccctaccatccattctgcaaataagcatgaactaaaaagtaatctggttgtagatagaggaaagcaacaagttttcctgatacatctaggggaaacattttccagttaaaggttatttttatataaaaataagaatttaaaagcggtacagaaagaggtttgggagtaggggtgaggctggactgccgagctaataaaacaagaatttaagaacataagaatagatggtttagtttatggattaatccaaaagaattttaactggatttcgatctcacttcactaagtcttgactttttttcttgggagaccccacagctagtttggaaaggtaaaacacctggtttatccatttattgacctatttaagtttccattctgaaacacttcattaataatagtcatacctgtacttttccttctcaatggtgggggtctgctggagatgatgtgttcattatctggaatttactttttattttctatcagatttaggaagaataagatcggggaaaaattgatattgctttgttagttacagctggggagatagcacaaaaccccagactaggtatcctgtagctggatccctaaacatcatttcaaagtgtgagactattcaacaagcctgaattaagtaactagtaaatgcaaagcatagtgggtgctgagaatacaaagataaaagcttatggggcctaccctcaaagagttctcagtctctgaggaagcagacagtaattacagtgtgacattttaagtcccattttagtgacttcctagagaaggtgacaccaggcctccgtcttggcaagttgtggcatttagactttagagaagtagggaaaggagaaagaatgttccaggcagagggagcagcatttgctaaggtcatgagaagatgggaaaagggaagagcaagttgttctgcataacttcagtgtgcagtacatgaagatagacaagagtcaaatcatgaagggccttgccagtcatgttttaaagtttgggtttcatcctgaaggtggtaaggagtgatgtaatcagcttccatttatacaaaatgaaagatgccctgtatcagtctgaaacttgtgtatgcaaatccacatgaaatgtgccctctttgctcacaaaggaattaaatgcatcatttacttttaaaatttatttctgagttctcatttgttaacctgtctggataattttattgtaactaattacaactggttttattctctatttataatagttctacaggggcaaattaaatatagatttcattcaagaaataacacaggtctgtctgtatgcttaaatttttatcaaacataaggagtagggaaaatattttagctcaaggaaaagctacagaagtcaaactagccttaaaaattgaatcaacaggtaatgcatcgtttcaggccatttctagtttttctccacatagaatataactgcaactcttaaaggatttttactgtttgaggtttgctccattttagagtctgtgctaccacttactggaacactggattgaaaacaaaattgtaattcagcctttgcagaagttgcaaggaaattttacacattcacgttttttgtcacaacatctcctaatcttgtaagacaaagtgttgtaatgatgatataattgtgtaaatactatggaagcgtcaaatgttatttatctgaactgttttgccagtttatagtataaacatgctagaatttatacatccagcctaatggatatctcaattgctaccttcaacaagttgaggctataaaattatataggccactgatacgtgcctggggttatccagctgttagtttcccagtggagaatgccagactttggtggtcagagcaaaactcgtttaggaccctgagccagccagacaaggtgcttcatccttaagggggctttaattaaggatgaggtgaggagcagccattgccccaagtcagtagagtttccagagatagtgagtttgctgcaattctctttcttaaaaaagataatttggccgggcgcggtggttcacgcctgtaatcccggcactttgggaggccaaggcgggcggatcacgaggtcaggagatagagacaatcctggctaacacagtgaaaccccgtctctactaaaaatacaaaaaattagccgggcgaggtggcgggcgcctgtagtcccagctactccggaggctgaggcaggagaatggcgtgaaccccgggggcggagcctgcagtgagccgagatcgcgccactgcactccagcctgggcgacagcgagactccgtctcaaaaaaaaaaaaaaaaagataatttgtggacacagctgtcctaaaggtcacctgaacaagctactttctgtggtgacctggagttgagctggacccccaaggggagtctttactggtaagatagggaatttagagggaggcttacggacaaaggcagacaagtggcaagaatgtgttgcacgtggcagtaggtggccaggctgatgcagagggccatgtaagatggcactgatgagatggagcccaaggaaaagacaattttatgtatggaaccatctgttatgtggcagtgaagattcagaccaatcatacaggaccatctgcattttgttaacacctgtgtgcacagtcacaggcaggtcttggagccctgggagcctggcagcagcccagcatcactagaaaggtgaagatggcagggacagccctgccaatcctgcaaggagtgcactagagagcctcagcactgggccagggaagctgcccaagaagcagtgtccagggcccacagaccaatagaaggcagtcctcacaccatttcagaggtggcagcagtcagagttctcaagttggaagaatggtctcaggggcaaatgcaaaattcagtatttaagtaggaaggggtcagaaatgtaggatgatgattgataggctaggatgacaacagagaaggagtcagcctagccacgtgattcatcaccctattaccataagcatggtgcttttccttgggccttaagttctttcatttttcctatttgttaatactctctcttacaagagtaacaagaaacagtcacgtatgtacatatcatttaccttcagctataatgaaggcatttgaagaaggtcattttgtattcaaagaaactataattaactttccaaaagaatacttttctaatatgccatggttttactatattactagcacaacatttaaaaaaacaaatattggcccaaaattaaactctcctatctgatatgactgaatgaatgtttcattaaatacaagtggtgtagatcaccatgctgcttagtgaagactctgccaacctgcttatttgaaaagtcaggcatacaacattttcatcttaaagtctaactctaagctttgttattaagaacaaatgaccagaaatccttgtcctggctttatatgcatttaactctatgacatttgaaaatattccctgttttttcatagttctgatcgataattttattactgtcttgaaagatggtgaccacaatgtccttaacattctcaaaaaaataaataaataaaagttgctgctgaaatttacatttttcatatctttttcatagctagaacttgttcacacaatagttctctctcagaattacatgtaggttctaattagagctctagttaatgttatgtgtgctaggtagtctttataaatattaatacttcattgccatgaagcgattctgtagccatcaacagtcctttcctctgataggactgattttatggaatcaaatattatgaaatgcagaagatactagatttgttttgttttgacagattttgttttgtttgaatgttttcaattttcctaatgagaaataacttttagcaagaaaggctgtgtttgcctgttcttgtatccattcatctggaatatgccaaaggaggggaaggtcataccatagatgctcctgttgattgggtgttagtcataaagaccatattgaaaacatgacactaagcaacaaaacaaaggtaggatatttaataatgtgaaagtatatagaaaattacattaaaaaccccaacttcctgcagtgttcttgcttccttccatctgtatatagctgaagtaccaccctgatcccactaccaatttaagtcttcacactgttaagtataatttattgagcacttactgtggaccaggtacctccattttgagtgtgtattgttttaattgtcctcacagtatcattttgaactgaacattccccgacttcatagatgtggcagtgagatttggaagagtagaaaagtcaaataactttcccaggacacataactaaaacgtgatgttgcttggatttgaactgagacctatttgactctaaaacctgtgatcttacccacccttctgtctcaagcatatttctgtcagtgagttgtttaagagaaagagttattctgtgattctcagactttctaaaaagatcaacaagtcctcccctgaactcctaattcttggtataataaattatatataaacattaattcttggtataataaggctagtaaaaaaaagctagcataagcaactacagaaagatacaatctcaaataaaataacttagaacttaaaaatactagctgttagagaatagtatgattcctctaattctgaaactcatgaaaagagattcgtaattgaaggtcactgacagggtacccccttacacctatctggcagcctcacagtcatccacattaaccacatatgtgcctgaagccaaaggttttcacttaaaagtttctataaacaaattattacatttctaggggaaaaaataatcctaggctaattttaaaattaacaatctgaattgctcaatttttccattttctttcaaaatgaaaacttggaatatgatagactccgtggatgtgctccatacagtaaccattttaagtatatataacagatctaagaacgtagagtttggtttttttcatccgtttattcatgccaagaaattctctttaagattgacttagtttggcatcaacctttaacacatcaactgcataactggcttgggtctacctgcctttgtactctgcagacacacaaaccatgtatagggcatgtttctccaccagattttctttttcagaatttgcactgccaaacagacattaagctactctaaattcttgacaagtatgtaactttataggaacacagtagtgtatttaaacattgaagagaactttctattcatcccactcttctaacagagccatttaatcctatccagaaagatgagtccattttcagactctcctttgatcctacagattagagggacagagaagtcaccactgaaaattgaaaaaggacgcaagaagaaatggagatccatgaccatggccccaagaaagcaaaagcatgttactcaggtttcccaagatccaagttagagaggggagaagagattagagctagaaaacaaatacttttaaaaacagcattttggaatttatcaaagtaggctttaatgtcagattcataaaaatgaaacagatctcagagaatgtattttctgagaaacttatttctgtccccaatggaaatgtaaagtaaaatgccccagactcattttaaagtccaaagactattttatatgctagctttgagaagcctttagaattgcaacactcacagggtcagaagtttttttgaacagattttcttttgtcccttatggcctttaggcactccttgagctaatattcaggagttatttgaatgctgttgcttcacaacactgaaagtgttttaacatagagggaggaaaatcccacagcctatgtcatcataatttatcaacaaattaagtccaagaatgcatgataatttatggataacttggaggaaatggtaactatggtatcaatttggaacaaaaccaggaagtcagatctcacttgatttaatgttatctgaaggatttgggcacaagtttaacattttgatcacggaataatcttatgccttaacatgatgaagactgagtcttccttcctgaaaaatccttaatacaggacaagaaataatgagtctaaaatttcgtaactgttttcctgctcaaggaagagagaaggaataaataaccacttacaatgaaaccttttcttgctacacttcatcatgaggcaagtatttcagatgttgggagatagattgtaaaggtataaaagttaacttcacagctatacaaagctatacgtatgtgcaccatgtgtcaaatgagagaaagtatagatattcaatgttgttgaatcctcacaattttctatattagagtggatgcagcatctgtttttcaatttttaatcatcaacattgtcaagcttagagaaaagttgactgtacagtacaattaacaaggaacacccaccgttcagattcaaaaattattaaaactctgtcatatttgcatgtagcatgttaacactgtttttaaacacagatgactagtcaaatcccccacctcctgctgggatccacattgaatcgtttgtgtatttccagtgataggaaactcattatctcctaatacatcaaaacaaataataaccacattttctcttacactgagcgaaaatctgcctttcttgcatttctagccatttattctatttctgctttttggaaatacatggtcaagatcttttcctcttcccagggagaagagcagaaaaaataactattgagtactagggttagcacctgactgacaaaataatctgtacaacaacccccagtgacacaaatttacctatataacaaacctgcacatgtacccccaaacctaaaataaaagttaaaataaaaagatcttttcctccttccctaagctccctttcataaccctgaagatgatctcagatatagatctcatctatgttttcttctcttgtaaattgagtacaaagaaaaagataaggatgatatgaggaggtagggtagggctatgggccttcttatgggctggcatttttttccataaattttgatctgtaatattttcattttcattcagtttgagatttctcaaatttcaatttagctatctttaaaccatgggttgttgtgaagtatgtctaattttccaaaagaagggctttttctagttttgttgttgttgttgtttctatcttatttgcattgtagttggagaacataatctgtatattgcaaatttttgaaatttatttagacttactttaatgccagcatatagccattttcttttaatgttccctcagtatttaaaaaggctatgtattctgtactgtgctctatacatgtcaattagttcaaaggttttaatcacattttctattcatttctgaaaacatgtatttattctttcaattaccaggagaagtgtgttaaaatcttactgtaactgtgcttgtcaatttttccttttagtttcattcatttttttatttgtctatactgagcctatatgattaagtgcatttaaatttagaatttctacatattcctggtaaactgaaacttttatcattatgtagtatttttttaattctctaataatcttttttttccataaagtcaacctcttctaatactaatattgcatagccaactttgttttggttagtgtttgcataaatattttccatcttttttattttaatctctgtgtccttgtatttaaattatgtctcttgaaacagtatatttgggttttgttttttaatcaatttgacaatttttggtttttagtgagtgcatttagtccatttacatttactataaccactgatatgtttaggtttaaaactacctaccattctatttgcttttcatttgtcctgcacattttagtttccttttgttttcttaccttcttcctaaattgatggagtattttgtattattctattttcccctctattagctttgtagttttattttttttttttaccattcctttattgtttttcctacagatcatttgaacatgcatccatgacttatcaaaatttaagatcaattagtacttttaactcttcctgcgtgattcaaggaccttaaaatatttaaactctattcctcttcctgccaaactatatatgctattattctcatgtattttaattctaaatattttataaatcccaaaatactttactattattgttttaggcagtcagtacttatttagatttatccacatctttattctttttattgtgctggaattttgaatcaaaaagagaacagaaaaaagaatttagtgcaaataagggccctgaggcatatggagaaacattgcgcagaaagatcataagtaagatataatgaaatgggcaggaaaatacacacaagaaagtaacattctctgaaggcaagaggcacaaaggtattctttattgaaaaagctttaggcagttaatgagttggagaagtattgccaagttacactcaccaaatttagtagtatgcctcaatttagtgggcacaaaagctgcttattgttgaatgaacaacaagcataatgtaattggtttcatacaattaggaggtcagcaagccatgcttgttataattggcactgccatagtcaggggcttatgcgacctcaagtgatgatttgcctgaaggaataagccaggaatgtgtgtgctttgggctccagagacttgactaatctggctgcaaggcctcagggagggaggccaagaatcaaatcacagtgctcaggcagggcttggtagactcagttgaatgtagtcagtctccattcagttcatcactcaccagtgtttgagccggagccggggaagtgggagatagaggagaggagagatcaagtggccgggaaccaggaaaacacaattgaaatgtcagtgcagaggcatcccataatagggcgggatcttaattcctcccaaggccatccactttgaagcaggtctccagcctgtgtggcatgggcttaaaccttcacacaaagggtctttaatttctagtactgagccactctggagcaaagactgatgttgctgtttgtttcaaaatacaggtttacctccacaaggtagcagactgatgaatggttgttaatatcccaaatatcagggttttcttttcccaaacattttctaaattaataattaagtttaagaaggcctgtaatcccagcactttgggaggccaaggtgggtgaatcacaaggtcaggcgtttgagaccagcctggccaacatagtgaaaccctgcctctactaaaaatacaaaaaattagccaggcatggtggtgggcgcctgtaatcccagctactcaggaggctgagtcaggagaatcgctggaatctgggaggtggaggtttcagtgagccaagattgcaccactaaatgctagcccaggcaacagtgcaagactccatctcaaaaaaaaaaaaaaaaaaaaagtttaagaaggaaaaaaaaagagtttagctgggtatgacatactcacaaagatgccagaaaatactcctaacaattaacaatcatttaacagtagacaatgttgtttccttgagattctgaaagcataagcttcatgttgccagtgggcaaaaacagctgaagaatgagaagtaaagcctttgtttctttgctcttcctctgtttcagcctatgacccattggttcatctggtttatgtgtagtacagatgagtcacagattggtcgttcacatgcattagttggttttcttccccatgttcatgaactgtatgcctaacctcatccaatcatctggcaaatgaacactgttgtccacagaggaagctacgtgaggggggtccatttgcaatgcaaatccgtcatcattgctagaaaagcaattcgaagtagcatgatttttttcctatgagaacagcatattgtaaagttctgatagaacacaatgcaatgccaagggcttctaggacacttgatttcgccactctctaaaacaaagaaatgaactatcagggaggctgataatttgttgattttggtgatatttttgtttatcatttaaagcacaccaaattattaacaatctgttttgccagaactgataagaatctagaactataaatctactgctggccatcgattaagacagttctctcttgttacttaatattagtatttattttctccactagaactgcttagcttgagtgaattctagctgataatttcagaagggtgaaaagctaactagaactgggcatttggcccagataaatctgattccagtactatgaaagaaacagcaagggaactagaaagtctttgacaaaaaaatgttgataattggctaaaaactggggagggaaacagaaaacttggagagctatgaatgttattctaagtagaagaaagacgcaagggaggaatcaaggtgctgtgacattaacaaccctatctttaaggctaaaaaaaattaaaaacacctataaattcacttaaaactactctccagaactcataggaaataagtcttcctcaggacctaaattgcagaaacaaaatggaaatctggtgtttgaatctctgctctgtgtgaccctgggcaagttccctcaactgagtctacatttcagtgacatccttttttttcttcatctgtaaactgtggatgaagtaactacctcttccacagggctattaggattaaataagaagctttgtaattctgccttcccaatcaaataatagatctttttatattgctaagaatttacctatttttataccaattaattttagaatgttaccaagtttgtatatgaatctgtataaaatattatatacttttttctaaatcagatttcaatctacataatttattatattaattactcaggttatcattatcaatagcaaatactggatgagtaaaacagtagtaaacttcagtgccctcaggtcttgctgaagtaattcttaccttccaggattatattgaaaaacaaaatactccaaatacctctaagaccttcactcagtgagtcccttttatttaaaaagtttcagagagtaagtaaaaagagtactttggtaggaactagtttatcaccctgtctctagaaaggattgggagcaatcattttgagcaggtgggtatctaaatcattaagaatgttgggaggaaggaggccaatggtaaagaagctcttccttctaacaaacatgaatcctttaccttgaccatttttctactttactccatttatgagattaaatcagtttgattgaggaagctaggtataataaggttttaaatccacacagatcaagaagtatcaccaacttgaatttaaccactatcttttctttaaccacaagagttcacaggatagcaccattaaataatatttgcaaagcatgcacagtgccccacacagaactagtaaagatacggttattttactccaggggtttacagtctggaaacaaaaaaagtatattgtgaagaatctgaatacttttaaaaatctgtgtgttattgttgaggatagactctctatttcagagatggagaaacaaagagaaaaaattgataccatgaccctagatcacacagggagtgacagattcaaaataatttcagtcttctttgtcctattactagtgcattctcatcactagtctacagtggcttattcaaaagtagttctaaattatttcttaaaccaaaagcagcacaaattataaaagtctaaatggtactcaacaccattcaaggtgcagataatttttgcccatgaaaacatgctaaagggactccatgttgtggtaagttatcaaattatggaaagaacattgcagagattaaaatgttgcataagagagagaaagcagcatgagtcaggggtttgggaaatatgagtcagactgaagggaaggagccaaaaacatagagaatgagggcctaagcagggacttaatggacaccacagagatgtggacaaagttgtctccattaactttgagagaaaatcaaatgtgcggttccctagacgtgggggtcggtgtgataaagaggctagaagagctgagcaaagattagcctgtgttatttaaagcaactaacggtgccaaagtcagcaagagagggacctacaatagtataaatcactaggagggagcacgtgggcacatttttgaaaaatgagggaatcaccaaatattgccattagctattgttaatgtattagaatgacgaaatgtgttatggtattttaggaagcacaatctattattttgttctttggtaatgttaacattaggctctgtctacatagttcagagagactccttatgttgttcaatccagactctctaatcctgcctttaaggccttgaattttgttcacgacagatctagcatttcatgatcctcttcaaccaggcactgcaccaggctcctcacacagagccccggcagctgtgctgacgccatctgtctgccattcttctcatggaaaccagttttgtcttatcagcattttctaatgtgagctgctttctgcctagaaacagcttccttttcctggcaacccatgtatctcgtcttcttcaaaatgcagtggagaacccacctcttctggcgaatctgctttatacctcatagcctctgcactcctggactcacttgctcaacatcatttttcttttactaacatcttactgattttgctgtgtttctcagatataccttgttactctgcttcatacatttttagctccattaggtaaaacactgatcctacttttcctgaaactttaggtaccaattctcagcaaatggtaataactcatttatccatttattgcacaaatatttattgaaaatccaccatgtttcatgcactatcctaggcactgggaatacaggggggaaaataagacatagatcccccatccccacccaaagagcttgggtccaggtcccaggaaatttattaactgactgcctgaaaaaccaagtgagcttaactgtcaaggataaattataatcatgcaaaaacaacaaaaaatttctccccatagtaatttgtcctagattatcaggaaaatcatggctgacctgagtagtttcccttataaataaagcattgcttttgctaatgcagatattctcccatacaaatgtaggaaacagatttttcttacacaccatggagatacctacaaaaggctgtgtttgcactatgggaagtcaggagcaagtagagggcagtggactgtcatcaacactcctgggagagccaccttttccagagcatctgcacagggatgggtattctgctttgagtttctgacatcattgtccattttagtaaattttgtatcatagtgagctttctggtatttatgacaaatggaaatgcatagaagtagaaaagccaaacataacggaatttaacaatgtataataattttatatgactttgcatagatgtgtaaataagtaattccaggatctcaaagtataattttcaaaataatattgtgttatttaaataaactaataaattgacattaacgtaattgaaaataggtcaaagaaattcagtctgtttatagcctttagcattagataaaccaccaacagcaaaggagaggataaatattctaaaccacagccagagaagccataaatggaaatgtagttagtagctgcctcctggtcacagaggtcacttttttgacaattttatgagtcccagtaagtaaaatgtgtaatcaccagtcagtcctaggtgaggcaagtcttgttgcagctttgtttgggtgttggtggagaaagggaaggaaagtagtggcagtgagcacagtggtatttgttttttgttgttgtttgtttttattaatttaactcacctaatatttttattaaataacccactcagaaggtaaacagacctcattcttaagaaggagtagcacaggtttttgtgtttaaaatctacttaatgatacattaattccactggaaatgttagcctatttatcagacactaagaaatgagcaacaagaaagtaggaaggaagtcatagggcatcagttgtaggaatgcagcggggtggaggcagtttgcagatagatgtcaaaaagaaaagcctcagtcactgctgaggcctcccttagaaaatgcagcagccagcccagggccttgatctgctgccagaggaaacttgccacatctgaatctaacattgccgtatctctcaggactgttatcactgcaaatgctggcaaatgttcttgacataaaacaatagatactctgctgtcatttctgcattaacgagtcataaagctctgaagaaaccccagtaaaaaggttttcatcaagtgcatctgagaaaataataaaagacacaaaaaacagcagataatttcaaagcaggattgttgcaccatcgcatagtacctaaaaaggacagtttgtaatcactgacttgaaaataatactagtagtaattataataaatttcaaaacaaaacaaaataacaaaaaccttagccaaaactttaaaaccaagttcaaagaattacgtaagtggatgctttatagattattatccaataaatagccatacatcactcaagtatttttcatctcccctccctctttcttatcgaaagaatctctcttatcatttccacacccagctaagtgaagctgatttctgaggacaacccttttacaatctcaacttcatatattattatactgcatagtgtaaatgcgcagtcctccttgaaaatacagaaaagtgaaaggcaaaccaacctcagggtctactctcagagattcttagagggaagacagaaattgggtgaattttttattattgattctttccctactttttcttccaacatactaccatgagtctgccacagtgatgatctaagacctctgaaatctgcctcaggggtcttaaatcatcactgtggtagacccagggtagtattttggtttttatacaaaaattgtcatctaggaatcacaagttttatgatattgttaatgaagcttagagtggttgttgaagaatgatgaaattatatgatccttttttgtgtactacttaacttcatgatataggagagccgaatgaatataaaagtgatacagataaggcaaaattagattttacttataaattactgtaaatatgaatgtacacacacaaatttatatcaccttttgatctgaaagaaatttcttataactagttcattatgctatcactgagcattttttacttttctagaactgtaacctgcatactcattaaggcacatttagtaaattattccaagaagtacactgctttgagaaaatatggatttttaaactacacaggctagaggaatatgatcaaattgaatcctttgcattctgaaatttgcaatgaaagatttatacatacatgttgccctgctgtttgcaaaaacaaacagctacagggaacgtataatattaaaggttgattacacccagttattggttagatttttagaaatttgtcaatggaaattatctcaaatacaatatattggatggaaaagcaagtatcatacaatctattaaaatttttaacatacaaaacaataccatatgttctaatggatgcatccctgtctaacaaaagtacaaaaacatctcagggaaggattcattcctaccgagacagtggtagctgatgggtcaagggatgaggatggtgtgaggctttagctgtatctgaaatgtttcttaacaaaacaaaatgagccaagaccaacatgacaaaatgttagcatttgttaaatctgagcagtactcactggtatttgcaaaattattttctgaacacttgaaataatttataattttaaacatttccaatgcaagaacattataaacttttaagaataaagtaaaaatttagcttaagaagtggcaaaatggaggaaatatcaacatcttcacaactgacaattctttctgtgttgcatgtctctgacagacatagacgagtgcactgcagggacgcacaactgtagagcagaccaagtgtgcatcaatttacggggatcctttgcatgtcagtgccctcctggatatcagaagcgaggggagcagtgcgtaggtaagtaccacagtgcagtgagcacggtcctgtcttgagtaccttaactgtttcaacctcaagcattccaatcaaagcattcatgtttctttggagagtggtagccaataattccttatttttttatagactaccaatccattttccacaataacaagaaacaaccttaaaggttgagctattctggataacaaagtgttggttaaatgttagacgaagcaagagcagaaatttggggtatgaatgggacaataaaaacaaccacaaaaaaatttaaatttgctgttttgggggccatcgcgctaacacactggtactgtgggcttcattcaccattcactgctgcagagcatagcatagcacagcacatagagcaaatggtggagttgcattccaagcaccaaccccagctcgctttgagaccttgagcaagttacttaaatcctgtgtctcactatgttcacttgtactgtggagatgatactaggccctacctccagagctcatgtagggaatgcttagaatagtgcctgtccctgtgcagtaaagctgtttgctatcgttgtattctgagtcaacagatgggtattaaaggctctttatactgcaagcctttgtagggtaccatgagtacaaagccaagttcagcacgtgcctctgctggagggcctaagagcgtgagctccctgacagcaagaccaggtcatcttgtgtcactgtggtctccccagtccctgaagtgtgcccaccatgtgatggaggctctatgcgtgtgttttgagtgaatggaagatcaaagtatgaggaagccaactggcagatagtgaagtaaaatacagtactctgggctcaatcatgaggcccagcactaggcatgaaactctgactgtccatttatttacataccccttcttaccacagatcagtgaaaaagccttatttcctcttaggaacagagggtgaggatgtggggacagacaaccagcgtcagttttcgcctgagaatgtgagctgttgatgttcacatgtcaacactgagttccatgtgggccccagcccagttctgtctgccatagggctgtgcctagatgctggggttagtgcccagcctctgaggaaggcccagggtttgctataaatgaagctgtgatttaaaagaagagtgtgtagaaaactccagagataacaaagtttggccattgtattagacaggaaaataaatatttgagggcataaaaagtacagaaaaaagaactaatccaacttagtgtggggtgaatcaaagataatggaacatacggtcacagcccttttaatgtggtaggaggaaatattcctaaactcagatctaatcatgtgtcttcccctcctgcttccctcactgagagaatcaagtctacattcctcgacagagcatgaaaggtcttgctcaatctgatcattgtccagttctgttgcataaacacctctcccccaccacaaaatattacaccccagctttattccaccagttccccacacacgtcacacagtgttacttacactttggtgcctctatacaagctctttacacaacaaaaacattccctcctggcaaattcttatttcactgtcaaatcctagcttaggatcacttcctctgggaagcctgctatgatttacccaaatataattagttgctcctcccctgtgccagtacttctcaaattatgatgaaggatacttttttgtaaatttccaatctacggcagaccaatacttctgtaaagcacaataaaaataatgttgcactaatgtcaaattgctatttctaaacatgtactctcagtttctgtatttattcattgcagactggtccaaatagcccatgaaccagcagcagtcagcaggccacacttcaagtagcatggtgctccctgtgtcccatacactcctttctattgttgatcttctcattccatggaataatttgtttcatgcctgtctttcataccagacaaggcagaacacatgtatactgattatcattataaacttggggtgccaaacacagtaccagcaaataagaatggttcaatgaatgtttattagttaagaagacatgcgtcacatattcaccaaatagttattgagggcttactgtgtaacaagcattgttctaggaactgggataatagtaaacaaattttacaaattcatagccctcgtggagctattagaaagtataataccattcatacaaattagctatcaatactagcacctgatgatagtactgaggactaggaagcactatgctaaaattgctcttaattagtgtgaagtttcgatttattcgaataatgtttattgaacacctactactatgccaggccctattccagatctaacaatgaacagacaaaaaaccctctacctccacctcaaggggagaatgtcatgcactatagtgagggaacacacaagaagcaaataaacacataacacaatgtcgagtactgttaaggactacaaagaagtctaaagcaaggtaagggaatagatagggcagaagaacctatttgatattggtgggaaaggtggccaccctgaggaggtgacatttgaatggacacctgaaccaaagtaaggggaaaagccatgtgaatatcttcttactatttatttcagtattcaagttaaatcaaatatatcttgcagcttattagctcccatttatgtttacttgctttgtgccagtaactttgcctacattatgtcttgtaaccctcccaataattctactcacagaagaggaaatgcaagctcgagaagttaagaccaagctagtaattgccagaacaaagattcagactcaggttatcctgaggccacttgagcacactacttaattttagttattaaagtaccaaaagagcccagcataaaggtttgttttgttttgttttgttttaccacaaggcagtgtcactatatagcattacattgtatatgcataatggttgttttaaattacacatgccatgttgaagttgtcacaaagtgtagaatcatgaattaatgaaattttattatgcttctaagatgttagtcctacttagcaagttcttagttgagcattttatagttgaaaatatttatatgagaaggacacaggctggaacacttcatcaaagtgtcaaaagagcactctcaagaggtaacttatttagcatccaattcttccacagtgttcttttatttgatacacaaaaacgtcctaagatacacatggcaagccttgctatccacatcttatagaagaaaaaccaagatactgaaggcgtaagtgacttagccaaggtcaccagttgagcacagcccacaactctttcttctttgttttgtgctgcaccatgcacttcagtagttcttttttacttctgtaattatatataagcttttagctccccaaactgacatcttatatatatatgcaatagtctcaattattttgttttctttaaatctcaatccacccaccaagtttatttaccactgaatggcatgaacattgagtctttgttcttaacttcttaactcagaatacaaagtatatttaaaatacatataccctaattttaacaaaataggaaattattacttttaaaaagagattttctctacataggttttctagataatgcttttcagagaatgctaattcaataatttggttctctttgtgtgtgtgcctgataacctagacatagatgaatgtaccatccctccatattgccaccaaagatgcgtgaatacaccaggctcattttattgccagtgcagtcctgggtttcaattggcagcaaacaactatacctgcgtaggtaagccttttgagaacttgctgatttctgtcttcacaaaaggaaaccccatgccatgttgcagtatttccagttttctatgttcttgagtaaatagtttccatcgacttcccttcagcaatcataaagcttaaaagataataaccaatctgtgtcttaaaacacatcaagatgtgaacagaaaactttttaactttggttttagttctcctctgtggatagatcaacaaatttaaaactacaaatcaattgatatacatacaccagtcaatcagcagtgtgtgatataatgctgaaagtgccaaaggggttactacaagttcaagtatataaactttccactgaaagtgcatctgatttttacatgcctcttctcccctttcagaatgcaatgtcacggcacacaattaaaagattggcatgacatggaaaaaatctagtgtaggaaaaatgccttttcacaatattttcagtgctttagagcattgcaaaactccgtatgggtctcaaaggcttatgttataattgtaatggaatttaacagaacccatttaaaaagtaataaatagcacagataaatcttcagtacagcatgctgagagaccatatcagtataagtgtcttatatcaattatttatagaattggcattttgtatctgaacaacaaaagaaaatcgataccggagtgtatatttattagaagcattaaattcctttggaaagattcatcaaacatcaaactaactgtcattcctagaaaaaatatttcggtatttccaaaagaagtatatgacagacgtttgtagttgttccaacaaatatgaaacctaaatggatgttctccagtgagcttctgcagggcaaataattcagctagggaattactcacttgtcagcagatgacgtaggtacaaaagagtaaggatatgtttaaagtctatatatatatgtgtgtgtatatatatacatatacatatatatatatataaaactttttttcagatataaatgaatgtgatgccagcaatcaatgtgctcagcagtgctacaacattcttggttcattcatctgtcagtgcaatcaaggatatgagctaagcagtgacaggctcaactgtgaaggtaaaactcttcccagatagtatggaataaagtccaattcctgtgactgctgttgttttatctgattatgtacccatttatgaaaacaaacgcttacccatgggaattctgttctaaaatccagttaatgtagttcagttgttacattgcctttttagtgtgttaccaagaaaaaggaaaagaaataaaaataactgaaatattaggtgcaggctggctctaataattagaaagggtgctctagcatgttgcgtctcagtgtgttatccagtgaccaggtatgtcagcacctcctgggagcttatgagaaatgcagaatctcaggctgcaacccagacctcctgagtctgaatctacattcaacaaaaactgcaggtgactggtgtgcacatttaagtttcagaatagccaagtgcatgtcaaaacattaaaataaaaatcaggagatctggtttctggttctattcctgctactgtgtgacttgggcacatttcttgagttgcctgggtttcactttccacatgaacaagaggagggccatttaactagattcatgaccttcagggtccattgcatgtgcacatttcgttatataattcaaaaggcattagacatcctgagggggatgccacagacacttgatgtccctgacctcctcacggttcactcagctttacacaaagctcaaaccccaccgagagaggcctcacatcatgccattacactcaaaactgaaagaggctacctcaggacagctgcctctgcccttctgagtaaactgtagggacatcactattcagaaatgcaaagcattcttcccctgaaagtcagatcctgccaagctgtcattctggaagcttgcacaggttaggggacttggcattcaaagctcaaatgaacttggcttcaaagtcacccaatttctgagaagacaaacatgaactctacatcctggatgggtctgcagagtccaaaatgaaggccgtcaaccacaagccaattcattcagtagtgtagttaggtccaggattagccaaattgtcagcaatgattcagtaaaagtcatgataagaaaaactttttgtgctatgaagtcatagagggaaataagctgatattgttagaatttgccttttagctgcttataaagttttgtatttctatttcagaatttgcaatatttttactctctttagctcacctcaaaagtgtattacttcctctggactgttgagcagaacaaaaaaaatatatatgtgtgtgtgtgtgtgtgtgtgtgtgtgtgtatatatgaaacccaggcaacttaagaaatgtgcccaagtcacacagtagcaggaataggacaagaagccagatctctttatatatatataggtagatataatttttcctccttaaaatataaataattttaattatatataattattttaatatagatattttaaatcttataatttatatatatatataatttatatatatatatatatccaaagtagtggtgcacaaacttttcaactctgtgtcctttctcttgtctaattcaacagacattgatgaatgcagaacctcaagctacctgtgtcaatatcaatgtgtcaatgaacctgggaaattctcatgtatgtgcccccagggataccaagtggtgagaagtagaacatgtcaaggtaagtttattttttttttcatatgttaggtatttagttttagccaggaagagacaagaggaagttataggattctcctatagactttcatttttcccactttcaatatacaatttaagctcttttttcccctgttcatcataaaatatatacatctcataaagaggtgattctatgctaatgccgacatttttcgtccttaaaagataaataattttaataaaatattgatatgtattctatgtaacctacatcatctctttgagatacatcttcaaatcatccactggaaaagattcagttattaaaatgtttcacctgtgagtttgagtttagagcataagctcaatatgtgagttaaacatacctccatccagtcttagccctctaaaacacaaggattataaattgcgtaagaatgtaggtgctgagaaaagtcagcctaatatgttgtaaaatatagttgaatattttagagaaaactactagccccaaaatagctaatgaccttgggtccagtttcaaaataaacattcagatgatcttcacacctatacgtaagtggaagaggcagctccccacaatggtatgatttcagagtttctcaggaagatctaaaaaaaaaaaggaccctacctccaatgttgcatgtagttgaaaattttcttaacagggaaaggactgtcagataaaaccaaaaacgtagaaaatcctggaaaagctagtacaaacacttaaatttacacaaagcaacaaaagaatgaaaaaatgaccaaacttgacagaaaacctgtttgaatcccagctccactgtattcagtctgcacaatcttgaacaaattatcaaactactctgagcctcagcttcctcatttggaaaagggagttgtgggaatttagtggaataacatacataaaaataatttgtaaactataaagcttgtacaggtcaaggtgtttttatgaaatttacttaccaatgtaagtgaccagtagtacgtcttctgtagagagtcctttttaatcagagttggagtgaaggcacacaaggacaataaagatcctgttaagaaaagaaagatcaaggaaaggagacactggggattctcagtctatatcatgattttacaggaaaatattaacttagaggaaatccattacctgggattttataataggcacacaatttttcgactagactccaaccactgagtatgagcataatcagaatgtagttcattgcacaatgaacatctttataaccctttccaggttactagagactttataaatgttaattatgggaaaacattgcattccaatgattttacttactgaaccctaattgagactttcaacatgcatattacatgcaagaaaatgttagctagtggaatgtcttaacaaatttctctggagtccttcaaacaaatatctatgtgtttctgatcaaaaattgatttgatgctcagcaaaagacagaagcagattaatgcacggtgggatccgacctgcctagcctatctatgtggaaacatttatatctattgtaattaaaggtggaaaatgcaccaaaattgtaagtgggggattcctaaatgttatatattgaagatatgcagcttcagaatgtttggttaagccaaaacattttttgtgaaaaagacttagcattcttctaaagtataaagcaattgctttctcctacggaaatcgttccttctgagccttgtccacaggaataaaatgaaattgaaagttttggattcttaactttctctaaaagacttattttgtggatgaaataactgttctcatttcacaggcctatacaaatgaaaactgtgtgtgtgtgtgtgtgtgtgtgtgtgtgtgtgtggagagagagacagagagacaaaagaatacacatacacatagacacacactcatcaaatattttgagagtattaatttctgaaaaatcttccagaatgattaaggtgatgattatgctaggctctacattaatggaagtaataaatgaaattataaggttgtcttttgcttctgttggactccatataacaaataagtattagttttccctgtacctaaacagcatctttattcttcaaaaaagtggaaaatactgaaaggataagtcaattgtgatttcatttgaagaatctaagttttctttcttcagccatagccagcccaagaagacactttttgtaactgtctcttggagactacctagctttcccagtctgttcttgagttccagataactttagccagtttggaagctaaaatacttttttttcctccaaagtcaaggcatgaattatttagagtatatgaacttgaatgagccactaaacccttatttgtttttcatccatatcaagtggaaatatctttctcacctacctccacacagtttgtgtgaagagcaacttagttcaatttaatatttcttaaaagccagatgctctattgcattaatgctaggtgatgaaaggattaaaagatgggtacaataacccttgccctcaaggagtttacaagctaatagaagggttaagctagacatgcagattgcaataatgcaaagcagaaagcaataaaggcccttaaaaaagaacaccgggtatgagaattcaaaagagatcatatcccagcacctagcccatgcttggcttacagcaaggattcagtaaattacttatggaatgagtaaattcatgaataaaaatatctcattgtggagaaggaatgattcagaaaaagtttacattgaataaaatataaatcactattcaaatgtaaagggagacagacatagagatgtagatattaattttatttttattgttgttgttgttgttgttataaatgtaatggctctctagtaaaactgttctctcagatgtcatctggaggcttctgattcccaaatttaaagtcaatctttgtccagcctgaggtaaacacaacccttcttcccaggattctctctccctctgacttctttggcattgccttttcctgggttgtctccctgcactgacagcctcttccttaacttcctctttttccttacagtcctaaaattgctatgctctatgaggtggaacacttcatagtttcacttcctgtgctgtgcttcctctggacagtataatccactcccagcatgcttcagcttactgaaaccagatttctagcctttacctttctcccaagttcctgaaagagatgataagctgccctccatagtttatgcttcctgatttctcagcttggaaagccttccctgccccagccatgaaaactccatctaaccaccacccttcaaggccacgttgagatgcctcttccttccttcagccttccctaatccccctggcaaaattacccaactctgctccacatgccccagtatacttatctatctcttacttaattccattttactttctaagtaatcatatacacattccctcaattataatgtccctgatgacaagaactggtgtttaacttttatataggcagagtcagtggttaacattggggtttgaattcaacagatgaacaataggtgcttgataaaatatcatgaaatgacacatattaatctgcctagaatgtctcagctctgtctgtcctgaattcaatacaatgaacacccagtcttgtgtctaaaagcaggttgaacacagtccagatgctctcacacctccttccttgcaaacagaatctgccagttatatgatttaattagatcagttcattagtttagttagtaaactctttgaccctacatctctacagatataaatgagtgtgagaccacaaatgaatgccgggaggatgaaatgtgttggaattatcatggcggcttccgttgttatccacgaaatccttgtcaagatccctacattctaacaccagagaagtaagaaaaatcagaacttttgaaagtgaggattttctggtcttaccaagccaaactgctgaatacttttgtttgtctctgcagccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgagtaagtatcctgaaggcagccttaactattgagaaagatgggagtttgttgttgttgttgttgttgttgttgttgtgtggtatccacatgtggaaggaaagcaaacatttaaagtgtcttatgtgtaggcattgtgtaaggccttccagctacattatttcatttattcctcttggtaacactgccagatagatattaatattcatctccattttttacagaggagaaaagtgagatgcagaaagattaagtagcatccctgaaatcactcaaatattaagtttggcagactctgatagagttgtgtgtgaccacgaaaatacaagcctcccatccccccgcctctgcccccacccaacataccccccaagtaggtatcactaatcattgatggttaattaattatacatagacatacatataattcaaacccaaaataattcctggagctcctaaagagtttttcagacatcatgaattcatcattgttacattcacaagacagtttgtgttcacaccgaaactaaaacctataagtatgtgagaagtgaccccacctccccgcacagtatgtgtcagtagttgtaccattcttgccaacttctgggctggcagtatggagtcatctccctatctttcattgcctgtgtgaaatctactttctgaattctgccatttccctcttcacactgtctcctgggttatctttgcttcctcacatccctatctctcttcctataaactggctcccgtcacttccatgatcccttcagtggcttctgagctggtctccctgaccccaaagcctcagccttccagtctccctacaaaatctcagcaagttcattttaggttaaaatttggacatattttaaatacggctcaccacttcatgtgaaaatgatggcaccctaccaagcagtttgcagagttacggtaactgtttcatgctaatgatgttattcatccagttacaattttctcaaaactcctttgggcactctttatttttaatcaaattttaaagccaatatttcattttgagaatatgaattaaattgggaaattcatccttgtggtacagtttacagatttttaatgtttacccatttatcctgttttttgatatattaatttcccatatagctccagagttatgtgatattatttctttgccagtatattagaaaatgattaatttctcatgaccaacttctgaaaagaaagacccaatgcaaaatgcaatctattacaattatttttttgaataaaaaagaatatattatagttctttaacatttgatattttaaatttgacatattcttgatatttgtaagaaatttccactgaatgaattttacacaattcagatactaccaattaactaattctagcctaaacaaataacattatttttaaataacaaaatctttaaaaataattttctattttgaacttttagccataatgtaagaaaataaaattttctagcagaataatcaaagagtgaaacaaagttccaacatgttttttctttgcaattaaacatggcacttttacagttatttattattcatatcagtgcacttaccgacttcatattttcaaatcaaaatacagtgtttttctccagtgaaatccttattctcatgactgatagaaaacattgccaattttgatatttccagagttaatgttaaattatttgaaagaaaattatttaaaataataaaaatagacatttcaagactatttcttatcacataattcaaaaagtacttggatcaaatcctacagagtttctccactaaaattctacttgtgcagagggcattgaaacgcatgaaaatcaacagcaggttagttaggttaattaattcggttaattaagcacctactacatgctcagctctatgctaggtgtcatgaggaattaaaaggacatgtaatgcacattttctgatttcaaggagctttaaatattattgtgtagaaaaagttaacatctatgaaaatagaagtggggcaattttgtgcttaattccatggtccagatacatcaaaaaatcaatgtgggctgtcaaagaaggtttcttgatagtcatgagtcagcctgattcttgaaaggatatgtggaatataaaattttatttatattccttttgagaaaatactgagaaaaccatcttccctggaaaagagaacgtattgtaaagaaagtacatgaaattgaaggttgaatatccaacatcccccacactgccccagtgtctctgctcccttactgagccttactattattcttcatagccctatcactacctagtctagtattcactgaactgtgtcatccactagaatatgagcataatgagagcagagactacacctgtcggttcagtattctatcctcagcacatagaatggtacctggcacatagcagatgctaaaataaaatttaaatgaataaattaattcaatcaacaccttcaaggtgttattattacctacaactattgtttacaagaggtatgcaccgtggaagatcctggagacacaacaatgaataaagccaagccagttcctgcccccgtggagcttgtagtcaagacattgaacaagtgatcagaaagatgttgactgctgcagcagagggttgcaagctgctcatgagtatataacaagtagccctaaccaaagcattctctcccttggtttaatgtccacccattgaggtgactgctaaatactaatccatgactctatcccttggcattcaaactcacacatccacttacctgcctctccaacctcatctccctccactcacaagagcccatcatattattcatcaaaatgaaactgcacccagttcttctgaacatattactttacaaaactttcatttatgcctggtgactctcatcaggcattcaaaagctttccctcagtgcttcagggctcttccttttcttccctttatacatacacctttatgtatcttcatacgtaccctgcataacctcatatatcttagcatttaccatattctgttgaaaaactgtttccatttctctttacttactagaatgtaaacagatgcacaatgttgagaaaatgaaaagtgacaactttgtttacaagtttagaaattatcagattctcacttaagctctagtctctgtaaagtccacaactactcaataaaagtgaagaaaaatgttaacagagagggaggaatcaaaaacaaagaactatttaaaaaaaaaaaaaagcaagtccttgaaacttggagctaatgactgtattagacaagggataagagccaagaagagttgaaaccaagaagggaccaagtagtggctcttttataccaccttcaaaattctccccctaattcttataggaggtatactaacaaagcatagaaactccaatccaagaaaattattctcttcctttctctattttcttttattttagcaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggggatctgccatatttgtgttggtttttattttcatatccagcctaaaggtggttgtttattatatagtaataaatcattgctgtacaatatgctggtttctgtagggtatttttaattttgtcagaaattttagattgtgaatattttgtaaaaaacagtaagcaaaattttccagaattcccaaaatgaaccagatatcccctagaaaattatactattgagaaatctatggggaggatatgagaaaataaattccttctaaaccacattggaactgacctgaagaagcaaactcggaaaatataataacatccctgaattcaggacttccacaagatgcagaacaaaatggataaaaggtatttcactggagaagttttaatttctaagtaaaatttaaatcctaacacttcactaatttataactaaaatttctcatcttcgtacttgatgctcacagaggaagaaaatgatgatggtttttattcctggcatccagagtgacagtgaacttaagcaaattaccctcctacccaattctatggaatattttatacgtctccttgtttaaaatgtcactgctttactttgatgtatcatatttttaaataaaaataaatattcctttagaagatcactctatctttggaggtttttcagtgtagtcagtagcccccaatataatttttatatctgggataaacatcagttataggtgccagcacaagaactaccattaggttttttttttaataaataaactgggagatgaggaagcaaaaatacagttaaaatcatgccacaaaacagccaactttttcttaagtctagtttcacagcatatatgcataacctctgtcaccaggtaatcttgctgctaaaacaaatacctctcaaagagttgactcatgtgcagaaattgccaaaaagaaagttcagcaaaagcccaaggaacaaaacacaaactccttctgtgagagtaggggatgggctcttaaaggttaaaggggcacagaaacagtggagagagaacagatctgaccaagggacagcacagaagcagagtcaacaaccagccacaacacagcaagactgttgagttcattcctcttaccctgtctacatggttgcttacagtcaagataaattacagcttgatctaaatgtttccatttttaatcaatctagtgattttcctacatacaaaaacagctctcaagtgagagctgggaatagcaacagttaaagaaaaaaagcctaagaccttcttccaacacatttttccctcttaaacaagaaaaccggtcttgtctatggctccccagggaattgtagaagaaacaggaatctctgacatgtttatgctaagccctggccctcaatttctacctccaaatatatatatatatatatattttctgggcctgcggaagccattaactgcagacaagatgtttgcccttttatcccaaagcctagtcctacccacaaattacagacacaaggaagagggttgatactgaagtttcactgaggcaatttctttgttctgttgtgataaaatttaccattttagacattttaaagtgtacagttcagtggcatggagtacactcagagtgttgagcaaatatcgtcactatctagttcaggggcccccaaccactcccccaacaactgggctgcagactggtacctgtccatggcctgttaggaaccgggccgcacagcaggaggtgagtggtgggcgagcattaccacctgagctctgccttctggcagatcatcccagcattagattctcatagaagcatgaaccctattgtgcatgcaagggatctaggttgtgtgctccttatgagaatctgatgcctggtaatctgaggtctgaggtggaacagtttcatccccaaaccatcccctcacccctccccaccctcatcccccactatccccacccatggaaaaattgtcttccaccaaacctggtgccaaaaaggctggggaccactgatctagttccataacatttcatcactcaaaaataaaccccatacctgttaacagtcactcccatttccccttcccataagcccctctgggagtcaacaatctactttctatggatttgcctattccggacgttttatataaataagatcatacaataatatgtggccttttgtgtctggcttctttcactcagcatgttttcaaggtttagccatgttatagcatgtgtcagtacttcatttctttttccaactgaataatattccattgtatagatctatcgcactttgtttattcatcagttaatgaacatcagctgataagctgtttatacctgtgattattgtttttcaatcttgggtgtcaaaaagaaactgtttcctagactattcatccactagtttcacagcctaaattcacccatttttagtttggcctttgactaaaaagaatagcaagtttaaaaaaattgttttaattcatggaagcaaaaacctggaaaaagctttgagaagctaatacatgagttcctttataggtgcaatcatcctcaataaacgtaaatatctcatgctctcttaatttgaaattgaaaataaatatcatgtctaaaaacaaatcaaagcagta

SEQ ID NO: 17339 - DNA, 60110 bp, Human; identical to SEQ ID NO: 17338

SEQ ID NO: 17340 - DNA, 12415 bp, Human
cgaattacagattcagggagatttaagaaacatgcagtagaaggaatgttcgtgtccctccaaaatgcatgtgttgaaatcgtaacccctaaggttatggtattaggaagtggggtctttggaagataattagatcatgatggtgcagctcttatgaatgagatcagtgccccgataaaagggactttgaagagctctctcattctttcctgccatgtgaggatataacaaggagacaatatgacagtctgtaacctggaagagggccttaaacacaaccagaccatgctgacaccacgatctcagacttccaaccttcgaaactgtgagaaataaatttctgttgtttacgtcacccagaccatggtactttcttacagcagcctgaactaacaaaaccaattgtaatgtatggacttcattataattctgatttcaagtagtaaactgtgtgggccggaattaggaagcaatgagaaatatttgaatgctaactggatatttaatgtaaggaattattttatgttgttttaggtgggataatggcgtggatatgtttttattttttttaattcctacctttatacagacatgctgaaatatttacagttgaaatgattaactgtctgggatttttttcaaaataatctcagtgcagaggaaactggaagggttgtagatgaaacttggaagtggatgtttctctctacttttggatatgcttataattttccatataaaagttctgaaaacggaaaataaaatgctcacattgtgaggctaaggccaaaagaaatcagagatgcatgagaatttccaaattcaggattatttaagaacaacatagagaaaaaaatacttctggtttgagttgcaaaaatttatttcttttatgcaatatactaaaaaatcataattaattgaaaaatataatacttcatatgtaaaggggagaaaactactccaccaaagatgtcacatcttttaattcatttggagatcaaagaaatgtgtctgccaggcaaccaagggctcatggaaaggtgtggtttctgtacaaatgctatttgtctaatattttgtgctgttaatgactgtcccattagcatcttcactacacttactttcatagaaaggagaaacatgatttatagagccctttagtgacaagggtgaggatcctacacactatgttgctggtttcctagtcttcagcaagaaagtgtaggagagaagcaaaaaacgtcctgttcaacccctgctcctggatgtggcaaggaagaggagttacccggcttgaaacaaaagaaatcctaagtctgacacacaatgtcatgtttaaattcccctttctccaaaatgtaaaataaatctgcttccatcttctaaaatactatgggactaaacatccttttgttatgctaaggaaaagccagtattcgcgttgatttagaagagggatgttctggttatagaacgatgctgtgtctcagaaacacttaaatactattaagctagaaatagaagggaaaataatgcttccccgcatctcccctcaagtgtagtcctctttttttagcctgatttccgacgaaatgtctgaatgcctacagttatttggccatcctgaaaagtgcaacttatcctgacgtctcgagggacggaaaagttaccgaagtccaaggaatgagtcactttgctcaaatttgatgagtaatatcaggtgtcatgaaacccagtttcgaaggagaggggagggggcgtcagatctgcagacggaagcaggccgctccggattggatggcgagacctcgattttcctaaaattgcgtcatttagaacccaattgggtccagatgttatgggcatcgacgagttaccgtctcggaaactctcaatcacgcaagcgaaaggagaggaggcggctaattaaatattgagcagaaagtcgcgtggggagaatgtcacgtgggtctggaggctcaaggaggctgggataaataccgcaaggcactgagcaggcgaaagagcgcgctcggacctccttcccggcggcagctaccgagagtgcggagcgaccagcgtgcgctcggaggaaccagagaaactcagcaccccgcgggactgtccgtcgcagtaagtgcccgcgcggtgctggccgcggctgcccgggtcaccccgccccgcatctgtccgaggtggccgcgctgggggcgccgctgcggcgagggacagtggggagactggcttcccaaacgccaacgcccctctttgtcttccacctgcagagtttcctggtttgaaggtgtgggttggtgggttagggggctgggggagttgggattcagggagaagagggttggagaatctttgggacgcgattctctcgcctaaccggtacaggtgagacttcagtccttatgtttttgatcttggttcatccgttgtggggcagaaaattctgttgctttaactcttggataaccacccctaatagatacattatttctctctttggtgtcttctcctcctaccccttcccagaaatccaacatgaaaatcctcgtggccttggcagtcttttttcttgtctccactcagctgtttgcagaagaaataggagccaatgatgatctgaattactggtccgactggtacgacagcgaccagatcaaggtgaggccccttcccaggacggcccgcacccttcttcctgggctcgggagctgtcaccttcccacgcaacagcaccctagttaacgtggcacgcaccgccaccacggaaagaggcagcggttgcgtgcgagaggatggaaaggggcactatttcccgggttccccacgggattttgtgcccacgattcaagtttcttcccgagggctgcaccgtccggcccaggaactccctgcagtagggatgccctcccggatgagcccgagatcctcacaaggcgggaaatctcgtaagatttcatcccccaggacctgggatttcgggggctccggtccagctgcactgccctagcgtctgggcacgggcagaggagggcgcctgggtcgcgggcagcagcgggcacacgcgcgagctgcagggggattggagggccggaggctggagggaagttaatttcctgccttcacgtttgttttgcggacctgaggatgtagcttgaagtctccctttagaaactcgtaggctacaggcgctggggagcgcgcctcggaaaaacggtgaaagtcgtctgtaaagcgttgtcacccttccccaccggagccccagccccagatcccacacacctgtgtgcatttagggcggtgaggactctacaaagccggcaccgagacaagacaaagtcaggtggcggcgcagcagatgagggaaggtccccgggctgggaggaaagagcggaaagcgctcgaagcttgaagacgccgagccagctgctaactcgccctggcaggcttgcggggggcgggacgcgagttcggcggggaggggcgcagagaggcagcgcctcgggagggaccccgctcagcccgagcgtggggaaggccgcctccccacgcctcggggccggagtacagcggggggaagggctcgggttgctgggtgcctcgctctggttgccttacacgccctttgtccgtgcttttgtctcccaggaggaactgccggagccctttgagcatcttctgcagagaatcgcccggagacccaagcctcagcagttctttggattaatgggcaaacgggatgctggtgagataggcgaccgtccctaggtgtcttgggcagcccgccctgtctgctcactccttcctggagtaccccagggtctctcgctctgaatagagatttccactccaagaggggtgtaattccccaggcgcgacattggcccacaccgcactaaggcacgcacgggcccgcggggggagggaaagatctggttcgcatgcctcactgtattcgagtgaagcgctcccttgactaaagatccaaactgacaaagggaaggcacgggcctccaggggtagtactgcggatgatccaagtgcatgtggaagaggattttatagcattccctgaggtgagagtacatttgtcttgggatagaaatatcgtttccttgaattcatcgcacggtcagtggaacatgtagttaatgacaattcgtctcttgtcagattcctcaattgaaaaacaagtggccctgttaaaggctctttatggtaaacattcctataaatctttattttactattgtgaaagcacatgtaggaaagtgaaataaaatcttttatgggctgaaatacaagatctgggtcatgcctgtttaataaagagatggatttgcgcactctctctcggtttctctctctctctgtcactctctctgtctctctctctctgtcactctctctcagtctctctctctctctttctctctctctctcagtgggtggccagccttgaaggtgggatgtgttacagtcttatagttaataagaggcctcagaagtctcatagtcctaggtttgaatcccatagaaggcacttaataaaaattccatttgtttgtttaaatatttagtttttatgattaataatttgtttagcatttatggttctgctttattcctcaggataatatatagatagaaaatgttacatattttgagaatcaaattattttataaaagatataatgtagcatctttaaaaacaaatctatatgtgtttgctaattttatctttcttctaggacatggccagatctctcacaaaagtaagttcaaaattattttgacatttatcaaatttaaatgtaaaattatattgaatttcactttatttatcttaccttattttctgtcatgactctagggcttaatatgtttaatgaagacaatataagaatgggggagattcatattacatccagaatatggttgtttagacatattgtacttagcaaagagatgcattatattaaaaaagaaaaaaatgtcttttaagtcccttcaattgttagttttagagaagaatttcaatcctaggattagaaatctaccatacatatttcttcccagccacccaccccctaagcttactttcactgtaaacaaacaaacaaacaaacacgaaacccccacaagcatttataggcatctcctaactcattttagtatgcttggtccaataatgatgtcatttattagggtcatccagcagccaattaaatggaatgagtgagtgaacatgagtagagaatccatactaaaaatgaagacggtagagatgcagttttttaatcccctaattgaatgggaaaactcgatcagtaaaacatttcttagggcagcaaagatggcaaaattgtggtatgtgaaggtcattaaatttgtttctcagttaatggaaccggagttgacaagaagtggaaagggtctatcttcatcgtattgtccactcacctattgtaccctgtcatggatttggttcattgggtggcagagcaggccacattaacgtagcagctctattctcaactattaaaataaaaaccaagagaaattctctcactagcattaaaatagtaacctttccaaagagttcatctttgaaaaataaatagtattcatatttactttctaaggatttgactttgaagagaattatatataaaaattctatgtaataaaaaatgtactctgttcatgtgaaaactaataaacttttctgaaaggagtatcttttaatatccaataaaataaaaacagtgaccttttagaagattataatcatcaaggaaaggaatctggtttaattaaggtctacttgctgagaagtacaacttattaataacacaaggaattatgcttggatatttcactctcacacaaatgtgaaattgacttcctaaaaaatcaaacctagctcaaataacaatattttatataaaatattttagacccttacataacagataaaatatatgaatagagagtgcttgctaatattaaatatagaattaagaaaagtggtttcattgtattgttttagtgtaatttataaaacttttaaggaatctttatttcttcagtctcaccaaaacttgaagtagatagatatttattatacagacatatattcagaagcttgctttgttctggttataatagtttgtttcctcaaagatatacatattaaaatacccctaaatgtatttttccaggacataaaacagattcctttgttggactaatgggcaaaagagctttaaattctggtatgtatgaaattatgactgaaaatagacagtatctcaaatctatttctattttttctaagacatagttttaaaatattaaaaaggagtggtagatataaaaatgagtattatggtggaaaaatttaattgttgtacttgtaaccacaaatggatttatagctggttaagctaatactaccacagtatctgtctatttctctccaatcaccattcttaccagtgtctgccccatttaatcattaccaacctgaatctttgggttagtgctatattctttcctatagatctgttaaataagccgtgtttaaccttactgaactaagggggagtggggagtgcagggaagaatgagggtgattttcacttgttatcaaagtaatttgaaagttttacaagacattacatttggcgatcttccaatacaaaaataaattcacaaaacaaattctttatgcaaattaatcactttttatgaagttgtagaaattcaaaatctaaacatcctgatggatgttggagaggacaaaagtgatacggtttattccagtactttcaaaaaggaacacaattaaatatccttgagtgttataaattggttctggctataaactccttagagagaaaggatgccacaattctcattttaattctgaacaactttttcgtatgatataaaggctgcaggtttccttctcttcaatttccatcttctttgtaaataccacgtacatatatctgaaaaccattattagttaactcattcatcacactgatttcaatgtaaataacccctagatcattttaatagaagctcactttttgttaagaccttatagctcttacctctagggcttcttggaaaagctattcaaattctattttgccttcagtgaaaatagaattaaaatactaaatacgttattaattataaagtaatcagcagctgtcttacccatttagaatatttccagtttctagacaatctataagatgtgctggcttaatccttaattatctggatcctaggaaaaataattatcctagtgttttttaatggagatttttttctttattgtgaaatgtaagacttgggtacattaaataaaaccactttctgtggggcaaaaatcaaaacgcgcaatagaaaaaaaaagttaacacaatctgggctacggcagaagccagagaatatattcatataattgaaaagttctaagtgtttcataattgaccttttgatacaaaatttccaataaatctggaatttgaagttcttggtgaagtccacaggacttcctagtgttcttattgggtccccactttctatttagacactacctttgcatcttctcaccagtcattttgggctgccgaagtgtaaaagtgtaagaaattatcaatgtgccttaatgaaaaacttgtaattgttttattaatatgtattatcttcccacttttggaaatgaaatataaatttaaaccacaatggcttttatttgtaccaatacatactagtcctcacttaattgtagttttcttgataatcatattagtcatcaactttccatttccagaattgatataggtttcagaacatgcttaactttacaaatgtagatattgtacaagttagaacagattaaatacaattaaatgtacttaaaataataacataattttaagtagtgataaaaatcactgtagtgaatcaggatcaatttataactaaatctttgttcctccattttagttaaggaaatataaataggtgaaatgtggaaaaaaatgtgatatgatccacagtcaatcagggatctttttatgtacctcattgaggcaaggttatcatagccttaatctatagccctctgatctttacccactcatggtcagggacccctttgacaatctgataaatctagatagatgccctttcccagagaaaccctcatcagctcatacactcaaaaatttatatcaggcttcagagggttcaaagaccaggtaagaaactctgcttccatgtaagaggacattatgttccagctaaatcactgtctgtctttagttggtttacattagctttcatctaatttctctgaggaatagagtcatgttacctaaagcttgtcagagactgaacttgggccattcatcctgttcctaatataatcaaaccagaatgagaaataaactgtttccttccctcacgcctgtccagtgttggctcagactgttctgcctcacaagtgcatacttaattgatgtaaaatatgcagcttattgttaaccgcacttaaaggatagctgggtgtttaagaccagtattaaaagagggaagtgataatactggtgcctttacctgtcttctctgtcagcaaatcttctcactgaggaaactgtttagagtagcacttattattcctacagatccttcacagatctttctactctttctgtttacattcagtattttatacaggccatactgaatttcaaaaagcatagtagttccactataccatacgtctaagtctataaggtattcgttaaggatgaaaaatatcccaaaatacttttattgcaacagtctgatttttacccctttgtggttacagatccctttgaaattatatataataaatataatataatataatatacaattttggcatttttttgtccagataatcaatgtatttaaattacttgctagctatatgttaaatacctttggaagcaataattaatgcttcacaggccattaaggtgctagtgaaaagttaaacagtatggtatttagatggctcaactgacttacctatggtaaatgggctgtttttagtcttgagggcagtccatcactgggaggtatccacaaggtaggaagagacccctacacaattagatgccccttgaacaaagatcagcaaacttttcctgaaaagaaacagattataaatattttaggctttgtgagccatgtaatctctgttgcaactacccaaatctgttattttaggccaaagcagccatagacaatatgtaaatgaatgagtgtgtctgtattcctataaacctctttacaagaacaaatggtattctagatttggcccatggtctctgctagaataaaagtcccacatttggtttttatcctactagtattcctggttattttaggcattgtcctttctagaattcactatgggtatctgccactgcttgagaaagctgctgagaatcaacactgcaatatattgtggaaatatgctttgggggcaccaagtatatgatgaatgatgaatgaaaccgagttctgtggttagatcatttccaatcagaatagagactgaggcaggattggaagatgtgcagataacattcttagaaatacttctgtagagggaaaatgtcattatgagtttaaaataaattactatatgccctgaactttagttgtgtaactccctcagtgaattcacttaaaaaacactttatctcttctttgttttcagtggcttatgaaaggagtgcaatgcagaattatgaaagaagacgttaataaactacctaacattatttattcagcttcatttgtgtcaatgggcaatgacaggtaaattaagacatgcactatgaggaataattatttatttaataacaattgtttggggttgaaaattcaaaaagtgtttatttttcatattgtgccaatatgtattgtaaacatgtgttttaattccaatatgatgactcccttaaaatagaaataagtggttatttctcaacaaagcacagtgttaaatgaaattgtaaaacctgtcaatgatacagtccctaaagaaaaaaaatcattgctttgaagcagttgtgtcagctactgcggaaaaggaaggaaactcctgacagtcttgtgcttttcctatttgttttcatggtgaaaatgtactgagattttggtattacactgtatttgtatctctgaagcatgtttcatgttttgtgactatatagagatgtttttaaaagtttcaatgtgattctaatgtcttcatttcattgtatgatgtgttgtgatagctaacattttaaataaaagaaaaaatatcttgaagatttttgtcacatgtcttttattaacatttatgtccaattagcaatctttcctttaataggtgaaataggttcaaagcggttttgtctaaaatgcagtttctctgtcatgcactttttttgctaaatcacttgtcatgagatcatttatgaagaacacaattgcattttgcattccaaagagtaaaggctaagttctggttttatatgcttttaattcctttttacaaataggataataatctatttcaaagatatatttcactgattattttcttgttgagtaaaacatcagctcactaccatttcagccctgctcagagcccaggtataaatgcatcagtgcctgagtctcactagcattaagatagcaaatcaaattctcacaaagattgtcggaagatgatacaggaagatgaggtgttgataatagggcaacaccctcacagcaaaaataagaactcctttccagcatttctaagaagtgcctgtgaattgctaatacctataacactctctctgtctgatagaagcacatgcgtcaggaataaataccaagcattgagagggaggcttgtgcattttgattgataagtgtccttggaatcattttctgattgcatagagcatgtgaagtattgaccagtggtgaaacaatgcagacaagcactgttcagtgaagtaaaaaaaatgaatttagcctggactggtgactgttggtgagcaataaaaccatttgtaggagagaagagctaaagcatattttaacatacatattttcaattaaatgtttttttaaaaaactccaactcatattccttagtacacaatacatctaaatatgaaaaattatataatggtaagcaaaatggagaaaaccagagtcatcccctagagccccactccccaacagcaatgtttaacattccattgaataataattataataaataatcattagctaaaattatatatgtacttaatcactcaatgacaaaaataatcgtcattattatcattttacagatggggttatgaagcttaacaaaatgctggggtcagagattataataggagtcaggattggaaataaactgagggggaaatagagcaaatatctaacaatgaaattgattaagcaaacgtactaaaacaacagaatattatacagtcatttaaagcagcatcatggtgtatttaataatgtggaacatatatggtatgttgttagacataaagcagtatttgttatatatatatttacatatgtatttacacatatatatatagtttttctgcatagctgttgtaacaagaggaacaattttagtggataagcacatgggactcaatgtcatactactcaggtttgaatcttggctctatcacattatgaatggccttgtaaagatgggcgagtcccttaacttttctttgccttattttcctcatcagtaaaattagaataacactagtactcactacatggcattcagctgagggttgagtgaaatgatgcctgtaaagctttgaacacactctctcacacacagcgagcattcagtgaatgttacctgttcccattttaagctactgttcaaaatgccagtgtgaaaattagttctatattttagccataaaaaatgtttatagtcactagacacactgaacaagcaacagcatggggtggtatttaaatctttgcttcacaaattaaatccaggctatatcacaaatttgcagtgctttgtgctgttcattgctgcactaaatagtccccgtggctccttcccactctgaaattctataaatctctgtggtatgatcccacagtgctacataaagacatgcattggcggaacttcactcatgcctgctttccctctaggcccagaaacccagtagcaacacaaataggaaaagggacagaaacttcagtttaagtttctgctcaaacaatttattattactttctctttgtgctatatttcctttaaagtaag

SEQ ID NO: 17341 - DNA, 12415 bp, Human; identical to SEQ ID NO: 17340

SEQ ID NO: 17342 - DNA, 12415 bp, Human; identical to SEQ ID NO: 17340

SEQ ID NO: 17343 - DNA, 12415 bp, Human; identical to SEQ ID NO: 17340

SEQ ID NO: 17344 - DNA, 54444 bp, Human
ataaaaaaagacatgaaatgaatcggggaaaatatttgctacataactaagaatgaaggcccttaataaaatctgtaaaactatacacacttttaggaatgaatcaacaaataatttctatgaattagaaaaaagtgacaatccaactaaaaaatgaataagggatataagcaatgtgtttcacagaaaaaataaaaattgacaatgaagttatgaaaaaatgttcagtctccttagtaattgcacaaaacaaactaaaacaatgagacattacccctaagattagtaaatgttaaagaaaaataataattggtgagggtgtggggaagtgggcacttacacctatgtttggaaatataaattggtgcaaccttatagggagagcaatctcacaacattttccaaagacttacatgcacaaccctatggcagagaaatttattcctcttccaggattttttttccttcaaaaacagtgatgtggatgaaaaacacatgttcactactgcacagggtataacagctgaaaactggaaacgataatactcacattcccttcagtaggggaatggttaaataaattttacaagccatctggtagataccaggcatgagctaaaagttagggtccagttagagatggaaagcacaccagtaatttgaaagggaaaatgtaatatgaagaattattaactagtaaaagaaggctaactgctaaaggtacaagagcactcaagctgtctgcagtcagcaggccccggctggtgagcaggaagctgcccgctgggaggctgccaaagttccctgaaggtgagcaccactggttctacaagctgctggcagtcatggcgttaagagcaggaagagaagcaccagaacccggaagagaaatccagtcctctgctaggccttgcaccgtccctctggcgccctctactgacaaagccagtaaaattgtgccgctagcaaaggagatctttttatgggatgtagcttggtgtcaccaaagagaacagagtggacttggagctcagatgcaacacaatgattgatactggcacagtatacttaccctgcttttgtaaacaaaatggtatatgtgatgtctctctttgtctctctgtatataaaacaatatttgtttctacttattatgtatttatgtctttactctgcatgccaggagctaagtattttgcatgtattaactcattttgttctcataataaccttcacatgcaggaatcattatagctactttatgaatgagccgaggaaggcactgagacgttaagtaacttgcccaaggtcacgcagctagtaagtggcagagcaagaattactatggctttataagcctaggaaaaagtctgaaagaatcaaaatgttaacagcggggacctcaaggaagcattgaagaggccatgggagaagttttcactttgttaaaaaatcagtccttcaaataaataaatacagtgaggcttccccagaagcagatgtcactatgcttcctgtacagcctgtggaactgtgagccagttaaacctcttttctttataaattatccagtcttaggtatttctttataacagtgctaggatgagctgatacagtttcctacactgtaacctaaggcaatgctttgcacaaagggatgagccagattgcttagtaattaaaacgcaaatacaaaccacaagcatatccattcatgaattggggggctgctttgtgtgcatagataaggtatattttttaaaaaaattatttttccaagaagaaaataaaccagttaataaacgacaactcacagtgccaggaagtgagaaacaagtgtgtgataaacggtggagaatgggagcactctccgcagtgggcgggaggagacgaggagggcgttccctggggagtggcagtggttggagcaaaggtttggaggaggtaagtcatgtgctctgagtttttggtttctgtttcaccttgtgtctgagctggtctgaaggctggttgttcagactgagcttcctgcctgcctgtaccccgccaacagcttcagaagaaggtgactggtggctgcctgaggaataccagtgggcaagagaattagcatttctggagcatctgctgtctgtgagattaagcactatgtatattgctttattcactccccacagcaaccttaccaagcagttcttttccacgtgaaaagatggaggctgggtggagcaaaaggaggtatttagagtcctcagcaagtgagaggcagagctgggatttgaatccagatctgcctgatactgaagtctaggctggttccacctctccggactgctttccagggagtagaagacagatattttaccttagctggctgcttctagaagtctgaccctgctggctcaaaacgactttagttccttgcccagaggctgcgggctgcgggtcaagacatcagtagaaggagggcccagccagagaggctgacatgggcttctactcaccgtcatctctccttccttccaggagcagcccctgggtgcgtccactttctgggcacgtgaggttgggccttggccgcctgagcccttgagttggtcacttgaaccttgggaatattgaggtaagcctgggatttccagaggaggtttgggggaaagagaagtggtgaacgctattactgttccctatctagacaccagtgggccgagtggagcagatgccagttgggaccttcccgccctctctttggttattaatccattattgttccctgtacactggtatgagtggatgggggaagtatttagccaagtttttgagacctgtactcggagctaaaatgcattgtcttcctatagtgcgggaccccacaactgtggaggagccgcaggggatactgggtagtacgcagacattatgcactaaatgacaatggctcacatagtgaaaagttattcttttttatttttttttttgagagggagtcttgctctgtcgcctagcctggagtgcagtggcgcgatctcagctcactgatatcgccgcctcccgggttcaggtgattctcgtgtctcagcctcctgagtagctgggattacaggcacctgcttccatgcctggctaatttttttttttgtatttttagtagagatgggggggtctcaccatgttggccaggctggtctcaaacttctggccccaagtgatctacccaccttggcctcccaaagtgctgggattacaggcctgagccactgcacccggctgatttcacatttttagataatatgaccacattataaaaatttatgtatttttatataatgtgaccactagatgaaagcaatatacttaggcttttatttcttggttaagttcctacttattatgaatttactctgcatgccaggaattctaagaatttgcatgtattaactcatttgattctcgtaataaccttcacatgcaggagtcactattacagtgactgtatgaatgaggaaagaaaggcactaacagaattgattttatgttacttaggtcaagattttatgttatttaggtcaaggttaattgtgttgttcaaatcttgtataactctactgcttgtctgtctttcttacccattatcgagaagggaacataaaaatcttacactatgactgtagattgtcaatttctcattttaaattaggatcatttttcctttatgtctgccttatgtgatattagtataatgatatcagttggtacatctttttccatccttatactttcagtgtttcggtgttcttatacttgaaatgtgtctgccgtaagtggtgtattgttcaagtttttcttttattatagaaaaatgtattctggaaggtacttttcttaaaattacagtatttagtccattttcatttaatgtaattgtcaatataattgggctaaaatctactatatttccagttgttttttattcgtggcatcaattcacttttctctactttcttgatttcttttagacgaattaagtaattttagaaagttcaccttactcctttattagcttgttaattatgcatgcttttagtattctcttagtaattgcacttgagttgtactacctaatagtacagccacatgttgtttaaaacagctttactgagatatgattgatatacaacaaatggcatataaagtatataatttgataagttttgacatatgtatgacatatatgacagtcatatagacacactcatatatatattcatgtgccatttcagtcaatgaccgaccacatatatgatggtggtctcataagattataatacggtatttttactgtaccatttctatgtttagatatatttagatatgcaaatacttaccattgtgttacaattgcctacaatattcaatacagtaacatgctttgtaggtctgcatcttaggagtaatagtctagaccatatagcctaggtgtgtagtaggctataccatctaggttttgcataagtacattctatgatgttggcataatgacgaaatcactgacgatgcttttcttggaacttatgcctgtcattaagtgacgtatgactgtatatatttgagtggaactatcactgcagtcaggatagtgaacatatatattacctccaaaatatttcgtatgccctcttgaatcctgtcctcctgcccctccccacccctgctccttttaggcatttagttctgtaaattttctcctagccttgctttagcggcatcccatgcattttgatattttgttttgattttaatttaattcaatactacataatttccttttgatttcttttttgacccatggattatttagagttgtgttatttcatttccaaatatttggggattttccagacatgtttctgttgtccaggccaataacaaattcctgacgccatgaagtcaaagatctaactccccagggggagagttatgcccaagaaccatcggtattttgtgttagtggtcattgccagagtgaattccacagtgtttgtgataaaccctaataattccaccagagggcagcaagccaacatgaaaattctattaaaaagtctttttttagagacaagagtttggctctgctgcccaggctggagtgcagtggtgtgacctcggcttaccgaaccctggccccaccgcagactcaacctcccaggctcaagtgattctcccacttcagctccccatctgcgagtagctggaatataggtgcgcatcaccgcacctagttaatttttgcattttttgtagagatggagtttcatcatgtttcccaggcttgtcttgaactcctgggctcaagctatccatctgcctcggctgcccaaagtgccgagatgacaggcgtgggccactgtgcctggccagacagaagttttcaagtaaagaataaatttagctgaagagcagtgtcaaattatttctatccccaccctcctgaattaaatcttcgtagtctctgattctctttgtcatattcttaaccatttggattcttttcagtgcgtctgtgtttgttccttttccccagtatgacccctttctatttttttttttttttttttttttgagacagagtcttgctgtgtcgcccaggctggagtgcagtggcacgttcttggctcactgcaacctccgcctcccaggttcaaaagattctcccacctcagcctcctgagtagctgggattacagatgcctgccaccttgcccagataatttttgtatttttagtagagatggggtttcaacatgttagccaggctggtctcaaacttttgacctcaagtgatctgcccgcctcggcttcccaaagtgctgggattacaggcgtgagccaccttgtccagacccttttctctatctttatgaaaacatctctccagtagatcttcagagtaaaaaaaaaaaaaaaaaaaggaaaaaagaaaagaaaaaagaaaaagaaaagaaaacatccagcaaggtctcggaggaaaaatagaaaattagaagactggagtgagtcatgttgattttctggtgtaaaatttgtatcgaaaccttacataaatactgaagaattcacaagttgtaaatatacagcttggtgactgattttgatatccagacagtttttttcccacttgcacacactccccgcaagaatgcatgctggtttgtaaagtcattaatttactggtgcatcagtggatggctctgtgtcttctggctttatcttggcccagaaagacaggaattaacgttgagcctagtagtctttggcctttgtgccaaagcagtctgtgggccagccttgtgtagtgatcaagcagtatgtttagatgtcaggcatgacacgggttaaaaagccagctaggggaaaaatgggaagtggcattttgcgatctcatcaaacaatcttgatataaacttagagaacagcctcttggcaaatggagagcagctgtaggtttctgactgaatgtgcaagaagaacgtgaatgaaagagatatactaggtgggagcagtcagggtagacttcctggaggaagtggacagtgttgtgtggattcacactttggagatatcaaagaggaagagtattccaagtgggggtaacaaataacaagggaggcaaaaaagaaaagtatgagggaacaacaggatgttgtcaggaaactaaggctgagctgaaatccaggtgacccagagaagccttgagaaggcttgtggcatcttgtggagcaagtggggaacttgctctgtttgagagaatatgcctggaatatatgggatatcatttaaattttctaaaggttatctacaagataatttcagagaatattcgctcccacctcagcgtaggaaacaatgaaaccctgaaacatttatttatttattttccttgcttttcttttttctttcttttttttttcttgagatggagtcttactctgtcactcaggctggagtgcagtggcgtaatcttggctcactgcaacctccgcctcctgggttcaagcaattctcctgcctcagcctcccgagtagctgggacaataggcatgtgccgctatgcctggctaattttttgtatttttagtagagacggggtttcatcatgttggccagactggtcttgaactcctggcctcaagtaatctgcccgctttgggcttcaaaagtgctaggattacaggtgtgagccactgcacccagtcttttccttactttttattttatttatttatttatttattttttaattgatcattcttgggtgtttctcacagaggaggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcacagatctacaggatcccaaggcagaagaatttttcttagtatagaacaaaatgaaaagtctcccatgtctacctctctctacacagacacggcaaccatccaatttctcaatcttttccccacctttcccccctttctgttccacaaaaccgccattgtcatcatggcccgttctcaatgagctgctgggtacacctcccagacggggtggtggccgggcagaggggctcctcacctcccagtaggggcggccgggcagaggcgcccctcatctcccagacggggcggctggccgggcggggggctgaccccccacctccctcccggacggggcggcttccttactttttaaaaatacgtttgtcttcaactattggatatcttcatctaatttctagtgttttttttggttgttgttggcttatttgatttttactttttggttaataacaaaccttttaaggagttacatagactcttatcagtttacttttctaatttgttttctcctgaattctcagttaccttggattgattgtgctttgggttcatcttgctttttcttagtggctactttcagtttccttcctcttcagtttggcaattttttcccttttcaagcaaggagctcctccctgttgaggcgtcacgggtggcgggcaatccttacccggatcctcccacagcttgctctctggaagctcacactgcaccgtaattatgaaacttttgatattgtccctgatggcttctgatgcaagctgggacagcatttgtctgttgataagtgaaaccaagttcctgagatctggctctcttttgcccttctatccaataccagcaaggccctagtttcagagcattttggggacttatgatcccttctagttacctctgcatctgtgccccttttcccctcaaattagttcatagagatttttgaagcacccatgttactcaaataggcccatttttagcatgtgggaggtaaggcctagatgtgaatccctcataagccaggcagatcaaactgtgtgtatgcatgcagatttggcccaggaacactcttctccttcagggcccattgtctacaaggacagaaaagaattcttaaggccattcactatctcacattttctgttatttttctgtcttttccttttccccctacccacagagaaacattagaatcattgccctttagaagagcagaactatgatgcctcctgtcagggatggaacgaggcattccatgcagatgacaacccaaagagagcaagagtggctctatttatatcagacaaaatcgactttaagtcaaaaactgtcacaagagacattaaagtatattatataatgaaaaaagcatcaatccaccatgaagatataacaattataaatatatgcactcaatatcagagcacctaaatatatgaaacaaacaatgacagaactgaagggagaaatagccagccatacaaaaatagtaggagacttcaacactgtactttaaataatggatagaacattcagacagaagattaataaggaaacaggggacttaaacaacattatagaccaaatggaccgaacagaaatacacagaacgttccaccctacagcagtagaacacacattatcctcaaatgcacatggaactttctccaaggtagatcacaagttgggtcacaaaacaagtctttgcaaatttaagagactgaaatcataccatgtatcttttctgaccatgatggaatgaaactaaaaatcaatggcagaaggaaaaatagaaagttcacaaatatgtggaaattaaacaacacactcttgaacaacaattaggccataaaaataaaaaaagaaattaggaaatatcttgagataaatgaaaagaaaagcacaacatacccaaacttacaggataaaagcagtactaagcaaagaagtactaagaggtactttattgcaatacacatctgcagtgaaaaagaagaaagatctcaagtaaatagtctaacttcgtgcctcaaggagaggagaagaagatgaagaagaagaggaactaagcctaaaattagtgaaggaaataacaaagattagagtaggaaccaagaaaatacagaatagaaaagcaatagaaaaaaaatcaacaaattttttgaaaagaataacaaaagaattggttttttgaaaagataaacaaaatcaacaaatccctagttaggctaagtaagaaagagagaagactcaaataaacaatatcagaaataaaagaggagacattacaactgatgccacagaaataaaaacatgaggctataatgaacaattctattccaacaaactggataatctagaagaaatgaataaattcacaaaaccttccaatctacgatgactgaatcatgaagaaatacaaagtctgaacagacttataactaatgtggaggtttagtcaataatcaaaaatgttccccaaacgaagaagtccaggaccagatggcttcacaggtgaattcttccaaacatctcaagaagaattaatgccagttcttcttaaactatttttaaaaattgaagaagagggcacacttccaaatttattttatgtggccaacattatcccgataccaaagccaaacaaagacaccacaagaaatgaaaactgcaggtcaatatctctgatgaatatacatataaaaactcataacaaaatactagcaaatcaaattcaacagtacatttaaatgatcgtacatcctgactgagtggcatttatccctaggatacaagtatggatcaacatacaaaaataaatcagtgcgaaatggcctattaacagggcaaagatataaagataacatgatcatctcaatagatgcagagaaagcatttgacaaaattcaataccctttcgtgattaaacaatttttcaacaaactggaaatagagtctcaacatcatcaagaccatatataagaaaattttcactgttgagtattatattagatgtgagcttttcatatatgggattcataatatgtttcaaatatattacaaagctatagtaattgaaacagcatgggaatagcataaagacaaacacataggccatcagaagagaagagagagctcagaaataaatccatgcatatacagtgccttagtccattcagcctgctaaaacaaaataccatagactggtggcttataaaacacagaaatttatttttcacagttctggaggctaggaaattcaagatcaagtagctagcagatttgctatctagtgagggcctgcttcttggttcataaatggccatcttctccatgtgtcctcatggaattagggtgatggagcgctctgggatttcttttataaggcactagtcccattcataagtgctctaccttcatcacctaatcacctcccaaaggtcccatctccaaataccaacacataggggattaggtttcaacatatgaattttaggggaaacaaacatcagtctattgcatatactacctaaagcaatctacaaatttggtgtgatctctattaacatcccaatggattttttttttacagaaaaaaacctctgaagtataaaaaggaccacaaatagctaaatcagttttgaggaagaacaaagctagaagcaccatacttcctgatttctaaatatattatactcccatggtcatagcagcactatttacagtagccaagatgtgcaaacaacctaaatatctaggatggggaaagaaaatgtggtagtcacataaaatggaatattatttgccttataaaggagggaaattctataatataagacaacatggatgaatcttgaagacattatgctaagtgaaataagccagtcaccaaaagacaaatactgtatgattctacttacatgtggtatctaaagtagtcaaatttatagaatcaaagagtggaatggtggttgccaggggctggggaggggggaaatgagttgcctgtcaacaagcataaagttttagttaagcaagatgagtaagttctagagatctgctgtacaacattgtacctatagtcaacaatactgtattgtacacttaaacatttgctaagagggtagatctcacttaaatgttcttactacaataaaatataattgataaagcaatagaaaaggattcctatacataggattcctatacataaaaaggtcaatacctaatttccatttaattaaaagcaatgaatagtcaatttacacacaagacaatttctgttattgaggcagctataggatatagaagagatttcccaactcactttgcaaggtgcacatagccttgaatccacaagcataatgtaaataatttacttttaagaaactcagacagaaaaatcctataatcatctcaaaagatcctgacatttctttttgataatttaatgcccctttctgatttttgtcaaatactaggaagctaataggtaaggaaaagtccctaacttgataaaaatacctaccagatgcccaaatcaaaaatcatatgaattaggaagttctggagtgcttctcattaaactcaggaacgtgtaatatcgttattaatgtattgttccaccctgttttggagggcctggccaatttaacaagttaggtgatttgataagttagtttaatacgcataacagcatggctgtcccgaggcatacaggaggcgatgggctgagtcctgactgcagctcccccaaggacctgccacgcatggattatacacaaagtctgttcaagtctgttgagggagtgaagggtcggggggcagcaatcccctgtttggcctgccaggtaaagcctttgtaattgctaatggctgggcctgacagattacacataggattttggcctggagcccaaataattcctaaactccatcctttgatttttcagagcccaagcgagaaacataggctaccccatcatggacctgaatgggttggattttgagggtctctgttaggagccaggttattagtctgcagttacaataaatagaccatggtcaggatcaagatcacttccagcatcgtgtacagattaatatgcctggggtagcttaggtaccagaaaaatccatgtttacagaaatgtttgtttgcagcattcagtggcacaggaacaaaatatttatttgtggggatacatccagcattttgtcaaattcactggggaactgcctgggacaggcatatcaatgaatttagtgacttggaagtcacacagtctattctgtaggagagagagaaggaaggttagattcccacttctccctcctctgtaccctggctcatgggttcataggcgctcacgttgggggaattttccccaaccactgtgacatgggtaagggtagcatcttccgactatcctccagggaggtgggctgtaatctggcctggatcctctgatgactaaaaaaaaaagtttctcttctgtacattgatatccatcccttgaaaataaccaggcaaagcaacaaagccactttatggaaaacattgaattagaagcctcaagttgatagtgattattttttgcaggcaaaaaaatccatgctcagcaccaaagggataactgatgaagagggttactgtctctcatgctttgttttttaatagctaatctaatctctcacctatctgagtctttagaaaggaattgaagggggtggggggcccttgtagggttccccagagagactgaggctgtgcaataaaaggaagcaggtagacagtctgatcaaatatgcagcgcaaatgatgactgcccctttgaggaatgccacactgggaccccagactgttcccctgagatgcatagtccaggccgaggttcttttattccctcctgtcagtcacttaaccctgtccttcaattgtctactaaaacactcaatcatccctgctgcttggaggcgatagagagcatagggcgtccatcatatatgccccatgcttgggcccattgatgtgtggcttgggccacaaatctggggccattatcagatgcattctatgcctgggaatcaaccatctaagatctgaaattgtgtcaccgattgattgacctgacctcacaaggaggttttttatttgtttttgtttttttttttgagacagagtctcactctgtcacccaggttggagtgcagtggctcaatctcactgctacttccatctcccaggttcaagtgattcttatgcctcagcctcccgagtagctggaattacagacacgcaccaccatgcctggctaatttttgtatttttagtacagacagggtttcaccatgttggctagcctggtctcgaactcctaacttcaagtgatccgcccacctcggcctcccaaagtgttgggattacaggcgtgagccactgtccccagccactggacttgataaccatccggagtatcatgaacaaagctagaaatctgagtctggttgcaacctcatcatctgctgcttccacttccttatcatagacccaggggaccaccagtgtagcctgccacggctccaggtttggagtgaggcgtaggttccaggcagctcctgttgaccctgctgctgcaggccaggtcagctgtccttgcccaggtgtgaatcatgggcatgtatctccctgctgggcttccgctttgctgccctttcctggccctttggccagagagagcaggcttttctttctgttgcttttccttgtttgttcttttttttttttttttttttgagacggagtttcgctcttgttgcccagactggagtgcaatggtgcaatctcggctcaccgcaacctctacctcccaggttcaagcaattctcctgcctcagcctcccaagtagctgggattacaggcatgtgccaccatgcccggctaattttgtatttttagtagagacggggtttctccatgttgaggctggtctcgaactcccaacctcaggtgatctgcctgccttggcctcccaaagtgctgggattacaggcatgagccactgggcccagccatttgttctttctaatttaggcctgttggtagttctggattgcaggcctctttcgttttcagtctggcatgtgtgggaataaaaagacagcccagggcacaaaacagggtgttgttcctgcctctgggtccccagccagtctgcctctactttccacctctcagggttgtgtgattgtctgttgatttattcccagggtatttaggtgtccttagaggggagaagcagggaaaagtgaatctatgccatcgtgtctcggaactggaagtccacccccatccccacacacactagaattgcagaagaaaaataagatgagaacttgagtgaaaaaaacatattattatgcaatcatcaaatgtttggacagaaagtgttcttagacaacctctagtctaatttctcacatttggaaatctggaagttggactaagacctgaatcgaccaccctcacccccagttcagctgactgactccccagcctgtattctcgccattccacaccaggatctgtcctgaggctttgaaaaaatgtgaactgcatgtcctgctcagatcccaaccctcccacaccactttgctaagagtctgttctgtctgcaaaaatcccaaaagttgtgtcaactggaacgcaaaatgttcttcatttgactttcattgttttttggaattttggggggccagggaggagcaagaaaggagctgcaattgcccttgggtaagatttgcttagaattttaggaagaagttgtctgggcacagtggcttactcctgtaatcccagcactttgggaggccgaggtgggtggatcacgagatcaggagttcaagaccagcctggccaagatggtgaaaccctgtctctactaaaaatacaaaaactagctgggtgcagtggcaggcgcctgtattctgctagggagctgaggcaggagaattgcttgagctggcggggtggaggttgcagtgaaccaagatcacaccactgcactccaggctgggcggcagagtgagactgtctgtctcaaaaaaaaaaaaaaaaaaaaaaaaagaagaattttaggaagaaatctatctgattctagaattatctaggctgttgaggatgtgtgtctggtggccactgggacatcagggtgagacttttcttttaactgcatgtatgtgaattaggttgcttctggagcctactgagagctcactgggtccccatagcatccatgctgaaggcgccttccttctgtctgtgaccttgaccctcagctccacatttccccaggggctgcaggatttctcagaatcctcattagcacaacctattttttttttttttttcctgaaacagagcctcactctgttgcccaatgcagtggtgtgatctcggctcactgcaacctctgcctcccaggttcaagtgattctcatgcctcagcctcccaagtagctgggactacaagcgtgtgccaccattcctggctaattcttgtatttttttttgagatggagtctcgctctgttgcccaggctggagtgcagtggtgcgatctcggctcactgcaacctccacctcccgggttcaaggtattctcctgcctcagcctcccgagtagctgggactacaggtgcccgccaccacacctggctaattttttgtatttttagtggagacagcgtttcactgttttagccaggatagtctcgatctcctgacctcgtgatccgcccgccttggcctcccaaagtgctgggattacaggcgtgagccactgcgcccggccaacttttgtatttttagtagagatgggggtctcactatgtttgtcaggctggtcttggactcctggcctcaagtgatccacctgcctcagcctcccaaattggtaggattacaggtgtgagtcactgtgcctggacagcaccacctattagtgaatgacagccttgacttttgaggctaaaactttccacttctttagtatagtaattaaatctctcgctttttctactatttcggtaattaagcaggtaaagaaaaatatccagaacaatataatagggagtagggcaagaaaatcctgaggaaccacgacctgtgggtggatcgagtgcaggggtccttgagtgtagctggttgcaggaaggccccagcagaagggggctttgatgagcatccaccttgtgtaccgagtgaatgtccgtccagatgaggtgcggatgcagctgacaatggaggcgactgtaatggactatcccaagtagcaacatcatcaatttaggttttcagcctgagtgagactttcagttaatactcaactgaaaacaagatgcaaattttccttcagaaatttgttgaaagtgttttcactttggtactattgatctattaaagggctgagatgcagaggagacaccattgtgtaatttctagtggccgctctttttgtccgttatctgttcactgttctatccatgctgttctgccacacccctttttcacttaccaacacatgttggagattgctctctatcatagcatttcctctcctattctctagcctgcctcttcactctcttaatggtatcatttttctgaaaagaagctcttaattctaaaatggtcctgttggtggttttttccccttatggtcagcactttttgtgtcctttttgagtttttgtctactccaatatcataaagacattctcttaggatttctcataaagttttactgcttccttcttttttgagagagtcttactctgttgcccaggctggagtgcagtgctgcgatcttggctcactacaacctctgcctcctgggttcaagcaattctcatgactcagcctcctgagtagctgggactacaggtgccccccaccatgcccagccaatttttgtatttttagtagaggtgggggtcttgccatgttggtcaggctagtcttcaactcctgacctcaggtgatccacctgccttggcctcccaaagtgctgggattataggtgtgagccaccacgccctggtcaattgcttcctttttatatttagattgactatccatctggatttgaattttgtgtgggtaggaaatcaaggctcattttatttttatatggctatcttgttgatctgtcgttatttactataaagacgatccttttttcacttcacctcattgtcacctttacccatgtatcaagtgagaatagagtgtgagactttaaaaaattaatggattattttttaagaacagtttcaggtttagagaaaaaacagagcagattagctgggcatggtggtatgcacctgtagtcccagcttattcatatgcttatttgccatctgcgtatctttttgtgaggtgtctgttcagacctcttgcccacttttcaatcgggttgttttcttattgttgagtcttaacagattagcttaatcagattggcttcgggaggctaaggcgagaggatcgcttgagcgcgggaggcggaggttgcagtgagttgagatcacaccactgcactctagcctaggtgacagagagagaccctgtctcagaaagaaaaaaaaagaaagagcagaaagtagagagttcccatataccctctgcctcctacacttctcccctccccacactttcccgttattaacatcttgcattagtgtggtacatttgttacaagtgatgaaccaatattgatattgtaggggagggcaaatctgttttccttctacccttctaagttcatggctgagaaccctataacagaagacagattaataagagaaaagtgcataaacatatttaagttttatgtgacatggaagcctttataaggaaatgaagactccaagaagcagttacagtttgatgtaggtttgataaagggtggacagttgtggaggatatgatagagcaaagagtttgaagtaagtgtagtccgctggcagaagcttatcaaggcccgtttgtttagttagattcctctctgtgtccctttgtcttcacagataccaccaggtatagggagggcatctctcacctgagggtcttatgacctggcttcaggagaaggtcagaaaacccttcctgcacatgctgcttttgcaaattccttcaccttaaaatattcaatatgtcattgtgttagtctgttcttgcattgctctaaagagatacctgaggttgggcaatctataaagaaaagagttttaattggctcatggttccacagactgtataggaagcatgatgctggcatctgcttggcttctggggaggcctcaggaaacttacaattatggtggaagacaaagggggagcgagacatctcatgtggctagagcaggggaagcaagagagcggggaggtgccacatatttttaaacaaccagaatatcatgagaattctatcatgcaaacagcactgtggggatggtgctaaactattagaaaccacccccaagatccaatcacctcccaccaggctccgcctccaacattaggaattacaactggacatgagtttgggtgaggacacaaatccaaaccatgtcagtcgtggtgccatattttgtggtagcacgtcctgaatcccatcaataaattattctgaactaaagttccatagtttccattagggttcacttttggtgtacatcctaccggttttgccaaatgaataatgccatgtagaaccgttacaatattgtacagaataatttcactcccctaaaaatcccctgtgctgaacctattcacacttcctcccctgagtccctggcaaccactgtctctatagttttaatcagaatgtcacatagttggaatcatacagtatgtagcctctccagattgccttctttcacatagtaacattcaattaaggctcttccatgcctttgcgtggtttgatagctcatttctttttattgctgaataataatctatggtatggatgtgccacagtttatccattcatttattgagggacatcttggttgcttccaacttttggcagttatgaattatgaataaagctggtataaacattcatgtgcaggtttttgcatggacataaatgttcaatttgggtaaatatctagaaacgtgattgctggatcttgcggtaagcatatgctttggccaggcgcggtggctcatgactgtgatcccagcactttgggaggctgaggtgggatcacctgagatcagcagtttaagaccagtctggctaacacagtgaaacctcatctctactaaaaaaaatacaaaaattagctgggcgtggtggcgtgtgcctgtaatcccagttactcaggaagctgaggcaggagaatcgcttgaacctgggaggtggaggttgcattgagccaagatggcgccactgcactccagcctgggcaatagagtgagactctgtgtcaaaaaaaaaaaaaaagaaaaaaaaatggccaggcgcagtggctcacacctgtaatctcagcactttgggaggcggaggcaggtgtattatttgaagtcaggagtttaacaccagcccgaccaacatggtgaaaccctgtctctactaaaaatacaaaaattagctgggcgtggtggtcatgccggtaatcccagcaacttgggaggctgaggcaggagaatcgcttgaacccagaggcagaggctgtagtgagccaagatcacacttgccgttgcactccagcctgggagacagagtgagactccgtctaaaaaaaaaaaaagcttcatgacaaacttccagactttcttccaaagtgtccgtatgagttttcattcccacgagtaatgaatgagagttcctgttacttcacatccttgccaatgtttggtggtgtcagtgtttcggattttagcaattttggcaaatatgtagtggtatctcactgttgttttaatttgcaattccctaatgacatatgatgttgaacatcttttcatatgcttatttgccatctgtatatgtttttggtgaggtatctgttcagatctcttgcccacttttcaattgggttgtttgttttgttattgttgagtgtcaagagttctttgtatatttttggataacagcatggtttttgtttttgtttttgtttttttttgagacagagtctcgctctgtcaccaggctgtagtacagtggcatgaacttggctcactgcaacctctacctcccaagttcaagcaattctcctgcctcagcctcccgagtagctgggactacaggtgtgtgccaccatgcccagctaatttttgtatttttagtagagacgggctttcaccatgttggccaggatggtctggatcacttgacctcgtgatccaccagtatggttgagttttaagagttctttgtacgcttttgggtaacggtcttttgttttgcaaacattttctcccaatctgtggtttgtctcttcactcttaactgtatcttttgaagggggatctcaaagaacatctggtcccccacaacaacatgtcatgtcaggtgagagatgactcattttctcagaaactaggattttgtgtcatatgttgtaaaccacgaaaagttaattttataacccaccttctagatctactgagaatacgtggtgttatcactaacagttttgaggaaagaaataattgcctaattcattttgtagtgaatgtgttttgttactaccacagatactcttaaaatccacttattatggagggggaaaaaaaaggaattttctttacagaaagtgaggagtgaaacctaatggagaaaatatctgtttcagggaataaccctcccaacatctgatttttttttgttttagacaggggctcgctccgtcccccaggctggagtgcagtgatgcaatcatagctcactgcagccttgaactcctgggtttaagcaatcctcctgcctcagcctcctgagtagctgggaccacaggtgtgcaccaccactgcaccaccacacccgactaatttttttgatttttggtaaagacagtatgttgcccaggctgatcttaaactcctgagctcaagtgatcctcccacttcagcctctcaaagtgctaggattataaatgtgagccactgcacctagcctgatcttttttttttttttttttttttttttttttttaagaaacagtcactagtgctgtatgtaggttacagtagctatgtaggcccttcagagtcacttcacttttctgagctttcgtttcttcaacgtcttcctgtctgtaagacacatgctcttctacccctgagaccaaaaaatgttaccagtgaggatctaatgatataaaatagggaaaatgctttaaaactgcacagtgcttaacaaatgcactgttattatatcattaaaagtgactcctgggtggtgggaatggttgcataacgacgtgaatgtacttgatgtcacttaaaactggttacaatggtaaattttatggtatatatattttaccacaattaatacattttaaaagatggttcttgacaattattcttagcgtctgaggtgccccatttcttgggtatgggcatatagtgcctcaagaatattggggatcctcacctcttctatgcccaaacctttaagaaaattctgggccaggcgcagcggctcacagctgtaatccaccactttgggaagccgaggtgggtcgatcacctaaggtcgggagttcgagaccagcctgaccaacatggagaaaacccgtctctactaaaaatacaaaattagctgggtgtggtggcacacacctgtaatcccagctactcgggaggctgaggcaggagaatcgcttgaacccaggaggcggaggttgcggtgagccgagattgcaccattgcactccagcctgggcaacaagagcaaaactccatctcaaaaaaaaaaaaaaaattctggaaaagctaggtcagtgacatgaatattggaatcagagtctaacaaactcaatttcttcctttctaaatccgtggtacggattcatgtctgcagtagtttttctgagaaagcagaaggggtaggtattggcaatcaacaagctgcagagtatgcagattgaggtcagtaactgtaaatgccccatgactgtctgatcattttaataccaaaagaaaaacttaaaatcccagttgctaaaatctttgtcttagacaactctttgagcctctccctacaaggcccagaaaggaatgagatagatgtgaatggaatctgttttcccttcccttgccacgctctggaggaggagtctagggcagtagccaaggccagctgccagtcaaggaaaggggagcggccccgttgaatccacaaaccacaccatcctggcccatgggttatatacaaactcccacattggcaacaaacaaagggcatgcacattcaggggattttgctttcactgtgagtgtttatctttgaagggtgtcacatcaagatgaatgggaagggtgtgttgcagttgagctgaggtttggtctttcttggcttttttagggacacttacaggtccaaatctgctttcagccggctggtggacatggtaggagacacagtagtctcaggaccaggcctccaggtgggagctgagattctagagggtggaaaccacttggagattgagtcaaagcagacctgtcctcattctgtgctgggcaggagccagctctccatgtccctgcagctccagcaacacctccggatctttcagcttccctgggactaaggaccatgcacattattaattctgatataaacagtcacacaggcacatgtctcaagatgagggtgagaagttggttacagcaaatgaagtaataatgatctttgtgcttcacaataggaattcaaccaacctgaggcttataattcacttattaacactttttatttttgttgagacggagtgtccctctgtcactcacgctggagtgcaatggtgtcatctcggctcactgcaacctccgcctcctgggctcaagtgagtctcgtgccttgagtggctgagactacaggcacatgccaccatgcccaactaatttttttgtatttttagtagagatggggttttgccatgttggctaggctggtctcaaactcctggcttcaagtgatccgcctacctcaatctcttcaagcgctgggattacaggggtaagccactgtgcctggccataattcatttatcagtcatatatatatacacacacactgggagaatctagggtcagtgccttacaaatggcacaagttgaagccctgagactcccactcctaccctgctccccccattctcagtactgctcctcagatgcctccagcagatcatccatttctgctaggctgggcctgggtacatgcagggagatgtgtacaggggctaagagcagaaacttttgagtgagacactcctgagttcatgcactggccctgccatttgtcagctaattgatgttgcatttaattgcatcatctgtatgtaagcctaataatttatagccatcttagagatgttgtgagcttaaataacatagtagtgaatatttatttatttgtttatttatttatttagacagggcctcgctctgtcacctaggctggagtgcagtggtgtgatcatagctcactgcagccttgacctcccacactccagttatcctctcacctcagcctcctgagtagcttgagacaacagatgcatgccaccataactgactaattttttaaaattttctgcagagacagtgtctccctatgttgcccaggctggcctcgatctcttgggctcaagcgatcatcctgccttggtcttccaaagtgctgggattactggtgtgagccactgcacccacagcctatttattgagaaatgtggaaggcccaggcactattctaagtgctccagctgttttatctcccacagttttgctcagataggagttccaaagctggagctggaagactcatatttttagaaatgttacagttaattctgaggtgggtcagattgagattcatggctatgcattaatgtttaggtggtgactaaccactcagggttttagagacaaacagaccttattctgtcactcactgactgagcgtggccaagtctttcagcctctctaagcctcagtgtcctcatccataaaatgggaccaatcgtagcatccacttctgagaactgttcagaagtggaaatgagctagtttaggtggctgtgtctggcatacgccaatggtttgataagtattagcttgtgcctttattaggccaactcctttttgttaggtgactgagaaaccaaggaccttctgccctttatgcaccagtcactattagtttaaatttgttgctcttccatccacatgattcattccaaatttgaagtgttggagaaagggagttagtatgtcatagaaaaatctctgtttttggctcagcaggactgagtttgactccatgtaactgtctgagtcttagtttcctcatccataacatgggagaacaataccctgaattagagaattctgctgccagaattagagatagttcatgtcaaggtgcaacatataggtaatgtgttattgctggtgttctggttataaaatgtacaagatgtgaaagcaaaagggcagaaaaccctttttaaaaattcatggctgggcgcgctgcctcatgcctgtaatcccagcactctgccaggccgaggcgggtggatcacctgaggtcgtgagtttgagaccagcctgaccaacatggagaaaccctgtctctactaaaaatacaaaattagccgggcatggtggcgcatgcctgtaatcccagctacccaggaggctgaggcaggagaatcgcttgaacccgggaggcggaggttgctgtgagccgagatggcaccattgcactccagcctgggcaacaagagcgaaactccgtcccccgaacaaaaaattcaaatgggaaagagaggcagatggcagagaacaggggaggggctgggcaccgtggctcatgcctgtaatcccagcactttgggaggccaaggcgggtggatttcttgaggtcaggagttcaagaccagtctgaccaacatggtgaatccccatctctattaaaaatacaaaaattagccgggggtggtggtgggtgcctgtagtcccagctactcgggaggctgaggcaggagaatcacctgaactcaggaggtggaggttgcagtgagtcaagatcgcaccactgtactgttgcctgggcaacgcaccgagactccgtctcaaaaaaaaaaaaaaaatgagagaacaggggagggtctagggctcagagctttggagaacagacctcagtagcaccaacactccaggatcaatgctacaaagacacgggttacaactaaactggagaacatggccaaggatgggaactcagcctgagcagggctgagccgagcagggctaagccaagtagggctgagccagaacacttcctccttttttctgaacaatctacctacatttcagctacagggctggctttacccagtccggcgggagggaggagagggctggtctgtgacttcagtgctgaggtttgatcaaggcaaagggaaacttcctattcccagaccctttgcaagaaagaatggcatattacttgccaccgacaggggttattattactaaatggagtcagtataaatgctttccaataaagcatgtccagcgctcgggctttagtttgcacgtccatgaattgtctgccacatccctcttctgaatggttggaaattgggcatctgttcctttaaacaggaaacatttcttgttcgagtgagtcatctctgttctgctttaggagtaaagtttaccctgcagttccttctgtggtgaagttttctctttctctcggagaccagattctgcctttctgctggagggaagtgttttcacaggttctcctccttttatcttttgtgttttttttcaagccctgctgaatttgctagtcaactcaacaggaagtgaggccatggagggaggcagaagagccagggtggttattgaaagtagaagaaacttcttcctgggagcctttcccacccccttccctgctgagcacgtggagttaggcaggttaggggactcggagactgcgatggtgccaggaaagggtggagcgggtgagtgcctgttgccaaggtggcctcttcaacaggaaaccacaatatttttgtttcttgacttgctctagaaacagggctgtgggggtggggaagcaacttggatctgcccttctgaggacacctctgggtgctgcctggcccaggtctcctgtgtggtttctctctgagccgttgcctctgactttgctactttttcactctgagcagtctccagttcctctgctacctttttgtcctccaagcttccctgccgcctcgaatgcagatacacggtctccctcctgtggacccgtttggagagtccagaagactttatcaatctacttttttttctttttcatttggccctggggccgacggttaagtactttattctgtcgaatcacgatgccctgaggtgcacagccccttccccctcttccgtgtctgaagggtttccttttatctctccacccccacccttgccctcctgccctctctcttgttccccaaagacagttctctaatgttttgatgtggattcgtgaatttatctgtatctttgcaaaatgtatttttcttttgtatgtgtacactgttttttaactatgcgatctcaggcaagtaagtaattcctctgtgcctctgttatctcatcattaaatgattaataatgcctccagaggtgactgtgaggcttgaaggagataatacgcatacatcacttactacacgagttagcaattattattgcatattaatactattggtattttattttgctcattctgtttctatttcttttttatttatttattttttgagacaaagtcttgctctgtcacccaggctgcagtgcagtggtgcaatcacggctcactgcagcctcaacatcctgggatcaagcaattttcccatctcagccttcagattagctgggaccacaggcgcgtgctaccacacctggctaattaaaaaatttttcttcatagagatggtgtctcattttgttgcccaggctggtctcaaactcctatgctcaagggatcctcccaccttggcctctcaaagtgctaggattacatgcatgagccacggtggccatccaggcattgatattatgaggccatcttgacctagccctctctggtgaagagtccttttcagatacttcgttcagtcttctcagctatgagtccctaccctctgaaagcttatattctatttggggaaagacaaaaggcagtttcaaagaagagaggtgtttgattttcttttcctacttttaatatcagaaaacatttcatctaactctcagtatgaaggcaatattttgtttactggtatatccctagagcccaacatggtgagggccccaggatttgcttctttgataagatggtaaacccatctttcagctaacttcatggtttcctcagctacactcatatacaaggatcacctttggtaagatggacttaccatcttaccaaagagtttttgcattttagagttttttctttttagatttttttcattttagaatttttttatttcagagttttttctttttagaggtttttcattttagagttttttctttttagagtttttttttttttttaattttagagtattttaggctgctgagggtggaatctggtgaccttggggccacagagatgctccttggctaaaccaggggctttagctctgaaagttcacagccaccctgagaaccaagatgagagggctctgcagtgtccaatctcaagacctctctgaggtgctccatcaagattcattgaatgaaaaaattaaagtcttaatgatgaacccagaaaaatctttaaatcctaaatatgaaatgaaagtgttcttagttacaatccagtccaacgtcctcgttttggaatgtggaaatgaggccccaaaggtaaaatggcccatccaaagtcacagccaggggccagtgctcaggtggccaggtgccctgcgtgcggtctcctggaccaccaggcctttttcctgcagctttagaagctttagaaggcactctgctcactcaggggcaagtggtaagcgctctttcccctctagtgtttgtgactcaggagtttcgaaacaggaagtagagctggctggctgtgcccttccgtccttcattagacgtttgctcttgtcttagatgctcagatggtagtggataggcctgtgacgaaggtgctaccatcgtgagagtaaggtaaggatttgcctctttgttaaggtcagaggggccttttgggaggaaggcctttgattctggagttttctaggctgctgagagtgagatcgggtggccctggggccatggaggtgatcctcgtatgtgagtgtggatggggaaaccatgaagttagtgtaagaggtagcagtccctctgagagccttgccgagggccgtgcagtttccagatctgaaggccattctagcttagactgatgaagtcctaggagcttctgaaatgctgcaagtttaactacttgtataaaggcctcatcctgatcccagtcaaacttgtgaaataatagaagccaaaatttaaatctctactgactttgctgctacagctatcctcccaccaacacacatacccaccaacatacacacttgccaacataaacgcacacacacatacacacaaacacacccatgtggtcctactaattcaattatttattttttaaagaaattaaaaaagactgggcgtggtggctctcgcctgtcatcccagcactttgggaggtcgaggcggtggttcacctgaggtcgggagtttgagaccagcttgaccaacatgaagaaaccccgtctctactaaaaatacaaaattagccgggcatgatggcgcatgcctgtaatcccagctactcgggaggctgaggcaggagaatcgcttgaacctgggaggtggaagttgtggtgagccgagatcgtgccactgcactccagcctgggcaacaagagcgaaactccgtctcaaaaaaaaaaaaaaaaaaaattaaaaagatacagaacagttcaaaaaacaatataatgggaagactagatagacacaatcagagacctgcacttgtggggttaagaatttacaggtgaagttgcaagtttcattctgtttgaaaatgatgggattatatgttttgctgaggtttggacacctttgctgggttgtttgaatgccgtggctgcagcgccctgttatggacatcatgtgcgtgcagaatggatgtctgtcaggttccggggcagcccgcagtctgaggcagccagcctggattggagggagtggcaatactacctgccggttaggggtttgggcctgagagcgagtggctttcaggttctctcaagcttcggatgagatgcaggtttctgcttccgatggcaaatgcatgttttgctttttagttatcactgcaagagctaggatgctgctagaatattactggaatgattgtgatgagatggaatgtatttgcagtttaattgtgacatgtaatacagtggtagaatgggactctggaatgagatgctggggcctagattctagcacttcctttgtgaggctctgaccccctctcctatagtggatttgttaagaacttctgtttttgtggctttgttattataaaattttttgaaatgttgttctctaaaaaagttatgattttatgtttttcttcatgagattctttcactgccttccagctgcaagtagaatgacgtctaaatctttgtgatctgtcactgaagcccttgagtgagacacttaaatctggctgtggctctctctcttactagcttatttccaagccgtgatttttcacaacagaaaaatggggacagtaatagtagtttcttcagaggcttttagtgaaatgaggttaaaaaatatttttatgtttatatggatatatagattacaaacatttatatatcatttatttatatgattattataaacacatatttatatttaaatactttggggcataaatatataaaataataaatatacttatgtaatacaaatagacttatatacatttactatttagcagagattatataaaatatatgtattacatggcaacatattcaaatttacatatgttatatatacatgtggaaaaaaaattgggaaaaggccacaaaatgtgaccaaagaattacttccaaatggcaagtttttaagtaatttttattttctttttatacttctctgtactttctctatgaaacaagtgttacttttactgtttttaggaaccaaaaatacaagtacattgtttaaaaaatactagcttaacaaagtttctagcccataagctagtgcagaaaatctaggtcccataaaacaagaactgccacacgatgtctctccccttacagtgctggatggcccgttgttaatggtgtcataaatcctttgcaagtgactgttttctaggtactatgactagagggatgtgtaacttaagcaaaaaacaaaaaacagaaaaggctgactatcatctgacagtgtatcctggaacacctaggccagagaagaagccacgttagcattttcccttctaaatgtcagttatgatttgatggggaaaccacttaaaaagcattgtcacgttgttgaaaaggtaatgaaatgagtgagatgagatggctatggaggacggagctatgcgccaatcttattatatccaaattcatgtcatctcagccttgaattgtattgatttttattatatactgtcagaaaatgctattgaatgtgtaacaagagcctcaaaaaggtttattcattttgaccccataatactacttttaggaaattattctaagaaaataattagaggtattcttaaagatttgcgttttaaagtcatcctaaatgtaatcaggaactggctatgtaaattatagcccatctctaagattaagtgccttacagatattaaaacccatgctgtagaagaaaaactaaagacaggaaagtacttacaatacaagatgtacttaccagtggaaaaatccacttatactacagaaatatgatgtgttcaaatataaggaaaaatgtgtatgcataaaatatttggtaggaaagagtaaaatattactgggcatttatatttggatggtggaattatacataattttaattttcctttttatcttttctgtattgtctaaaatgaatacactaagcattgttatcctcagaaaaaaataattgagggatgggggaaaggaagtcctgctttcatttgattctttggttggttttattctgtaagatgagactttaacagaggttagaatgcattaaaaattgtaaagacagttgacctaatggcactaaacagggttagatctagtttagatcttttccagcatgtgaataagaatggatctttaaataaagattttaactaggtatatgttttagaataagtcatacatgtacatggtaaaaattcaaacagtacaaactgtgcagcaaggtatgggaaataaagcagctctcactgtcacctccacccatcagccttctcacactgcacgcccacatctgtgtgtaattctgcttttctttaacattactgaaggaacttcctgtgcattttttgtcagagctcttctgtgaatacacaaaatatgtactgatcaatacattatgtagatcacgcaggctcaaccacattgatcttcctattctttctagtagccaaatagagttccctggaatatgattaatagcttgcctaaatcttctaatgctgataaacagttgtttctgctctttcgttatttcaaggaatgctaccatgaatagccttatatatggttttgagtatacttgtttaagtgaatgtaggaaaaactcttggaagttaaattgtgggccagtttatgtgaattttatattttgacagagatggctaaattacccacctgtttttttgttttgttttggttttggttttgctttttttttttaagagttggggtcttgctacctggggtcttgccacctggggtcttgcccagggtagacctgaactcctgggccacgttggtttattttactgcattcccagggcctagagcaacgattgacacgtgctagcagtatctattggaaattctggccaacttgcaatagacctgattatttctacactgaacatgtctaagatagctattactattcattcaggaaagcccagacaattatcatgccagcagcctgagacagtagccagtaatagcctggtgtggtagtttgctcctgtagtctcagctactcagcaggctgaggtgggaggatggctctagcctgggaggtggaggttgcaatgagccaagattgcgccctgcactccagcctgggtgacagagtgagaccctgtctcaaaaataaaaataagaataaaaaataaaccagcaaaagtttctgccctcacagagcttccattctagtgagagggtagtttgtcatcaggagggtgacgccggtagggctgggggccagctccctgcagggaacaaacatgatcgcagtggggtgggagtaggggatgagtccccagagcctctgtggtttccatttccacacaaaaaaaccactgctgctgtaatcaggagggggaaaagatttttaaaaattttctttcagggaatggaaggaaaggatatttttgaaagtaagactttgaaaactaaaagttttgggtcacttaaaaactcaaaatctttaggtcactttaaaaatatttaatcttggagctggaggccattattctaggtaattagctgggtgtggtggtgtgtccctgtaatcccaactactaggaggccgaggcaggaggattgcttgaacctgggaggcggaggttgcagtgagccgagatcgcgacactgcactccagcttgggtgacagagcaagactgggtctcaaaagaaaaaaaaaaaacgaaaactaaataccgtatgttctcacttaaaagtgggagctaagctatgaggatgcaaagacatacagagggatataatggactttggggattgatggtggggttgaatgggaggttggtcctaataggtcctagtacgtcccctacttctaagtcttccagtctgtcctttgcactttgaatgttaattcccagttggataatgtcattctcatttttacagtcctttcttagctcctcatcacctccaggacaaagcctaaacccctcgccccatggtaatgcggcccctttgtgacatggtacctggctagagcttcatccctttgtcccatcactctccatcccagacactttgtagttactttattgagctccttgtgcctgcctgaatggacttgaaagttcttacctccatcttttacattaattgtttcctgtaagaattgtgctttctcgcattctccccaaaatcccttccccataggaagcccttctcccaggctaagttaaggtttcttcctctacatccctaccacactctggtcacaaccctctaaccattggcttgttttttttgttttttgtgttttttttttttttgtgagacggagtcttgccctgtcacccaggctggagtgcagtggtgcaatctccgctcactgcaacctccacctcctgggttcaagcgattctcctgccccagcctcctgagtagctgggattacaggcacgtgcctccacacctggctaatttttgcacttttagtagagacggggtttcaccatgttagtcaggctggtctcaaactcctgacctcgtgatccgcctgccttggcctcccaaagtgttgggattagaggcgtgagccaccgcgcccagcccattggcttgtttgtatgtctaccttcctaaacagtaagagggaacttgtctggtgttctttttttctctcctgtgctgacagcacaatgaccagtacctagtagttgcagtagcctttgatgaacaagccagcaaatggtacttttcttccttatctgaacataccatttattttgacttagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacaggtgggtggaaactcccattgtgggactgggaggtgtgggttgaatggacagcctctgagctgattggggcttttttttgtggtaccctgcctagtgcctgggaacccagcagtgccacaattctaagcttctacagaaagacagtagtgccttgggtggtcctgctaaaggctgtaaaacttagcttctccccaccctagagagagtgggtaaacaaaggcgtgagagagaaaccacattcagtatcacttgggaggctttgggaagatgtcccaccggagccagattaagaaatttaggggccttatatataattctatagaaatgctaagaccataaaataaaaatttatttttcaaagtgaaacattacttagaggtatgctgaagttataatagagtttttctaagtgttctcatttttttcctctcttatcttgatgcctctcgatatccagattgtgtgcttactttgcccatccattgagtaaagcatcatggcttcccaccctgaaatccccctcccacctgcttgcggatggctatgaaaattttcaatgagatttaagggttttctgccacacttaaagactcgaatgactaagttctttacggagctgtaagccgctggcctggcacatacagctaggcagtctccaccgaggctgcccagttcctgtgagcccggctgtatgacagttctaagcttctataggaagacagtggcacgttgggtcatcctgccaaaggctgtaaaactcagcttctccccaccctagggagagtgggtaaccaaaggtgtgagagagaaaccccattcagttacaacttcatgatgctgtgacaagactttaaaaacagaaacacattgtcactttctctctttcaacatctcctattatcggacactacttaaagcaattttagctttgctttcaggaaacttctactgaagtcttcgttctgggcccatttcattgtctctgtttgcttgttgataactatggcatgtgagatggaaagggttcacaaccagggctgacagctgctgtcctctgatggctcagcccatgaatgctctggtctttctattctcagagactattttttgttttgaggcttgactattttttgttttgttttgttttgtttttgagacggagtctcgcttcatcacccaggctagagtgcagtggcatgatctcggctcactgcaacatctacctccagggttcaagtgattcttctgcctcagcctcctgagtagctgggattacaggtgtgtgccaccatgcccagctaattttgtatttttagtaggacggagttccaccatgttggccaggctggtctcgaactcctgaccttaagttatccaccagccttgacctctcaaagtgctgggattataggtgtgagccaccatgcccagccaaggcttgaccattttgattttaagtgaaaaaagagatattctgggccgggtgaggtggctcacgcctgtaatcccagcactttgggatgctgaggagagctgatcacctgaggtcaggagttcaagactagcctggccaacatggtgaaacctcatctctactaaaaatacaaaaattagctgggtgtggcggctcacgcctgtaatcccagctacttgggaggctgaggcaggagaattgcttgaacccaggaggtggaggttgcagtaagctgagattatgccattgcactccagcctgggcaacaagagtgaaactctgtctcaaaaaaaaaaagaaagagatattctgggtatataagtttcctagggctgctgtaacaaagtaacacaaactagcaggtttaaaacagtttttaaaatgtgttttcacagttctggaggcctgagtcagaagtcaagatgccaacagtgttggttcccttttaagaggctccgaggaataatctttttcatgcctttccctgcttcgggtgggtggaggaatcctcagtgctccttgtcttgtagatgaggcacagcagtctctgcctatgttcccttctctgtgtctaaatctccctcttatgagacagtcactggattaggaattagggcccacctaatccagtatggcctcatctttgtgtgtgtgtgtgtgtgtgtgtgtgtgtgtgtgtgtgtgtgtgtgtgagacagtgtctcactacatcgcccaagctggagtgcagtggcatgatctcggctcagtgcaacctccacctcctgggttcaagcaatcctcccacctcagcctcccaagtagctgggactacaggcacccgccaccatgtctggctaatttttgtatttttttgtagagatggagtttcaaaatgttgcccaggctagtcttgaactcctgggctcatgcaatctgcccacctcagcctcccaagttctgggattacgggcatgagccactgcgcctggccagcatgacctcatcttaatgagattttatctgcaaacgtcctgggtccacataaggtcgcattctcatattccagatagacatgaattttggggaagaggggagaacactattcaaccagtacactagatagctttggtttactagcattgtgaagtctttataaggcacttattcattaaggcgccagttagtcctaaaaacccacagccccagaacaaggaaagccgaggggggtctcatcttgtgcccaccatcttggtcctttgaaggttccacttctgccgcatgagctgggctgaagcaaacagccagtgccagacacagtctgtacctttctggcggagggtcgatcatctattaataaggcaggatctctcttaaaatctttaatgtattggcttagagataaaagggtccgggcaatcctgacttactgcttgttcattatcattgaatactagccagaagctaataaatatgctagggtgaccacttaccattataagaaaacactagacattttattttccagttataattgctacctataaaataaagatcttataaactattcaggttcattactaaatggtgatggtacaagaaagcctataggcttcaataatgaggaaagcaaaagggtaaataccttgtaataaaggtgaaagagtcagagtagctttggattagatccaattttggccaaactgaaagctttagataaacacttctagggtagagagtccatgagaagggggataaggcagatggtaatactgagtaatttctgtttctacgccatttttattttcagaattttacttttctaattaaattttaaagtcaacgtgtttttgtattaaaattattttcctttacaccatagtattgaaaggtttgctgacttctaaaacattcctttgttcacctattcgacaagcatattccaagagcctaaatgtgccaatcacataaatgtgataggcatagattaggaaatagtaacacctatcactcattgagcacttagtgtgttgccaaagactgatttaagtacttcacataaacttatttgtgtaaccctcgaaaccttcctatgatgtggttacggataattatcttcagtctatggacgaggaaaaaatgtgtaacatgtctaaagttaacactgctcaaagatagtggaaccaaggctccaacaccaatagcctgggtccgctgagctcaatcattgcacctcacaaccctctgggtttatgaaaataaaaagggtacggacctggccactaggggacttgaacagtttctaaacagacaattattttctgtttttatttttagtgtggtggcatgatcacagctcactgcagcctcaaccttctgggctcaagtgatcctctcacctcagcttctggagtagctgggaccacaggtgcatgccaccacacccggctaatttttaaatgtttttggtagagatggggtcttgctatgttgcccaggctggtctcaaacccctgggctcaagtgatcctccttctgccttggcctcctaatgcgctggaattagaggcatgaaccactgcaccaggccaacagacaattatgtgtgttatcgttttggggttactaagtcatagtggagtgaatgcagctttgaggatgctcaggcaatgcttgagctgattgttcatggatgggcctctgcagatagacaaggggatggggtgtagcggcaccacagaaaggggtgagggcagggcagctgggtgtgtttggcttcaggtcctttcgtgtttgcggtctggtctgtgatagggatgtattcggagactttgtattccagaaccgaatgcttggccgtcttactgaagataatgactgggagaatactgaccagttttgattagggaagtcatgagccaatgtgcattttgaaaagcataatttccaaaaggcaaagcattttgctattgcaacaaaatctccattttacagaaaaaaaaaaaggaaaacaagatttactcaactgaaataaactgaaagaaaagttgatagaactttaaattgttaagggtgggaaagtcggggaggagccagtagacttctgtgtcaccacaccagcctctttccaagggctcaactcataaaccatgccattaactggctttatgttgaagggaggcctttggaatcaagcccactgtgactccatatatcaaatgggaaattatttgggaaaagatttctaaagtgtctccatttcccaccacagggtcatgctctatcagatttcagaagaagtgagcagatcagaattgaggtcttttaagtttcttttgcaagaggaaatctccaaatgcaaactggatgatgacatggtaagacctggtatcttactgagatttagtcctgagacttggttagccagggggcatttctgagaccaaagagaggggtattttggtaaaagcaacctggattctcactttttaactagaagaagaaagttgtcagcacgagtgttacagatgtgattcctttagaccgaagtgctgctcatgttaattattgggagcaaggcagagtcagaggccgggagaaggaggctgtgcagatgcagcccagacccggcagagctgggaaagactgcggtgggtctgagatatttcctccacttctgcagtccccgaaacaacctgggacctgaaactctgtgtgtatattgtgtctgtgtgttgtgtgtgtatttccgtgtctgtgtgtgcctttctctgtgtatagtgtgtgtctgtatttgtgtgtgatatgtgtatctctgtgtgtctctgtataagtggtgtgtgtgtctgtgtatctctgtgtgtgtgttctctgtgtggtatgtgtgtctgtgtgttgtgtagtgtgtattgtatttatgcccctgtgtgtgtatcactgagtatactctgtgtgtgttgtatctgtgtgtgtatgtgcatgtggtgtctgtgtgtgtgtgtctgtgtgtctgtatgtactcaggtctggagaggcaatgctgggggtgaggctgttccccagggtgtcaccatgatgaccgggctgctgtctcaggttgtttcacagtccccaagtaatgcattcgcaggagatttgagcacagggcctggggactgggtgacatctgacatggcttctcctttatcctctcacttctgtctttctgggccagaaaacatggaatcgcttccctagtagcctgctggctgtgagagaccagcagaaactgtcagaaacttgggaagcaagggcaggtccttggttggagaaattggaaattaaaaaaaaaaatctaatctaaaaaccagtagggctcaatccagattcccaactttatttctcctcctcttagaacctgctggatattttcatagagatggagaagagggtcatcctgggagaaggaaagttggacatcctgaaaagagtctgtgcccaaatcaacaagagcctgctgaagataatcaacgactatgaagaattcagcaaaggtagaaacaacctgacagccgggaatcggcaaaacctactctaaaattgaaactgacaaatcgctccatatcacagttgtttctaatcaaatattgtttggggtttccccttttaattcagagagaagcagcagccttgaaggaagtcctgatgaattttcaaatggtaatgcttggagatacattttcaagatttagttaatttactatctggtacctgcatgtgtcctccccacagccttctaccacatgcacatcttaacgtgcctgctctactttttctttttttttttttttttgtgagacagttttactttgtttcccaggctggagagcagtggcaccatctcggctcactgcaatctccgcctcccaggttcaagcaattctcctgcctcagcctcctgagaagctgggattacaggtgcgtgcaccaccacgcctagctaattttgtatttttattagagatggggttttactatattggcctggctagtctcaaactcctgacctcaggtggtctgcctgccttggcctcccaaagtgctgggattacaggcatgagccactgcgcccggccgcacctgctctcctaagacctgtagcccaagctggcaagtttgaaataggtgcagagttagtcagtagtaagtaatttaacatcattttttctatgtggctttttttttctccttgacgtgctgctcatgttatgcactgagtagctggatttaaattatgtttcataattttcttggttaagtcactttctctttcaacaccttctacactaagtcactcctttcaacttcctttcactttttctacctgataagcgaggctgaaccaagagagagagctctcaacgatctccttcaaaattttgattaatcaaatagtctttttttttttttgagacagtgtctcactttgtcccccaggctagaatgcagtgatgcaatcttggctcacaacagcctcgacctcctggactcagatgatcctcttgcctcaaccccctgagtagctgggaccacaggcacaagccaccatgcccggctaatttttgtatgtcttgtagagatggggtttcgctatgttgcccaggctgatcttgaactcctgagctcaagccatccacctacctgggcctcccaaagtgctgggactataggcaattaataaagtattctttctgattagaaaaattatatacactaattgaagattattttaaattcagagaaatttttacaagtccaagaacaccatcactccattcatattatgaatatttttattgtatttttacgttggctctttgtggtgtgtgtgtgtaaaatacattttggatcactcaaatgtattttaaagattaatgtctatgcaggctgtccttccctttcccctctgcctgctgagcctaaggccttaagaatactttaaggagtaaagtactaaatcattaattcatcctgagctagtggctttattaatgagtatctcacaaataccacaaaaattcaacctggccatgtggagcaatataaaattatggcatttcttggtatgtttttctctttggcgaggagacaacttgatcttgtgtttccagaagcatgttaattgccctgcttgcagaatctctctggcttgaaaggagattatattcatggcagtctgtgaattttcattttatttcatttatttatttgagacagagtctcactctgttgcccaggctggagtgcagtagtgcgatctcagctcactgcaaccactacctcccaagttcaagtgattctcctgcctcagcctcctgagtagctgggactacaggtggctaccaccacgcccggctaatttttttgtacttttagtagagacagggtttcaccatgttggccaggctggtcttgaactcctgacctcaagtgatctgcccatcttggcctcccaaagtgctgggattaccggcgtgagcccctgttcccagcttgaattttcatcttaaaaaagaccttatgttgtcctatgtgctacatatttcattaccagtgtacctttcctgccatgtctcattctagatgtgtctcttcgttgtttgcaggggaggagttgtgtggggtaatgacaatctcggactctccaagagaacaggatagtgaatcacaggtagacggaaacctccaaatccttttttttacattacagattctagttatttaatttgttagcttttttttttttttgctgccagataaactgacaaggggcagaaacttactgaaaattttgagaactgtagaaaaaattcacacaaaaaaagttaaaaatgtgacttaatttttaaaatgtgactccttcagttttctatacatttgaattttattttaagacccgagatgaagatactggaatagttggagggtggagggggtaataagcctcctaccaaatcttctagcagccgtgccagcctggatgggggagtggtttggagaaagagtctagcaggaatggaaaaagccaagccttttcctttagcttaatgtttcaaaaatgcttctccttggtgatgaggtgtaagcagcaaactctcacaatctagccatctctgtgtttttgtctcagtgaaccagcagaaacatgtaatttttaggcataataacttctctttatgtaatcaacaatccaccaaatacatcctgacttattagacgatctgctcctcctcatggtaggaagaagaggaaatcctgaatatctgaagtaggcttgagagagattattcactagtgtgggctcctgagaaaattaccagacctctttcatctgaaagtcaaggattaacccaagtaatgtggtactttctaaacagtatagcatgctacaagcattgtccccactgaagagctaaaaacactgtcttaatatcttagtaaatcttagtatctttttccttttttaatgttttattgagacaggggtcttgctacgttgccaagccaggtctcgaactcctggcctcaagcaatcctcctgccttggcctcccaaagtctgggattataggtactagccaccgtgcctggccaaatcttagtgtcttagtatctcagtaaatacacttaatatgcttaataaatacttagaacacaactgtaaataataaaaacttaacatacttggtacaaacttaatcaaatatttaatatcttagagttaacatattaagataacaggttatttgcccaaagtcataaggtgaagtagaggcaggaattgggcttcctagcctggagtccttttctccacctcaaggggctacgcagacctccaactaaatgctgagtttctcggtactgaaacagccctaggagaatgaataggacacagcgccatccctggccagtactatcaggtactacagtttggataccataacctacagtgtagccaggacctccctgaccagcccatctcttcccagcagccaccgtggtcctgagagctgggttaagccatcacctttaaaatcctgggaccacactgtgcaatgcatgaatgggagaccctcagctgttagccacgaagcacagatgagttcagtagacagccaagagaatcacaagtcatggcgtgggggcagccaaagacattcattcattcagtgactcttgattgagctctcacaagttaatacaccgtagtccctggcacagatgttatgaacctcaaggagtcttctgtatagtatgggaagcagaaatgagaacaaacaataatacaatgtgatgacaacaatattaatatatgtgcaaagtgctcaggaggcccaggtattgggacactgactttacaacgatggggcagaagtctgagaggtcctgtgtgaaggaaataggtagaaactagttcttcgaggaaacgaccccgagttggggtggtgcaatggaaagcaagtcctcttactagggagttgtttgtttacatctctagtgtttgacccacagagtcagctcctgggttgggtttttgttttccagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggtacagtagaacccaaaagagaaaagtaaaatatttcttatgcctatttttttttaaatcaaaagggagagaacaaaagctataccaaaagggccatgtttcaagaaaatggatttaaacatatttccctgtggaggtaaagaacattcttatacatttatcagtttcctgctttttttaaaaattaattttttaaataaaagtaatgtatgtataaatataaaatatcaaatcttactaaaagacataatgaaaagcagtaataagctttgttttgaattcagctaaatgcatagcgcttctgtggaatgtattaggcgatgaaattgctgtggtatcaaagttcttatagaggctgcatttttacaggttgggctgttaagtgcagcagaaattgtgggttcttaacagaaatagcattttcaagtattaaatattaaactggttagcaattcttttgctcagccaaattaagctaagatcaagaacttacaagttaaatgaaaaaacaatttgtagtatgtgaatataaaaagtgactacaacaacaaaaaataaaaatcatccatcaccattgagagattaataattttgatttgatcaaagaacttttggaaatagtgtttatcaggcataacatcaattattgatttgttttgcaaatggaggtaagtttagaaaattaatgtagactgattataatcatcaggagtctgtaatggcccctattaacattttttttttttttttgagacaaagtctcactctgttgcccaggctggagtgcagtggtgtgatctcagctcactgcagcctccacctccctggttcaagtgattctcctgcctcagcctcccaagtagctgggactacaggcacacaccaccacacatggctaatttttgtatttttagtagagatggggttttgccatattggccaggctggtcttgaactcctgacctcaagtgatccgcctgcctcggcctcccaaagtgctggaattacaggtgtcagccacctgtacctggtccctgctaacatttgatttgtttatttaagcaaatctaagcctttaaaaaggcacagagattaagtccattgattacatcattcgtcactatgcgcttggtattgaaaaaaatattttggacccttgatttgtattcttttaaaattaaaacatttctattaaaataacatttgcttctatttctggcagctcattttcttataactggcccatgattgactagtctctggtaggcattcgagtctgtgtgtcctgctttttctgttcctgttcttatgttttatgctgaatgagtaaaagtaggagacccagctgcagaagtcatttctcctgagagactcccttctgtcctgcttcagtgccttcagacttgctttacagtcatttttttaatcaacattccacatttccaaaggatcagaatttttttcacagaaccaacacactgtattagtcttgccaaagtgcttccaaatcaacaagggcctattgcatttcagttatttttttctattcctaatgctagactgtattttttcttttttttttttttgaggcagagtctcactctgttgcccaggctgcagtgcaataacatgatcttggctcaccgcaacctctgcctcccaggttcaagtgattctcctgcctcagcctcccaagtagctgggattacaggcatgtgccaccatacccagttaattgtatttagtagagatggggtttcaccatgttggtcaggctgttcttgaactcctgacctcaggtgatccactcgcctcggcctaccaaagtgctgggattacaggtgtgagccactgcacctggctgagactgccttttgactgatgacttatgtttagctctgatgtgctgacagggacaaaatgctggagaaggaataaaaaaggaataatccaacaaggatcaagagaacaggaaaggagacaatagctaatgaaaggtttccaacaatttgggggagttgaaaaaaaagagtcgaggtaattgacttaacagagaaagctacaacctcactgattacagaggggaacacggaaaggaggcaagcctatttacccccacagaatcctggaaaaattcagcaattggaagtacaaagtgtaggtgaggcaatgagcagaaaacaggaagattctttgaaagcctatataagcctatacaatcctctgattcatacctccctctcatagagccagcaactattcttattctaccatcataaggaacaggaagtttgttttctcataaaattgaaccagagaggctctacacttcggtgtgccaggcccagcaaaggaagcaatgaagcattttactgaacacagagagactgaagaaaacctgctggtggcatggagtcagatctctaaaccaacttggttccaagacactggcagcagatacagacttacctctggagaagctgaaagctctagctaaaatacatacagataatgacatctggaggtttcctaatgaaatgatcaggtccccaaccaatcatcttgctatgaaatccctcagagaacaagccacatccacaaacacagagctttcagtcgactttttaatggactaattagtcaatttatgaatggacaaccaaaggtcagcaggcatttgaagaaaggctctaatacgaaagagaggtagcttggtacggtggcgtgaaaatccagcactttgggaggccgaggcaggcgaatcgcctgaggtcaggagttcaagcccagcctgaccaacatggtgaaaccccatctctactaaaaatacaaaaattagccaggcatggtggcaggtgcctgtaaccccagctactacagaggctgaggcagaagaatcacttgaacctgggaggtggaagttgcagtgagctgagatcgtaccactgcactccagcctgggtgacagagcaagactccatctcaaataaataaataaattactagataaatgagaggcaatgcaaacaacaagaaaaacatgaaacagaatatgaatgaaaaaaagataatgttgagaaaaaagcaaccttttttaatgcttaatattggtatttagtattcttagagagttagttaaaggtccatgaaagaacaagatgttatgaaaaagggacagaacaagcaagtctccttgaaaattaaaaatttgagcaccaaaatgaaaaattcaataaagtagaagataaagtctaaggaagtaggataaaaagacaaaaatagaaaataggagtgaaagataagaaaatttgaagctaaatcaaggatgtccaatttttgacaataagagttccagaaagaaaggacagagaaaggggaaatggaactttccaagaacgaaatgacgcaatctccagattgaaagggtataatggattaagattcacttccaaacatatcataccctagaagcttctggaaagagaaaaaagtaagccaaatatgtaaagtatcagaaatggaaagtcttctctctagcaacactgaaagctaaaagactgtgaagaaaggccttcagaattctgaggaaaaatgctttggaaatagaactctataaactaaagactcatacaggggctcaaaaaatgtacttctcatggttatgctccagcaaaggaaactgataagaaagaggaagtcatagatggaggaaacagggaacctactatggaagagacagagagatgtcccaggagaagagaaattcatctggcctatggaacagccagttggtattacagcagaaggatgcagtgctctggatggaaagttttccaggaagaaataaaaatgagtcagacaagtagcctgaaaatgttgaaagattttggccagatccattgagcacttggagaaaaaatagtgttaagcatataggaaacaaagcagatgaaaaaataatacaattacaagttccaggaaaggcaaaaaggttaataagaaaggaaacataatgaaagaacattatgtttacatagtcttaataatagaaatattactatgggccggaggtggtggctcatgcctacaatcccagcactttgggaggccaaggtgggtgggtcacttgaggctgggagtttgtgaccaacctggctaacatggcgaaaccctgtctctactaaaaatacaaaaattagctgggtgtggtggtgcgtgcctgtagtcccacctgcttgggaggctgaggcaggagaattgcttgaacttggggggcagaagttgcagtgagctgagattgtgacactgcactgtagcctgggtgacagagtgagaccttttctaaaaaaaattaaaaaaataaaaatattactatggattcaaccaaaacttgtaaataattgagtaagagcccaaatgcttattctccataataagaactcaatgcgaaagtctaaaatttataaatgagtaattagcagtgtacccaaattcattacaaaatggagctcaatgtggaaaaaagtggttaaaaactgaaagtggttgccttcatggaatgtgactaggtaatggggagggatagagaggggataaccttttgtataaggtcttctagttctatcttattaattcatatcttttattttgctatacataaataattttgagaaggtttaggataaaataagttggatcttttattcaaaaattgttttgtttttttctgattatgtaaataatataatcatttttaaaattggttcagtagtaagcctaaatgatagcttacccatcttgtaaactagtttactagagaaaacagaccaacaataacactctctcctttctcatttgcttcagggtttgagaatgtttttagctggtggcaataaatattagaagcctgcagaatccagctacgaatatagagggttttgctcttgaatttctggttcaaattcttatctatcaatgttatgcccactgtgctctccagctgtggtctgtgaattactgtggtataacgtgactgttcaaatttcacttttcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcggtaagttttgcctactcagccctcctcactgttacactaccttccccccctactccatcacactactatctactcatattcagagcctattagaaagtgctatgtgatttagatcacattaacaggtcagagaactgtccaaggggagtggtttccgttcaactctaaatgtctagctgtagatcacatagctgcatttcccaggtcagttacaaagtgggagagtggcaagtgttaacatccttagtttatagatggaaaagctgagatgctttattcctttattcagcacctcaaaggacaatcagggtatcacagagcaggaaaggataggaaagtcatatactccagctctctgtctttaggccaaaacatgactgagccaattcaactagttttggaaatcttccaagaaggcagtaacccaattcaatgtttaaacatcctccaactctgtcaaaagttctataatagcaaaccatcctcaaaacctcttggtgcattatgggagataaatagcaggttccttctagccctgtatttcatgttttgagtatatgaagagtgagaatttcccgtaacttagatcatgaatctaacttagatttcgtaacttagatcatgaatcctgcaaggtttccgcggctagctaccaaggtagaagaagaggttgcctaacaaaaatgctaagagatcctggtgagaagaaggtgggagtagctgcaggagacgttatactttcacttgccttaagtttaattgcatcaaagatgaatccgcagatgcgatgtcaattcgaggcagagagtattggggggcattgaagcaatggggagccaagtaacgtggagaagagtgagagacacacaggtcaggagagaaagaaaccaactctaatactgacaccgaggtttctgatggtcaaaagagttcctgaataaaccaaaagtaagttattaagctctgagacaacccatttaccaggaaagctggggtaggtcttggtttcgcaccttattgtttcaaatgactgatattttgagagaaagaactacagaactatctctgagcacagcagaggagacagttcatcagttgctttcccccacagacagtcacaatgttatgtgatgtatttcagaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaaacttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatcttattgctccttggagattttttgtgtttggttttggtttctgccaatgacatctcacaggaggaaaacatctggactacagacatgttctacttgagtctcccatgatcggcacacacagttgtatttttaaaatttgttgtcaatgtttaaaaattaggagatatcacataaaaaccagaataacttcttttaaaaaatcatactatctgacaatattgacctcatgcttttgcatggcaaaggtctgagaagcaccttcttcagatgggacagtgctctgtgggtcactcttccccatccgctgtgccccagccctgcccaagcccctctactgaggctgctgttggttgccacttatcactgtgcttgggcaattgttttccttatgtctagcccacttcacttatttatgttgcctgcactgtgggtgtctgaattctggtgatggtccagaggaggtggtaagaatcatcagaaacccttcctaagtcataggttagggaacatgattgagaggtagggaagtagggggcatgggtgtgagagaaaaatattttagagtaaaatcaacacatcatctttttttgctacctaaatgccccaggggacaaaggtacacctcccaaatatagtaaaagttcaatatgaagaaggccttcaaatcagtttctttctaacgaaatacgtcaaggtagaagaaaaatagtacaaaactcagagaaagctcagctcccagtatggagagcatcatttttcagtgaagagtccgtgataagctgtgaaattcagatgagaattcaaacattttcagacattcagcgagtcagagcaacccaagaactaaactcattatatgcattttctcaagaaaaccctcccaggagtttcctgggcctacagaaatggtgtgccaaccatcttcaacaatgcagagcaactttttgtttatgattcttgtcctttcttgctaccatcttgcacagtgtcagaatcatccttagaaacagtaatagaggccaat

SEQ ID NO: 17345 - DNA, 85665 bp, Human
agatgctgtctgtcacccctttctttgactaggaaagggaactccctgatcccttgcatttcctgagtgaggcaatgcctcgccctgctttggctcgtgcacggtgcactgcacccactatcctgtgcccactgtctggcactccgtagtgagatgaacccagtaccgcagatggaaatgcagaaatcacccgtcttctgcatcactcatgctgggaactgtagaccagagctgttcctattcggccatcttggctgcctatcgaggccattattattcactgtttgggagactgcaatagtcgtttcaacaaatgaaattgattccactttccacactgtagccagaaggaatatttctaagtcaaatctcaacatttgcttctctgcctacaattctttattggtccccagcctgacctcctactactctccaggtttatatgtaaaaactatttgctagtttcagttatgggattgcccatttgtccctttttgtctttacattcttttgtttacaatttccttcttggtctcacaggtgaatcttttcttcagcctcagcttccaggttctctcctctgagaaaccatcctaaatcatccagatggtaaggcatgttctctcagatcaacaattatctttattatgtaactgccaggcgttaactgtgtatgctggaaattgaactgtgaagacagtgtttcctgtcctcataaagtatatagagagggagactaacattttagacagtttagtcagttttattgaatgctataaagatgtcgtgttatgattataatatatgtataccttatatgcacagtatgttacggacgtataaccatcttaggagagtatcagaggccagcttcccttggagacattgaaatttaatgggtggtcccattataacctttagaattctctattaaaaagtacctgggcaaatgcttttgaattgttgctgtgaaaatactattttgactagctaatacgttatataccacaactctcaaaagatccttttgaccatcacaaatctaagactgatctacaatctatgggcagattgaagtccacaatttaaatttatgtataacaggtagtatgtacaggatcttctactcctagcaataacctagccagtattatccctattttatagataaggaagttgaggctcaactattccaaagtccccctattcagcagttgagtcagtcagtggtcccaacccaggggtttcaggacgccaagctctctttccaccatgcacttgcctacttctgtatcttatttccagaatcttctagtgtttagtcgctagtaggtgcctcacaaataaatacacgtgaaagcctaatgctaaaagtagcattatttttactatcaacctcaccaacacacactacgacttcatcccattaggactgagaggctttccacatctggtttaaagcttgcacaaaaaatagtaattccaagctgtgcattaaaccccattacaccctgttttgtactcaatgccactaatttcccacaacgtcgtcagggaaaaaaacgacaacaaaaacatcttttgacaatattagtcttctaagtccgccttccacgtccctctaagggccccagctccgggtccgtcttcttaggcactcaaggtttctaaacttggggcttccagccggtaaaactaaaggcacggggttcaggggtcattggaggcccacgggacccccttaaccccttccaccccttccctattcgcccatctccatgtcgtctccttagcctttgagtggaaaaagcgtcagcccgaaatccccaccaagcccaagaatgggcaaaacctcggcgcgcacaggaccagcgagaagaggatggttccggccctgagactagagcggcggcgacgctcggcgtacgcgctgccgtcacgccgcagcccggcagcgcaggctcctcccacgacgctgcgggtccggtttccggcgggagcgtgggccgccagactcgggagaggctccgtcttgtgcaagggtcctgtgggctggctgcactggcctctgcggtggtgcctgccagaatgccccacttggaaaacgtggtgctttgtcgcgagtctcaagtgtccatcttgcagtccttgtttggagaggtattgtagttaaactgtcttccagatcctggaggcagacgtttcggtagtcttgcgacctgttccaatatttgttttttcgtgtttggattgagggccaaaaggccgtttttacgttaaataggggtgttgtggttctgtactgcagcttcacccacagtctcttccgaatattgaagaggagacagtctgagagcgaccggcctgcactataggacgttgcctaagacgtatttgaaacacgccacacttttcagaagtttgcccacattagctcctagaagttgcttgttatcttaccccaacccaatgacatttatgtaacagatgtgtttgcagggtgttatttattcaaatgtaagttcacacgtttctgtgcggtagttggagtgagtcaagtgtagagaggtggttgctttcaaggccactaagggccaaagcagtgcttcaggtttaaaaatttactggcttttccagaattgtaacagtccagaagaggtctagggtaaacttttctccttaactgatagttcacaggatgccctagagaggagtttgtcttgtctggatgaacatagatacgtagggagtcctttcaataggcagagggtagcgttcaccaattcaaaatttaacctatttttgactattttctggtggtctttgatgtgctttttgattcagactcaatcagaattggaattaatcaaacttggatcttacctgcgaagagagtgaatgagaattcagggtcatactcatacccccatcttctggtttgcttttttaagtacagtcatgcgttgctgccacttagtgagggggatacgtcctgagaaatgcatcgttaggcaatttaatccctgtgaatatcagaaagtgtatttacacaaacctagatggtgtagcctgctatacacctaggctgtatggtgtagcctgttcctcctaggctataaacctctacagcggtgctactatactgaatactgtaggcagttgtaacacagtgataagtctgcatctaaaagtatctaaacatagaaaaggtacagtgaaaatagggtattataatcttatgagatcactgttgtatatgtggtccatctttgaatgtacacgtgactgtactttcatccaactagaaatattgcatggcaatttgaggtggcctgtgaagcattagtggaaaagtactaccctctgtctaaaggggtgcattatttagggaagttagaggtcaacaactgcatcttcaattaattttctatttatactgctttcaattatagttatattattactggagcattttcttgattatgttctctgcatttcatctatggaacgcagatcactccagccagaaatgttcctgctgaaagagcaaattggcaaatagggatgagtaaacttagtggtggatcacagaagagtttttgacctttgcttttaatgaaaattatgtttaacaatattttaatatcagttttctgcaaggtgctgtgcatgtgggaaatacaaacaactatagcaaagaaatataaaaaattggttcatgtttctaagaatactcatttatttgttcaataaataaatatttaccgagcaccttttctgtgtcaggcactagcttattgcagtttatgttagcgagatttatgaaggtgaaaggttaaataacagtggaacagttcaatataattctaggtcacaatagaaaagatgtttaaggtattattaggcaacaacatgtaatggatagcagagatactcagcaacatgcatttaattcttgagacagaattttttgtttttgttttttgagacagggtttggctttctttcccaggctggagtgcagtggcatgatcttggctcactgcagtctctgcctcccaggctcaagcagtccgcccacctcagcctccgagtagctgggaccacaggtgtttgcctccaagcctggctatttttgtgttttttgtagagatggggtttcactgtatttcccaggcgaactcctgaactcaagtgatctgcctgccttggcctcccaaagtgttgggatgacaggcttgagccactgcatcctgctgagacagaatttttgggccagttaatttatgattgttacatataaacttcagaaaaagattcatgtattacattacctattcatttcaagtaaatttttagtctatttttagcagttgagctgcttttgccatagctgtatgccatttagaaagtctttttcctgcgtaaatctgagttcctgatttgtcttgtaaaaggaaatgtttaacttagtgacttgaatgtaataaatgtttgtgactgttgctgtaatcgatgataattaatagagacttaactttctgatagaaattgcataatcccattttcttgtaattatttaaaaaaatgtattattaaaaaataggccaggcacagtggctcacacctgtaatcccagcactttgggaggctgaggcaggcagatcacaaggtcaggagtttgagaccagcctgaccaacatggtgaaactccgtcttaactaaaaatacaaaaattagctgggtgtggtggcacacacctgtaatcccagctactcaggaggctgaggcaggagaatcgcttaaacccgggaggcagaggttgaagtgagccgaggtcacgccattgcactccagcctgggtgacagggtgagactccatctcaaaaaaaaaaaaaaaaaaaaaagagtattattaaaaaatcaagttttcccgtaattattttaaaaatgtagactataatttcctccaaagtagataatgtcttttactgttatttgttctcttcagtacctcatggttttcagcatttagtaggtatctaatgaaagcgttcatttaaggaatgaagtacaagtatttgtagtattaactagaccagagagacctttgacaatatttacttttctctaagctgctaacctaatgtactgcaagaggatcttgcacatatgtattttaaaataaatgctatgcagattttattagtgttttatgtgatctaatgtatgcatttatgccagcatcagtgagtatgcatagttcagaagtagtctataagttttcctaagaatgaggacccttgaaattccttttaatcttttgattatatgtactttatttcatagcattaaaatgtatagtgaagttgtggcatcgcaggagataagagtctttaagaaggagtaatataaaaatggagtatgaacaaaattatccttgaaaaatctcttaaatctgctatgaagttgaaaatactagtttgtatatgtaaacctgtacgataataaaaatataaatatatagtacataataaaatatgccaaatatgttacatacattttaatttcataacaaagaaagtgcttagagttgaattcaagtaggttcaaagtgtgttgatgcatccacaatatgctcattgttaggaatttggattgaatatttcacttttccacgtacaactttctcacaagttgataagtgtttattttctattttgtatgtgcagcctcatatttgtcttttctctcgttagagacatcatttcagctttccatccatttttatttatggacatactgctagtggaaagacctatgtaacacaaacgttgttgaaaactttagaggtaagaataaaaatattaaatatttctttgccctttttagtgtataatattggtactgataattgtgaatctccacaaatgcaaaattgaacataccacctttacattactctccttcccatattatctttctccatgaatggtctactgtcattgacacagttgtccaaacttgcactttcttaactctttcctcatcttccctcatttagtaaatcacatcaataaacttagtctgttgcttcacattgttaaaatcatgtctccatctacctttaatcctagccattgctgctaggattttcatttaccattgttttttttccatgtatttctgtaagcctcttatttgcaatcttcacccagcagctaggccatgcaaatcttaatattttcaggacagtgttcaagtaattcgcccattgtataagacctttcatgagctgaatttatctttcataacacagtggttaagagtttgggctgtggagtctggcagactcatgttcctttttggattcaccagttagtgctttctccatctgcaaagttggctcatagtgacaacatttgggattaagagaattaaatgttagcacatggaaagtgctttctgcagtacatagtgcgtagtaagcactcaataaaggttagctgctattattgatgagtattgccatactccctttcatatcctaaaccagagatgggcagtctttttcttaagggccggataacgaacattttgtgcttgtggaccacgtagtttctgtctcacctgcttgactctactgtattgtgaaagcagccatgggcattctctatgtgaatgggcatgactgtgtttcaaagcaacagtatgtacaaaaacaggtggctagcccacaggctttggcttgctaaccccgtcctcctctagcactgaggatgcacgtttaggatagcatactgaactgtgtacagttcctgctgtcttactttcaagccatggcacatgttgctcccctacttggaatggctttcctgtactcgctcttcctgttgcttggcaaatgcttatttattttgccaggttttcttctacttatactctacaaggtctttcctgatcctctaggctgtatcagatgcccccctgttttgcaaccttagcaccctgtgcttaattctgtcataatatttagccttctcagctatgattttgtgtttatgtttccctgactttagattgtgagtttcttgaaattatccccagcaccaagcacattacttggcatgtattaacttgtggatttcagcttattaagttgtagatttcagcttttgatctcaaagatcagctgtgcattttaaaaaacacatatgcctgggctatatactggacttcagaatctgagtgtacaaggtcttggtccaggcatttgcatttcagaaccccctgaatgaagtgcccccaaaatatatgttgaataaaagcaataaaacccagtaaggaagtttcatatttaaggactgtattccattttttatcacactgtagtttctgctgttacttaatcagtgtaatatatgattattgttactacttctgatacagggactcagacaggcacttagaatatgctgcctttaaaagtcatggatggtacaaatgccgtaagcaagacactattcataacagagatgttgtggacttttgttcttaaaggacagtaaaggagtgagagagaagtgagttagcaaatgctggtgaaactgtccccaagtaagtttaatgtggctttagtgacactgttattcagagaaagaaaagcctccttattggataaagtttataaaatcactaaaaatagttaccagttccattatttgtgccaagtgccacaagttatcttcctcagaatgaatctgcttttgtgatcttattttgaggatagactgtattggtgagcaagtctcgtttgtgaccttattacttctggagttaactcatgttgatattttgatagttttttaaatgaagggctagttttttttgttttgttttgtttttaaatggggtcttgctctattgcccaggttggagtgcagtgttatgatcatagctcattgcagccatgaattcctgggctcaagtgatacttccacctcagcctcccaagtagctgggactatagatgtgcaccaccaggcctgtctaattttttttacttttttaaagacagagtctcactgtgtttcccaggctgatcttgaactccaggggtcaaatgatcctcccacccatcctaaagcactgggattacaggcaggagccatatgcctagcaaagagctagtgcttacagtcctcgtaggaggattgctatggtttctaactcttaaaattctttttttttttgacttagtaaacgtttattcaaggatattatattaaagttataagtgtgaaattcctattaagatttttaacattcaaatatgcttagatttcttttcttttttttttttttttaatagtgacagggtctcgctatgttgcccaggctggtctggaactcctgacccaaagccttgggattacagacatgatccaccatgcctggctgatttctttataagaattctttataggaaaatacaaatttgctttgaatttccataagaaagaaatggcaagctgaaagaaataattgaagtgagtttaatgaagggacagttttataatggaaattttatgggaatcactaagggatgatggtacaccagggcctttaccacctccaggcctgaagggaccatagaaaggagctgttattggaaccaaacaagaggtgtagccttagaagaggggctgtccaacttgatctttggtagaagagtatccactgccaagctagggccactgaggggtcatggtgggagtcaaggaaatcaatatccaaacttctctcccaccattctcccttagtctcctgctggttctttccattggcttctccatccagagacagaaaataagagagtccaggtgatgtaattctgtagctgtcaggctcttggggcatggggtgggtttggtgggatatagatttagaaaggcaaatggagactatccagcacagccattattgtgtttgtgtgttttcttctttacttacagtgttttggttttcgttttcagctcccacatgtgtttgtgaattgtgttgaatgctttacattgaggctgcttttggaacaaattttaaacaaattgaatcatcttagttcttcagaggatggatgttctactgaaataacctgtgaaacatttaatgactttgttcgcttgtttaaacaagtaaccacagctgaaaatcttaaagatcagactgtatatattgtaagtaatttcatttgattagatcatctcttatcttgaaaactgataatttattagatcaattttcatatatttgttttgagtctcattatgtacagtgctctgtgccaggtgcttttagtatacagaaatgtattaaatatattccttatccaagggaagcttcatttaatagaaaaggtatgacacatacatacgactacatgcagaatgtgataagtgattgtcaccagatgcaaaatattgactgtgtgtgtccaatacagcttcatgaggtattagcatttgagacagacctaaatgaatcagagtattctaggaagaaattgaagtagaggaatttcagatagaattatataagtaaaggcatgcagctgaaaatggaggccagagagtaccaaatagtctagttttagtgggttataaagtatgacgggagaaaaagaagactggaagataggttgggcagattgtggaaggtctagaaaactatactaaagcacttcatttaatttcttagggagtggataggagatagtaaagactttagagcaacaaatatgcctggttactctgaagacatgttaaaatgatcatctttggaattggataagaactacccaagactggatagtttataaaggaaagagatttaattgacttacagttcagcgtggctggggaggcctcaggaaacttataatcagcagaaggcaaaggggaagcaaggcacctgcttcacaaagtagaaggaaggagaagctccttataaaatcgtcagatcagatgtgagctcactatcacaagaacagcatgggggaaccacccccaagattcatttacctccacctggtctctcccttgacacatggagattatggagattacaagttaagatgagatttggatggggacacaaagcctgaccacaccattccacacttggcctctcccaaatctcatgtcggtttcacatttcaaagtcaactgtggcttcccaatagtcccccaaagtcttaactcattccagcttaattagcccaaaagtccaagtccaaagtctcatctgagataaggcaagtcccttccacctatgagcctataaaatcaaaagtaagttagttactttctagatacaatggagatacaggcaatgggtaaatacagccttttcaaatgggagaaattggcccaaacaaaggggctgtaggccccaagaaagtctgcaatccaataaggcagtcattaaactttaaagttccaaaatgatctcctttgactccatgcctcacatccagcccactgatgcaagagtgggctcccacagcctcatgcagctcgacctctgtggctccatgcctcacatccagcccactgatgcaagagtgggctcccatggcctcgtgcagctccacctctgtggctttgcggggtacagttgccctctctgctgttttcacaggctggcgttgagtatctgtggcttttccatgcacacagtgcaagctgttgaatctgccattctggggtctggaggatggtggccctcttctcatagctccactaggcagtgccccagtggggactctgtagggggggtccaaccccacattccccttctgtactgccctagtagaggttctccatgagggccctgcacctacagccaacttctgcctggacatccaggcatttctgtacatcctctgaaatctaggcagaggttcccaaacgttaattcttgattgctgtgcacctgcaggccccacatgtaagccgccaaggcttggggcttgcactctctgaagcaacagcctgagctatacgctggccccttttagccatgagtggggatgcaggacaccaagttccgagactgcacaaagcagcaaggccctggcccacaaaaccatttttccctcttaggcctctgggcctgtaatgggatgggctgccacgtgaagaccttggagacattttccccgttgtcttggctgttaacatttggctccttgttacttatgcacatttctgcagctggcttgaatttctccccagaaaatgggttttttcttttctacctcatggtctggccacagattttccaaagttttatgctctgcttcccttttaaatgtaagttccagttttagataatctctttgtgaatgcatatgactgaatgctttcagaatcagccaggtcacctgttgaatgctttgctgcttagaaatttcttccaccagataccctaaatcatctttctcaagttcaaagttccacagatctctagggcaggggcaaaatgccacccttctctttgctagagcatagcaagagtcacttttattccctgtccccaattagttcctcatgtccatctatgaccacctcagtctgtacttcattgtccatatcactatcaacattttggtcaaagccatctaacaagtctctaggaagttgcaaactttcccatttcttcctgtcttctgagccctccatcctgttccaacctctgcctattactcagttgctataacagactaccaaggactgggtaatttataaagaaaagacatttatttctcacagttgtggaggttaggaagtcaaaggttgaggtccctgcatctggcaagggctttcttgctgcctcctctcatgatgaaagtagaagtacaagagaggatgagagtgagagcaagaggtggcagaagtcccttttataataaagccattctctcaataacccactcccttgataacaatattaattcattcatgaggacagagcccttatgacttaatcatcttttatgcagcttctcttcccaatactgccacactggggattaagttccaacacatgaactttgggggacatagtcaaatcatgtcattttgtaaaggctttgtaaatgcatttctttttgttttgtttttttgttttttaaaggttctagataaagcagagtatctaagagatatggaagcaaatcttttgcctggatttcttagattacaagaattggtaagtaatgtgagaaagtgctttctccccacaacttaatcaatggattgtgttgtaaaagtttttcattttgctatttgataggtgagaattagtattttaatataattttagtttgcatttcttttatcagtaaagctcagtgtttttttcatagtaaaatcagttggtgatttgatagcatttattcttcaattattttagctttttctctgtaattatgaagtcactgctttctattaaaagttttagatgttgctagaataaatggcagagggccagactttaaaatctcaaggattttaaaattttctttgcatttcaaaataaggataatctaaaataagaatagcatggctattctggatcatctggatttctaccttataatcactcagtgtcagagtttacttttgtatttcagtttactcttgtgttggcttcacaaagtacagtaagtcctcacttaacatctcagtagattcttggaaattgcaactttaagtgaactagcctacagcaggttcttccttaccttcagcatcatttcattataacattgttgaggaaaaaaaattggtttcattatatgttgcacttaaagtcacagtttcccagaacctatcaacaatattaagcgaagggttactaattaattctactgtgaatgtcatggcccaataagaaaaggacaggggcggacttactaggcatttgtgtcaggtgaaagccaaataatatcacagatgaaacagggttttgtaatagtttgaataaggaaaattggtgagggaaatagctgtggttgtttccaggtgaaaccatattcaccgtattcataaagggaataaagatttagtttgagcaaaacaatactattcaatatattcagttaatattaatttcaattttattggttttatagttcgtatttataaatttattttggttttataattttgtaagtgctttgagtataagcagtttatacctacctaattttatgtttgtatgtattaaagtattaagtaatattataataaagtaaatacttggggagaagtgcttaaagcatttctgcctttcaaagttaaatacattactcaaatttgagaatctgctggaagtttagagaggccactgaaattactgtgtgcccaaggctgactcctgaagtttacttttagtaatagttgagggacgagaggtatagagaggacaggataataagtgtagctattggtggcctattctggaagttaacctcacacagtcttgcttttctttgtttcattaactcttgacattttattactgagactcaagatctatcttctttgagtagatgtctactcatttcctatttcctttccttttatttatttgtttcatttgtatttgtgggttttcgcatactcatccactatttcctgttgctttgctctagaactcaccatctggtatccagagtgcagtattgtcttcttgccttttcagtgtagatcaccctgttttttcctccttatgcccagtaatggtgatcatgcatcccttcacaacaattaggacttttcaccgttttttagtttcaattacagaaactgtttgaagaaaattaaaagatttagagtaatctcagctgaactggaaaagagaattgctttgacatttctgcaaacatgcttgatttttaaaaatgtatttcatttaagagaaatctggcaaaagcatttctcatttttttatgttaagtatttatctaagtaaagggaagtttaaaatatggtggatatcatgtatactgaaagtacttatcagatgaatagatgagaacattaccaatttaaaatctttctgcccaataaatatcttcttcttttaagcctctcaatatatttaaactgattttataaaatgcttttagataatcatatttttatagcaaaaacaattcaataatttgttattaggaatgtgattagggcatgctattttacccctctagaaataaattcagagattcttaaaaaatcagatccaatatgatggctaatgcctataattccagcactttgagaggctgaggcaggaggatcgcttgagtccaggagttcaagaccagcctgggcaacatacagagatcctgtctttataaaagatacagaatttagctgggcatggtggcacatgcctcagctacttgagaggtataggaggatcacttatgcctaggaggttgaggccacagtgagctgtgattatgccactgcactccagcttggatgtgtgacagtttgcaaacgaatgagctccttgattaggttttctaaatatggtttattaatatgcaaataatttgttataggttagaactctggggggatgtatttgaaagaaaaatccaaatggaaatactgctccgattaagatttttaaatgcaaagttacttttatttctttctttttacaggctgacagaaatgtgactgttctctttctcagtgaaattgtttgggaaaagtttcgtccaaatactggatgctttgagccgtttgtcttatatttccctgattacagcataggtaaaccttaaaacattgttttggcaaatgatatgcaggagaatagtttttgttgtttgaaagattaaactagcatattcaaatgggaatactttgttattcccatttgatattcaaatgggaattataaatttgatattcaaatgggaatttgatattgaaatgggaatatcaaagtattattgccattcaaatgggaatatcaaagtattaaactgttaaggtttgctgccaatctcaaataagatgtttgtatttctgcacttacaaaatttttattttggaactgtgagaggttattgtataattactacatttttttggatgagcagctctcatatttgtgctaatgtatcttcatttttttagtcactacattaagatgtatatttatattgtgattatgacatctgtacgaataatcagactagacttgtaaagcatattaagagtgttgaaatcttcatttaccatatacttgggttaagtaccatgttgcgcttatatcttttgattttataaatctcattttctttactgtaactcatacagtaccaattaccagcccttgtgtttcttattttcttgggggctctatttaatcttaaatttcatagatcctgatgattttggtctttggaagaacacaatagctttttgtgttgctgaatagctttgtggattaagactgggctgtcatacagagatgatacttgggattcagagattataactgtgaagtataagatggttagcagtctataaaaaaatagcattccatgaccttggcctcattaacactatccctctgaactaatcagctgtaaacataccttaagattaacacatttttgtctgtttccaccagaacagcagtgaaataacaccttctgtcatagccaattagctgagtttttttttaaacagcaacccaaaatagatggagtctttattgtcattaatttctcatccataaaaatcccaaaataaaaaagggtaagaggaaaagtgataaaggattttatttaaaaaaaaaaaaaaaaaaggctctgtacctgtgtcagcactgttcatagttcagtttttcatgacccattttaagtactgaaaaattatttagaatttaagaaaattattaaaaaatgttgatattacacatttcagtcaagttgaattaatgtaagtaattacagaattaaatttttaaaattctataatttaaatttatagatttaaaatttaaaaagtaaagatacaaagcagcatagatgaaagtttgaggacaaaagtaaataaaatggtcttactaattttagtgagtataggataatagatttttgcaaagtatataataatggagccaagttaaattctgattattaaattttagggggttttacatattcagttttgttttttttttttttaagcaaaaacactgtagtcagacaaaaagccattcagaaggggaatattaattgataagttgaaattatggttaagtgtggaaccagggcaaagagattatctaagtgattagtgttaccttgtcgtaataacttgaaacatgtccttttcaggaatatggtgtctgattttaaggaccgctctcctcttagcagttatggctaggagcccagtttggaagtcgttttctggtctttacctcatgcagactactcatctttcaatgatggatattttttctttagagagattataatgcatttgattaggtttttggtttagttattgtgtcagtttggatagattaagttatgttctgataacaatctgaaatttcagtgacttacagtttcctacctaagaacatttgtactgctgttgtcttacattttacttctatatttattataaaccatgtaatactatattaattataaaacctcaactattattataaacctcagatattaaatattattattttggctttaaaaaataacaggacaaaaaagaaaataacttttattgtttatcctgctggggatttgttgagttcttaagtctgtgggtgtatagtttcatcagctttggaaaaatttcaggcagtgtttcttcaaatattttgtctgcccccctcaccttttcttctctatcttttttgtgtgggattgcattatagctatgttagagcactttatattgtcccactgaaagtctgtttatttaaattttaaatctttgtgtgtgtgtgttttatttgggattgttttttgtttctatatctttcagttcactgacttctttttttttttttaacaagtgtctagtgggcagctaatctaatcctgtagaatatttcattactgatctcattgtgcttttgttttcttttgtatccttgagcatatgagcatacttatgatagttgttttaattttcttgtgtactaattcagttacctcttttgttttgggtttgttcccaccgagtaatttttctccatcttgggtatccattatgctttttcatgtgtctagtagtttttgatagaattatagacattgtgctttttgttgtgttttggactttttctcattagcatttttaattacttacagatacagttgacccttttaaggctatttttaagctttttttggagagatgatccagagtagccattattccagggctaattttagctctacttctaagacatagtttttctggaatctctactgaatgccctgtatgtttagcatggtctctgccttctgactagtggcaacatgaaaaattcacagccctgtgtgatttctgggaattgacatatagctctccaataattgttttttccctaaaagttgttcttgcatggctagggttttaccctatgcatacacagattggtattaagctaagacttgaggggaacccctgtacagatttctggagctcttttttggcatagcttcctcccctcaggtactctaccctgcaaattctagctacctcagctccctcagctctggtctctgtctcctcaactcagtaggataaatgagctccttttgaaagtctccttgtaccacagtcttaaaattacttcttgttagaaagcctggctgatggtaggactcaccttatttgtttaccttttctcaggtattacggtccgttactgccatttgtttgatatttaaaaatagttgttttctatagtgtgtccagtttttaattgattattagaggagggtatttctggatgttcctactccctcacaactggaagcagaagtctctctccaaggtaggaatggcttttctttgcacattagcctatacttggatagtgaaattttaagacccaaggagacaaccagtgggtttctcctaccctttgtttactacctcatgatacactgttttcagctttctattatagatgggatttttttttaatgaatttgaatagtcctagactgttagagctggcatgacttgcttattatagaattatactctgagatttttgtctgtagtctataaacaagttgctaggttacttttacagcaacacagtgaggattcctattcttataagactttcatcagggctgaaatcggccggtgataacatctaatcaactgtcttatgggatacagagggctacctgtaaggaatacctagatggagatgttcaaggggtactcagaagtgcagtctgagctggagactcaactgttttccagattttcttagccattcatttatagaagtttgttgttgttgttgttttgctttatgtatgttaatctctgtgatcatttatctcttccttccatctctcttttcttacatccatccagttatttggtaggttttataggtagatatctttgtttctaagttttatggtaccttttagaaattttcagtatattaactatttccccatgcctagttaaaaaaacttagtgacattatatttaaagtttgctattagaatgtaaaagtacatggactctacagggaagttttggctttttttttttttttcagcagttttgaaataaaaaagcaaattcagtaacagtgtctcatctagtatccattcaggctaatattctaagtataaaactaggctttgaaattttttttgtcaacttctgtgtttaaatattccttaatagagctatttctaaacttctgtttataaattttcagatagttcatatatattttttgatcttgtacctgcatctaattgattggcaggcacaagagtggttaaaatcaagggccaatggtaaatggcctggctaaaaatactaacttactgggaaccttaaacaaaaggaaattgacatgattagaatatcctggaagagtttttccttgtaatttttgcaaaaaacttgagccctctggaactaggtttaaagttgtagtcatatgcaaagagctcttaactaagaagtctaaggagagcattgcaccaagaagtcagaggatcttacaataaggaatgaatgactaattgattcctgtattatgactgggaaattttgaataatatatggttgtttccctttaaattttactgtgtttctaaaattatgattatttccagcaggataaagtataaggttaggactcttaatgtggtattttataaagagtctgagatataatagaagtagagtaaagatatcaaagttgtagggagaaaatacgttttatacaagggggaataacaaagtaaggactaggatcaggtgatgattattgtaaaaaaagattaattcttttcattttataaaacatgaagagcattttctagtttgttggcagtttatgtactatcccctttttcttcctagttgatttacttaataggaagaaaaataaactagaatctacagtattttttcccttgttactgattttgccggtaataaggttgttgagattttctttagatgtcattgttttctatttgtcttagtatttaataattttttttttaccctcagtttcaaaattgtgatttactttttcagaagtatttttactcaaaacacttctgacaccaaatgtgtggggtatttttgttcacccaacaacaaattcttcagttttctagatatcaaatgggtgtcctaaaattcaattcacttctgacactaactaccagaagttagtgcagacctcacaagttaagggcttagtcctacaagaatattagcatttcagacaccattctaagtcccaggtttctacctgtactccagaaaactggctataaattggggtttcacatgagcccctcctcaggtttgataatttgctagaatagctcacagaactcaaggaaacactgtacttactccatttatcataaaagatacaaatgaacagccagatgaacaggtacacaggacaaggaccagtggggtcccaagctcaggagcttctgtccctgtggggctggagtgtgctaccctctcagcatgtggatatatttactatcctggaaactctcagaacctcatcatttaggatttttttatggaggtgccattatatagtcatgatttgattaaatcattggtcattggtcatggattcagtctttagcccttctccttttcccaaggacaggaggtggggccttgatatggtttggctttgtgtccccactgagatctcatcttgaattataatcccgtaatccccacatgtcatggagggacctgttggaaggtaattgaatcatgggtgcgattcccccatgctgttctcaagatactgagttctcacgaaagctgttggttttataagtatccggcattttccctgctggcactcattctctctcctactgccctgttgagtgctttccaccatgattgtaagtttcctgaggcctccccagccatgcagaactgtgagtcaattaaacctcttttctttgtaaattacccagtcatgggtatttcttcatagcagtgtatgtgacaatacagggctctaatcacttggttggttcctctgacaaccagtccccatcctgaagctatctaggggcccgctgtattagtccattctcacactgctataaacatacctgagactgggtaatttataaatttataaagaaaaggtttaatagactcacagtctgtgggctgtacaggcttctgcttctggggaggcctcaggaaacttggaatcatggtggaaggtgaaggggaagcaaacacatcttcacatggccagcaggagagagagcatgaagggggaagtgctgcacactttgaaacaaccagatctcatgagaactctatcacaagaacagctagggggaagtctgcctcatgattcaatcacctcccacgaggcccctcctccactgaaaatttcaaatgagatatgggtggggacacagagccaaaccatatcacccatcaagaaacacctcattagtataaattgaggtatgttttaaaaggacttattatgagtaacaaaagatactcctcttatccttctcattcagggaattatgagggtttttagaagctctgtgccaggaactgcagtgaagatcaaatatatattttttattatatcacaaatcacacttttgtattctaatcttgtaatagttttattattccttaattgttgctgggtctgggtgttttttttttaatacctttgttataaaatgcttgaagatatgattagtgtactatgttaatcattataagttattttgtgtcctgtgaacaggcaaccttcaaaagatcctgtcccatgatcatcctccagagtattcagctgatttctatgctgcctacattaacattcttcttggagttttctacactgtttgtcgagatttgaaagagctcagacatctggtaaatgaacattttgcttgaatatatatatatgtgtgtgtgtgtgtgtgtgtgtatacatatatgtgtatatatgtattttaatgttttccatgtagaaatggtatgagataggttagaaactgaaattttattctgggaatttgcatatggcctctagagactaacataccataagaaggtagatgtctgtgggttagtacaaactttgattgtttgatctgatcagaaaaatgtcattctcagatcttcttactcttccttgttttttctctaattgcagaaaatgcagaactccataaaaatcaaaatgaggaataacagaaaagagatgtaaaaacttgagcagttttacaactctgttaatattttgtaacagattttgttcaagttttatgtatgcggtgattgaggtctagaatctagatggatttgagtatggtcagaagctttcattgcaggtctttcattaaccactgaccctgagctggtaatctttgtatagatggttctttttaattttttttttttaacaattagaatagctgtttatatttcatagacagtttggaaaatgttgatgtttaatttttctttgaccttttttgttttaattgtagggatgggaaaggaaagagacaagaatttctgttttcccttttagaaatcttcaattaattaagatcttatctccatttaacagaaaatagtaatatatctgaggctggaaaacagtcactttcaaagtaacagattctatgtctcttagcacattttcttcactttgttctttttctgtttttgccctgaaaagtattacttagattcagtgtgtgtttgcgacagaacacagaaggcaatcatttaaaattatgctcacatttagtatgtttttgaaagtttcagatttcagggctcctctgatttacatgtagatttcagacatcttctcagctgggaaaaaacaaaacagtttttccagttcaagcttatcactaacattcctctagaagttggatgtcttgggatccctggcttctgagggaaatgataacacaagagacttacagagaggagagggtcaggaaaacgcacctgagtgagatggacttaggagcagataatcctcctcggtctttcctggaaagtaacttgcagttaccactctttagcactcgaatcctgtgggaatctgtgctgacagccatttcaaagtagattataaagtacaagaaggaaaaatttagggaaaatatttatgggaaaataaaatgtaaagagagaaatatatatttaaatgtggtattttttaaagttctttgagtttcactgtggaatgattttatttagggtgaggttacagcttttttaaaaataatattcataaatgtgtagtatggtttaagtcttatactactattggtaataatagagaaaaggatccttaaacattagagaaaaatagcacaatgttcttagttttctctatatatagaacatggaagaataaagatattcattttcttttttttcttcagatagtgttgtttgtgtttgtttcaaagtttgtaagtggcatatttcttgaaagtttattaaatcacctgaaaaatattcttttcagggatcttttctggaaagatgctttatgaattgatatttctgtatttttcagaggctagttctataggtagcttaagataggagaaaatgaagtactactttgatattcatttaggtttgttttctctaacaaaccttatgatactgcctttttaactgttattcataaattattaaacatattttagtgtttcaaccaaagagaaaatcaatacagttgccccttggtatacttgggggattggttccaggaccagtcccatatatatcaaaatcctagcacactcaaaccctgcgatcaactccgcagaacctgagtataaaaaagttagccctccatatacatgggttttgtattccctgagtactgtttttgatctgtgtttgtgatctgtgtttggttggaaaaaaaaaaaaatctgtagacaagtggaccctcacagttcaaacctatgtcgttcaagggtcagttgtttattttgattagccaaattgtgtaccagttgctgttaacattatgacactttagtgttattacaccatgcttagatctgaaaatctaaaattaaggtaagaaagtttggctaaagcgaataatttctttttgattcttcttctctacacttagtagaatttggaagatttttctattttaaatcattgttttttatgaagtagaataggaagaaattattttaatgatttggttcttagttttctgttatctagttatatgttatatagttacacatttatatatatctttttctgtgccttattgaattattttgatatgaaatacttgggaacaaactaatatatatatattttttttaaataaatggaattagtatgtttttaaccagtttgcttaaactgctgttcagtagaattccagtgttgattcatggaaaactactaagtagttataattagttaattagtactcctcaaactttagaatacatagagtttctagagagatcgttaaacatagattcctgggtctcatcctcagagattctgatttggtatgcctgagatggtgccaagaacttgcatttataacaatcacaggtagtgctgccaatccaaatactttgagtcatacgaaactcaatgatgtttagtttatgagaatgttcagaccttagaaaacaacagttaattatttgtgcttgaggtttttcattatatgttttatggttctatgtgacataaatataacctaaaagaacaaattatgctttgttactgtagggaagttcacatttttaccctgcagttttgataatttgaatctataaaacaaactaataatagattaacgggaaaaaaaaggcatacaaatttattttttaattttaatttaattttaaatttaattttatattaagttccaggatacatgtgcaggggcgtgcaggtttgttacataggtaaaatgcgtgccatggtggtttgctgcatctatcaacccctcacctaggtattaagccctgcatgcattagctattgcatacaaatttattaatatgcatatgggcacaggagccttacacaaaatatgagactcaaaaggtggggggcagaaaggggggccagctggttcaaatttttatgacatcctgaggttacagaaagaaaatgggcttggagcatggcataacaggttattggagggagaggagcaaagacttggttagggaaggcagtcttgtgcaaatgaaacctcataggcagcaactttcagaaagaatagatggtagcctgtgctaagtttctctgtcacaccttcaaaggtgtcagaccctcaagtctctttcttgagagttaatctttcctagatccaaggtggggggtgatcagagaaagcctgtttgcatctgctgttttcttatttcctctacagatgcaaatctccctcacaaaatacagcttttcagggctgttcttgtgcttgcagcccttctgattagccatatcaaaatataccaaagaagtatatttttggtgagatgctcctttctcctaattttgtatacagaggctaatgtattaggcagaatttagccaattaaggaatattttatgttgtgctgtcattattagtatttttgctgttttgttattatagtaataagctacaattacatttttttttagaaagaagcagggtcttgccatgttgtccaggctggagtgcagtggctgttcacaggtgcagtcacagcacactacaggcttgatctcctgggctcaagcaatccccctgcctcagcctcctgagtagctgggattacaggcacatgccactgcgtataattacatttgacttgagcaaatgtgttaagtaaaatttcctgaactgcaatacagattttacttgaaaaataaatttctaattgtgatcgatcagtgctttttttcttctctttttttttctttacttacaggcagtacttaattttcctaaatattgtgaacccgtggttaaaggagaaggtaactgtgtaattttactcattaatatttattttgagaaaggtttttacaagatataaattactgaaattttcttccctttggggtagcaagtgaacgtgatactcgcaaactgtggagaaatattgaacctcatttgaagaaagctatgcagactgtttatctcagggaaatatcaaggtaattttctatttagtatgcatactagtttttatatctttatttgggatatatactctctcaacttaaataacagagagagggactctaaaagaaaaagatatctgtttgaggattggcattgcaatgggaaagcacatgctgtagtaaactctgcatcttcagggaggtaaaggaagacaaggtttttaaaggaagaatgaagagaattacataattgttttgagataattattctttgctacaaggatcaattacaaggatggcgccagttcagagctggacagggatttgcctggcagatgtcctcatggaggtattttttgtggaagattgcattagcctttatacaaggttatgttttttcctgtcttttgtaatagttctttttatcagacattatgcatgtgaacccttccttcatggcctttcttggctctgtttgtcaggatttttaacacatgtgactccattttgattctgacaacttttttcttttaatcaagatttttctccaaaatcattgctgatcagtcatcctgtagttagatttttattgtcccttggtgccagaacggagctgtcctgggttgttgtctgttcacatgtcgaagggagtgaatggtggctaggagtcagtgtcagaactcttttagccacaagggaggtttgaagggagtggctgagtctacctagagtccgttgttaagttaattttgtgtgttccataggtgttggctatcattgcaaagtgcttgggccagcattgttctgttaggagttgtacttctgcagaaattgttttttgagacgtagtttcgctcttgttgcccaggctggagtgcaatggcgcaatcttggcatactgcaacctctgcctcctgggttcaagtgaatctcctgcctcagcccctcgagtagctgggattacaggcacgcaccaccatgcccgactaatttttgtatttttagtagagacggggtttcaacatgttggccaggctggtctcgaactcctgacctcaggtgatccacctgccttggcctcccaaagtgctgggattacaggtgtgagccaccacacccggtcactgcagaaatttgacaggcaacaagtacaaagtttacaaaggaaaatacaaagtaaaatgtatagtaatatgacaatctcagtttgtatagtgcttttgaactgtgaacctccgcttaaagggaacctactgaataaatcaaatgaccacagagagttaggtgagacttctaaccatgtggcctattttcttatttggtatatatgggtctcaccttttccagaggaatttattcgggtacagcttgtggtattagcggtaacaccgacatttccttatgtaaccaatccgtttatcatctagtattacatgactgagttgaaacaaagcagagtgagcaacaattgtattaaggatgttgccaaagttgcccactagatggactaaagaatcttttaggtcaggttctgtcaacttaccagcagaagctgctaattgtaaaatttcaattataccattatcctatcaagtgaaaatggtaggcattaagaggagtaagagtctcattatgatgtggagtcttgttctaatatcttcgaaaaaactgtttctatcatgaaactgtcaacttcttatcctgctttgcagttcgactgtctctggttatggcatttagtggtttgttgacccttctgtgtggtccacacatcaggtacaaggtttgttccttaaaattcatctagcttcaatgtataaggcttcaggaacaaagtagtccccctttttagtaattttatagaagaaagttggattgggggaacctagaagaatttagaatctagtctaggctacaggttgattaaaactcaaatacaatgcataaaactgcaaactaataacaggtacattatagctttttttaaagaaacataaccttttctctctatgttgatcacatagattttaaaacctcttgagtctaggaagtcaaaccaaggccgatttaagattttagttcctgggcctgccaggaagtggcattttttactcactcactgtaaggctgagaatccttgaaaccaggcaattctgtgcacattttctttttttttttttttttgagacggagtctcgctctgtcgcccaggctggagtgcagtggcgcgatctcggctcactacaagctcctcctcccgggttcacgccattctcctgcctcagcttcccgagtagctaggactacaggtgcccaccaccacacctggctaaatttttttttttcgtatttttagtagagacagcatttcaccgtgttagccaggatggtcttgatctcctgacctcgtgatctgcctgccttggcctcccaaagtgctgggattacaggcgtgagccaccacacccggcctctgtgcacattttctaatatgatatgacagtcaaagtcttggtaatataaccagtgtttccaattatatcctgttataaagagagagcaaattcttattgaacttagtgaataaacatattttcaaggagaaaaaaaatacccatgaatagtttttgaattttagaggaatgaaatggggagaaaaagcaggtgcttcaccttggttcacaaaatatactttactaaattgctaattagcagttccataaaactataaactataggtagattaagagagaaaattttctcaaatctggaaaacaaaaacaagcaaaaaactaatgtttcaaataaaaatcataaaaacatcctcatcagttattcaatctcatgtaattaatttttgttctgtttgatcttgattagcagtttcatgagcccatcatttcttcattagagttctgatagatttttattgagtccattgatctttaagttactagaaacttgtatttaagagtacttgttagaatcttattttatgaatctgattgcaaatgcttttagataaaaatcagaacaataactgtaggatgacagagacttagaatagccatggataaaaatttgatgaaagtttaccataatcagaaattgacaaggaaatttgatgatttttgtggcatacatataatgaccacaattatgacttgatgatatattagatctctaagttttatgtaattttacactgatattaaacacatacctataaatataactgaaagaagatccagtattacttaccatttggcaatgcttcttacacaatttacaaaataaatttaatcatttaatatctttacaatatgaaaaatatgtcttttgaggctttccaggggcctagctagaaaatccaaaagttagttctaggtcaaaaatatttaatttagaattttgatattggggagggaggtctatcaaagatgtgaaaaggtttaaaacacctgatcaaaacaggatcacaggtcattgtgaaatgatagtcattcatttaaccagaatgataatcagaggacttcaaaagcaatatagaaagttacctggatttaaaaaacgttaaccctttcaaagctattttcctgagtaataaaaaataaaaaactagtaagaaaacacagaaagttatcttgataaaatgcaaaatatttgtttcttgggacagttaccaaaaaagtaaagaaaaacctcttgcagtatgattgcttctccttatgggaagcccatttagataacctggaagttgaacccagtgaaaacagtacttgaatttaatcagacacaggaagaatgtgtggtcaagcttgtgagaacacactatgagtgtaaacagaaaactagtaccttgagcagggaagtacatggcttttagtaacagcatgggaacttttctggttacatggaataattcagacacattaagaaaagccaagtgtacagaatcaagttatactggaggaaaacattgcttttgtaggccatcaagacaaacattttagagttagactttaacagcagagttataatcagaggaaaaaagtgacaggagctgatgaaaaagttaaaagagagagttatcacctcaatcaagattaaaggtgtactttctcaaggggagaaagagttgaaagcagtgatgtatgacatgcagtaagatgcagcaaacattaaacttctgagatataagtctgagaagctttaagaggaaaactctacctcaagaaatgaaattaccatcctaagtgaagaagacagctttactaacgtgaaactagaaaattaaatgaagactgtgaaacagaaaaaaaaaacaacaaaaaaaactgcagtttagaagatggctattaagaagcagaattcagaattcaaagtgaaaacctctaatttttactaagagcagatcaatacttaggaaaaaaaaaaacttctttctaatatagtggaccaaagttttagttttatattgtggattgagggatatatttatgtcgaagtttaatctttggaaagacttacaaataattcccttctaattacagccagcttgatcacacacaaatttaataaatctacccttcacaaaccttgtaatgacttacgtaaaccatccatgacatgcttagatctttagttattttcttatacttttaaataactacatttaggacaaactatttaccacacaaaattatttctcaaatttatccttttttttgactgggtgtgatgcttcacacatataattccagcactttgggaggccaaggcaggacaattgcttgagcatgggagttcaagaccagcctgggaaacatggtgagaccctgtctcttaaaaaaaaaaaaaaaaaaaattcacttttctttttaaccttcttttaccaaaaatacatctttatacccttaactttgcacatctgtgtctcctacttactggttcctttctgtcatgtttctgttttcttaaatttactttctaaaataaccttaaataaccttcagaattttgacaaaattattcttttttctcaataaagaacacttttttttggctttgtaagaattctcattaaaaatacatcttatgttttgggatacactttgtgtacagaattatatatgttaatcagaattgttaaggtaacttttagtaaccttattaataaatggtgctaggaaaactggctagctgtatgcagaaaacagaaactggaccccttcatacatcttatacaaaaattaagatgaagtaaagacttaaatgtaaaacccaaaaccataaaaaccctagaagaaaacctaggcaacaccattcaggacataggcatgggcacagacttcatgaataaaacaccaaaagcaattgcaacaaaagccagaattgacaaataggatctaatcaaactaaagagcttctacacagcaaaggaaactatcatcagaatgaacaagcaacctatggaatgggagaaaatttttgcaagctacccatctggcaaaggtctaatatccagaatccacaaggaactttaacaaacttacaagaaaaaaacaaccccatcaaaaagtgggcaaaggatatgaacagacacttctcaaaagaagacatttatgtggccaacaaacatgaaaaaagctcatcagcactggtcattagagaaatgaaaatcaaaaccataatgagataccatctcaagccagttagaatggctattgttaaaaagtcaggaaacgatgctggtgaggctgtggagaaataggaatgcttttacactgttggtgggagtgtaaattagttcaaccattgtgaaagacagtgtggtgattcctcaggggtctagaaccagaaataccatttgacccagcaatcccattactgggtacatacccaaaggattgtaaatcattctactataaagacaaatgcacacctatgtttattgcagcactattcacaatagcaaagacttggaaccaacccaaatgcccatcaatgatagactggataaagaaaatgtggcacataaacaccatggaatactatgcagccatgaaaaggatgagttcatgtcctttgcagggacataggtgaagctggaagccatcattctcagcaaactaacataggaacagaaaaccaaacactgcatgttctcactctaagtggacgttgaacaatgagaacacatggacacggaggggaacatcacacactggggccttttgcggggtggagggcaaggggagggagagcattaggacaaatacctaatgcatgcagggcttaaaactgagatgatgggacgaaaggtacagtagatcaccatggcacatgtatacctatgtaacctgcacgttctgcacgtgtatgctagaacttaaagtaaaatttaaaaaaacaataattctcattaaaaacacatcttatttttgggggtatactttgtgtacagaattatatatgttagaattgttaaggttacttttagtaacctcaatttctagtaaaaacctaggaagcaagaaattttgtcacatgtcagttttttatagatatgagcaattttgtaattttataaatatgtttataacctaacttttatgtgtagtgatagtcccaaatatagtcttttcttagactttaagaagccaagaacaaacttatgtttagtaatttatatttcagtattttttcttatttggaagtgattcagacatttaatgagtattatttaattcaactatttgtaaatgtttatgccacctacattcatctaatttatttatttttaacaagtataagtagatttcttatgaaaactgaggcattaggcaaggctagtcattagttcaagctatttccatgttaatcatttttatagcctatgaatatcaggtgttcacctaagtgagaatcttaaagttgtgggtattttgctgattactttggagacacagctgtttttattaaaccaacaatattcaattggtcttatttatcaaagagttacacaaacaaagattgttctgtatttaggctgagtttatagttttgtacttctgtgtcaaacccttataccttattaaaacctcttgtctagtagagacaaatataaaactgcccggcccataaatcccggcaaaagtttatgccgacaattctgaagacatttctatttttattttatcaacaagtttaaaaccagcttgcttatttatttttatatttaaaaaagtattgaactactgtacacaaaaaataaaatcctgagctccccaacaactaaatggactgcttggcaaaggggacctcacaaaaacctgaaaaactattcctagccatgaggaaaagggaggctagacacgtccattatagcccctcccttttagagcttaggcacaactgaccatcattaacattaaagcagagagatcgtaagactgacaaaacagactctttgtgtcaataagaaaccaaattccaactggactctgatatagaatcacatgacagatagcagacaccgaaagaaatcaaagtattttaccgcaaaatatttctttgacatattttgaaatggccctgtaaagcctttttaatgcaaccaggctttccctgtctatgcctttcccagataactagcttatttattaaaggttcatttaagtcacatgtcatttggtttaattactgtttattttaacagttttcattattattgaagccaatctgaatagaatgccctaagggatttctggacaactgtgccagattttaccacgtagacacaacatatgtatatatgtataaacacaaacacatatacacaccagtttataaaaggatagttggatccaaactatatttctgataaaattgggacctgttctcatgactaaactttatttgtcccagtaggcaatcttatgaagactgtgtaccaacattttggataaagcagtttctgtagcagtttgatttttaaaaacacttctttttatccttttttcagtttcaaataagtttagtgttacacattccaatgtttatattttttagataggactagctgaattatataagaaaaaaatctccaagtatcctagaattagtaacaaaactgtcttttgtttattggtctgatttgcttgactagtcattgtggatgaggaagcgttttagcagggtggttttggaagcgttttagcagggtggttttggtttgtttcagctttttctagtccctgcatggcagacaaagccatttttatgccagacagagaaatgttatattattgctctgagctcaagattttgacctctttgatctgagagcctaactcttataaacattgatctcttcttttcttttagaacatccaactcttaaattaactgttccatcactcaaagcaattgttagtaaggcaaacctaaatttacatttccagaaaatgtgtaggttgtcagttgccatggagctgatgtaatttgtaaaacaataatttgaaagcactctaaaactttttccccctttgtttctatcttggctggaatgccatagcagcaagtttatctcaataccagcagaaaaagttactagattcaaagtaggcaggaaaaaaatagagaggtagagaaattagaatgctctacatattttaattctttagttggttgcagtttttttaaataagtttaaagagttcaaataatggccattgtgctccaaattttccttgatgtcattttgttaccagcggcaaatccgtttgggcctgcagcaacctcaattcttttcttcccagaagaaataattctaccaaggaagcacaaggcagaaggagagacaggcaagttttagagcaggagtgaaaatttattatatagctttagaacaggaacaaaaggaaggaaagtacacttggaggaaggccaagcaggcgacttgaaagataagtgccccattgaccttttacttagagttttatatgttggcttacttctgggttcctacaacccttctctgattcttcccttgtggttggctgtccatgtgtgtgcagtggcctgctagtccttgggaggtgagcatgtgcagtgtgtttactggccttgtacacatgctcactggaggtattcttcccttaccagtggaatgtccctggaaggtcatatactagttaaatgcctctattttgcctcttactgcacatgcctgagcttacctacccaactcctgagatcttattggaaagctgctgatcaccagtttcaggcgtttctatctattgggagactgccgttgcatggtgccagctgtgaccaattattagcgatacagtgtgacaatagcttgcccatcaccctagggtcgcctgctgttcctggtggggtagggggagccttctcctgtcctgctcatgcctgactagctgccttctgtaacaatttgcccatcagttaaaaaatatgcccaagaacagtccataatatagctggctggaatccccaaaggtagattgttttggcatgcctttagaatttgaggatcccattttgtttcttattaatcactcaagaacaaagaaaatcccataaatcttgtcagggagtattaggcatttggaccagtgttttagatggtggggaccatcgtagtggcttttaattagctaggctgtgcccaccatttagaatgtttatttttgcttcttgtagattcttagaaataagcgagggaaaaaagctaaattatttacagatgtgtgttaccaaaccaaaatgaaaccaagataagagtattcacaaaaattttacggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggataatggcgtgaacccgggaggcggagcttgcagtgagccgagatcccgccactgcactccagcctgggagacagagcgagactccatctcaaaaaaaaaaaaaaaaaaaaaaaaattttaaacccaggtatgcagattaaacaaaatactaaattaggcatgcagaaccagaagtgaattcaccagaaaagacatacctcacagaacacaaattttatagtaaccggagtattcaaaccagaaggacacttgtccttaccagaaagggattgccagaaaaggcaaaaagttgttattatcccaagaggattgcaaggccctttattaaggtgcccttaatgagatcctgaatgaatttaggagcttccatcaaaaagcaggaggctcaccagggcagaaaaggtgagctgcggaagcagaaagttcagagggctcaagtgagtactatataccagttctaagaattgctgattccttctgaaggtgatcttgctgcaagtcccacttctgactccagatatgtcaacctaaacaacagagagggactctaaaagaaaatgataatctatttgaggatgggcattgcagtgggaatgcatatgctgtagtaaactctgcatattcaggaaggtaaagagaggcaaaggtttttaaaggaagaatgaggagaattacataattgttttgagataattattcttggctacaaggatcaacaacaaaggtggtaccagttcggagtttgacaggcagttgctgggcaaacatcctcacaggatttttgtataaggttatgatggcctttgtgcaaggttatggttttttcagttttttgtgatggttcttttatcaagcattatccgtgataacactttcttcgtggccctccctggctctacttgttgggggttttagcacatgtgactccattatgttacacaatttgtaacaaagcctttttttttttttttaacctggaaagctataggaaagtcagtactagctttgccatatttatgctagatatttgaatgatataatgaaaatttgattttaaaataaatatatgaaccgttataaatcgacatttgtctattattaaaatttcttagtagtgaaacagctcaggagagacatggtggcacatagtgtgtgagaagaacatgattttgacttccagctcagccattgtctgccgtatgtgaacttagcaagtcctaaaacctctaggctttggctttctcctctaacagtccttagaagatttagataatgtatctgaaaattattgtaaatattgaagtgtcttatagatattagattaagcctagattacaaatcaatataggaaacctaaaaatatcaacactgtctgcttttctttctagtcaattttttttaccatttttctctcatgaatgccttattctatcactaactattccttaataattttgtttgatttcagtttaattaactgattagcctataattcaggtaaaaatttggtagtttcttaattagcagaaatactacaaagatactattactccttttcctttttcagtaacaaaaattcatttaatgagagtttttagaaatcatagaatggaaaagcttgtgatcttctaaatgtaggaaaacttgtttgcttgttaaaatgattcttacataataatgaaaggacttctagtcccataggataattatggccacctaaattcaattgtgtccacaatatcaataaagagagctaatagaaccacccataactcttgcctgctgtattaacaggagttagagattgctacaagcttcattttatataccagtagtgaagtaaacaactgaaaccaacagggccagctctggagctcatgctgaggtgaaaagtcaaacaaagactgaaaggaaaagagaagattgttgggacaagggatacgttgactagtagtggtgaaatacaaatgaaattacttgaagaaagagagttcaaccctgagtgagaaagtattgaacagttctgaggctggaaggattagagcactggctactggagaatcaaagtgacattttgttttttgtttttttgtttttttgagacagggtcccattgtctcgtccaggctggagtgcagtggcaagatcacagctcatagcagcctcaacctccctaggtccaggtgatcctaccacctgagcctcccgagtagctgggactataggcatgcgccaccacacctgtctaattttttgtattttttttgttttaagagtatgggggccagagttagcatgatagtcttgggaaagtactgttttgaggagagacaagtagttgattcagaagggtgtggtattcctttgagagttggtaatgaaggaaaagaatggaaagaaaggatagaaattaaagattcctctcatcccccaaataaaaaagaaatgacaaaatcagaagctaatccctccttttcataatagcaccatatattaaagaaacttgacttcattatttttccagaagggagcactttagaattaagtaattgtgccattccgcaaccttacccctgcattcataaagtcacctgttattactgaccaagccaaacattaggtatttcaaaatgaataaaagacaacatggaaaagccatgtaaaggtattatttaggaagaaacagaaaatgtgaataaaacagtttagttgatgaacatttcccccttaacacccaaaacaaagcagaggaagactgcaataccacacctttacttggtttaggtttgtttaaaaagcattttcaggtatggaaagcattctttaagtttgaaattcaataacttagaataaatggacaaagaacagggggatgtgaaataaaagttgatcaaactcaggagcaaagttcaggcaatagtagttatctcagaaatgaaaatgaaaaaataagatatccaaaggaaagtagattcaactgagaatatagtaagagacattgaggaaaggactgaaaataatcaagagaacaaaactaaaaaaagaggtaaaaataatcaggtaggatgtgacaaatatgatagacaaagaagatttaacatatatttaattggagctcctgaagacagaaaagaacaatggattggagttaagatctaaaattataatccaagaaaacgttccagaaatagaagacctagctttacacattaaaacagttcattttcccaattaatccagaatgatcaattctgaaactgtactagtatattgtactgtaacaaattatcagaaatttagtgatttaggacaacacatagttactgtcttacagttttgtatgtcagaagtctaaaacaggtccacagggcttttcttctggaggttctcaaggagaatctatttctttgccttttctaacttctagaggctgccttcattccctggcttgtggttccattctccatcttctaagctagcagtgtagcattttctcttctctctgacttgtcttcctcttagaaggatccttctgactctattgggcctatctggataatgcagtgtaatgtctatctgaagatccttaactcagtcacatctgctaagtcccttttaccccataagaatgtattcacatgttctagggatttggactttggtatctttggaggcagagccattattcagcctactacagagacttcttggaaagcatttagactttaaaaataacagaaaaaaacctctgagctttcaggcaaaaaataaaagtcacttacaaaggaaagtcagtgaaaaagtgaaacaaatggatcaacaatttcaagaaactcaaggagaaaggaagtgtaagccaaataattttatgttcagtcaaacctgtcattgaactatcaaggctagagaaaaacaatattaaacatggaagaactcagagaacactactcataagacatttcttaggacgaccttgatgtgaaaaagagatgactggagaaactaacaaaaggattgatgatgaacattgaatttaattaagcttagctccaaactaaaattaaggtggaaataagagtagaagaatagtatgtaaatattatgtattctgacaaggtaggaatattacaacttaaaaattgggaaaagaaggaaaagagaaaggggaaaattaaacttgttgattgctatacaggtgagagatgggcatcaaagaatacttcaaaagctaaaactactttttttaaagtatactcaaagaaggcccacactcatccttatcacttccaccctgttcttcatgcagattttggatatttaattgttctaatctggcattatttttaaattagccctgtaaattagctcatttttaagagttctgtgagagttttagagttggtgagcacctttgcatcaaactgccttatttttttttatgagtaaactattcattttttcgaagtcatgcagctaaaactgtcgtagggcattctttactcattatactatagtgtgttgccttataaattcaatttgtcgtgtcataatcacttcatattcttaatagtgttttggttgtttaacagttttaattgcaaataagtccaggatggggcaattaaaataccttgaattctgcaaggcaagcatcctacaaggattcgactcgtagctctagtattgactggctaaatgtccttgggtgacttaatctttgagcctcagttttctggtgtgatacctactttgagggattgctatagagtttagaaatagtatatgacaattgcatctaatacggtaactagaacattgggagttttaccgagtggtaggtggtagtatttattggttttttgtttgttgttgttttttttaaagacaggctcactctcgcccaggctggagtgcagtggcacaatctcagctcactgcaacgtccacctcccaggttcaagtgattctcgtgcctcagccacccaagtagctgggagtataggcatgcgccaccatacccagctaatttttgtatttttaatagagatggggtttccccatgttgcctaggctgagcttgaactcctggcctcatgtgatcctcctatcttggcctcccaaagtgctgggattacaggcatgagccaccacacccggcctgggtgaagttttttgatagctacaacagtcatcatagtaaaagagattattaaaatagttaatatctagatattgctttataaatttatgccattctaatatatacattaaattattttgtacaggtacaaacatgtttattgcatgtatatatttttcttttctgttttgttaataaataaaaaaatttagtttttctagggctctgttttaagtacaccatattgattttatttatttttaattcatttttgctcttctattttttttcagttcccagtgggaaaagctacagaaagatgacacagatccggggcaactgaaaggtatcagaggaagtattgagacagttaccggagatacttcttcagctaattatcaagatactaaagttaatactaaagagcattcagtcaggaaatagtgttataaaagagaatttacttttcaagctataatgctattttgattaatgatttttctttaactgaagctctaatttaatgggaggaaataaaagtttgaataccagctttctattttctaaatattggattatatcatgaaaatcaagcagtttctatttctttaaatgcttttattaaagcaatctaattatgtgacagttttatctcattatgtttatatttcatgagttttatggaataaaatgtaattttatgttaatcggtttgggatatgcactttggtggttatgttttgaaaacattgtgcttttgtttaagaaaactactactttggattcatcccaaatattaaatagaactaattttacttaaaaaaatgagcaaatattgaaaaaaaatttttttttaaaagtcagtggctgatggttaaagaaaatggtatgaaatagtgctgttttgtgtttttttggtttttatgtgttccagatgctttacaagtgacttctagttgtgtgtttttaggaaaagggatagatgccagagttagaacaaatctgtaataattgatttgcactactttctatctgtttgaccttgaacccagctcaatttttcacttgtgagataggaagaatatttagcattactgcaaagattcaaagtgatgcttaagtaaagcacctaacacagtgtctgacacatagtagattttcagtaaatatcagattccttcccttcccttaagaatcagtgctacttgaatgaccctactgttttaatatttatccattcatcagttattttctatgtgcaaggcagtgtagggatacaaaaaaacattagacataggtccttcaacaaatagtattgtttactaaggggtatgatttatgtacaggttaagcattctgaatccaaaacttccaaatagaaaatgctccaaaattttctgagtgctgacataagctcagaggaaatgcttgttttctttgatttttcagaatttagggatgttcaactggcatatacaagtattctaacatctgaaaaaatccaaaacacttctggtcccaagcatttcagataaagtatactcaacctgtacagttaactgttaatataaggcatcacgttatgtgggaatactcagagtaggaattcatagtagaaataagtttctctattttggtgtggtaggggaacaccaggggtttaatggagagcgtggccttgaagagaagaacgagtaggatttagacttcagaatgagaagagccaagcaaaaataatagattgagtaaagcctgtcattaataatagtgttgatcaccaccacgaccatcattatcatgacactttttaaaataaggaaataggtcattttgactagagaataccatatggaaatgaaaagtcaagtgagaagagatacttaaaacccaatgttagcctaataagtacttcatcaaagtgttttgttatataggcctctcagcgcatactcatgtggaacttccatattactctaagttcattctaattgctgcataccttgcttcatacaatccagcaagaactgacaagaggttttttcttaaggtaataataacatacttcttttcactttattttttaagatcccaggaatattttgaaatttcttaacacttgtaaatttctaaggggaagagattagaataagattgccaaatatgtatttaggactcattctttaaaggctttacattaatgtcacaacctcaaatttgagaaaaggtaggcagtttcatagaaaagaggatatcaggtataccttaggtaataattcagatttaaaaaatacatagggttttgtttaaagtgtggaggatggaaataattttaagagcggtaactctttgttgttctaaaactcactgtagtgaataattatccagcacactgaaggagcctctcctgtacatacattagttggagaaatcccagtttagagttgtttttttcttcttctttacccactatgttcttgtcactttagactttttcctttttcctctttcctcaaaacattctgatctctttcctaccttaaggtctttgtctgtatgttctgtctttctggaaagctccttctctactcattcttcatgcttcagtttaaatattgccttctcaaagcagttctccctgtacaacctatcttaaagtaggtcctctttattgtttcctatttcacatgatgtttgctttcttctttggacttacaacaatttatatttattcatttttttgtcatgtcttgtgctactcttcaggactttattttttttttatttttttgagacagagtgtcactctcacccaggccagagtgcagtggtgtgatcttggctcactacagcctcggcctcccaagtagctgggattacaggtgtgtgcccccacgcctggctaagttttatgtttttggtagagacagggttttgccatgttggccaggctggtcccaaattcctggcctcaagtcatcctcccactccggcctcccaaagtgataggattacaggtgtgcgccactgtacctgaccctctttagtttctagagggcaaggaccacatctattgttttcccctgctattgaatcctgagtgcctaactaaaatgctctcaatcagtgtttattatgtgaactgtgcttaactaaaatgccctccgtcagcgtttattatgtggattgccagacttatgggatgaataaaaatccatatctctggaagtttcatttttatagcaatgtatatgctgaactaaatcaatataataagctcttttaggaaatgtcattattttattttagaaattctttttttacatgcaaaagtaattttatatccaatccaagtctaaacgaaattggcctaaaatatgttgaagtctaatatatatacaaggtgataagaagaataactatttaaaaacctgagatatacagattagtattatgtgtgccatgttttaaataaataacgttttctggttttgtggaatactgtcttttcaacttaaaatttgttttccttaattgcagcatcatggaaaaatcaagaaaaccaactttctaaaaaaacacgaaaaggtatttacattttaatttctaatggaagaaacttaggaaatgaagataatataggaaatagatacatctgtaattgtatttgtcatttgaatataggaacttatttgtgttgatatggtaccgttatactgtaatagaattttgttatattgaatatagtgattgaatgcacatttaggtgagctgctgctggagtttaaaactgagttgacaaagttttttagtgacttagtagatgaagaagtttaccctggattatttagttaaatacagccaattgaatacaggcattttcctcttttctttcccctttgaagcacccacaacaaataaaaaaggtaaactcataaatactaagcagatgagagacccccagaatttgcaattgcatggtaggtagatattgaggtgaccaagcagattagagaaaacgctaaaacctaagcctcaaacttagctaatttggccttaggaatctggaaaaaagcttagggattagaagcactaagtacttttgaaggtggggtcagataaggttgaaactggtgaaagaagcatttagactatttagatcacttcttccactttgtatgtccaaaccactgttgcttttcttgtcagaagatggagaattttgaaatataaactctgcactatagaaactgcaagttttgtttcccttattcttagaggcagttttgctcaattccaggacttcctgactccaaagcctacgatgatgtttaccactgttcttgaactcctacaatagacaaatggttaacgtttagaatttttattatttatctgtttttgaggtagggtctcagtcacccatgctgcagtgcaatggcgtgatcatggctcactgcagcctcaacctcctgggcttaagtgatcctcctgtctcagcctccctagtagctgggactacaggcacacgccactgtgcctggctaatttttgtattttttgtagagacagggtttcaccagggactcatctaagcccaggagttcgaggctggtctcaaatgatccactcctctcagccttccaaagtgctgggattacaggcatgagctaccatgcccaacctaatgtctcgaatttttaaagactcattacaaaccaataagaaaaggacaaaaattcgatagcaaaatggataaatgatacaataaggaacctgaatgtctaacaatcatgacatgattaacagccttattcactaatgagagaaaaagttaaaacaacagtgagatatttcatactcttggtttgacaaaactaaaaaattctatgatttcaagtgctggagataatgtagaagagcgagagtctgcctgttctgcaggttgacaatatctactgaagttaatatgtgaagttaatatgttaatattaggatagactagctatgcttgtagtaaaaagcaaatcccggctgggcggggtgcctcacacctgtagtcccagcactttgggaggccgaggcgggtggatcacgaggtcaggaggtcgagaccattctggctaacatggtgaaaccccggctctactaaaaatacaaaaacaaaaattagccgggcatgatggtgggcgcctgtagtcccagctgcctgggaggctgaggcgggagaatggcgtgaacctgggaggcgtagcttgcagtgagccgagatcacgctactacactccagcctgggcaacagagtgagtctccttctcaaacagacaaacaaacaaaacaaaaccccccaaaccatggtggctttacacaacagaagtttttatgttgcttacaacataactgtgaattgagtgaccctctttcatctcatagtgatatgaagtgaaacattgtggcctctgaagttgccactaaagggaaagaaggtgaaagactaggcttgcaagtagtttacatcacttctattcatatttcattggcctggcagaacccagttacgtgacctctatctaactgcaggagagactgagaaatgtagtcttcttgtgtgtcagagaagaaacagtgttggcagacacatagcactgactctgccttgtgctttaatccagcagtcctacttagagaaactcacacatgtgcacaaggagaaatgtacaagattatcagtcacaggattatttgtaataatgaatttttttaagtagtcataaaatggaattctgtaaggtaatttaaaaatggactagagctacatgtatctatatggataaatctcaaaaagcaattggtagagaggtatgttccaaatgatatcatttatataaaattttaaaccatgcaaacaatgctgtatattgtttgtggatacatatgcggtagtataaaaccttcatgagagtacatcaaattctagatagtggaatttttctagagaaggaaagggagaataggatgggagagggttcaaggaagcttcaacttatctgtaatgtgatctaatgttttgtttctctgcacttattgcacagtatatttgataaaattgagtggtgagtccattggtattcattatattcacttctgtactcttttatatatttgaagtatttagtgacaaaagcatacaaaatttaagacctggaaaataatttctagccgaggtaaaaacttcattgtataattctgagtaggtattcttctttacattcattcttgttttaaataaatagttactcccatgcatgtaaatacagtttccaattttatttgccattgctaatataaagtacttatttgtagctgggtgcactggctcacgcctgtaattctagcactttgggaggccaaggtgggcagattacttcaggtcagaagttcgagactagcctgtcctacacggcaaaactaaaaatacaaaagttagccatgtgtggcagtgcatgcctgtaatcccagctacttgggtggctgagatacgagaatcacttgaacctgggaggtggagtttgcagtgagccaagatcgtgtcactgtactccagcctgggtgacagagtgaggctctgtctcaaaaaaagaaataaatatttattggctattaaaattatctgctaatagaatggaacttgagcattgtctcgtttctgatgacatgaattatactatatgagtttgtatacaagtgtgaacattttacaatattgaaaaaatttttttaaattttacattgttttaggctgctggcttatttactttataaaatattttattagttttctaagttaagctacgacttactgtaattgatctttttagagctactggtgttgaattttcctggcagtggtacaaagaggaattgtgagaaataagtagtaagctctagtctacaacttaggaatctggtttggttattatcttggatttggcaaaattacttaacacctggttataacagtaaaataggaggcatatttaggactagaccggatgactgtgagttctttaattaatatttgttgatactaagtcagaaatcttgaggaatatgttaaaagataaatcatggctgggtatggtggctcatggctgggtatggtggctcatgcctgtaattctaacactttgggaggccaaggtggggaggattgcttgaggccaggagtttaagaccagtctgggcaacatagtgagaccctgtctttacaaaataatttgtaaaaatacccaaacattgcggtgtgtgcctagagtcctagctactcaagaggagaatctgacataggaggatggcttgagcccaggaattcaaggctgtagtgagccatgattgcgctgccactgcattccagcctgggtgacagcggaccttgtctctaaacaaaacaaacttaaaaaaaggataaatcatgatcatatcagttaaacttttaacttagagtttgcaggttagatttgttagcatttttaggggaactatatataacaaaaatacattgttactggcagttttgtagtacagaaagtgagtgctctggtataagaagaaaatccatgtttttgttttgttttttacagacaagcaatcatctccttgggccaaaaccatttccactagacagattattagcaatattatatagtatcgtggacagcagagttgctccaacagcaaatattttttcccaggtaagcttaatcatagattattatctgtcatctttgtgggattcttcagatagtagagtcaatagaattccaggcattcagatttttgttcaacatatgttactgttttaactatataatgaaccatgtttttggtaagtaattgaaaattacgtatatagaatctttgggggtatcactaaatttacatatgtttacaagtataacctcatggcaaataatttaatttggctctttttcaataaaggaatttttaaaattaaataatcataattatcttgctaattaaacaagtggcttgatgaccaagttgatgaattgtaatttaatgaaaacaaaattgaaaaatttttttttgtaacagagtaatctacaatgttcttattcctcatctatgtactttgcagatagatgtgcttttattaaaaaatgctgttttctagaataattaagttctcagaatttcactaggtggcagcaaagcataaaaatagaaaatatgactttaaaaaaaacaagtagttaaggtttgttttttagttgacattttaagaaaaaacaaattattaaaattatagtcacagtagatttcttaaatggtccagaaaaacaatgcttagcacatggtacaagtggatagaagaaaaagcaaaatgatataactagtatttatttaaaagcaaagtcatgtcagatattgcagtgagcattttgttttctctatgcatttttaggttgagaaatatgtaaataatgcctgcgttttaattaattcactgaataaatctggccccagaatagctgtcagactttgtaatctaatgtgtgctggtaacttttaatttttcatttagagaagagtttgagtaacaaatataatctcaattttctcaacattgaatttaggtagtttttataaaagtcagcatgtatagaaaattgtatctacatttattgtgttcttgaagaaactcagttcactcagttactaggctacataaatagttagctatataggtagatagctacctagataggtaggtagatcactaatgctgataactttaaaaaagtaattcagttttaatttgtgttacagggatttttcccatgtattttctaaaaaagctttgtctgaaattggattttaataaaactttaccttttattaatagctttctacatacaacataggaattttttgttttgtgtttactgttgcagtaactctagattagcaggtattttgaattatcaggtctttattataagcaatggagccttacattaagtcagagagattaaacaacttttacaatatgatgcaatgagtaaacctttgagatttaaagcctagggaagtgagacagacagtgcttttgaacagagcagaaacatgtttgcatcacatgtgattgtacttctcaggtgcccacaaattacctgtgtgaggggcacaatgaaggatagtacatgttttttctttcaatgagcttataacttattctagggcattaaaatgtatacatgaaaatacttttttttttttttggctttctctacaagtttatttattttattttattttattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgtgatagtttactgagaatgatgatttcaaatttcatccatgtccctacagaggacatgaactcatcattttttatggctgcatagtattccatggtgtatatgtgccacattttcttaatccagtctatcattgttggacatttgggttggttccaagtctttgctattgtgaatagtgccgtaataaacgtacttgtgcatgtgtctttataacagcgtgatttatagtcctttgggtatatacccaggattgcgatggctgggtcaaatgatatttctagttctagatcctgaggaatcgccgcactgacttccacattggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtgttttggctgcataaatgtcttcttttgagaagtgtctgttcatatcccttcgcccactttttgatggggttgtttgtttatttttttgtaaatttgtttgagttcattgtagattctggatattagccctttgttagatgagtaggttgtgaaaattttctcccattttgtaggttgcctgttcactctgatggtagtttgttttgctgtgcagaagctctttagtttaattaggtcccatttgtcaattttggcttttgttaccattgcttttggtgttttagacatgaagtccttgcccatgtctatgtcctgaatggtattgcctaggttttcttctagggtttttatggttttaggtctaacgtttaagtctttaatccatgttgaattaatttttgtataaggtgtaaggaagggatccagtttcagctttctacatatggctagccagttttcccagcaccatttattaaatactttcttaaggctgtaaatgaatgctagatagtgcttctgagaagtttagagcagaaagagatcaattctagattgggcaggttgaaagagttcacagaagatgaaaaatgaggcttggctgtggagaatgagtaggagtttttgttttttaaatatttctcatttaaataagtgatacatgtttattatacagaaatgtataaatgggtaaatagagaaataatagtttaaaatcacctgatatcttatttccaaaggatagagttaaggttagagattcagaaagaaaggttaatatgatctgaagaaaggtttgaaaagcaaggcatacctgtgaactgtcaccctggtttggttggaattgaatggggttatattgtagtggtagttgtcattgtagttgtgattgtaatagtagcatcatagtaacactactgccaccacatgccacaccttactattggtaccttacatattgttgtttacattcgtagagcattttctgtttttagaaataaactcttcagcaattttatcctctggggaaaatatatggcaattaaaaacaatgggaggcttctgatttagagatttactagctgctctgagccattgactatgatgaacaatgtccgcagtcttcgtggttatagcagtgccagtaatattacacagttaagaaaacaacttggcccaaaatgtatctttgtctgttaacgaagttaaatttttttcaaacttgacaattgtagttgctgatctttttattctttatctcttctaattaacattttataatcaaaatgataaatttgtatatttaaagtattgctatacatgaatttaggtgaatttaatagcaagtcatttaggaacacaatcttagttattctcattgggtatacaaagggtcggggagtaggtagagatagatgcaactagttctaaggagttgatctttacttttgcttggtcagtaaagtatccaagaaaatctaataacatatatattgtgttccagaacaaaatgtggcaggaatctcatccaaagagtatttctcccacatgccttatattttcttcttcccattgactcccagtgaccttttctagttttcttctttctccttttattcttctatcaaaattatactcttaaccatgggaatggcagtttgtatttaacctacatacacttaattttttaagtgaaaaacagaaatacgtttgttttcaaagtgcttatttggtacgaacactagatggcaatgtttttgcattctgtctttaagatgagccaggcaaacagaccttttacctgttaatactgtctgtgatatctagagaaatttgttaacatattgggtcatttgaatggaaataaacttgctgaaaaatgtaattataaacatgtatgtgtgtatttacacttttatgaaaatgtaaataaaattggcaatgaattatatttcgtacctggaggtaaattgctttttattagttataatgtgtctatatgagatgatcatgtattatttttgtattcacctgttttaagaatttattttatagtgatatgctatttttatagctggatttactgactaaataattgtttaaacttattttgtgtataaattgatcatgtatgatatagacattcagaattctcctgaagcaaaagtttatttccattgtatttcaaatctaatctattctataatgaagttataaaaatagtaactcaaggactctttaaagtttattaaaattccaattgagaataataaatttataatagtactagcagcaatattgtattgtagttggcattattctgaatttcttcattctctattgaattttaaataaaattctattcattagtctcacaagtaagtgaagagaatagtagcacatttaacattttatgttaatgttcagatttattgaacttaaatatgactttaaatttttttttagattattattttagtcttacctggtttttacctttagtacaattttgcagtcattatttgggtcatttttaaaattttcattccagtaagataaatgtagcccttctatgtatgcctgaacttcatgggtgacaaagcattaattctggtatttcattcttttctcctttcctttctgctctcatcataagatagaatggaatacatgcagtaaatgggtaaagtttataggtattctttctaaatttttaatttgatcagttatgattttgaagaccatttgtcagcttttaaagaaatagtattgtctttttttccagaaatatattaaagccaagttatgctttttaattctttttttcttaaaagaaaaaaatatgggaatttccgaattatctgtttcattctttttatagttctatgtctcctcttactcattcttacctcccctacccaaatactcttgtagttaggtcagagcaataggagtacagttctttaagattatcagagataccacttattttaaaatctcaaagccatattgctttatttttttcccagagaataaaattgctggagagtttatttctaaaatcattggtataggtttctaaagtgacttgtaaaaggaatatgttttaattttcattgatctgcttcgatcaatttgcattttggaaaataatttttgaaagtagtttactataattctgccatttaaaaggttttattttaataatattactatattataaaataatgtattctgaattaataccaagaaacagctgaaagattagaaaaggagcatagttctttttaaaaaatagttctgtgtaccatattgacaagttggatttttccataattaatacctaatttctgagtggtttcatacttagttgtacataataaaaaatttagagtgtttttgcaaatttattttcatttataagaacataaacattttgtagcatagtttaatatacaaatatataccttttctgtttgtaccttctctgcttatgaactcatgtcatgatactatggatacacttggagttatttgttacatcgatttaacttattggtcatgaatcaacaatcgtttcttacggaggttttatttattgtaatagcatttagacaaccttactactcatttaggtgttgttttataagatatgtaggatatatccaaaccaattgtttttctcaaatgaatttatcatcagtcagaaagcagaatgataatttagttgtttcatctatgaaaattttttttttagcaaatacttcatctgtaattcaccatagctgtaggaagatgtttttgctatactgtacttgttaaggtagctaacgttttattacaccaaaaatagattttggcatatttcttcaaatacaggtagatatgtggtaaatttatatagttttcagttttctaaagaggagacgttgttaatttttatttaattctaaaacgtttataaataaaaatattttaatctaattcacatttcaagttcaaagtcagtgtttattttttttccatggttggaattaaatttatctttctctgcttaaaatttcatttaacaaatatttactaagtgtctactatgtttcaggcattgtcttggataaagagaatacagaaatgaagatgtgtctgtggattccacagcccttcatttgtgctggtgcagccaccagattctattttatatgtttagagttaatggtgtatatatgtatttactgtgaagacatatatgtgctgaaggaactaatacttaaatacttaaagtgaatactaataagtacttaaagtgaataaataagagttttttacttaagtagttcttaatattttataacttagatatttaagtgttttctactgagtcataacaaacctgtttgttgaatatttccttctgacatgccttgaacttagtgtttgaagcaatgattgatatttataactaaattttgttaatacccaattaaatttagttatgacattggtgtcagacaatctcaagacttggaacttaagttatggagaagtaatcagtatattgtatatggcctagtatatacagtctgagtggcttttcttaaaaagttacatggctatatttgaaatacttcataatggaaaattatactcatgtccttttttaatatacattatttcaaactgcttttatagatttttaaccaaaagcactttaaataaattttatgaagactttatgataaaatttctttaccttaaaagttaatttgcatattacataatatttatatttctacaaaaagtagctacattcattaaacgctagtcagataacactagaaatctagtagataaaaatatctaatccatttattgatcaggtaacaatttgaattttgtagacataaagagtaacatcctaaaatctagctgtaagatatttatataaattgatttgagtgtgggcattatctttatagacattaaacttggtgactaaaagggacagttttccttaaaattccatggatactaaattattagaaacgtgaagagctcttcctttgcaatttctctgcatttcatttgtcctgtgccagcattccagtgtttctgtaatatttgactgtaatgcttgatgctattaaggtaagttatgtaaatcatagaaaatagcttgaatgctaacatttcctaataatcttactatgtttttttcttaacaacaactgagattgtgagacattgcattccaagatggtaaaggagccttacttaatgcctacttcgctgatgaagaggtcagcagggatgctatttaatagaggccggctcttttctagattctaagagcatcaccgccatgatgctcagtctccactggtgcagtaaatgagattctcaaatctcctactacccctggtgtggacatattactgttctgccatcagaccactctgcagtagatacctacttcaggagattttttaaaaaactgctttgggatgtttcatgtttgcaaagagtaaagttaacctatgatttttactagctgtactactgttgtaaggaataccagtattaattattaccaaggatactaaaaagcacagcatattttattttactgcgcagggataaaagattgtttttcttgttctcatatgtaaaagaacagtgttttcccctgctattttcttatcttctctaaatctgccattaaatttcttagtgtaatcactttgcctttgtgaatgtataattgcagcagtgggcatttttactgaactctagaaaaatgaaaccagtgcctaagggtgacatataaaaaactgcctaagggatttaaaaaattgcataaattatgctttctacttttgtataaaataatacattggtactttatttttgtgggcaatattttataactacctttctcaaagattagtgttacttccaataagtttactaaatgtatatcctttattcacatttttgggggaaatatattaaaccccaataaattttatttaacttggcagatttttagctgacaacacacaaaaaagtttgtatggatatgtgcttgcaaatgcatgtttaagagattccatactactaatatatagtgactatataggcaaatttgtgcattagatagaacttaatgactagattgtttaaatgagaagagttttaataagaacagataggagataaatgatttagaaaaaaatcttcgttgtggaaatgtgtggtacatttaaaaatacttctggctgggcatgatgggtcatgcctgtaatcccagcgctttgagagactggggtaggaggatcatttgcacccaggagttcgagacctgcctgggcaacatagtgagaccctgtatctacaataaataaattagctgcgtgtggtggtgcgtgattgtaatcccagccactctgaaggctgaggtgggaggatcacttgagtcaggaggtcaagactacagtgggctgtgattgtaccactgcactccagcctgggtgacagagcaagactccatccccccaaaaaacaaaatctataaaagatgattaaaagacatgttggtgcttaaagagggtttccagtaagaaattgtcttgattccttgtcagcacacaatgaattggagatttttgaaggagactggccacacctgcccatctatagacatacagcagtagctggtgcttcagagaagactctttatcttttctcctagatgaaaaattagggttcttaggcccaggtagcctttagaacctgaatgctccctcacctttggtcactctgaatggtggtggttaattgaattcttagaatcaaaagtaatcatgcctcctccatagttaacaagaaagggaactagatttacccagagctgtcttatctactcccttggcgctagtgctctgtgtatgttggtggcttttgaaatacatatttctagttcttattctctagctctccatccaaattgccagctgaacctgaactgtacctggatgacccatatatgtcagacactggtgtgccccaaaccaaatcattccctaaatctttccctgggttttcagccttacctagatttcaaaactaatcatttattaattcatccattactaagcacctgccatgtagtatacgcgttattagatgctagaaaaacaaagataatatagtttctagtttttagtttagctaaatggagaaattatctctgaaccgtctcattttctctccttcatttacttggtcaagtctagtctatttttcctaaatacaaatgtctcttaaacattctcctttttttccaccctcactgacattaccttaaatcagtagcttccttattaggcagttgcaccagctttctatctggtctccttgtcactaggcacttgctggttcatcatccatacggtcatcagcataaatcttgaaaaataaatttggtctttcttttctggttatacttttttttgatgagttacattatttacagaaccaagtctacattcagtagcatttattgcaaggtccttcataatctggccccaatttctaccacttccttcattcaccatatataccattcacaataagctgtttcctctctgaaaacacactaattttaaatgtttttatattgttgcatgtactttccccttacaactatcgagctctctttttacgcatcatggtccatctcccaaatgtcatttctcagtgaatctgcactttgcctccctcccttttagttcattttcttctctatagtcagataattatgtttatgcatattataatactaacgtagcactcattttgtcattaccattttatgtgtttgtctccaactaccctgatgtttgagggcatagacgttgtctgttcatttttgtatctcttgcacaatgccatccatgaacatgagagtcattcattgaatgatctcccattctcctaacaggcatttatggtcttcatggttgctaaagatttgcaggcagtttgcatgctaaaaagttccagagattagaggctttatcttcagttgctctatgtataaacatacatgctactttttgtttatctgagcatatttgaagactagcaaaccactctcctttttttttttttgaaatgaaaatttatggtagtgatttaaagttgaactgctttgatgatatttgcctatttctgccatgtgctgcatttaccacctctgctttgtgtgtgtaaaaatgtcagttgaactctcaatatatgccatgaaccgtcaagtctcctgaattcagatcaaatgtggtgcttgttgggttgtgtggaactcatacactgaaatttcatttgttaagttcatttatttaaataatttaatatgtttcagattgtgaagctcctccaggacaagcaggataggatatttcttaagtcaatggacatataacaacctatgaacgtataaaaataatgagcatgttaaaaattaattacagttgtaaattgattttcttttgttggcagaaataacagtttattagccgagaaacaggttcacactgtttttacatcaagcatttccagctgaagcttgttagtagctgcctctcagattaaggaaaaaaaaatcctcactgtggtacatgaactcctattgttacaacataaataatcagctcatcccctacacagatgagaacaaaggacataacagtacacagagcaaagattaaacaaatattgtataaccccatttaggatgtaaatctaaaaatattgtacacagaaagagatttttgtttttttatttttctttgtgaattcctcagtcataacgtaggacctagtcaaaggaaaaggaatatatactgtggcttttgagtcagatagattgattattttaagctaaggtgaaataaaatatgttaagcagtgtcagaatgctgctgatgtatgaaagctagggaagtactattctctttgataacaggatgcctcagatttttaggggatttgtttaaactgaggaggacaaaaaaataacaatttttattttgaggaaaaacatcagtggaaaacatgactaaaaatttagtagtaaaaccactgacttttaatacagttttttaaaaacaaaaacaaaactttgttctgtattttctaacatgaaatctgaatcctgactttgaaaaagagaacctactccctaggctacttttttattcatttgagttttattcatttgactttgagcttgacaaaacggacaagaaaagcagctgtggaaagcagtatataatcccctaaaatctgaacattactgacaatagaatatatcttcatagggtgtagaaacccagaaggggagttataattttcccacaatttttatatttacctacataattaagatgactttacctggaaatgattctagtgtttcagaaaaagaccttttcattaccctttcttttaatgtattttaatattttatgagttgtagttgtgaatgtttctgtaaatgacctttaatccacaaatgtgtaagaaactgctttgggataccatcttcaatatcatctaataatttctggatttaagaaatcatgctttcccccaaccttaaatttacttttttttttttttttgagacggagtcttactctgtcgcccaggtgggagtgcagtggcacagtctctgctcactgcaacctctgcctcccagattcaagcgattctcctgcctcagcctcccaaatagctggggctacaggcatgcgccaccacacccagctaatttttgtatctttaatagacctggggtttcaccatgttggccaggctggtcttgaactcctgacctcaagtgatctgcctgcctcggcctccccaagtgcgggggttacaggtgtgagccaacattggccaatatttaccttttaaaaattaaaccttaaaaacagcaatttaatgtctaatgtaatatataatctgacttatgaaaaattaacctgtcattaggttaaatcaattccacattaatgttttacttttgtgacatcaaactcatacatctaacaattctgttcacagtattgttaattgttacttctcaaggttattctatatccctgtggcaggacatttgcctgtactgtattgagatacttctttgtccttattgctacaatttcatttaaggctttttctctgttttacttgcattgcctgctctcctgggtttcttacttttccagcatactaatagttattgccttcactgtagaatgcaaggtggagtagtcatttccttcttccataaagctttcctaatctcgcccaacaaaattatctctttgtattctatagctccttgtttggggtagtataaggaatatgggctttggattcagatagtattcaaagccagtgctgttcttaaccactgttaacttcgtgaccttgagcaatttactcacctctctgaggtggtgtcatcgtctggaaaagagagatttatttatagtaatcatgggagggtttttgtgagaattgaggatgcacaatgtctgtcacagagcctggacacagtaataaattccagtccatatgccactaattaccatggtcattaatagtattaattagttcctatagctatctttccctgacccctgcccctcaagttttgtccatatcctctgctagaacctgagggaaggagtaaatgccaaaacacatatgtgtcattctcaggaattttgaaagacagcagaaaaaaagataaaagcacataggctcatactggtgttctttattcacagtagcagtagtcttggcaaaccattttctaatcatcaacacccaatgtgaagtattattttggctaaatgtttttaatatgttcagtattcttaaaacaagtgtttaatttaaaatttgttgttacaactctgaaatgttttctagcaaacctttagcacgacatatgtgttgtattatttttcattgggacttttggattaaatatttggaaacgttcatttgtgtgggtgactgactagggactgataatgccaattgtccttttatgatgtctctttcatcatctattaagtgaagtattgatctccaaagtttcaagtcctgatgggcaagctcagaattttactgtgcaattatttttatgttgaaaaatttatttttaataaatttgaagtgcagttggcttttatagccccaaaacaaacaaataaaaacagaacttttatcattcaaaaatatataaagtaagaatttggaaaaatagaacactccggttgggatttatatagcaatacttttgctataatcttcctttgctgtagaggaagtaataagttttactagtcacaggtttgtggcaaatttgtaaggacctttatggactcacagcatgaaaccagtagctacaaatcctccttgagtctgagccccaagtcataactaatcatctgcctttaagtaggagagatttaaaaatctttacaaataagggttaaaaagtgtttttatttttacaagtagatttttttagcttcatagctacttaaaacattttgagataacatttattctgacagtttacaaggtatttctcaaagccctctatattttgagtacgttatcagtgttttattttttaattaagcttttttgaggtaattatagattcacacacagttgtaaaacataatgtgtattctctcttcctgtgtgtcctttactggttccccacagtggtataacatctggcaaagctatagtaaaatatcacaaccaggaaactgacattaatgcaatctactgatctcattcagatttccctacttctatttgtattcttttgtgtatgtctatatatatttggttatatgaaattttatcctgtgcatagttttgttaattcaccaccacagtcaagaccggttccattatcacaaggattctccgtgatactcactgatgaccataccttcctctcttcctccccttccccaattcctgttaactggtaattgctacctctagaattttgtcatttcaagaatttgtttaagcataatcatatagtatataacacttgggaattaacttctttgagtcaggataattcctcagattcatccaaatttttgcatgtattaatagttcattcattttaattactgaggagtattctgtggtatacatataccacagtttgtttaaccattcacctgttgaaggacatctgggttctttcccgttttttggctactacaattaaagctgttaggaacattcatgtactagtttttatgtgaacatgcagttctctggaataaatgcataagtgcaattgcagggtaatacggtaattgcctgcttagttttataaggcgtatatgttttaccacttcaagtgaagtgtggaaaccatactgccattccttttactttctcactttttcagatactgtcttgagtatcagaaggtgttaaaatgtttaatcaaatgtgatttagaaaactcatgaggatatattctcttgtatttatccacaaatctcctctttccactgttcgttctttcacttttattatttccttttgtttgaagaacttccttttgctcttctttgaaggtcatctgctagtgacagattcttccgttttaccttgttcgagcatgtctttatttccactttattcatgaaggatagttttgctagatatagaattgccagatctttcgtcaggattcttctttaatccaggggaggaatgagcctacctgggtagccttttgccgctcagttgtggattggaaagtgctgggcttggttcacctttcgctcttgggtggggaattctaagactcgcaccctctatattgtttctgtagccctagggtccctaagcagcccacctacctctttctacctttcagagtcctcttttggtcgcctcttatattatttccaggatttatagttgtacttagcagggaagaataacaaatatgaatctatgcatcctgtctgggtgggaagttcttctgtatttatcttttttttctaaccctctgtctaggctctttgttagtgtttgttcctgaaatgtgttccttggtaattcaaagctcaattgaatgagaagccttctgtaaattagtgctaaaaaaagattacagaatgttttaccattattatttagagagcttttttttccaacagagattaaatccttctaagtcattaatttatttactgcaaaatatttcaatttattattccatgctggaactacagactttgtgtaaatctccccctgcatttggggacctaacaacaggaatgactgttgtgtatctcttttctctaagtcacagatgtgtcactgaataagaagggtcgaagttaatatacttagccatagaagactatgttaactcttttctgtgtatcttcccattcattaaaatttcaggcctactctcattatggatttctacaagtttccaaactaagaaggctatttgtcttatcttggttttcagcaatatttactgtcccccaaagacccctgtatcccttggttgcccatcctgttctgtgtctttttcctgtatagtaaaggtctcaggcagttagatgggaaaggctcggccccacctctcccttatttatgcatatacatgcatgcatgtgaaactgagacaccacgatgaatctgagtactcattgtctagagactttttgtcagatccacactgaccatatcagactacataggtattaatactagcctggagatctgagttcatattgtcatgaacatttaaagtggagcaaggaagtaaataagtattttttatgatcctgttcattatttatttatttgtgagacggtgtctcgttctgttgcccagggtggagtacagtggcacgatctcagctcactgcaatctccgcctcccaagttaaagcgattctcctgcctcagcctccagaatagctgggattacaggcacatgccatcacgaccggctaattttttgtatttttagtaaagacgggtttttgccctgttggccaggcctgtctcgaactcctgacctcaggtaatctgcctgcctcggcctcccaatgtgctgggattacaggtgtgagccactgctcccagcctcatttttaaatgcacagtacctagagtaagtcctcaagagtttcatggatatatagttggaaataaaaattagccaatttaaggattggataatagaaaggaaggtggatattctgctatttatgcatatatagaaataatttttaaagttttatatgtatttttccagtagttttcatttagtaagttaataaactaatacgtttgagattcaaaatgttgactccactaattaatctttgtgcttgattttgttttcaattttactctagcaaaattttaataaactgggaaagtacctttaaatatttggtacatttgttcactcctttttttatttttatttttatttttgagacagagtcttgctctgtcacccaggctggagtgcagtggtgcgatctcagctcactgcaacctccaccccctgggttcaagcaattctcatgcctcaacctcccaagtagctgggattacaggcacgtgccaccatgcccagctaacttttgtatttttagcagagacggggtttcaccatgttggccaggctgatctgaaactcctggcctcaagtgatctacctgtctctgcctcccaaagtgctgggattacaggtgtgagccaccgcacccggcctgttcactgctttatgtaatagatattcttctgaatatctattatttgtatatttgtgtacaatttatatatatgaatatttttatgttgagtttttcagtgattttcacatgataaagtcaacaaatgactgaaatgagtttttttaatgtgaaaaatcacattctaatttaattgctttttttaggtttagttcttttaatgtattagcttttcctaaatcatccctacccctaaaaaaattgatcaatcatcttattaatattttggaagttccttttagctgctgcatcttcagctgaagtgatattatattctttgcacaatttacatgattaatttagccggggaatcttggtagaactgaaagtgacttcaagggcttgtttgttccaactttctgcctttggacatttgttacaactaatgtgctaaaagtaaaaaactgtaaggcatctgaaaatattcttgagaccctaacttaactatattaaagacagattttgtgtttttctatgaaaaaattgtggaaaaagtaatttagcatacaatttcgattaaagaatctaaatatgtgagtgttcgaattaacaggaaagtatcagttatgagaaatattataaggaaatgtcagtggcaaagtacagggtaattaatgttttcttctgtattaaaaaaaaagtactaaggggaactgcctttaataatagagttcaatgcatgatttttcaaatagctattactaacctattttagcaaacgaatcccttacagaaaaatagaaagggttgaagttaatatacttagcaataaaagactatgttcactcttcactacatatcttcccattcattaaaatttcaggcctactgtcattatagatttctacctgtttccacactgggaaggctattgaatttgtcttgtcttgggttttagcagtacttactctcccacgaagactcctggatcccttggctgtccatcctttctgtgtctcttcttttcatagtaaaggtgtcaaacaattaatcttttaagagatacgagctcagggcctgcattttatcattattaagtgaacctttctttaaacctcatttcatgtctgttttgtctgatgtttaacatattttcatcattgttcgttttattagaatttgtgtgacatatctcaattttgtctttgacctttaactttcacatgtgcttccattttatatgtatctcttttaaacaaaatgcagtttgattttttcagtctttttattttatttgaagcatttcatttacttttaatacaattgttaatataattttgtttctattatcttgtttatgccatttgatttacctgattttttttctcccattctgtagattgccttgtcattttattggttgtttcctttgctgtgaagaagctgttgagtttgatgtagtctcatttgtttatttttgcttttgtttcctgtgcttttggcagcctatccaaaaaaatcattgccaaaactaatatcagggagtttttttccctacgtttacttttaggaattttattgtttcatgtcttacatttaagtcgttagtccatttgaattaatttttgtgtatggtgtaagatgagagttcagttttattttttgtgcatgtggatatccaatatttccagtaccatttattgaagagactatccttttcccattgtgtatttttggtacccttgtcaaagattagttgaccttatatgtgtggttttatttctggactttctgttctgtggatctgtgtgtctgtttttatgccattaccatactgttttgattactgtagttttgtattaataatatactttgaaataaggaattgtgatacctctagctgtgaaaaatgccattggaattttgatggggattgcattgaatctgtagattgcattgggtagtatggacattttaaaaatcataattcttccagtccttgaacacaggtatcttttcacttatttgtgtcgtcttgaatttctttcatcagtgttttatagttgttagtgtataaataattcaccttcttgattaaatttattcttacatgttttattctttttgatgctgttgtaagttagatttttttaaatttcgttttttgatagttcattgtaagtgtatagacatgtttgttgatttttgtattctgcaactttactgaaagcatttattagttctaacagctttttggtgctcatttatagttataaatatttagaacatccctgtgtggctgaaagattattatgatgatttttggttttgaaaattgaggtccacattgttgaactgaccagtctgaagtctactgctagcaagtggcaaaagatagatcttactaactttaaatgtttttttctcttaaactatgttctctctcttctgaaatcagaagattaagtgtggaatctgaatgggcccagtggtgagagtgggaatgaggtaattggatgatcttaataccttaagtgacagccaggcagctccacctctacggtgaatacaaatttgtagcatataccagatttctaagttaatgggcaaagagtcctgtatcttagtgctagaggcatactgctgggtttattctgttgaatgctccctttatgactattttgcagatcatcctaattcttttagcacacactcttttcaggccggagtataatacatctgttagatctgcactttcttagctgtgatcacagcttatgcatgttttttaaaagttttggagttggagttaggagatttaattcctagtcaggtgagtttctggcaccatctgggcattaccactttgatcaagttactaaacatcttagttttaatgttggttaaattaacaatttgaatctagcaatcttctaatgcagaggtcagcaaaccttttcagtaaagggatacatagtaaatattttagactttgcaggctaaaaggcaaaatgtaggatattatgtagataccttaataagtaagagaaaaaaactcttgttgcaccctacctcatttgcctggggtaagtcatcccacatggtgggcatgctttgtgctctgttgtcatcagctggagacattcttggaataaagcaagaaggggcctggtgggcagaacaggcagggtggccaccatggtcattttcactctgtcacagtgacacccaggttcccatgcacccttctttcctcccagagaacctagctgcctcaacaaatttcagaggattgctagtatgcagatcacattctgtgatcccccagaaacaaaacaaaaaactggaaaaactctgtaagttggaaataaaggaggacttccaaaatagcaagagagccgaaaaagaaatcaaaatggacattcgaattaaaaggactatagaactacttacaaggtagtgaaagtaaaaagagataagaaaatataattacaacaaaaggtaagaaaggaatgagaaaaaggaaaggagggacaaataggtcaatataacagtagaaagaaaaattttagaaaatcattagatatattaaaaacaaatggagtctatggtcctaatgaaaggtaaaagttgtcagactgattataaaaacaaaatcccactatatgttatttacatgagaactgttttaaattgagaaaacatcaaccttgaaagtagaatcatgaaaagtaacagaaaaaggcagagcacataaaggaatgctaatatagctatattaagattagaaaaaaatacactgtaagctaagacattactggagaataaaagggttattataatgaaaaggtttgtcaacaaaacgtaattttaaatctgtatgtatgttacctagtaacatagcttaaaaactacaaagcagaaagattctatgataacaaaagaattttaatacctctctcagttttgatcaggcagattttaaaaatggtgtatataagatttaacaatacaaataatgtctttgttacatatgtgtcttgtgtaatagacatatatgtaacaaagcaatagacatgtaacaaagaacataacatttgcaaaatacatattcttttcaacgcacaatatttataaaagatatttcaaggtgtaacctaattattgatactgaattagaaattaaagtcttagccttttgaatgcagagctttgtattttgatgtattaatataaattgcttttctagttgaaatatttcttatttactgaatataggattttctctacataagatactctatatgagatatttattatctgttcaccctttaatttgttagtaaagtaatcgactaaatactgcatgataattttccctttaaaatggtaatgggaaatgtaatatagtaagatgatcatggtttcttgaattcttgctaagccagtagatctggaatatggagaaagttacttaagatctctaaggcttatctataaaaaaaagtataataatgtccaccttgtggacatgaaggtaatgaggaataacatgagataatgtgtatagagtacttaataccaagcaaattactactgctgttagtgtttttattattcatgggatgtttacttagcatttgtaaagtattagtctcaaattaagtgagcattttaattcctaagacacatgattaggtattacagatagtttaacttaaaactcttattcatattgccactgagcagttacaggtaactaagtctccaaattttatcttactgccattgctgactctttttcctgctggcttatgggagacaaaaataagaaattaggagaagacaatgggcgctcaaagaatttcagctcttggatcagcttcctttcttagatttcagagaacttaatattttagttggccatatgaatgttaagtgattttgtactttgattttgacctatcaaaatacacttttgcttttactaataatccttctggtgttttcctgagtacacgatcagcaataagttttaaagcaatggttgggtgcgggggctcacgcctctaatcccaacactttgggaggctaggcaggtgcatcacttgagcccaggagctcaagagcagcctggacaacatggcaaaaccccatgtctacaaaaaatacaaaaaattagctgggtgtggtggcatgtgcctatagtaccagctactcaggaggctgctgtgggaggatcacctgagtctggggaggttgaggctgcagtgagccatgattgcgccactgcaatccagcatggataatggagtgagaccctgcctcagaaaaaaaaaaagaaagaaaagaaggaaagaaagttttaaaccaagactaagcccaggtctgaaggatgtatttcttatctctcatctaaccagctacctaactcttaaaaagacctaaatccatattattgttttatacccaaaggagtatagattttatattctgagttatttagatagatattctgtaaaatttttagaggaggaatgtgctttatttgcagcttttaaaggtttagcggtcatgtgtctgagtaatgaaacaaagctgtctctagtggaattcttagggactgattgtttgaatcagttgttgagctaggaatcttggttgggctgagtgcagtgactcacaccagtaatcccagtgaaacaggaaaagttcccttgtcccccttccaggggtagtggcttgcttcttcagtgtcccgctgctcaaacctctaatgggagcatgcagacgggcaggttgtggggctccaatctcacggccgcatctagggatgaatgcttacagctcctgaagccgcagtgggcgtgttacagtgtgctcttttagttttgccatctataggtggcttgtgttagctcaattagaccctctgccttattggaaggagagagggctttctgtatccttagttcttgccttgctgtaccgaaaaatccgatcaaatgtgggcttggaaaatgagtgcaaggttttattgaatagtggaagtagctctcagcagatggttggggagcccgaaggaggatggagtgggaaggtggttttcccctgaagtctagccgctcttggccaaactctgtgttgtcccaccgtaggtggcctgctggcatctgctggtgtctgccggtatgttgctctcgatgtccagccgcttgcttgttcttctgccagtgtattcctcttaacgtccagccacttgtatctctacctgctagggtctcggggtttttataggcacaggatgggggcatggtagccagggtggtcttggaaaatgtaatatttaggcacaaaaactgaaatgccagcccttacctaggtctgtgggctcagacttggagtggagcactagccagggaccatggccttctctgcccagcacttccctgcccccctcctgtatcaccgaccctttgggaggccaaggcaggagaatcacaaagcgaggagttcaggaccagcctggacaacacagtgagaccctgtctctacaaaacaataaaaaattgtttttttttttttgtaggcacatttaaaaaatgtgcctgtagtcccagccacttgggaagactgagttgagaggaccacttgagcccaagaatttgaaactccagtgaactgtgatcaagccatgccactctagcctgggtaacagaacgagaccatatctctaagaaaaaaaaaaaaaacaaaactaggactctgacaactagtcttggttgttagactggaaaacatatgtacaaatttgtatttacagattgcaaagtagtcattttctttgcagacgttttttgtgattcagttatgtatctttatcagactataagatgtttcagaaacaaaagtattacataatcttattaaaacagtttcttataaaaatgttctcttttagattacctctctagtgacccttcagctgttaaccctggttggccatgacgatcagcttgatggaccaaaatacaaatgcacagtgtctctagacttcatcagagctattgcaaggtaaaatgtcttgaattatgtaatgatatactaaatataaaaattagtgttttccaaatgtgatgtcattagtcatgacatttaaacatgaaaaaatcatctatttaagtgccaagaatgaataagctgtacgatagaatgaaccttctcaaatttacaaatgatgtaaaactgggagaaatagctaatatgttagaggacaaaaatcaagattctgaaaaaccttaataggctggaataaatgatcccatagtggcaaggtaagatttaatggacagttggctacagaaaactctcttgtattgaaataagatgggagagagctggcttaagtcctaaattttttagctgactacaaggctttaaaaatcctgacttaggtaacactgatagaaatatagtgtctaggtcaggggacataatcattctactgtgcgttgtcacaggcagatcaaatctagtgtgctgtgctgtgtttagagttttcagagagacaaatggatacatactgaaggggcacgaggagagtggtagaatgaggaattgtgtcacatccctgactgaaggacagagtgtgagagaaaagccttaggaaggacatgtgaactgtcttaagtgtttcaggggctgtcgtgcaaaatgaatgaagctaattctgagtaattctagaatgttagaagttctggggaagaaagtacatttgtcaaaatgaaagctgtctaaaaatacaagtttccttacaaagaggtgttcttagtgttatggaaaatgttcaaaccatttatatgaataagtgacttcatcatacggttgcagctggataacaatctgtcaggactgtaatggaagaggtgatgagtgtgtagactggcagagtgaacagggcaatccatagacagtgtgttcctaatctttttcaatatgaagattccattttagcaccctttaaaaattagtcatgaaagtatttacatatatttcaaaattaacagtatttaggcatgagacattattttgttcagcctaaaacagtgcttgatatcagtatagatttgcaaatctcctctgatgattaattttacagcttcttgaggttctgaagtccataggttggcagcttctccctgaagtctcttctgaattcaaaatgctctgaaaaataaataaataataaattattgaatgaatggccaggtgcagtggctcagacctgtaatcccaacagtttgggtggctgaggtgggaggattgcttgaggccagaaattcaagatgagcctgggcaacgtagtgagacccccgtctctataaaaaatgtttttaagttctgtgataatatgatgcaggtatttaccacatttttgtggcatataggctgtaaaacatgaattcaagggttttagtgtttcattttaataaaaccaggaaaacttttacgcagagaaaattgagcagaaacttattttttagtgtgttaagtataatcacaaagcaattacttcctttaaaaaagcaattatattggaactttatatctaagagcctctatccaaggcataaatttggagtgaagcctgttcatttcagggattttattactctgaatatgttaggttgtgccccagtataatcatgtgcaaaacagaagtttgtgggttcctaatatagtgaatctccattgaatctgacttaatttgacgttacttagtgcagagcatcacagtgatggatgttagacacatccagagacatgcactttcatttaccacctcagaaggaagcaagaactttagacctggaatcttgacatagaacttgggggctctgtaactttcttttgttttctttactgttccctacttcccatgggcaatatccatagaataagcacccgctcctccccacacctgccctcttccattctctcatccctgtgttttgtacttcttttctgctgactttacctttcattctttccctccctcccatgtgccttaggaattattattctcctaatagtcttcctcattgccttagctaaaacctgattccttctttgggatgctgcttcccctggacttacctctagttgtagctatgtattttctcaaaccctaatccctcagggttggaggtcatttcggtgccatccttcttgttgccacttccagactgttactgcccccaacttcttataaaaatgtggacttccttgagactcatgcaatctggctctatttccctattctccttaagactgatttttgtctcttcagccattccacctcatgtattgagataatagggcacctggtatccagacttcttttccacctaatttttttttttttttttttttttttttgagatggagtgtcttgctctgtcgcccaggctggagtacagtagtgcgatcttggctcactgcaacctctgcctcccgggttcaagcgattctcctgcttcagcctcctgtgtggctgggatcacaggcacacaccaccatgcctggctaatttttagcagagacagagtttcaccatgttggccaggctggtcttgaactcctgacctcaagttgatctgcctgcatcggcctcccaaaggcctgggattacaggtgtgagccaccgcgcccagcctccacctaaattcttgactctgtttaaaccccacattctaacgcctgagttcattctgttcagtcttcactctgtttcacagaacaaggttgaagccatcaactgagaattgagctacctgtgttagtgtccatcttctctttctttcctttttcagcaggatggggttcctcttcctaaggtagattcttctacctatgctctgaattccatctcctccactttcccagaacctttgttagtctcggctgtttgtcctctcagtggcacctgacactgttggctactctttcttaaaactctcttctcttagacatgattccacagtattctggttttcctctttattctttggttgtttttactaacaaaggctatctttaccatctgacctttaaatataactgttcctttaggcttggccctaggctcttttctcatattacatttttttccctaggcaacttgagccacacctgtgacttcaacaatcatctgtgtattaataatgcccctgtttttaaagaccagacctattttttataatattcttgacctttattgctgtttcccagctatattaatacatttccaaaactgaacttaggaattctaacctctgcttcaacccaccaacaaaaagtgaaatatctggctttcctccagtgtttcttatttcagtgataagcactgcagtctgctgtgttacccaggcctgaaatttgagtccttcttgacatctctctctcccccactcctaatatttaaccattagtcctattgagcttacaaagcccctcttatttgtctcaatttcattcacttgttatcatgatacttttaccactctagatcaagccaccatcatctcttctctaacagtctaattgatcttctgtctgctcttatcctcttataatttattatccatgctgtagccagaatgattttataaaaatttaatgtcaccctgctcattaaaaatattcagtagtttcccatagctcttgggataaataacagaatcttttaaataactaacaaggcccaaatgatctggcccctacctgtgcctagccccatctagcacatacaccttctttcctcggtatctgcactttaaccacttttttccattttttatattcaccattctgcttcccatgcttgtatatacagcattttccagcttcttttctccttcacctagctaactgctacataacctttagatttcagtttaaatgtctgctccttaaagacgccttctcacaaataccacaaccaccatgatcacccccccataccacacacacacacgatttggaagttcccattttgttcttcattatatgtaacaagttttacttaaataattgagtaattagagttcatctttctttctagaatacaagctcctaagctcaaagcagactgtgtttatgtctatcactgccttatcctcaaacctagcacagtgctttaaacttagtatgtgctaaataaatattgcatgttttcctatagtgattagcagtaaaaattcagatgaaggggaaccatatgaatttgtttttggggacagcaagaagggagctcagagacagtctcattccaaatcaaggcttgatgggagaggaagtcccaaggatagttaccaaagaaaaggaaggctggcctcattccagacacctgtggcagagaacaaatgagataatagggatcacaggatataacctaaatgtctaaaatggcagtcaatcaatagcatcatgtatttttatagagttattgaaaatcacacttttgaaggatagtaacttgggaaaataactcatgatgtaagcttaagtgcatgtaacagttcatataaagttgcatatacaagaaaactaggaaactgtaagggacaggagtaatggtcaaaagtcagttgtcaccaagaaatcaagcagaatcctctgatttactgataaagcagtcatttgtagctttatccagaacactttcagtggtatgatgaagtagaagtcatattgtagtatttatgagaaagtagatgtagcaaagagagataatgtttttcattcgtttatttaacatttattgtgttgcccattataaacaaaacactgtggtaggctttggggagatacagcaacaagtataacatagctatatcctattcttattagcctgtattctaggattcatttatttacttatttatttgctataaaggagagagagtatttttttttcttttttctttttctttttttttttttgagacagaatctcactctgtcacccaggctggagtgcagtggcacgatctcggctcactgcagcctctttctccaaggttcaagtgattctcctgcttcagcctcccgagtagctgggattacaggcgtgtgccacaacgcccaaataatttttgtatttttagtagagatggggttttgccatgttggccaggcttgtctcaaacccctgacctcaggtgatccacccacctcggcctcccaaagtgctaggtttacaggcatcagccactgtgtctggccaagagagaggattataactgctgaaggggttgtgtggttgagagagggttattatttattttttaaagatttgagcatatttaaatgctgataggaaagaacagatagagaaggagagttaatgatacaaaatggagaaagattaatttaaagcacaaaattactgaaacgttatataagcatggggtttagaatttgagttgcaagagctgtagatgagagagcggaatcttcttgcgttataacaagagaaaaagatggattctgatggagctgaatttggaggtttggtggcaaaaagttgagggagttctgatctgatgaattccattttctccgagaaggaggagacaaaattgagactaagggcagaaatagtagcagtttagagaaatctggaacatttgaaatagctgccatggggaatggaagaaactgttgaaaggaaagcagtttgttgggagtgttgaggtttttgaccttgaatttacttacaatggcaccaatctgtgagacttgtgatcttctccaacaccaatccatgtgctagagactgggacagcaaagaattataatcgaaatcacatcgtactggggttttgccaggtaagttcagtggattccagcaagtaaccacttgacctgatgaatcatggagtcttaagctaggacgggcaggaaggaagtaaagccagtcgggggctaataattcagtgcctagcatatagatactcagttaatgtttgtagatcaggaaaaaatgaagccatttgtgaactgattgtcccaacatgttccagatagcaaaaaagggataaattggggatcataaggtagaatgtctgaatttatttctttagaagtagagcatttctgagtgtgattatgagagtggaaaaggttattggaggtaagaaagagaaatatatagtgaagtcactaggctgacgcaggtcttgggttggaaaggaagactgaactgtatgctaaattactcagtgactaagggatggcgacaaagaggatggggatggtgagcagaatggtcttaatctcagagtagcagagctttttgcacaggacaccagccccacctgacagaactgtccgggggtacagtagagagttaaacattcattggaaggagctgaagaaaagactatgtcctttgaggggagcctagtttcagttaagcctggaaggggaaaataaccattccttgaagagatagaggatatagagactacagtggaaaggtttggacagagaagctgtaggaagctgattctagaaagggaacatagaatttggagatagagtatgggagaaggcagataacagatgactgaaaagcttactaaattttgttcttggattgttcttaatgtgaatggtagttacacattttcaattgtttttcttccacagtcagtgggaagacactataagataaatagaggttacaacttaaagttgtatggttgcaagttgtcagaaaaaaaaaaaattaaaaaaatctcaaactcaaactgcccacaaaagtaaaaggaaacaaaatagtatcctaaagaaagaaaaagtattttaatgaatcaacaaaatgaaataaaaggataaaggcaaaattaaatccttaaatatatgccatataattaagttgtattaacgtattctaaattctgatttaagaattactcctaggaaaattgccaccacactattcgtgtttactgtatttctttccagctggttactttagaaaataattcatttatgttctgtgggagaatctcccatagtatattgaaagttatcccaaagtttaaaattatacttacgtgactataatatgcatctgtgaccatggaaagccagggaacatccatgcaaattacacaattctcttgtaagttatacctttctttaaagaggattgtttgtcttcaagtactttaaagcacaaaattatctttcggatgtgtggcatagttttttatgttgcccctgtgattattctaacaaattctgccatgtcttaaaataatatatgtgagatcaattggcaagttacctatttatattgggggtggaggaatggtagagatagtgatacatcttgggaagtaaatgtttcttaaaggaatgattttatattcaattcctgatcgattttttttaatctaaaactcttactatgattcagtttgcatgaatacttaccactgacaaagtacagaaagggaatataatgaaagttttatgaacatttaagttgcttagtgtttttaagtcactccattcattctattaagtctgttctgttatttatttattgtacaaactattctaatgctatagtaacaaacagatttctcaaaaaatagagaagtcctacagacatcacaatattttcatgtatttgtgctcttctagtactagtccattagacaaacatttctctgcagccgtcacaacttacttgcaattatttcttctccctttctcccttaatattgctggtatatcttcatattgatcattttgtatggctgtataatatttcatcaaataatgtattgtaatttatggattctcctagttttggaatttaagttgttttaatcttacctgcttcaaaaattttgttttcacccaagtccagaaaaaaaaaaaattagcaacacaacattaagtccattttaccatattactttaggtttataacctaagacccaaagtcattgtggagaaatgtgcctggagagatgtacaaataccacttgccttttctgtccgtggttaaaagtagtctataggtgggaactgaacaatgagaacacacggacacaggaaggggaacatcacactctggggactgttgtggggtgggggggaggggggagggatagcattaggagatatacctaatgctaaatgacgagttaatgggtgcagcacaccagcatggcacatgtatacatatgtaactaacctgcacattgtgcacatgtaccctaaaacttaaggtataataataataaaatgaagtttaaaaaaaaaagtagtctattatatccgtttcctttctatggtcctctaaataagatcttttcaatcagtatcacgattttttaaaaaccatgtgttggctgggcgcggtggctcacgcctgtgatcctagcactttgggaggccaaggcgggcagatcacctgaggtcaggagttcgagaccagcctggccaacatgatgaaactccatctctactaaaactacaaaaattagccaggcgtgttggcacatgcctgtaccttcagctacttgagaggctgaggcaggagaattgcttgaaccggggaggtggaggttgcagtgagccgagatcatgctattgcactccagcctgggcgacagagcaagactccatctcaaaacaaacaaaaagaatcatgtgtcaaaagtactttggtgcccataaatttgggtgtttctagagttgaacgaaagaaaaacatataaaataactttatgatttaataaccatactttttgcgtctttatgcaaaagattttttttaaactttttagttctgcagtattgttttggcagttttataccatttggaaaggcttagtattcttcagaggcactgttacaatgaagcaagttattcttcagtccaacattaggtaccacaatagccatagcatctctttttagctatttttaaatgtgttttcataagcagtatctatagtttcccattccacattttaaaaaatatttgatatgtcagtcatttgcttagaaacttttttagaaagtatattgcaaaatgatagacaaaaacattaattgatgatggtttaataaataagagcatgcaattagtgaatctttaaaaggctgttctcacatggatgattatttttgcagaattgaatacttaaggctttaattttatacttattgctagatcattatatccaattattttgaccatttattcaaataataaacctccaagtctgaatatttatagtgaagaatgagttttgtgaaaggagaataattatatgtctctctctctgctattttattctgcctgccatcagagtacaaaaatatacattcacatcatctgtttgttgtatcatattcttggatcatacagatttagttacaatacacacacaggtcagccagcgttaaaagactgaaaagaatgaaaactataaatgaggacagatgagctatgcattatgtaatgacaaaacaggtgtctcggaagataaacaatgttcagaagcaaagaagatttaaatacttttgaatctctaattactttattctggttattagacaaagcaaatagctttcaaatgaagtctaaactttctgtagtacaattgaagtacataatgttgaatagctctagcttcgtttacttttttttagaaaggcaaacttcgtgcatggcaaaaaaaaaaaaaaattaaaatattgtgttcctaataacattttaaagaattaatgtcagtcctatcagggtgcatttgatagcactataggatttttagcattagtcatgaattattttgcatgtgctttccagaatcatacaaagctgagcaatctaggggtgagaatgctaacatattatctgtttttgtttttaggacggtgaactttgacataataaaatacttgtatgatttcttgtgaaaacaagcttcaaagccatatggacactgtgacaatgactaagccaagctgtgttcatccagctacttagctggccaaggagaggagttctttggctctattggatttgtccaaacaggtgctggcccagcatggaatctgatgaaaatattctgattggtctgggtggatgtgagcagaagactatttaccagggaccctggagtatttggaagcaacgtgttaattataaacagcagggtttgagcacaatctgttctactcttaatgatgttatcttaacactgaaattgcctgaaacccatttacttaggactacattttgctctgtgaactatcccctgcgctttgaacgtgccagcagcccttgtttatatgcccattcttttcacttcctctccacaggagcctctgcagtcgcttgccaaagcagattttcctaaggccactgttttaaaagatcatagttgcaaaatataataaatacaagttctttttaaaatccaagcttgtgtgtatttatcttttcacttgcttttctcaaaaggcaaggtagtttgatcagaaacagaccaactttccctctttcagcctacttgataactgtggtatgcttgtataaggtttatctggtcactttcttaaaattagctacccaacccagttttttttttttttatcagtatcatggttttattttctttctttctcttttttaaaatcactggcctttaagagttccacaataattttttttcctgttatatcacttgtgaactttggttttgattttcttgtccatatttttgaagaaattttcttttagcatttgaatgcttgaaaattattttaagcagacttaaagttcttagttatagaacctagtgtaaatttcagtggcattttatttcttcattttttttgaagaaaaattctcacgataggcacttttagtgtaactatctggttcaaagaaagcaagtaattatctactatttagaggtaatgagttagggagaaaaggaatggaattcctttcgcctccctacataaataagacagactttcttgcctgaagattgacatccacagcaagtgatagagcatccccactgtaaatctcttgtcccacagaaaatgaagtttgtgtttcacaagatgtttggagatgccagggtcagagaaaagccatgcgtagtgtggattctggcttagtttccagcatgtagaaatccatgtcatcaagctgtagaaaacaatttgggtagctgattgaaggaagagcaacaccacctaggatagctttcagcccctcatatttgttttgcagatgcatgtctgctgtgcagcctgtcacggataagcggaaccagtctgtattttgagggaagaactctgggatatcaggaggggagaaattatcaaataggaaactggagagaaggatggaaaggaggtgaagtttcctataagtgactgtccatgcatcctcacagctggtcacctgtctcctgcccggtgcatttcctctcctgtactgccccaccttgttaccagccccagatgtggcttcccggcataacactaaccagattttccctgcccctgactgggtcatcagaactttcctgttttgtaatttactttctaatggcttgctaaatgactcagcagctaatttgattaatttatttagatgaatactaacagagcttaatatggatgttggcattttaacaagggtcatctgcaagtggaattctctaattggaagatatgaatctccaattacaggagggaatccaataatgagaattaggctggccggcgggccagaaatttctgttaagaggaggcacttaaattatactcagcatctactctacctaggtgtaaaagtaatttaggtggtagcagaagaaagttactaagctgtaggtttttagactatacataggtggtcctccattttacaaatgtcttctttcaattaccgtgagccaggtatacataggtggagaccttactccctcttccctcttactttcaagtcattttcaagcccatttcaagctttcgttgatgcagcaattcctttcaacaactctggaagagattgtgatctaccaagcctcatctcattagtcataaaggggtcaaagtcttgataccaagatagcagttgagactccaggctctggaatccttggatcaaataccagctgtattgctactggctgtctggccttaggcaagttatttaatgtgtctctgtgactttctcacctgtatagtggaaagtagaatttacttcgtagcatttttacaggattaaataaatgaatatatctaaggcagtagttctcaactagggacattttgcccgccggcaaacgtagtcatttctggagacagttttggttgtcacaactgggtgtggggagggtaaaggccagggatgctgctaaatacagtagtccccacttacccatgatactgctttcc

SEQ ID NO: 17346 - DNA, 24405 bp, Human; identical to SEQ ID NO: 12040
  misc_feature (1)...(24405): n = A,T,C or G

SEQ ID NO: 17347 - DNA, 51927 bp, Human
ggtgagtggttttgttaagtgctggtgccttctttccagaaccatggcctgaagaaatctgcttatctgttctttctttgctgtcatggtaaaccttgaaatttcgtgtgtgtgtttgtgtgtgtgtgtgtgagtgagtacacttacatggattcattgtagcagagattgaatgagcagagcaaatacattatgttggttctggtagtattaatggcctgtaaaacagagaccattaaatttaaaattaatttcatttaaatttaaattttagcagaaaatttctgtattttaacaaagaaaaagagatgcaaatcaaaaccacaatgcatttctctgatgaccagtgatgatgagcattttttcacgtgtctgttggtggcataaatgtcttcttttgagaagtgtctgttcatatcctttgcccacttgtttgttgtttttcttgtaaatttttgttttttttcttgtaaatttgtttgggttctttgtagattctggatattagccctttgtcagatggacagattgcaaaaattttctcccattctgtaggttgcctgttcactctgatggtagtttcttttgctgtgcagaagcttcttaattttgtctgaacactccttgtaggcagtgtttttacctgcgtgctttacttgttctgcactcaggatgaatcacagagcgttggtagaggaaataatcataaaatctaatatttttgagcactttctaacgtgtgtgagatcattcttacctctttatgtgagtcatttagcagtcagaaaagccctgcgagataaggtgctatttccgtctccatttacagatgaggaaactgaggcacagggaagggaggtcatatgtcccaaatcatacagctcatatgccagggaggcagaatttggctctagcatctagggtctttttttttttttttcttttttgagacggggtctcactttgttgcccagattggagtgcagtggcacgatcccggctcactgcaaccctctgcctcctggattcaggcgattctcctgcctcaccctcctgagtagctgggattacaggtgtccaccaccacacctggctaatttttgtattttttgaagagatggagtttcaccgtgttagccaggctgatctcaaactcttgacctcaggtgatccacccgcctcggcttcccaaagtgctgggattacaggcatgagccaccgcgtccggctgcatctaggatctcaaatactattctgtactttctttccaacactgtgctgtattccctctttagatatctggtggttggtttaaagtttatgcacaccaatttatctgtttgtttcttttggctataatgtcttggggagtgtaaaagaaactcatcttaccagatagccaactatgggtttcccagcatttatattgccactgttgtcgtgtgaggagtacagaaggtgaaatttacattggtgtgtttaaccagtttgggaacttgttctgagatctgttggaagaaatagaaactgatggcccttaggtggtttgggcttgtacttccccttcactcatattcccattagccttgacaatgagagtcgagtgtttttgattaggtggatggacgagagcagagacgtagtagcaaagaagaaaatagaaacttaaatctacttatttgagtttttatgggaagaattcttcttgagtaaaatctttttaatatggttaatgaaaggaagagaatggggttttttcaatacaaggtaatggagaaatagaatgaaaatgaaatcctaaagtgtttttagaaaaatgacacttgacagccaggaaaagccccggatcattagattgtgggtttaatgcctggactggccgagcagctacccaattagatggctggccggtggaattttggagttctggagaggggtcctgcttccctggaacgaacgtgacatttttctctcccaacagaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcggtgagtggagggcccagcctgcctcgtgcgttttctccgcatttccccagatgagctgagccctgttgaatgtgatagccatcaagatcaaatatttgtttataactgcactttgtaaatggaaatgtgccaaattactgatggtggtaaatagaggtacagggcaaaatataggcacagggacagatgagagggtgtcggttgggtgtctacctctcgtcacatggaagatcattctagaaatgacattgagtttctacgctgtggtaggcactgtggtcagcctggaggattccataaggaaaaatatagcacagaacccctgttctcacagggattagattctggcaggaatgagagttttcaaacaaatgttaccaaaagaatgcactcgtggtacatctgacgcttagaacatatccctagcctgttggaagggactttgggatttcaaatagaatagggctggagtaagaacttgacggaagaacacggctgcagaattcggggcaggacatgaagaaacaaccctcaagaggcgcgtctggctgggctgctgagcgccgtggttgtgtgtgacttgggcaaactggaggctgtgctctcatgttaggaaaatgaaactggaatgcgggcaattagggcttaataggagggatggcgtaaggaaaccttaggatcctttcaggaagattcttagtgctcctgctctccctgccttccctagtgagaaaggcagggtgtggagaagatgaagaggccgcatgctcactggtgcttccactcctcacctgttctttggttttctctgtggtcgcttgctttcccctacccaagtcagtcacccttcagtgtttcccgcattcagcagatatgcagaagaacattgtgaaacacaagatccccccatttactgcttccagatgtaagagatggaaggcctcccccacccccccgggctgactgccgcagagggagtgtgtgcccttccacataaagccctggctggagtcagcatttttgttatttatgggattctaggtctttgttttattttagacaagttcttggattcattaatgtgaaactcttaaaatatataaaagattcttcagtctaattcatgccaaaatataaatatagaatgactgaactacagctgagaaaagttaactttctacttgatttctatttagaaggtcagggtaccttaatatttcacctcagctaatcacataggctggggaatgagtggaatctcccttttcctaagggattcctgtgaggttctggcattccttctctactggcagagcacctgatgtgtcacggcagcgctgccatctccatgaagagttgttggcaagtgcagtgttaagacatgtataacttagcagtaactgtaagaaatgagtaattcctattatatgagaaattgtgggggcacttacgtgtggttttaaagctttagcttagcataaaggcattgtgccttgttaaaataattacatatgttctctctagaacagtttaaaacttgagatatgcagcaagaaatgaaaatctataattttactgcccagtatagaggcttcctgatttttctctgtttatagacattgatttagctctgattttcagaatttgtggggcttagaaatagatactgagcttgctttgcctttttaaaaaagaagttaaaagtttaaatttaaaagtagctctggaattctggtgcttaataattacagatgctttgatatagctagcatcatcctgtggacacctagggcagggaaagaggaacttgattcacttcataaggtaccggtgaagagcctgtgcatctggcactgctgcggggggctggtggccggagtggaatattgttgctgtgttcctactttgaaaacaagtaagcagggtttgccagttcccaccctcattctgcacccccatctcacatgcacagtttttatcaccctccttgtccaataaagtttacacggatactaaaatgagaagaatccgcactttttggtttggccacttctcatcacaacccacgctggctgtttcccagctactgatttttaaggcagtagcacagaggttctttgtaaattataccttctgaaatttccttttaaaaatcaggattgtagagctgggtgcagtggcacatgctgtaatccctgcactttgggaggccgaggtgagaggattgcttgaggccaggagtttgagaccagcatgggcaacatagcaaggcctcatctctataaatttttttattttaattagttgggtgtggtggctcatggctgtagtcccagctactcgggagactgaagtggacgaatcatttgaacccaggagttggacactgcagtgagctatgactgtgccactgcactccagcctgggcaacagagcgagaccttgtccctaagaaaaataaaaatcagggttgtaaagaggaggttaacactcatgctggtcacctctaatgaagacctaaattagagaacaggacagacaagctgggttaggaacagaatccaaaaagtgtttcttaagtgttggagcccggactgatcagggccctgtctggagaaccacgtccttgtgtctgtagtggcagctcacagtcataactgtgatgccctgcgtgccaaggaagagcttctatcttctgaaggattttgctgctgctgctctgtgactttgagcaatggatagaagcagattttgtgggtttgctttctttttacatcactgtcacagataatgcaagatttctggtgttagccagtgttccggtttagcctggctacatgttttagcctcttctctgagattgaagccccatggccccctagtgaaaacgatcttcactggagtgactggaaaccttttcggattggtcggagcccagacacacgtggttgcagttaagcaaagtacaggagcatgttggagcggaaagggaccagggaaaagagggatggggcagatgtgggactggactccaacttagaccaggcaaccttgggcaagttcaccaggattttctgaccttcagattcctcatatggaaaaccgaagtgacagtacctttcctccttcagtgttgctaagaggactgaagagttatgcaatgtctgcttggcccacaataagtatgcagcaatgttacttttttccctttgtcttttaatcttcatattttatacacaagaaaactgagtccaaagaggtaaaattatatcatacagttagtagaaggtccagaactctgttatgctgccttcattatagtagtagaaagttgtatattataactagggctttggggaagggggcagtaaaccaggatagaaagtttggatctgtccagatcaatatgaagagtcagtggcttgagcctctaaacccaggagcaggcttgtttgtttgtttatttatttagagacagggtctcgctctgttgcccaggctggagtgcagtggtgtggtcatagctcactacagcctcaaactcctgggctcaagctgttctctcacctctaactccagagtagctaagactataggcatgcaccaccatgcctggctaattaaaaaaaatttttttagagatgaggtcttgctgtgttgcccaggctggtctcaaactcctgggctcaaacaatcctcccaccttggcctcccaaagtgctgggattacaggtgtgagccacagcacctggcctagagcaggatcttttgaaaatggatatgcaggcaaatgagtctaaaggtagtgatggaaatggaaggagcaaaagggacaggtaaaataaaaacagagtctaagttctgttgggtataggatcagaaattgtcaagaatcgggtagtgggctgggcacagtggctgacgcctgtaatcctagcactttgggaggccaaggtggatggatcacctgaggttaggagttcaagacctgcctgaccaatatagtgaaaccccgtctctactagaaatacaaaaattagccaggcgtggtggcgtgtgcctgtaatcccagctactcgggaggctgagacgggaattgcttgaacctgggaggcggaggttgcagtgacccgagattgcaccaccgcactccagcgggggcaacagagcgagactccatctcaaaaaaaaaaaaaaaaaaaagaatcaggtaatggagaggactggcatgaagggggcacaggactgtgaaaacctgagtgactctgtccttccctcatcctctatccctgaaccaggtcagacatagatggaatcagagcaggagttggtgttgatgtggtttcaggtccacctatcagagtttgagagatttaggccatgaaccattatgaatatagatgagaacctttgtaattgctgaaggaggtagtagtgcaggcaagtcctgtgtgcaagacctgctgctcccagttagtacggacccctgtgacattcacagaagttcagaatgtctgagatgctctgcaggctaccttatctccgtctgcagctacacctccagtgatcacaatcagtgctacgctggcacagccagcctggccctgctctggattggaggcatcctcaagggctgcttgctgtggaagcagtttcgctggaccgagaggagccactggaattttgggtactgggccttagggtcacccgggaatgggaatggctgctgtgtggccctgtttgccagagggggccattggtgatgagccccatgcaagtggcatctgcccttcacctgctccttctaagccagcgggatggagaccctccagagagaatatgtgagttcctctccttatgagagccgtggtatgggcattgagatgactgacttgtcaaattagttcggaaagatttttgacaactactacaagatcataatgtacttgaacaaaaacctgtgatatgtgttatttgtttgtttttagatattggagaagggaataaattttagcaagtaaaaacttttttatgccttcacgtcttttctaagacttaattttaagaatatcagaacctggattaaggtttacttctggtgactaacccagttagtctatcacagattcactgtttagattgttatcagaccttggttccagcatgggttcatatcttacaatacacagaaccagttccttgggtataactgatctcgtttcctagttggatgactaaattccacaccaaacgatctcttgacctccaggtcacatgctggccggtggcccttttgcatgagagattgaaatttgtacatccatatgttagcatatatatggttagcgacttgctttagcattttaatcctatgcttcataaagcctgccacagaggatgtggcgctttgggtttcattctccacaagtcacagagaatagttatcagatctatattcactcagcaaggacttgagtttttctggcatgatgtgcacagtaccagggcagagaaggctgctgccctcagggagctccaggccagcaggaagtaccgctcggaccccttgtccttggcagagggtgagagccatcttgagactagagcagtcaatgcaagtgacttgttttcatgccatagaactacagctgtgggttcattctcaggtaaggatttggaagaagcaaactaaaggcaacatatccaggctgtgggagccacgctcaatcaacagcatggtttacaactcaaaagtcacactccaccagaggccttctcagtgtcatggcctgcatgaacaaaccacagacctccagctcacatgcacactgcaacaaggactggcatccttcatccatgtttagagggtgtatatggagcatattaccaagtaggatttccccgtgtggctggtggaatccctcatttccacgtaaccatacttcacacatgtacgcatgtaaaggcccacttgcaaactaggagaaataatttttgcaggagaagagagcagctcgttgattcataagtttttatgaagactcacaccagacttgtggaggtaaagcaagtgtgggcctatagggatcatgccagtggaaacgctaagggcggcgagacacccttctggacttgagtggctggggcccgctgtgagcgggagctgttgttgatctgggcaggattacacgtgtctgtgaggcagacatttagagacaagccttagtggaaactgccaggagtgggcaggaagggagctgtccaggaagggcagctggggttgagttggatggtggtgtcactcgccctcactgacaccagcctgatgggtctgaagaaggtctgtcacagtcagttgcaaggcagggcaatagatgaatgattttgaaccaggtgggaggtatcaggtgaacgctgagaggcagggacaagtattaggaacagtagtagcatctggttgtttctgcagtcatttgtaaatatgacctaataaatactgtttctacagtcatttgtaaatgtaaacctaattctcatctctgggaagctttggaacagaaatcagttatccgatgtgtatttaactagaagcctgtgtgagacttcagaagaatctcctgatccaatgctctggttacatccctatccttcatccttatggaaatctgggatgtttttaggcattaacttccatttattaccatatgtgattgcagattccgggtcagtgttccccatggcctgttattccatggtcttgatagcaacataattgtgcaaatggtcaaatgaagatgggagcaaagatttccccttttaattctacccctagcaactttgctgacgttgtgctcagagaattcctgaaaagtattccagcatttgaggacatttgcggcaagcgatcctggcagttggggcagtggggtggtgtattagtcagggttctctagagggacagagctaataggatggatatataggagtttattaaggagcattaactcacaccatcaaaaggacccaaagtaggccatctgcaaactgaggagcaagaaagccagtccgagtcccaacgctgaaggacttggagtctgatgttcgagggcaggaagcatccagcacgggagaaagatgtaggctgggaggctaagccagtctagtcttttcaaattcctctgcctgcttttaattttggccatgctggcagctgattagattgtgcccacccagattaagggtgggtctgcctttcccagcccactgactcaaatgttaatctcctttggcaacaccctcaacagacacatccaggatcaatacttcatatccttcgatctaatcaagttgacactcagtattaaccagcatagctgggatggagagactatgcttagagggggtgtttttatttagaaatgttattctggcagggtgcaaacatcagcattttcatgccttgaggtaacttcagcaccttttctaaaacttaatgagcttcttaataacaagttatgaaaaaccttgctaaattacattttcttacaaatctacattacaggaaacaattgagttgctttctaagagactgtaagacctgtctgctgacttagggacgcttttaggtggctgaattaggtgggaaaagtgttagagctggtaatgagcagtggtggttgggtggggtggcctgcagggtgagaactgaaggcagagtttctgatctttatgccaagaccaggccacaggagtattaagtgcctggcttaggaatttaaagaaagaaagaggttgattgttatatttaaaaaactatttccgggctctctttacccaggaagaaaaagctaaaggtcactacagatacgtagggaatatgataaagcaggtctgaaaacacaatttgattttgtacaaatgatgtcgcttctcacaggcttcattaaacagagaacgtgtttgatgacagaaacgcataaaggacggaaatgcgtgctgtaatatttacttatgtttaaaaatagccagatggaaccaactggtgccaaatgaaaaatgaccagcgtaggctgtgtttcttgacaaaacaccttcagcacccattgtccaaaagctgaccaaaggtagtagatgggaatgtggctccctttgaactaggcagaagtgaagcagatgccttgtatattcaaatggttggcatgtaaatttctacgggcagtcctattttctggaacaatgtgtatttgtaggaatttggacattgtgacttcaaattttcttccctttcattgaggcgggtttgtggtcagctgattttttttctggtgatgagatgttttgcgaagtaccgtgtcagcctcctacccctacccccgtccctcttcagcaaatcctctgggatagtggggagccgggaagttggaaactggagatggactaggaatgaaaagaaaaaaggttctgagggttaggagcaagtgttgaaaaatcagaaaacccagccaggcacaggtgacctggaccccgcctcctcaaggatgaaggatgtctccacacacagacgaaggaggtgtgggcatgtttgggacctgcctgtgaaccgccaagcaaaccttgacgtacctggatgtctcattgagctaggttcgaagctctgctccactatgtggtggacatgggactgagaagggaagcagcccccccaagtctgagcttcctcatctggagaggggctggcctttagcaggctccatacacattcactcacctcccatctttcctgcatgccagtgtcaggatagttctgcccttctgtgctcagctgggaggaaaggatcttgggaagtcagctagttcagtagtgagtacgaatagtgagcgtgaggcctcattgttaccttgtgacatttacagttcactgtattggggggaatctgggaattttaaaaatatctgtccattgtcatttagaaattattgtggagggggagttgcccaggggctggcctttaaaagacctagtgtaatatatcaaagatgtagtctgctagatatgagaattgatggccagagttcctctctgaaaggtcactggatggaaaagtagttttgtgtctttacaaaaagaagcacatgatggagttctgagcaggctaagatgcgtgtaaaatgtaaatgctgagaaggacgcggttggcgctctgtatccgtggattaaaaatattccatggaaataaatggatggtattgtctattgaacattgccagacattttttccttgtcattattccctgaacaatacggtataacagctacttatttacatcatattaggtattgtgagtaatatagagaccatttagagtatacagaaagatgtgcataggttatatgcaaatactatgccattttatatcagggacttgagcatctggatttgggtatcctgaaggggaacagctgtatagaccacatgttaggtattagaaggaacaaaaaggaatcatttttacccccggactgtggttctacatgctcctttgcaccctagagatggatcccgcattagaacccagccacgtctttggcagtctctttagaagttacttggctctgcctctcccccttctactccttgccctcctctctctcactctcccttctcactttcgccctgcgtccacctccctatccctctcctgcataaacagtagcaacacaaggggcatttaactgctatggctggcagatgcccatttggagatggagatgaatgagtctatgagtggtaaagcttgggcttctctacccctaagaaatcctcaacggcatcatttgcttttgcacttaaataggagagtggcacaaaataactggccatcgcgttcctgttagtcaaatattggtgagagttctggcctcggaaacctttgatatgcagatgttcacggttttcctgcccttcctgcccccaagggggacttgaacttgtttcctaattcagcccttgtggggagactgacctcaggaggaacctgagcttgtagagatgttgcggaatatactcatgaccaccgatttcactgtagtgggtttgactcactatcttttttttttttttttttaactgggaacactatgtaaccacattaaagaggtctatagcaggaggaataaaagactcctaaagcctgctgactcactggctcatgactgatttcctacacattcagctggggttgtctgctttgcttgccctgtttcttgagcccaagcgacccacacacactgcctgctgatcagtaggttatgtcagaaggccgtaagggccaaatttaagctatttttcatttaaataggcgtccctagaaatagctacgtggacttacctaatatagtatttaagtccccagcttttgaagtgattctgtcttgtaaaacctacaagcatttcagactccaattgttacagctttgcttcccagcactcagcttgcaaccccttgcttgtgtagatataactaaggttgctaacacccttttttaaatatagcatttctgttcaaaaaatagcaacactgggccaggcgcagtggctcacacctgtcatcccaatactttgggaggcctaggcggaaggatcccttgagcccaggagtttgagaccagcctgggcaacatagtgagaccttgcctctacaaataataaacagattagccaagcaaggtggcacgtgtctgtggtttcagctactcaggaggctaagtgcgaggattgcttgagctcagtcagacggttgagacggcagtgagctctgataatgccactgaactctagcctgggcgacagagcctgcccctgtttcgggaaaaaaaaataattcattattagaatgtgtggtcttttcatagagccacagattttgaagcacagatcctaatgttttgtgcccttccccttcttattcaaccccctttcttgaaattacagttatgtctgacaactgagtgacagtgtgaccttttatcccgtatcatcgagccttcaattagtgtctccttttgacagatgtctcatttactgcttcattttcaagcttttctcattattctaattgctaattggggtaataataaatatcttgccccaggttacatgtcaagatgttgctttattggggatatcattcacttctttaactttgatttagcttgtttgcctccatgtttctcggattccagaagattatacaccaccaaaaacttaaacctaactaaaaaattatttagctaaaagtttgttataaaatggtcctccagagcagtggttctcaaaataaaatttgggacattgaccaaggtggttgacctgtcttgaagggatatggtctctgtatgtccaaagctaaacttcatctcttttctgaagcctacccccagtacccagtcttctatttgattaaaggggacagtttttcttctcagccctccttctttctgcttacaccccattacctgttaaatcctgttcctgagtgctgcagcacgcccagtgccttggtccttcccggctcccaactcccactgccctatccaggtctgtaggagttggtttctccccagtctcttccctccctcctgttccacacactgcttacgcttcttgtagatttctttctaacccattagcccatcctcaccacttccctgctgaaaacttccctgctggaaacctgctgtccctaggaaggtgcttctcaaactttagcatcccctggagggcttcttaaagcacagattgctggatcgcatccccagagtttcggattcagcaggtctggtgtgatttgctttcctaaccagtgccaggtgttccgcagagcacactttgagaagcttggctctagaatgagcctgtgcacctgagatttcaggcttgcttctgtctgttcatcctgactctccctgcactcttctgctcagccagggttccctggagtccctgtggtcacttagagacaagacgtgggctccttcagaacaagcttgtgtcttgttcaccttatccccatctgcccattcacagctaggggaactcctctgcagagtgcagaaagtggtgttgcttttgaagagagagcactgaaaaagaccatgaatgcatttctgttgtgtcaagaggtatagaaggcacctttgtaagcagagcatcgtgaggacctccctgtgggcggccaggccacctgcatgtctaggccatgctgagacaaccacacttcaccatcatacttggtacttttcttatctcttttcacaccctctcattcttcctgttttctctcattttgtcctttccccctttctcttcctaccttagccttggtgccttcggtgtgtttggtggcttcatgggttgaaaaggcttctgatattcactacaaagccacaaaattgcttctgaatttcaggctatttgttggagtcaagactgaggtgatggaggacttgtactgtagttagagcatgttatcgggtgcacaagtaatattctacacaatcatattttacaggaaagttcctctttaacaaaaaataaccctggaagtggactcatgatgtctccattttacagaaaagaaaacagactcagcgattaagtaacaataatgcgtgacactaagcaaagatattctcccattcttatgcacacagagaataacgtttttgcttcataaagtagtgtgctgtagttagtaagcatgtttggaatcacagccataggtgttagaaagtttctgccgagagagaagacattgtgatgattaaaagatatggttaggtcatatttactccagaaaactattagcagtttgggatcaagagtgaaatacacacatgtagcacacagtagatattgacagaatgtctataaatgtataagcataaaaaaaagactgggaggaatttaccaaactactaatagtcatcatttttccttgatatacttctgtatcacttaaatgtttttaaacagtatatacattataacttaagggtggacaaaaagcaaaagagcttgtaggaagagaaatggataatcctaataaaaatagaagagtccatggaaacagatcaggcagtcatccccttctaaagggtctccctgtgagttcatcccctggcacccatccacttcctcctcagcgcggccctcctcagcctgccgccctactctgagacctagcttttccacacttctttttggtgtctcctgttttgtttcatcacaccttaagccagaaacgatctcttccacttttggacagctctctcctcttggtaccagaggttatcatatcacagtctaatttctccaagggtttccagactgttgtaaaagtgaaggcccctctctgaaattaaaaaaaaaaaaaaaggtaggctctaacgtcatagtcactgagcttttatttatcagtctctaaagactgctttttggctttctgtggatgtctggatgccttacagtgtcctttggccccagaggactcagcagctcacattggagacctgctacctgtaaagactactgctgctactgtgggaggctaggccctgccgccttatccatcattaggagttcttgcacatagcaaatatactcaggaagctaacagatgaagacgacttagagaaaggtgcacagcgatgtcaaatctgcacacctataaatgttgcacctaaaactaataaagacctgtgtctgcacatgcatatgttttgtagctgatgattttaactgttagagatgctatgcaagaaagtgaagtttctaacagatgatattgcgcttggtgaggagataaaatagtggaaatagtctcaaaaagaatataggtaacattttagaagtataaccaaatggggtttcatttccaccagagctgaacaggatcagtcctctgtgctgtggatggcagtggcttgagaactgtcaatgtgtgtagtggtggcagtttgtggctcttctcttgctctctttggccttatccggcaggaccagcacttgtaggtctgtaaacctgttttctctcttcaggcatctttctgacttagccgtggttccccgaagcctgtgtttacctccaggcgaatgattggtttacatcagcacatcttgcactgcagtctttcagcactcactcactgggcagctgttccgcaggtggccgcctagaggggtgcggataccacaggggcatattagactttatatttaatttttaagcattttattttttaatggacaaatacaaattatgtgtatttatggtgtataataggaacgagttcaggacatctatttttaataaaaatggtgaccatgttcactattagttggtgactgtagttaataacaatgtaccatatacctgaaattactaagagaatagattttaagtgttctcactacagataagtgacaagaatgtaaaggaatggatatgttaattagcttgatttagccattccacagtgcatagatgtttcactgccttctaacctgcccccctttcttttttgatagggtagtggtggtgcacgaagatccgcactacttgacagcgacgagcccttggtgtatttctatgatgatgtcacaacattatacgaaggtttccagaggggaatacaggtgtcaagtaagcattttcctgcatttgcgtggctcccgctcgccgtgtttcatgaagaacgagtggcctttcagaaatgcacatttgctcctatctttcgcctccttaggatcgctcaggcccctctgtgtccactgtaactttcccagagtcggtcccaaagctcactggaccctctagatgttccctgtggccctgggggctccatggtcaaatatgtgagtgtcacatcctgtattttatggtgagtcacatgttacaccagtgcacaataggctctgacgtttcctgcaataaagaggtctgttgaactgggcccaatccggcatttttcatgcttacttgaccatgagacccatattttgagaaagaaatactgacatcccaggatggcagtgttctgttaaagatacttgggaaatgttggctcatgggattacccttaattattaactgtagtgtaagaaaccctgtgatatccagcatacctcctttccagcctctgtccctcccaggcctcctgtatagggccctcaggtcatactgaacttcctgcagagccacgactacctctgctctctcccagccctgaggctttgtgcagttctattttgctttttagaaatggggtcttgctatgttgcccaggctggactcaaacttctgacctcaagtgagtctcctgcctcagcctcccaaagcactgggactacaggtgtgagccaccatgcccagacttgtgcacttttttttttctttggacggagttttgctcttgttgcccaggctggagtgcaatggcatgatcttggctcaccgcagcctacacctcctgggttcaagtgattctcctgcctcagcctcctgagtagctgggattacaggcatgcaccaccacgcccagctaattttgtattttttaatagagatggggtttctccatgttggtcaggctggtctcaaactcctaatctcaggtgatccacccacctcggcctcccaaagtgctggaattacaggcgcgagtcaccatgcccggccatgcacttttttttcttgatcataaagcctctttctacccccagcctgggtgcttgatgtattctttaatcttacaaaactcactgcatttcaccttttctctaaaaccttcctagtctatcattttcatcccctacctctgagtgaagcatttcttcccttttccctcccagcatgttatattccttctgcataactcctgatggcacagaggtgttcacctggcattctgcccccctagcccgagctccttgagaacagggtggttatcagtcatctcttttcacagcactgacagtgcctggcacacagtgagcgccccactaatgcatcctcagtgaaggagggagtacctctggtttctccacccctctttctattttagccacttcatttttgcttataccaggtacttgtctaaaaatggtcttggaatctgtgctttgttatttaaatcctctgatgcttagcttttatttgggccactgctagctacattgtaatctttttacggtcaggaaccatgtggtattgctggctctatccctcatgataggttgcatgtaatatgcactcaagaagtgcctattggccgggcatggtggctcacacctgtaatcccagcactttgggaggccaaggcgggcaggtcacgaggtcaggagttcgagaccagcctgaccaacatggtgaaactccgtctctactaaaaatacaaaagttagctgggcatggtggtgcatgtctgtaacccccgctactcaggaggctgaggcaggagaatcgcttgaaccggagaggtggaggttgcagtgagccaggattgcaccattgtactccagcctgggtgacacagcgagactccgtctcaaaaaaaaaaaaaaaaaaagaaagtgcctattgttttttacttgacactggtaacattggatgtctcagcttggcgagtttgtcccagtgttcccatagcacgtgcattaagccctattacaaaggaaaagcaagcttacttgtgtattatttaatttatgaacattctcaaagttggtgtcaaggtcagggtttgtctgtgatagtaaatatccatcaggtggatcagcctaacatatggcacatgaaacagtgtgtgtgtgtgtgtgtgtgtgtgtgtgtgtgtgtgtgtgctttgccaccaccacagagcacatatacggtaagtcctcagttaatgtctttgatgggttcttggaaactgtaacttgaaaaccactataatgaaaccagtttttcccataggctaattgatacgaacaggagttacattcccacagcgtatttctagtcacaaaaacatcaccaaacttctaaataaagaccacgcttcttatgttaaacatgaaataaatgtgagcgatacagacatttaggaacaattgataaaaataagatatttacctgtttattccagttaagggtcgtgggcggctggagcccatctgggcagctcaggatgtcaggtgggaactgccctggccaggacaccctcccatcgtagggagactcatactcacacccactcacactcacacactcactccgctcacccacactcactaggaccgtagagatgcaccagttcacctcacaggcacagctttgggatgtgggaggaacccagagttcccaggaaaaaccacatagatgtgaggagaacgtgcaaatgaaatgccgttatttgaggacctgctgtatacatgtaaatgtatatacattcatcgaggagcatggtgacttactttatgcttttgactctcctctgatctgaagacaagtcacataacttttctttggtcgcttgctccccctggaaaatgaaagtccttttatggatgtgtcagagaaggtgaaggaaagtatgtccagtcttcttgatctgtactcattgaagggagctgctttgcaggtctcgatttgcttccttcccccccccccccccgcccccgcccaggaggatctttttattctaagctttgattttcttaggctactgtagaattaaactgaaacaaaagagcaagacccagcacttggataaggggtcagaagtttgttgaatgatagaagcagcccgcctagagtttttaaacctagtactttaaaactgcaccaaggaagccatttataaagattgagctccctgcttctcagtggctctcatctctagctgcacttttgtgccatcggggagcttctaaaaaatactgaggcccaggccccatccctattcaactgaataaaaaattctagagcctgggtatagtagaacctggtatagtatcaagttcccctggtgagcctgcagcttaacggctagttctggagctggagctggcatatgttttctgtaaaaagcctggtagtaaatatttttggctttggtgccatatggtcttggttgcaactactcaactgcagcctcacacagaacaaaaatgaatgagtgtggctgtgtgccactatcactgtgtctacaaaaacagccagtgggcctgatttggcccttggctgcagtgcgcccgtctctgtttttgaggaataaaatcgcatcatttcatatggctaatgcaatttttttcccatctggaagcaacatctgattggactcatcttgtatggtgcttgttacagtctctgtaaatgggagagggtccgagaatagctcttcctgttttcatcaggactgtttttagggatggcaaagaagtcagtgtgtccagcctgtgtcctcctcagccacgtggctgattcctgaatctgcatgtgcagcacactgccgttgtctggggcatgatctgtgtgatggggccagccctgccttccatcctacttccttaggtcctcatgtcaaatcagagcctcctcacgaacactcagacctaatatgctaaagccagatgcactatggtccccttttgcttctttgaaacctgaataggaatcgggaaacatctcggtatttcctaacttttgcttcccagataccgcttcacgtcacctcattttgcatcttttctttgtttttgtttttctgcaatcatgacttcacccatgtaactaggattccaggtaattcttgatacctttggtcatcaaaatttggacacataaagaattatattttcctttccgtattctgaattagaatgctttagacttcttgaaaagttttgatgaatacctcttctgaaaaggtatctgtttaccactacagcaggttctctttaccactcatctgctgactcctggtctaaaccagtagggtgttaaagaggaatcacaaattaagtgcccttaagagttggatattgccttttctcccctctgtccccctctcctgccccacttaaacaaaacagaaataaacaagcaaagaaaaaatcagaccaaaactgagggagaaaacatttccaatctgaagccaccatttcttatctgaggactaaagtagagtctagctgatgtttagtattagagtgcggttgggatacaaattaaaatctaggaatatttatgtacgttcagcccatctgttgttttttctctttttttagataatggcccttgtttaggctctcggaaaccagaccaaccctatgaatggctttcatataaacaggtgagtttgtatgagacaggctctgtggactcctcttgcaagcaggggtgcttctgtatgtgcattcttggagccggaaggtttctccagagtgtatgtgctggaccagctcagagccttgccgtaagcatggggcatccaaggagaaacttgacacaaaggtttggggagaacaagttaaggaatttaacaggtggttcaaagcattgtatttcaaagctgatgtggatacattgtgaagtcaagtataatttttaagataaaattctagaaactctcccggtccccctggcggcatagcattatttctctccacttgaggggtactagaaaaactcagaagctggaacgtgggaatacatcttcatttcacagatgaggaggacctgtctcaggaaaagaggtgactcacccaaggttatagctggttagtggcagaaccaggaccagaagcaaggcctgcagcctcttgtgtaggctttcctagtgcatgctgctgaccctcaaagctgtccttggccaactcaccacctgtgtgacacttacccccaggcagctgtagggaggaacacagatgttcggggaaggcacttgtgttactgtataagcacaaaggaagctgggatctgagtatggtggcccttgtcggtctctagtccccacccatcaacggctacagctgttgaaacagcggctcatgagtggcagtagcagtgcaggaagacgttgctgtttatttttatttttatcatgattacaatgaatgtgggtgccacagctcttccccagtccacacggcaccccggaacaggcacgtgctccagacaggccagctctgctgcctgctgcttccacacagctgtccaggaaaggctcccgtccctggccccccttctcctgctctcggggcaggtaatcatgcggattcatgaatacaaatgcacttcctccttctgggttttgtgtgaagggcagcttaggagctggtgtatttggggtgcgtctgtggaagggatcgttctctgcagcctcggagccacactcctgcagtagtgcttgttggttcttctcagactgaagtgcatgatttctccccgtccgtcctctggggtcgacaggatgcagaaggctttgcttgagaggtgttcatctgtctctcaagagaaggggaagcaacttctcacacctcccctgtagaaggagctaggggcagtatctcacatgattggaaggatttcccatttttattctgtcctgtcagagccaaatagtagtttcttgcacaaatagtagtttccaggatccctcattttcacaagtgtaagaacagcctgtgtgtgttgaacatgtgtgtgttgtgtgtgatggtcctgaggcatcatggaatcctctgtgcctcctgggttacttctgttgtttagtggctggaagagagaagacacgtccattgcagataggcgttttcaaggcagattgaaaatcactggggtttctgaaggtgtgaatctatgacttgcacacttcatttggaagcaggtgaagatacaaaactgaagccaactttggatttgtacattcaaatctttttttttttttcagtcatccaatgaatatgaccttttggtggctaggaatgccttaaagggttgtttttttttttttaagaatgtatgaccgatctagaaatataaatgtgcgtgtattattcaatcatatttaccagctatatagcatccaattgcaggcttttctcaggctctgattccttaaatgcaaccaagacttttgaactcgtctgtgaaggagagagtagtaatgagcctgtttgtgtcatcctattgtcaccttaccacgatcagtctgttccccataggcagggccaggatggtgccaaggcccagaaccagtagggttccaggccaggagtaggtatggtcttatttcctacgggtatgggtgtgctttaagagtactcttgagaatttgcgaactgagaataaagaaaataactccaggccaggcacggtatggctcacgcctataatcccagcactttgggaggccgacgggggcagatcacctgaggtcaggagttcaagaccagcctggccaacatggcaaaaccctgtctttactgaaaaatacaaaaatcagctgagtgtggtggcaggtgcctgtaatcccagctattctggaggctgaggcagggagaatttcttgaacccgtgaggaggaagttgcagtgagccaagaccatgcccttgtactccagcttgggcaacagagtgagactatgtctcaaaaagaaaaaaaaagaaagaaacaaagaaaagaaaaaggaaaagaaaataactgcaaagtttaagattttttaaaaattttagtttatttggggtaggaacagggagaggataggataaccctgctgaattttgcaaacctatcaatttttacttagttattataatatgcatttttatatttacatgtgttgcttatcattgtaatattgtcctaagtttgatagttttcataattataatatttactatgtagcattttcttagtgatttaccatcatttacttaatcatccagccatgattaggttttttaccctagagatttttgatgcaataattttgaaatatttgcatattgtttatatgtaggcttttttttttttttttttttttttgagatggagtctcgcctgtcacccaggctggagtgcggtggggtgatctcagtgcactgcagactccgcctcctgggttcaagcaattctgcctcagcctcctgagtagctgggattacagtttcacgccaccatgcctggctaattttttattttcagtagagacggggttttaccatgttggccaggctggcctcgaactccctcaagtgatctgcctgcctcggcctcccaaagtgctgggattataggcgtgaaccaccgtgcctggcctgtatgtaggcttttaaaaacctcctcctgagtttgaattgtttcctaagaatacgttctcaagaatggaactgtagaacttaaggataagagcttgctcttattttttataggtctctcaaaagttgctgtttctgtgtttataccaaataaacaagttttggctgctttataaataaaacaaatccatctctctatcatttttaaaattgtataaaactaaaatagaaaaaaatgtataaatagccctgccatataattgtctgtgacctgcagccattgggataagattaattttctttgcagaaggaaccctgcggtcagttctcttaattctgatttcttgtgaataaaaccttgtgttttaccaaaaaatctatcaataaaggaatacctgcatgttccctctccgtttctgtgtgcagcattgcttgctggctgagatacaagcctgccgtctggtcagctttgtttctggagttggggcccaatgctgcttctgactttttcctctccattttaggttgcagaattgtcggagtgcataggctcagcactgatccagaagggcttcaagactgccccagatcagttcattggcatctttgctcaaaatagacctgaggtatgaaccagtaggtacttgctatgcatgattttgagaattctcagatataagagcctaacttctgctagagaccagattttgtagtctgatttctactaaaagtatagctttacgttacaccttagaaagttacacatatgaaaacctcaaccagggccgctgggcacagtggctcacgcctgtaatcccagcactttgtgaggccaaggcgggtgggtcaccagaggtcgggagttccagaccagcctgaccaacatggagaaaccccatctctactaaaaatacaaaattagccaggcctggtggcacacatctgtaatcccagctactcgggaggctgaggcaggagaatcgcttgaatccgggaggcagaggttgcggtgagccaagattgtgccattgcactccagcctgggcaacaagagcgaaactccgtctcaaaaaaaaaaaaaaagaaaggaaaacctgaaccagggccttttaatcgcctttaagagaaaaaagaaatcacttttttggggggattattttagtttttttaaaccaggttcccaaataaaatccttagaacagataactaacaaaggagtctttttactttaagagtcacctctgtggttagaaaaatggcattaataagttatagagagactcagatacatttttgtcaatagcaggttcctttttttcctttctgaaaggtatgaggctttccctctggttggtttctagagtttaaaataccatgggtgatggggacagtactcactgctagccagccttcctttgggcagtctgtcattggtggtctaagcccagcacggtttctgtaaaccagtgtgtaaaagtgtgttagtccattttcatgctgctgataaagacatacctgagactgggaacaaaaagaggtttaattggacttgcagtttcacatggctgggggggcctcagaatcatggcaggaggtgaaaggcacttcttacatggtggcggcaagagaaaatgcggaagaagcaaaagcagaaacccctgataaacccatcagatctcatgaaacttactatcacaaaaatagcatgggaaagaccagcccccatgattcaattacctcccccagggtccctcccacaacacgtgggaattctgggagatacaattcaagttgagatttgggtggggacacagccaaaacatatcagaaactgagtttaaatgagcagctcttttggaagtattgcttatggtatgactcaatagattagtagatctagctggcttagaaaaatggaagcatctggcttgaagaaatcgaatttattcttatacctgcttgtgtccagaagacatgctgactcaatccctgtgctactgacttttttttttttatataaataaagatggcttcttagagttttgtggtctttcaaggggaaaacagcattctccacagctggactgtgactgggcttgtagaatttagtttttttcatcccaaatgaacacatcaaaatgtttgttttgatggaattttatcatgaatctagaactgcaaaacaaataagaaataggttccttcctgtatttatgagttcattcaacaaatgtttgctgagcacccactatatgtcagacactgtgttggggtgccaaagcacagtgactcggcctctcttcctgaggtaccacgtaaggcaagacagacctaaacaccggtgctttctctgtcaagtggtaagtgtgggcgcagggcagaaggattatgggagctcagtcaaggagggctccctggaggtggcacctgagtagaatcttgaaggaaataggggcggggaggccaagggaatgcccacgttcacacctgtgtctgggagtggagcattttcatgtggtggagtggcaggaaagacagccttcctcatgcgtcacatgtgcctaaggagctgggacctgatttctatgttgttggctgaaaattccttctgggaaaaaaccgaaactcagaagcctagttccaggccaagtggatgtgagtgggttgtgcccccttcccccggctgtgcctttttctgtcctgtgtgtcagagttctgcagatgatttcattagaaaggtgcagccggaggcagtggggtacccctgggtatggtagtgaaagagtgatctttcacctttgtccagtaggtagggcagtggctatgtggccagtgccttcagacacatcttactgcatcttgcatgtggcagtgtggccagttattgtctcacttctttcctgcacttttctagagggattttatcaaaacagttttgctgctagacaaggtacttcttcccctattccagggcatacagtgccctgctgccagaggggtcttccttgagccccacagccgctgttttgctgagaaactctcagtggctgctccgtgctctccagccagaaccatctgtgccagtcagatcgctctcactacccctgcttttgatcctgccatcccctctgttagcatctccctgcctccctctgtctctgtctctctctctctctttctttctctttccaaaggcaatctcagttacaccctcccagtagcatctgtagctaccttggccgatggtgggctttcttatctctgggtcagtccctgtctgataattattgctaattatcttttaacatatttgcctcaattcttcaggcggattttaatttatctttctttctctctttctctcctttcctttccttccttttttcttttctttctcaatctctcctctttctctctctgtcctctcatctttctttctctctctctctttccttccttccctccctccctccctctctttgtacatgcatacatacatacatacaggatctcactctgtcacccaggctggagtgcactggtgtgatcacagctcactgcagcctcaacctcctgggttcaagcaatcctcccgcctcagcctctcaagtagctgcgacatggtgtgtgccaccatgtccagataacttttgtagaggcagggttttgccatgtttcccaggctggtcttgaactcctgggctcaactgattcccccaaccttggcctcccaaagtgctgggatcactggtgtgagtcagtgtgcctggccttaatttctttttaagaagggggcatgtgttttgttctcattctgaatcccttatagcacctggcacagagtagtagctaacacagatgttaattttgctgcgtcaaatgttttcactttgaatctctcttgagtattgttctccttattgattacatgatgacatcctgttttctctccctgacctttactgtttgtttagtgggtgattattgaacaaggatgctttgcttattcgatggtgatcgttccactttatgatacccttggaaatgaagccatcacgtacatagtcaacaaaggtacgtctgtgatctttgcctggattattggcatagttattggttaggttcagtgactttacatttgcttacatttgatttgacaaagattttacatgtaaatatatatctacctttttattcaaagaatgtagtacttcaagtatccttgtgctggatatgacagagtgaatcttttaacatcccagagcttattcttcattgtatctcttcatttacagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggtgagtgccctgcctccttcccttctctgaaggctttccctggggccgtgttggctcacacgtgctatccagtgctatctagtgctatggtgcagtcccagcgctggccggttgcctccgcaacccatgaaagagagcagaaacttctgtctcattgctggaaaaaggattctacatgtgtgcccagtgttaacacatcacaccttacccaagtgctttcagcactccaatatttattccagagcactgacaagctgtgcccggaaatgccagaaatgggaattacagcttcaggcaggtggaactttcagtttctgtgtctcctttgggctttaatgccttttacttactaatttgtctctaatgccaagccaagtatagaaatcagcctcatcgttcttttccctggatggctcgtggagagtcttggtgaatttccaacatgcatgtttgatttggtttgttttcatattgactcttaagagtcataccaatcacaagtttaaaggcagccattccaggagaatgagcgtggtggtccatgctcagcttgggtgcttgatgtcagatgatataagaagttgatccccgtcagttggacttggattagagttccatccaaggaacatggccggaggaagatcttttcatatacatatcataacaagtcataggaaaacagagtcagtccttctctttctgaaggtgttagaaatatttttctgaaactgttatagataggattttaaatttttatgtgtagttttcctcctcctacaaagaatttgaggctataagtaaggatctgtagaacctttcctgaggaacccagtaggcacagggaagcgcgggtgttctaacagaaccttctctcttgtgcatgtgtgcgcccctgcccaactctctctctcagtagcatcgaacgtgattccgcaagtgctgacccgggtgcttccttgttgaattggggttttatagcttcttacctagtgtttccccacttctgtttttttacttttaaccctcttttactataatgtaatctctttttcccttaccttcccacagatgcaagaatttttctggtgttttttgactgctgtatgataaagaagtaatgttgaaatttaaaaattatttagttgattgaagattataatataaagtttatattaaaatattaatttatagaagacattgttttacacttacctgtttaatatgatctgtacttagtttttaaaaatattctgagcaaaaggtgaagagatcgccccactgcactgcagcctgggtgacagagcgagactccatctcaaaaaataataataattgcagtatttttcctaagtgatactgtaagagagatgtaaggctgtgaaacttttgtggcaacagtgcactaatttggataatgtttgttcccaataaattaagagccaaattgtatgtaactggtgctttattttatttaacatcagtttttgaagaattgggcatctccagaagttatgtaagaatttttaatagacaaatagaaatctggagctaataaaggttattttgaaaaaaatgtacagaattattgctttagcttttggctgacctctaattggatatattagttcctgttcttaatcggtggtctgtcactacatcatttaaaatgtaattaagattgaaaacttaatgtatgctgggcagaaactcactaagccctgagcacacccatctaatttccacgtgaattgaacatgttcaatggcgtgttcaatggcatgttcattccatatcctcattcaagctgttccatttgaataggaaaagaatataaatagttcatttgttaaaattaatagatattaaagtggccaccaagactgccctaatgcagtaaaccgaaccccatcagtggtagtgactggaagcctgccgctgggaaatgctgtccccgcgcaatgcttctgtcattcttaaccttcaagtccattcaggaaggagtcttagagggtctgctgtggcctgttttataattgggggctcccaaatcctatctccactctacgaggggagatatttgagcagatatttgagcctctccaaaatgcctagcatttcaatcgagcagagattgatttttcttcttcccagattgcagatgtcagttgtgcagaatgtgggggtgaggtagtgctgtgctctgatttgaggaacctacggagtatctgcagtatctcgttatggttaagaacagggctttattaaaggccctaataagaagtggaagtggggaccagaaatgcatggtaaagattttggctgctgtttttttaatacatcctatttcaaagaccagtcctaataccgtttatgtagttttatgtaagagaagaggtaactggaaaatggcttctcagaacaatgaataaatattttggttctggttaattaaaactgccatagtttctttaattagaaaattatgctgttttcgagccaggtgtgaatgaaccccacagtaaagccagctttaagtgactcgatgtgaccttatcctttacagttagaaaacgtttccatttaagactttttttctcttctaattaaggacctgggaagagccaacagacggaagcccaaggtaagcacaccgtgtcagaccctgctctgtcctctttgtagttttcaatatctagcctggtaccttgtggcttatagttctcttttctgttctgatttataccagctttttttttttttaatctttagcctccagcacctgaagatcttgcagtaatttgtttcacaagtggaactacaggtgagttttgagatagaattgcttctacatatggcagccattggtctggactctcccctacctcttttggatgacttatcagctaacagtagacggaccaaaagcagaagagaaggaagtggttcaagtgctgtcttcttgttgctctgtaagatcttctcagagtccaagagtgccggataattcctcaaacatttattgagggtgatattagattcacctgtcttcctaggacagactatatcggtggctcccaggaagaaaatttctggtttttcttctcttatgactacgtatataccctttaaaatgtgcccatattaataaaggtttttaaagataagtcagtgtaaggattgcaggttgcttaggaatttagtgttcaacatttggttttcacgatatatctaacagtagaggtgtctgaagccctaattatgtgaggtttctgggcctccttcatttctgtcattctttaactttgttctgcttcatatgtgctccacaggcaaccccaaaggagcaatggtcactcaccgaaacatagtgagcgattgttcagcttttgtgaaagcaacagaggtaactttttgggatgtcgtcatctttcctcattgattgacattagtccttgagaatgaaagtgctgaaggtgggcaccagtgtgttaggtccatgtggcatttagaaacgatgtgacatatgggtaaggtcagaactttaggcccaagtccaccttctctcttttttcactttgaacctaatcgccaacccttgccttatgataattaaggtgaattgacagatgaagttcactgcaacatttatatagagaaactctatttggatattgccctagaaacatgtccaagaaaggacagagaagagatggactctcttgtgtttttatccagcgtccctgtatttgggaaataatttattttaaattggcaatgatatgttaaaagtttttgaatgattattatctgttgtggtcagtgtgacttccattgcactagaagtagtaaagccttgcacttcagctaatttcccatgcttttaaagtttactatccagtgtcttagtctatccagtcacagcagggccccatctacattgggagttaggatgttgacatacgaatttagaagggggtgatgtgattcagtccataacaccaacagcctattccaaacttgccttttaaaaaggtgcttattgaaccatatgccttttccttatactcttttttacatttaacataattggcttttgcagtctctttggaagtattctgtagctctgatttttgtagcaggagcctgagcttaatggctttggggaatggacatgtttggtggctgcagaaaactgatctttgagggatcttgccacttactttacttggctcacactttccaaatgccctttttaaagatgtatactttctaaacagagttcaacatttagtaccttaccaaagtgaaattttaatttcctaattggccttcaaacaaaacttaaaatgcattggtggctcattgaggcaaatgattacagaactttgtttaaagtcagttacaatatcaaatcaattacaatatcagtatcttctcagctttgtaagatgtctaatcatgataatggacaatatttttgttctgagtcagaaagttgaaaagtatagatagaatggagtccgatttctcattatattaatataacaatttcatcctgagaagtactacttgggatgcctgtcagacttgaataaaatccagctgagattatagcatgctcagcccacatccagtgcttctggggctgctgtgtttgctcaggattgatgctttcatccattgtcacattattattaagggtgacccagctttaggaaaggaaggggcatggctcagaacttggtatatcatcccctaggtaacgacaatgccctcatttcttagttggtatgacagcagctgctcttgcacaccccctgttttggccagaattctttatgttaataacatgaatattctatacaaaccctcactgtgcctgccctaagtaaggcccattctgagggaaaccagatgtccaaacttaatctgtctgtggacccatcatgatcagcattttataggagagcaaattcctgggtgccagatctgaggttgcattaaacaaattgtgatatgtaaagtagggctttaaggtattaaaaatattgatcaaactcaaaatactctaaggaccttggaaatccaccttcttttatcttctttcctcctttcccttaacaacataaaatgcaattttatgttgaaatgggtcctgtatttcttaaggtaaaattgaacttgctgggtactaggatactgtagtgatgaaatactaactgattagagcatataatcccttaaccttccaatttgagcaaaattttccttgttttgattaaagccctgaagtggatttactttgtcatggggagtgacttccactttgtttgaataattaaagtattgcttttttttttgattcagagtctcactctgttgcccaggctggagtgcagtggtgcaatctcggcttactgcagcctccgcctccctgattcaagcaattctgctgcctcagcctcctgagtagctggaattacaggcatgtgccaccatgtctggctaatttttgtatttttagtagggatggggttttaccatgttggccaggctggtcttgaactcctgacctcaagtgatctgcctgccttggcctcccaaagtgctgggattacaggcgtgagccaccatgccccttgtttttcattttattctttggtgagaagaaattgcagaccataagcaaaagccgtttctcctcagtgttgaggtactatgtgctcagaaataaaatggaagtttactcagagtcttttttttttaattttattattattatactttaagttttagggtgcatgtgcacaacgtgcaggtgtgttacatatgtgtacatgtgccatgctggtgtgctgcacccataaacttgtcatttagcattaggtatatctcctaatgctatccctcccccctccccctaccccacaaccgtccctggtgtgcgatgttccccttcactgggagtcttaatgcttttctgccttgctggtgtctttgcttacagaatacagtcaatccttgcccagatgatactttgatatctttcttgcctctcgcccatatgtttgagagagttgtagaggtaggcatttaattttgttttccttgcttgtttgtgtatgttctgctaagttgttgtgttttacagaaagcacttcccttgagtgccagtgacacacacatttcatatttaccacttgctcacatttatgaacagttattgaaggtaagtgtggcgtgcggactgtcatccctatagagaattctctgctcagccccgttttagaaatggtgcagattatttgaaagaatataaattctttttctgagtatgaacaggatactggaatttaatcactcattttaaaattaggagttcagacttttgaaggatactaatgtggacatgagtccagaaaaaccaactataaaggtaaagtcattattaattcagttctacaaagcccagcgaggcttccgttctgtgagaagtctctatttttgattgtgcttgttcctaatgcacaagttggcttgcgactaattttttcagcaatattctaagtgcccttggagaaagaggatgatccttgagttgacctttgcctaggctccctgtaatcaactgtgtgactaattttaaaactgaccaagaaccaccttttttccttctttgacaattttggattttatgctgtaggaaaaaacaatgagcaccattcattcatttagtgagtagttactgagctctagctgtgtgccctctgctgtgttggagacagaggtgactatcagccgatgctttggatgacagctgccctgtcggatttgctcatcccaaaggatcgaaggcgattagatcccatctgccatctgttccttctacttcctgcacacctcagagtcttctgggtttataaagcaatctcacatgagttgctgtacctaacgagttttagaggtgtgcctagaaggcaggccacgctgaacaaaagctttctgagctgtaattgttaaacagtgaaccatggtgtacctttctcgtggtttctgcttctaagacagagaacatttgtacttcccttgtgtcatcttttgaatcttttctttttaaattttaaaataggcaaactgtcaggtccatatggcttgccagcatggtttgtactagacaggaaaaaaatcatgcagtgtattctagctgaatggcaagccactctggtattagataccctggtgtcacaaattcatcatacttggtggcctttcagaaacttctagttagattcaaacaaaagaaagtgagactttaacaaacttggactctaggcaagaagttaagtttttattttgagaataaattaaatgtaaagtttctggaaggctatatatatatatatatatatatatttgagacagagtctccctccgtggcccaggctggagagcagtggcacaatctcagcccactgcaatctccgcctcctgggttcaagcgattctccagcctcagcctcctgagtcgctgggactatgggcacccgccaccaagcccggctaatttttgttttagtagagatggggtttcaccgtaacgtggccaggctcgactggaactcctgacctcaagtgatccacctgcctcggcctcccaaagtgctgggattataggtgtaagccaccgcgcccagccactaaaaatatttagaatatgtaataccatgtcattcattgaacagatacttaccaccgcactaaaagagtagaacctctgtggtcatcactaaaaacaacatagcctggttttttactgagtcccatatcttcaggataaccaagagaaataccacatttccatgttgtacaatgactagtaaatgcacattttttttaagttacctatatttaggaaatttaagatttctggaaactggcctgaaatgctaaaactgaaatgttggatgttgtccatatgttgtgtaacccctgctgtggtgataaaatgtttgttttttccattacccctatagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgagtaagttccaagcagcgaagtcccaggactgagcactgacttggacgcaggggcttgggcttgaattgggctgtgccatgtgccatctgtatgaccctggacaatcctcccaatcttacagaacttcagtttactcatctgtaaagttagaatgcgtttacctctcagagtggctgataaggattataagagaaaatgcatgaacacactttgtaaaccatggtcacaacacaagcataatgtgggaggtcattttatttttacaataaacactttgagcctctgcttcctcatgtgtaacacggactgtttacctcttctctcctactgtttgtctccaaaagttgctaatgggatcacgtaagaatagtaactatgaaatggttttcttcattgtaaagctccttgcatggacatgtaaaacattacttaattggccacactgaaagaagtgactaagccacagcagagcccaagagaacaccagcccctctgcggtgggtatcattgcgtggaccgcacagccagggccaggcgcgaggggcatgagcaatctccagaaagagtgttcacttactctttattttgaggcaggacttttgttatctctcagaacgttcttatgtttttaatggttctttttaaaaggacaactttatcaacatataatactctgtataatttgctgatttaaagtgtgtaattcaaaggttttgagtactttcacagttctccagccatcactacaatcaattttagaacattttcatgacctccaagagaaacccttacctattctttatcagctccccgaccccctccacccttcagcatccgctcatctgtgtatttctctattctggacttttctgtggatggaatcatgccatatgtgctcctttgtgactggcgtctttcacaagcatccatgtagcacgtattagcacttcattccttttaacggccaaatagtattccactgtatgggtataacgcattttatttatccattccttttttttttttttttttgagacagggtctctctctctgtcatccaggctagagtgcagtggtgttatcatggctcactgcagcctccacctccagggctcaagcagtcctcccaccttagcctcctgagtagctgggaccgcaggcatgtgccaccatgcccggctaatttctgtattttttgtagagatggggtcttaccatgttggccacactggactcaaactcctgagctcaggagatctgcccacctcagcctcccaaagtgctgggaatacaagcgtgggccaccgcacctggcctacacattcctactcgatgggcatttggggatgtatgtgtccattgctcctgggtgtataccgaggtgtggaattgctgtcctgtgctgaccatgtggggccgttagaggaccggccaggctgtcagagcagctgtgccattttgtgttccccagctgtgtgtgagggttctgatttctccacactctttgactctggccatcctagtaggtgtgaaaactttctcatgtcttgcctcattagattttcggacaagcaaacaccacgctgaagcgatggctcttggactttgcctccaagaggaaagaagcagagcttcgcagcggcatcatcagaaacaacagcctgtgggaccggctgatcttccacaaagtacaggtaacacgtgactcacagccactgctcccatggaaaccgacttcgcttttcagagttctgggagggccttttttgtgagagggagagatgaaggtaagggagagaataacatgtttttgttaattctggcacacatttaaaaactaaggcaaagccattaaggaggcctcagtttctaagatcaatagtattgcagccatctagggggaaaaggagtcagggtagtggagcctttctcattctccattttgttgcgtttttccggaacaagcgtgtcactcttgaggtaatttttcaagcatgagtgataacgtgtaacaatatcatgccccccagaaggccagaattgtggtagttgccacagatctgcccagttgtgttctaattccctgaaatagcttctgcagaggtggggctgacttccatccccattgggagggaacagggcagtcacgggtggaaacaaaccgtagccctgtgctgccatcatgagggctgtgagttctccgtgtggcctccgtgtggtctgcagctatgggttagggaacggggtcccaagcaggcccccttggcggagaggccgccgacttccaggtgtgtaaccctcaccttctcccactctccctccctgaaagtcgagcctgggcggaagagtccggctgatggtgacaggagccgccccggtgtctgccactgtgctgacgttcctcagagcagccctgggctgtcaggtgaggtggatgtcacggcgcctgattctcccacactaggatgcccagtcctcttctgcaccaaaagtcatctgtactgtgtgtgtgtgtgtgtgttctttcttaattgacaagcgtatctatatttatggcgtaacaacatgatgttttgatgtatgtaatatgtaaacattgtggaatggctaaatgaagctaattaacatgtgtcttaccacccatacttttttttcccacgtggtgagaacacttggaatctaccctctgggcagttttcaagtatatgatacattgttgttagctctagtcaccacgtggtgctatggagctcttgaaccagttcctcctgatggagactttgtgtcctttcaccaacatcacccctatccttcccaccccctactttgtgtgtgtgtgttatgtttgtttggaagatatgttattattaggttgcttggagaagcaaccatatgtatattttttaccctaggcaggggaatgtgtgtgtctgccatttgttgaattttctctaggatcaggtgcaagacaacctttagaagcaggtatgcagctgtggaatgggtcacaggtgatgagcctacccgcacaccatgctgacaacctgtagtaaagggagaaaggaggatttggtggcagacggggcatgtgtggggtacatgtcctgtgaattggccaagggagttcactgctgctgggtggtgaccagtcacataggggttctccctcgcttggccactggaagttaaatagaaggtgtacctgggtgacggctggtgttggcgtaaagcacactggaccattgaatgaacttactgaacagaccatttgaaatgagatttcaccagtcagccatgacttgggagttagtgagacttcattgcttgtgcacttccagtaaaggtgtgattgtgctctccttaataatgttgcatctcttggtgccccagttttatgaaggatacggacagacagagtgcactgccgggtgctgcctgaccatgcctggagactggaccgcaggtatggctgtaggaggctcctttttggaattttgttattcatactgggttattggtatgtctggaattgggttaatcactgactggttcattaaccatcttaaacaaaagtgctatgtttctgatcattaggctctgggggcaaacactcttgtaagtcagggcactgtggggagaacacctcctgcaactgaggggtggcgctggggatctgactgtaaagctggtggcagcagagacttgcctagactctactagtgacatctgagaggggccctgtgttccagattgagagtgtctggcccaacagagcttcctagtaattgagtagggtctcgttatttgctggtcattttaaacaacaaatagttattgaatttgtactgtgtgctgtgctaggtgttgggactaccaataggaataaatacaagtcctttttctcaaaaagtcatttctcaaaaggaaaaaggaggaggacaaacaaaaataattgagcatctgtcatgggtaagcctctgtgatgggtgcttaggatgtacctaatgtcagtgtaaccccaacagtgtccctgtgagataagttctggtacttctcagaggaaattatagattgttgcttaagtaacacataaatgatgtatgagaatttacgcggcattatgctttggagccaggatttcaaccccggcctgactgcagagcttctgtgcttcctctgtgtcacctgagtagtaaattctacactgtgataaataaacttcccagcttatttggagtattataagtattagcaccatttagtaacatatattctagaacctagcactgtccactaacatcattgtcctggaattaacgcagacagtctgtgaatcttctttatggtatttgtttaatttttaacctcagtttccttaacagagaatttggaatactgatctctagaagctcaaattattaaaacataggaagaattatttgtgatatctaatgtgatatctaacatatctaatgtctgttgttgctgcttttggaaaagacagcccagtcttaacagcctttggcaagagagttaagttagctgtagaaataagcactgtcccgtcttagtaaaaactgtaagacatgcttcttcatacgcaaggaaataaaggccgtgttgatcagaaccaggtggtgcgtgaggtttgccaaagctgcatatgttctctcttcttacagagaacaggatgctaagaattctgtgtaagatgagtgcaagtaatgggtgggggcgatcggagggtggaagccgagtgaaggtttgagagaggctgcttccaggtgtttgtaggaaccttcacatagaggccaaattactcataaataactcagagcatcacacttggaaaaggtcctgaagacactaaatatgttcttccctagtctaagaatagactctcttaaattatactaggaagagaatggctgtaattgcagaaatcagaagtttatcccagccgtttttcttatgtggaatcctgtttgctatcaaaataatttgacctgaggttatgagtagttcccttaggaatgaccatttgcttatttaatatacaggccatgttggggccccgatgccgtgcaatttgataaaacttgttgatgtggaagaaatgaattacatggctgccgagggcgagggcgaggtgagtgaaaaccgtcagtcattttccctcgctgccatttcctgtgatcgctggcctttgcgaatgctgtggtatttcccaacagctcaataaagccattgaacttgacttcattggtgatcctggagtctgccaggcttctttctgagggtacatttatgttcagctctcggggagtgggcaggagggacactgatgcctgtcttcctctgccaggcctcatagggatttgggctggagagcctgcaaagaaaggcccggtggcctcagttcctgggacgaaggtcctgcctgttgattgccctgggtacctattagtgagctgctggctgctggatgggaagcctaattacttaaaagtgatttcatcccctgcggggctttccaacagctttgagccagaacctagggcaagcatttgccctacaaatcggccagagctgaggtaattcaggaagggaagtaggggcactggagatccctcgcagaccctggtggggctctggtaactccctctgcatcctggagtttagggcttccagctaaaggttggggcagacacacacgtacacacatgcacacaccagttttctctggaaaaaccccagtaaatgctgttcactgatgatcttcttttctttaggtgtgtgtgaaagggccaaatgtatttcagggctacttgaaggacccagcgaaaacagcagaagctttggacaaagacggctggttacacacaggggacattggaaaatggttaccagtaagttgccgcctcctcaggtcacaaacagttcagttccactgtggggaagaaaatgtcttatctactgtgcagctgccatgtggcagtggcaccctgaattttctctttcccttcctccttggtgagtggtatgatgtagactgttccatttcctgcaggggacagggttacacttagcatccttggttggattttcactttcacttcagcgaatatgttttgttctgatgcttttttgtttctttgttgtgtttttggggttttttttttttgagacggaatcatgttcttgtcacccaggctggctggagtgcaatggcgtgatctcggctcactgcaacctccacctctcgggttcaagtgattctcctgcctcagcctcccaagtatctaggattacaggtgcccaccaccacacctggctgatttttatatttttagtagagacggggtttcaccatgttggccaggctggtctcaaactcctgacctcaggtgatccacccgcctcagcctcccaaagtgctgggattacaggcgtgagccaccaccgcgcctggcccgttttgatgcttaacatcaattctggttgttgcttctcaaccggaatacaaagagacagtggcttttttacaatatccgtactgagccgtgatgttgaggcctcagttaaataagatctgggggaagttgtggtagacttccagcaatgtaggatgggtaaggatttgggaataaatgtgtttcttaggtttgtcatctcattaaaaatagggtgtttcacagattaggcgaactccttgaatttagttgaatgtagtctcagaaccatttactgtagagaaattctgaagagtctatcttaagagtgagaagcttgtgcaagaagcctgacctgtcctacctgttggtttgaccagtaatctgctgtttcgaagttattatgatgctgattgcaagccctaaaattacaaatataatttttattactgtgtattggcagattcttgtagattttaggtgcttatttctttggaatttgtattgattagaaaaatacctcccaaaattacttcagattttgcaatacccaaactatttagagctaaattaagtccccctcttccggttcaagagagattaaatgtcagttccaattctactgtggcactcacgaacacatcccatagtctctctggaccttggtttgctccttttgaaaatggagaactggtgtggaacaaaagaaccctagacactttctacagatgacttttggaggcatgagagtggccccggggtggggatggggtaaaagtgggactagggttttgcttacggcactactgggatgtggctggtctggtccagagatgctagagcacttccacagttgactcactcttcccaaagggccaagagcacccctccagacatcgaggaagaaaacaggaatttggcctttgtgtaggaaacatttcttgaactcttactctgtgcagagcactttggaaggaaaagttgtgttcctgctattaaggaacttgagtcacttggtgagccagatgtgtatgcgcctaattcagacaggaggctaaatgagccagcaaagccttgctagtgttgaccagtcagtggtgccaagtggtgacgctgaataagcacgggctctaggaccccttctctgtctctgcacttggccaaatagccttggacaagttcctcagtctctctaagcctttgttttcctctctgtaaaatgggatcataactgacctctgtgggatgttattagaattaatcaatagtgtgtattaaatacctttcagtgttgtactgggatccatcctggttggaaaccagccatcagcccattcataaccccctcccctctgatcaacagaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggtatgtgctttctgggtcttgaatcttgctgcatagacattgccattgcctggtactccaggggctttaaatgtgattggaagtttgagacgcctatcacttggctttcatgtctaatctgctagaatatcattgacctgttactgatttttgttgcttggcatttcctgctcaggaaaatttgttctctttaatttccacatttttattttacttagagaggtctgatgtaccaaggggaggttggataaacatactgggggacaggggcatgggtaatatatgtttccaattatgaaagaaaatattgacatgggttataagaaagtttacaattttcaaacatattaaacccagcctattgatgatatgcttcctaatcatttttgagcaaacggtggttgtgaaccaagaatactcaaagttgaaaatcaaaatcagtattgcagtgaaacatgtatggtatttgccaaaatgttggacagatgatgccaaggaagagaggatctggtttcctgaaaattaaccttttggaaagttgggtcaaatggtatttctagttctagatccctgaggaatcgccacactgacttccacaatggttgaactagtttacagtcccaccaacagtgtaaaagcgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatcctctacccactttttgatggggttgtttttttcttgtaaatttgtttcagttcattgtagattctggatattagccctttgtcagatgagtaggttgcaaaaattttctcccgttctgtaggttgcctgttcgctctgatggtagtttcttttgctgtgcagaagctgtttagtttaattagatcccatttgtcaattttggcttttgttgccactgcttttgatgttttagacatttgacccagcaatcccattactgggtatatacccaagagatttataaatcatgctgctattaaagacacatgcacacgtatgtttattgcagcactattcacaatagcaaagacttggaaccaacccaaatatacaacaatgatagactggattaagaaaatgtgtcacatatacaccatggaatactatgcagccataaaaaatgatgagttcatgtcctttgcagggacatggatgaagctggaaaccatcattctcagcaaactatcacaaggacaaaaaacaaacactgcatgttgtcactcataggtgggaactgaacaatgagaacacatggacacaggaaggggaacatcacacacgagggcctgttgtggggtggggggagggagggagggatagcattaggagatatacctaatgttaaatgacgagttaacaggtgcagcacaccaacatggcactaacctgcacgttgtgcacatgtaccctaaaacttaaagtataatttaaaaaaaaaagaaaaagttgttagattttaaaattattttaggatattttcttataagagaatgcacttatttttctttgagattgcagctattttcgtttgatctagaatcttctcattcttttgatttttaattttattgttagtagattataaagaatgggatattagagatttttctttaaaaatgaacctatatacattttatttatttattttcttaaagatagggtctcactctgttgtccagctggagtgtaatggcagtcatagctcattacagcttcaaattgctgggttccaggggatcctcctacctcagcctcctgagtagctgggattacaggtgcaagccaccacacccagctgattttcaattttttggtagagatggagtctcactatattgcccagactggtctcgaactcctggcctcaagtgatccccattggcttcccaaagtgctaggattacaagcatgagacaggcttcctttttttccttttttttttaaaagcagttatctgatatccatcaccttgtttacttgaccctgcttttaaaaaaataagtatataaaagtaaatacgaattagagatttgttagattggtattcccagtggttttttaaaaacattaattgcaaaattcctgatgcttaccacattttagagccaggagttcttaatctgggctgagtgaactcctgggggaggggggtagtatgttctgaatagatgagccataactttcatcatattctcccagggggccacaagatggaaaaataaagaaccactattttagagcatttggatcaagctatgtaataactcatttgtctgtgttaaaggcatttctcattgcaattgtggtaccagatgttgagacattatgttcctgggcccaaaagagaggatttgaagggtcgtttgaggaactgtgcagaaataaggtaaggttctgaagggtccagtctgtcctcatcataacttggcattaaatgtacctgtagatattcagggacctctaacagaggaagtaatttatttttcttacccttttaggatgtcaaaaaagctatcctcgaagatatggtgagacttgggaaggattctggtctgaaaccatttgaacaggtatgaccttcatctgagtgggtgaattcctgtaaaacaaattttccattaagatttttttacaggtagattatataaacatatggggtgacctaaagacatacatgaggaataaataatggagtagtttgacaggggaaaggtttttaaatcaaaagcatttattctcttttcctggatatcagaatatgatcccgaatcctatcctaagaataggatgcctgtcctttgttgagaaggtgcagcttggctgaaatgagaggatggattggatggctggagagtgttgatcccctccaaggcttacgtgcttttgagactggtggcccgtgtcctttttcctcttttaactgccttgtttattggcaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaacagaacactgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgtttctctaatcaaggggttaggactttgctatctctgagatgtctgctacttgctgcaaattctgcagctgtctgctgctctaaagagtacagtgcactagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttcaggtgagtgaggcatcttttttaatgtcatgtttaatattcggaacagcctgtaatgtgcacaagcgaagagcaagaatggccctgggcctggaatccttcccagttgtcttcttttcttcttagtcaccctcctctaactcagctggcctcaggcactgacagacactgacccgagcctcccaccaggttgtctgtggcaaaagtcctaactggttgtggaaaagaaagtcatggtgtgaataacagagaaggtcctgaaaatgcagcttccttgctggaaaatgtatttcaggcgacgctggctgtaactggtgattccgtggtgaatgtaatcccactattgtattttagcactgtttagtcattctcttactgtagaattatttcagatgtctctttatagcagccaactttttcttgtttcttttcttctatctccaccctattccttctgttaccattttaaagattttcttttccacaggtattaatgaatcaaccccctaatttcttccaagcctgttgtgtttaaatctagtttcctgtcttaaattctgtttggtgtgatgatgtgtacatcaagccatgtgcagatgctatcttgtccattcttccacttttatttattaagatccttatcttagcagggggcagtggcgtgcacctgtagtcccagctacatgggaggctgaggcaggaggatcccttgagcccaggagttcgagtccagcctgccccttaaaagaattttttttgagacagagtttcactcttattgcccaggctggagtgcaatggcacgatctcggctccccgcaacctctgcctcccaagttcaagctcttctcctgcctcagcctcccaagtaattgcgattacaggcgcacgccaccatgcccagctaatttttgtatttttagtagagacagggtttcatcatattggtcaggctagtctcgaactcctgacctcaggtgatccgcccgcctcagcctcccaaagtgctgggattacaggcgtgagccactgcacccggcaggaattttttttaatgaagatccttctcatgtcttcagggcttaccttcctccccttctctcctgatgaagtgtgaggttcttaaggcctttcctttctcccctctcccttagcactgaacacagggcttagaaactaatagatattcattaaataaaccttttgaacaaatacttgaaattttgaacaaagctcctcttgcaatgaggttgataataaacactgggctcttttaaaatcatggtgaaattcacataaagttagcaccgtcaccatttttcagtgtacagttccgtggcattcaggacatccacactgctgtgctgtcatcactaccatccagctgcataagctcttcatcttgccaggcaaactctgtacccattaaacaacaaccccccgttctcccctcccgttaaactcctggcagccaccacttattctctgtttctattaaattgactaggtacctcatataagtggaatcatacagtgtttgtccttttgtgactggcttatttcactcagcataatgtccccaaggttcatccatgttgtagcatgtgtcagaaatttccttcctttgcaaggctgaataatattccattgtatgtatcagccacgttttgtttatccactcatccatcgataggcactcactcacactcttcttaccctctggctgttgtgaataatgctgcagtgaacactggtgtacaattctattggagtccctgctttcaattcttttgtgtatatgccctgaagtagaattgctgcatcatatggtaattctatgtttcatttttgtttgaggaaatgccatattgttcgccatatcaactatatcattttacatttccaccaaaaacgcacaagggttccaatttctccacatcatcactaacacttgttttctgttatgttcagaagtagccatcctaatgagtgtgaagtgtt

SEQ ID NO: 17348 - DNA, 51927 bp, Human; identical to SEQ ID NO: 17347

SEQ ID NO: 17349 - DNA, 156651 bp, Human
ggggatgttgaggttgatgataagaaggagaaggtggatttaaactatggaaaaaccatttaacattggacaggcctggtatccttcattaactaattcagtaaatatttattgagagatgaagcagggagggctcatggcatcccaggcacaatactactttattttcatgggttatttcattaaatccttgccacagcctttcagatatatgttattatcctcattttacaggagaggagatagaggctttagagagtttaagtaatttctccaaggtcatacagctattaaaaatggcagaggaggcctggtgctgtggctcatacctgtaatcccagcactttgggaggctgaggtgggcgcatcatctgaggtcaggagttcaagaccagcctgaccaacatggtgaaaccctgtctctactaaaaagacaaaaaattagctgggtatggtggcgggcgcctgtaatcccagctacccgggaggctgagacaggagaatcgcttgaacccgggaggcggaggttgcagtgagccgagattgtgccattgcactctagcctgggcaacgagtgaaattccatctcaaaaaaaaaaaaaaaagggcagaggaggctgttcctaaatccaaggcagagtctgagctctgacaccctgctccttccaaaatgaggggaggggccctgctgagggctcactgtggcgccatgtgcctgatcctcaaggtgagtctcagcaccaccccagctataggcgctgtgctctgctctcccagtggctcggcagcttggctacaccctgtggtagattctgctctctcatcaggtattcatgccgcttttataatgctcattgaagttataagcttaaaaatttgggaaaaatccttattttaacaacgctgagaggatatttctgtacaggtccattgtattttatggaactaatttttattcctttttcctttacatcttctcatattcaactttgatttatatagtcaacattttaaaaaaaatttgctttactgcttaaaaaactattgaggtctattttgaaatcctggtactgttgatagcattttattggcactaatttattttttagtatgtgaactttttattatgaaagcacacttcagttttaaaaatccagttggaaatacttattagggataggaaaacagctttacacatgaaatagtctgggtaataggaccatgtcagttttattaacttaaaattatgtgctttagtcagtcgttgatgttttaaaggaaacgtgttagattgtctccttatcttttccctctcttattttcacccttccttcccttttagtctgttatctcccttccaaatcagtatcagcaattatcttttaattaagttgaactggtgcttacattcctgttgtagatgtctattgtcaatcctttcctaaaaggacaaatatattatctctgctcggtaaatgggtgttgctgttcacttgtactgtactgctaaggaggaggggaaaattaaggtataaaatcagaagtctctttctagaggagttaggaacactagatattaaatgtgtctttaattaaacacaatcaagaaattaaaacaaaggttaaacattttgaaatctatacatcggggttctggtttaatatttcattcttaagtgacaaaaatgattcactgagccatattttttagggctagtgaaatagaaacagccaagggttgcatatctgtttattacagcctgtgacgtgattacccaggcttctcaaattatctagtatatttaattcagatgttcaagatttcttgtttgtattttattttgctaaattgaaaatcatcttgtagaaccatgctagttctaccttaaaaaagaaaacacccctctgctttaaagaaatggtacttcctgctttcataaacagtcatgtgcatagtttagcaaggcctgatgcctctggagctttttccctttatagcaccattgaatcccagtcctaacagaagtactgcgaatcttgtggcctcattctgaacaaaagggattagagaagaaaaatctcttgatataaggcttgaaagcaagggcaggcaatcttggttgtgaatattttctgatttttccagaaatcaagcagaagattgagctgctgatgtcagttaactctgagaagtcgtcctcttcagaaaggtacagctacatctcttgcatgaacaattaatggtgtagcattgctaagaaacaaaccaggacatatttttttttcttgtcaagtttgctatataacgtattgtcctgcatgctggtattgtgctgtattgaagatgtgtattggggcaagctgttctgcttttgcaaagggtgattgatttttttaagaaaaatagtggagcctgatcagctgcagcatgcacaccataacacagcagaccgctggttcatgtgtgacagctgttgaaggctttaaaaataatttagctaaaaagcagaaaagaaaaatcttgcttttttaaagggaaatgctgtgaggttttcttcctatatgttgaggttgctgctctacagaattacgaaggttatttgtaaaatgtaggttaaaaatacttgattttgggttgtaataaatatttattcttatatggtaagggagtgccatttgtaaatagcttaggaattgcaaacccacagattagtcacattctgtaagagagatatgatgcttcttcaagtctgtgctaggaaatggaacagtcactgcatgcagtaatggttcatgcctgcaggtaaggacaaaatgactcagaagtatttttaaagcaattattttatctgtcaatcatatgattatatctgaaaagagatatttcattaaaatgactgttttgccttataaaaagaattaagatatttttatctgaagtcagaaataaggctatagttgcctattttgatatgcaaatattgtatacagttctgtttaccaaaatagtgtatactacatgatgtcttaaattgagattcctgggcatacagttgatgcttacctttctcttggttacctaataggttatacttaatattgatattttatacttaaggtatatgttgatttatcttttctagggtttgcagggttatcttttttgttcatagatgtaatatttagaaaaataatggagaaataatgtggtagttaaggaatgatacagaaaaaatacaaaaaaaatgagttgaagaacctaccatggtaaaatggatttatttaaagtatgctagtatatgaaggacataatctgatgtaaaattatcattttaaattgatttattagtataatcaggggaaaaagcttatggctctaacttagggcatcacaaataaaaatgatgttactgcttttgttagagactgaaagtagaaaattttaggactgctagtgtttatttttgtgtggcttctaacttttggtttgtggctagccatctgatcttaagcattctgtttgctgagatgagaaacagtcttcagccttgtgaatattctgccagtaaaatggtggtgatgggaagggtagaagagggtggtgtgcatagtgaacgagctgggtatcagctgtaatgttagagtttggtactaggaagagcacacttaatgagatgacagtaataattacattagctttttggaatatcatgaattctttactgataaattgagggttggacagagtggatgaatattattgagaaacaaattaggagtggatgaggttttctggttaaaatacattctgtaaggaaagatattctaagatattttagtgattttatttatttacttacctacactctggtggttatttgaaggaaagggaggacgcatgtggtcatgattttaaagtttagaaatcagccactattgcttctgataacttcatgcacagttttaccagagattacttaatttatgtattattatttcatggccattatgctgtcctgacttaatggttgataaatgtagcttataaatcagacaacactttgcaaacatagaagttgtttcgttaatgtagatatattacaacaagaaggtactctcccttgcccctactttttattaaaagtcatatggtaatgaacagtcaaatcatttgtctttttaatttgtttggaggaacttgaaaaataagaatctgaagtttaaaaagaatttatggcttgtaacactatatcctgtccaggaatttaacaccttacaatatcatgtagcattatcattacattcttaaattccttgttcaccagtccagctacattttaagagtttttgctttcacttaaaaaaaaaataagttaatggtttgaggcatggtgctctaaatcttagagatatttggaatttgcatatagtcagtgttcccatctatctactggtagaaaggttgaagaaatctgacttctttctttagcaggggagaaactgcttgattgtaagcaaaccaaaagttatcattcaccacaactgattttgttcctgcagtatatagaattatcttttgataattcagaaaactgggtagagaaaagtacctctaaatacaaaatataaatacaaaaaccctgatgtgattatttctagtaatttttcatctcatttttatccttttaaaagaattgctagtcttgcaagagcttagtattggttgaattgtttttgttcaattttataaaatgggaaaagcaaaacaacctaatttatttttgtagaatcttaagagtccttcactgaaaaatatacatacgatttgaagtaaaattataatggaatttgaaggttgtttggggggctaaattgggaaatacgttatcctaatagatctcaataacaccttgaaatctaaaattatgtttttacctttaaaggaacagtggaagtctgaagagtgccattttgtaggggagttatggagtacttctgttctgaatggctgactcctaagatcaaaactatcagggttacaaaacgttagtttattttttggttttgtgttttgaagagagagaaaaaaactcagcataaccatttaaaaaattaagagcagagaatgctattgaatgaattttttaaaaaaaatgcctaatgatgaatgaaaaatgatgtatataatagttacgaggaagatatttgctgcaagacagtaccctctggagattttaggggtaaatcctactgcaggtattttccttttttttgagtgcctgttgaatgaatgaattcatcttgaatatagtagagtcggtgctagacacatttttactcccttgtttactcctgtttacagtaataaatgtgaatatctgattaaaaaaactaggttttcaagttctcgtttcttcattttgccctttcttagctagagcacttctgggatttatggggtaatgtgcgtgggggagagtagtagtagtaataaccataatagctaaaaaggtgtagtacagttgtcccttggtgtccaagggggattgattggttccatgaccccccatagatatcaaaatccacagatgctcaagtccttcatgtaaaatggtatagtatttgcacataacctgtgtacttcgtcccatatgttttaaaacatctctagattacttacaatacctaatacaatgaaaacactctgtaaatagttgttatattatagtttaaaaatttgtattattgttgtattttattttttattgttttatatcccaaatatttttgatctgtagtgggtcaaatctgtggatgtggagggctgactctaatcatttattaaacagtctagataccagttctgagtgctttttaggtgaagagaaagagagggaaggggtgtgtgtgttgtgtgtagaaggaatggttattgggagaactgtttaataaatcatcccagaagaatcctgtgtgaacagaaggtactttaccgtactatcatttttgtcaaactttattgctatttcttcagggaactcaggtaacaaaattgtacaattcttaatcagtaaagaaagttgagcccagagtggtcagagctgattcccagtctgcctaggtaaacccaaggagggctgaggagtttgtgagatgaggagatctgagaagctgagactgcattcacacatagcattgcccacatctgctgttcagtgtgagtggatgttgttttaattgataaagttcacaatgaactaaaaattaacaactcacaacagtgctatataggtttgcattttctcagggaacagatacggaaaggataatttctttttgcatgtttgtgggtttttgatgtattttagtgtttaaaagggagtctttatacttgtagctcaatagataagaactcctagcctagatccttaacatttcagttagctagccaatactgaattcacaaactgtagctgtcttgttcaggagaggagagaagcggagagggaaaaagtgtcatagtaatatttatgctgtggcctatattctaccaatgccgaataaaaaggattggtgagaattgatagagattgtgtgttgtcccttctccaatataagggtatttcaaatccataaggaacccaggctgtttttgtgtgtgtattttaattgttctcttcttattttggtgcctcgtatgcaaaggtgaaagtgatacatagcgatgtgtggatgcggagagcaaaaagctatacctggaaaaataaggagaaaggaagggaaaaaattcaaaagtgaggaaggtaccagatgaagagagaaagaagtaaagggcattcagtggaaaaggatcctggaccaagatgtctttgatttgctcttaagttgatatattttcttttatgatgtgtggtggactaagagcagttataggaggagaaccaaagggtctttcttcgttgttttccctttctccccccgttgcaatgcaaagactaggaaaaacatttgttgataactatttttcccttttccaactcctgctctgccactgttggctttctttctctccttgtagaggtgtacttgttccttaatgagatgacatagtggttgattgtgttgtcttctcatcactcaattctttatttaatttttgttagtattttcattgaagatacgtatatggaatagtacccagatcatagatctttatgaaatacagtttattgaaattttttttcagtgtttttgtttgtttgttttgtgtgtgtgtgtgttgtgcctaagaaatctttgccaagcctagggtcactaatattttctgctagattgacttttaggagttttaggatcttaacatttaagtctgtgattcatttggggttttagtattaaggtaaagattgagattcaattttttgcatatgacagttcagttgtatctgttttgaacattatataaatagaaaccctctggataagcttttggtctgttacctatgtgaggttacctatgtgaggttcatccatattgttgtgtgtagttgtaattaattaagtctcatatctgtacagtattcatgaatatacctcagtttattcattctattaatgagcatttgggaggcttacagtttgtggttattaggaatagtgctgctatgagcatttctttttcttttttttttttgaaatggagttttgctcttttgcccaggctggagtaaagtggagcgatctcagctcactgcaacctctgcctcccaggttcaagcaattttcctgcctcagcctccagagtagctgggattacaggcccgcgccaccacgcccggctaatttttgtatttttagtagacacggggttttgccttgttggccaggctggtctcaaactcctgacctcagtccacccacctcagcctcccaaagtgctaggattacaggtgtgagccaccttgcccagtctgccgtgagcatttccatacatgtcttttggttaatgaagcttgcatgcatttgtttaatatattcctaggagtgcagttgctgagttttagtgggtattgtcagttttccaaagtgaatgtaccactctatacttccaccaactgtgtatgctccaggttcttttcaatttggtattgtatatatttttttccttctcttacctttccctccatttctcccttcctttttccttgttagcattctggtggctctaccagtgttacccagagtttgcaccattttgaggaggattagaagtagaaactggactatttctgaacatgagcgttcctgagggggaacagaattagaagcatagaccagtaagtgaccctagggtgttgttgttggaggcactgctttcccactgattatagtcttgtaactgggtactagaggccgtgggtattaacattagttttcagacttggtttcagtagcaaaaccttctttcgtcaaaccttaataggaagttatcatgtaaaatatataaagaagatgcttggtttgggagctggggaatgtaaatcagagccgcagtttttgatgcttagccgtccgccttggagccacttcctcgagctccagtcctctttacttaaagcccttgaggtaggtaggccaccttaggtctgtccaagaaatcatgacattttgatagcttctgaagtgttaagttttaagctgttcctagtctctaaaatttatgtatcatatacctaaataaaagtgtagtgttagtttccaatgaaagactggacaatgttctgatcaggttttctgttggccattatttatttggtctagatgtagtagtttctacattattttgtaatcaattttgattctgtctgtttactgatgcttctctggagggttgcttacattacagccagagcaaacctttcagaacacaaatctgatcaggtaggtcattccacgtttaaaacctttcagctgtcttccccttgtgcttgggagttaggtaaactccatacctgggtcagtgagtacctcttttctctgtcctcatctccctctccagccttgtctcatgtatctcttcctttggtcatgtcctggctgttttgctgttcccatccttcctgtctcaaggaagctctgcctgtatcaaattacagtaccatgtacttctcctttgtagcatttgtcacagctgctgtttgacagtggggcgtatcagtgacatttggtctacttactggcttactcactgttaaccccaccttatgatcttatatatagaagtgctttcatcacaaaatgtcaacaaaacaaataatgttcatttgcattttacaaattatgagctttataggaagactttcttggtatggggagttatctctttctgtggtattggcatagattaataaataatcataagataattttgttacaaactgtcaaggttacaggtcttagatttttcttttttctttctttttttttttgagatggagtctcgagtcttgctctgtcgcccaggctggagtgcagtggcgcgatctcggctcactgcaagctccgcctcccaggttcacgccattctcctgcctcagcctcctgagtagctgggactacaggcgcccgccacaatgcctggctaattttttgtatttttagtagagacggggtttcacagtgtcagccaggatggtctcgatctcctgaccttgtgatccacccgcctcggcctcccaaagtgccgggattacaggcttgagccaccacacccggccagatttttctgtcaccataaaagcgcacagcttattgttacatttatttttcatttaatatacaatggaaattaaatttggacactttccatctctgtgccaaaatggcaacattaaagcatagtcatttacatcccaaatattagtattttgtgtatcaccttggtgttttttggtcacatttgcactccatactgttttttttttttttttttttaatttctagggtacatatgcacaatgtgcaggtttgttacataggtatacatgtgccatattggtttcctgcacccatcaactcgttatttacattaggtatttctgctaatgctgtccctcccccagtcccccaccccccaataggctccagtgtgtgatgttccccgccctgtgtccatgtgttctcattattaaactcccacctacgagtgagaacatgtggtgtttggttttctgtccttgtgatagtttgcttagaatgatggtttccagtttcatccatgtctctgcaaaggacatgaactcatccttttttatggctgcatagtattccatgatgtacatgtgccacattttcttaatccagtctatcattgatggacatttgggttggttccaagtctttgctattgtgaatagtgccacaataaacataggtgtgcatgtgtctttatagcagcatgatttatagtcctttgggtatgtacccagtaatgggattgctgggtcaaatggtatttctagttctagatccttgaggaattgccacactgtcttccacaatggttgaactaatttacactcccactaacagtgtaaaagccttcctatttctccacatcctctccagcacctgttgttacctgactttttaatgatcaccattctaactggtgtgagatggtatctcattgtggttttgatttgcatttctctgatgaccagtgatgatgagcattttttcatgtgtcttctggctgcataaatgtcttcttttgagaagtgtctgttcatatcctttgcccactttttgatggggttgtttttttcttgtaaattggtttaagttcttggtagattctggatattagccctttgtcagatgggtagattgtaaaaattttctcccattctgtaggttgccttttcactctgatgatagtttcttttgctgtgcagaagctctttagtttaattagatcccatttgtctattttgacttttgttgccattgcttttggtgttttagtcgtgaagtctttgcccatgcctgtgtcctgaatggtattgcctaggttttcttctagggtttttatggtgttaggtcctacatttaagtctttcatccatcttgagttaatttttgtatatggtgtagggaagggatccagtttcagctttctacatatggctagccagttttcccagcaccatttattaaatagggaatgctttccccattgcttgtttttgtcaggtttgtcaaagattagatggttgtagatgtgtggtggtatttctgaggcctctgttctgttccattggtctatatctcagttttggtaccagtaccatgctgttttggttactgtagccttgtagtatagtttgaagtcaggtagtgtgatgcctccagctttgttctttttgcttaggattttcttggcaatgcaggctcttttttggttccatatgaactttaaagtagtttttttcccaatactgtgaagaaagtcattggtagcttgatggggatggcattgaatctgtaaattaccttaggccgtgtggccattttcacgatattgattcttcctatccatgaatatggaatgttttttccatttgttggtgtcctcttttatttcattcagcagtgatttgtagtctccttgaagaggtccttcacatcccttgtaagttggattcctaggtattttattctctctgaagcaattgtgaatgggagttcactcatgatttggctctctgtttgttattggtgtataggaatgcttgtgatttttgcacattgattttgtatcctgagactttgctgaagttgcttatcagcttaaggagattttgggctgagatgatagggttttgtaaatatacaatcatgtcatctgcaaacagagacaatttgacttcctcttttcctaattgaataccctttatttccttttcctgcctgactgccctggccagaacttccaacactatgttgaataggagtggtgagagagggcatccctgtcttgtgccagttttcaaagggaatgcttccagtttttgtccattcagtatgatattggctgtgggtttgtcataaataactcctattactttgagataggttccatcaatacctagtttactgagcgtttttagcatgaagggctgttgaattttgttgaaggccttttctgcatctatcgagataatcatgtggtttttgttgttggttctgtttttatgtgatggattacgtttgttgatttgtgtatgttgaaccagccttgcatcccaggggtgaagccaagttgattgtggtggataagctttttgatgtgctgctggattcagtttgccagtattttactgaggattttcgcatcagtgttcatcgtggatattggcctaaaatactctttttttgttgtgtctctacgaggctttggtatcaggatgatgctggactgataaaacatagtcatttacatcccaaatattagtattttgtgtatcaccttggtgtttttttgtcacatttgcactccacactgtgctttttttctttctttttttttttttttttgagaccgagtttcgctcttgttacccaggttggagtgcaatggcatgatctcggctcactattacctctgcctcccgggttcaagcaattctcctgtctcagcctcccgagtagctgagattacaggtgcatgccaccacgcctggctgatttttgtatttttagtagagatggggcttcatcatattggtcaggctggtgtaggactctggacctcgtgatccgcctgcctcggcctcccgaagtgctgggattacaggcgtgatccaccgcacctggcctcatatcatgctttccttttttttttgtttttggagatggagtcttgctctgtcacccaggatggagtgcagtggcacgatctcggctcactgcaactgtctcctaggttcaagcaattatcctgcctccccctccagagtaggtgggactacaggcgcgtgccaccacgcctggctaactttttgtatttttagtagagacggggtttcactgtgttagggtggtctcagtctcctgacctcttgatctgcctgcctcggactcccaatgtgctgggtttacaggtgtgagccactgcacccggccattcttttttatttttaaatttcttaaaataaatgtaaaaccttttaatgctttttaaagcttaattttctttaaaaaggaatctttgtgtctccaccagcaatagagaacctgtattgtttgccttaaaaaaaaaaatgactgttaaaccctgtctagattctgttgtctgataaaggctccaagcctgagccatatgctctctgtgtttacaagggaagttaaatttgcaggtgtcataaagggacataaatatgtgttagcaccaaagtgagagttgttctcatacacccagacagattgaaagaacctcggaaaaggaataacttcctcagtatttgattcagtgtaattcaataccaggtttcaagtatcacctaagataattttgcatgtcagcagtggcacttcctcttctctttgggatcctcttctgctccagcaatgtagattatgatgaatttatcagggaggttctgaacaaatgtgagcagctattataataacaatagcaacaataaaaactctactttcaacagtcatagtgcagattccttttgtaacaatcttttatgtactggggctggaagaaattaagactaattttagtagattttatttgttatccatccacccagcatttttttcagcagctgctatgcactagccacttagtgatttggaaatcagggagccacaaagccagcacagaaatgtaggttttgtacagaatatcagtgtacaaaccttgcatggaagacacattcgtgggtggctggcccctggcataatttgttctgtttcttggacatgcagtgctaagtactctaatggacaacactacagtgagtagcttttggcactccttagaaagaattgcacataactaataattgcacttctgggaaacttactttaaaagatgagtggtatggtaaagaggttacaaacacagttgcttaccaagagtatgtccaatgagtggctacagccaggtggggagcacagaaactggagatgatgacaccatctagatgtgggtgctgatcggctctcttgctgattgctgccgtgtagaaataccgggcaagttttgcctgctcttgtgattttttttacgagttgaacatttggatttttatgtcaaatctcttcattttaaatgcttgtgtggctgagcacagtggctcattcctgtaatccaagtgctttgggagaccagagtgggaggattgcttgaggccaggagttcaaaaccaacccatgcaacataccaagacccccgtctctacaaaataatttaaaaataagttgggcatggtgatgtgtacctgtagtcccaacaattcaggaggctgcggtgagaggatctcttgagcctgggagtttgaggttacagtgagctgtgatcgcaccattgcactccagcctgggtgacagagtgagactctgtctctaaaaatacatacatacgtacgtacatacatacataatggtgcaagttagaaacaaaacagtaactcaaaacagccttaacaataagagtatctcctcttcagattcagcctatggtaaatatttttcttctgtgctatagcacattgattctcaatttgtgagccacagacttgtgcagacttattgtaggggatttttaaatactgtgattactaagcattagctgtagattgaaataatggaagtaaaattatcttgatgctcacaggtgtgtctctggatttttctgacatttgaggcatgccaaacactgcagatcactgctctaatagccatactaaaataacagtacaaaattcaataaggtattaactgtatgtaataggaagagccctgacagatgtgcatttttcttgttctcgctctctctctttttttttttttcaatttgagatggactcacactatcgcccaggctggagtgcaatcttgactcattgcaacctctgcctcccaggttcaagcaagtctcctgcctcaacctcctgagtagctgggattacaggtgcccaccagcacgtccagctaatttttgtatttttagtagagaaagggtttcaccatgttggccaggctggtcttgaactcctgacctcaggtgatctgcccgcctcagcctcccaaagtgctgggattacaggcaagagtcactgtgcctggcctagatgtgcgtttctcaacttggatatcattgatttgttctgtaaatatttatgtacccactatggtagaacttaagctttataaataatctgaaaatggtggaggtagaaaaatgttctgttttcaaaactgccacctcattattccccgcctttcccttttccttcttttccatctgtcttttcctcccttcacctaccctccccccaggaaatatattgagactagtttgataactacctataatgcagtagaaaaaagggggtcagagaaaatgcagatcacagtagaaggttatgatggaggatagtcagatgcacacgcagatacgggtatttgctgtgcaactagtaaaggtgactaacaaaattggctttaagcttcttgacagccatactaaggaaataattaacattgctcttttcatctgtaaggagaaacaatattagtttccccggtagaaccaaaccttttcctctaacttaattatcattttagcataactttttttctacatatcttaaatgcttatttattttagaaatttcagataaaatgatgataaggcactgagctgttaatcattaaagttcagtcaccatgattaattttttctggccaattttttgttttagtctaagatctataaaaagcagatgggccagatgcagtggctcatgcctgtaatcccagcactttgggaggccgaggcgggtggatcatctgaggtcaggagttcaagaccagcctggccaacatggtgaaaccccatctctactaaaaatacaaaaattagctgggtgtggtggtgtacacctgtaatcccagctcctcaggaggctgaggcaggagaattgtttgaacacagtaggcaaaggctacagcgagccaagaccacaccactgcactccagcctgggtgacggggcgagactctgtctcaaaacaacaacaacaataacaacaacaacaacaaaaaaaaaacaagcagatgtacttcaacgataacatcatcaccaaccgtacaatccagtatcatactgagaaatgattttcaaactggcattttatacttaacatatgcaaattttcttatgttattaaataatcatctgtagtatcatttataaaggttgcatagaactgagttcatgatatggatggatgtacataattttattgattgagtcttagaaatggaatcacttgtgaagccaatttgtaaggctctttataaaggagtgtttgtttttcagaaagatacatctttacgttgtcattggcagtgtataagagaaccttttaacttacaccctcacttgaaattctcaaaacagcctctttctgaatgtcgtatagatgacattgaagaatattccagatagtgttgacttactagtctctgttctttaggtctttactctagtaaaagttaagtattattgtggtactttctgtgttaattgggtgtgggtaagtcaaagatcagtacaatcagctgtaacgaggtaaaagattcatcaatagattcttatattcagtcaagcatttacgaaacagctaaatgagccattgatgttagcagttaagtgacatagtcactgagaaaatttgggtattctatttatgctaatgaatctaaattttgtaaggatttcaagaagttatgtgattcaagcctctcactctaaacaggtgacaaaacattcaacacagatggctggcttgtttttttttgtttgtttgtttttttttaaaataaagatgtacaggaattaagattctctaaccttaccttttcaaccatggcctcatgattggttgctcaatatattttcaatgacttaattttgttgcactacaataaaattactacttaattttgttccccttctaagacagttctaaaatgtaatcacctttttggtcaagaccttttcatttttctttctggaatttgaattacttttgtgggggacaggggcgtgctctctgtgtagtctcaggacggcttggatctagtctaaatagtattccaggaaacagcatctgagaaatcagggtgaaatgaaacattgtggcaccatcttgaaactctaaatacttgcataagcgggaaaagagatggaggagaggatgggaaaatagatgagaggggtatatagtgaccaggtggcaaagaaaggtctttgaattttatgctgatgtttaccaagagccattgaaaggttttagcaaggatgtttgtagataatacatgcacattttcctgtgggcatgaagtaaggtcttttaaagaaagtctaaagaaatatatttttccccctagcatggaaggctataagatatgctgtagactttgcagcaagatattattcatctgttctggaaattggtgggaatattatggcagcatttacaatgagtgacagagagtggatgaattccttgacactgggggtattaaacatcgaaatggagtaccatagttagaggtgcttctttctaaagacaggtgattgacctgttaaatcttacgtatttttttcctaggttttacgcagttaattatgattaaagaaatcctaacttaaagatactaacttgggtcgggcgcggtggctcacgcctgtaatcccaggactttgggaggctgaggcgggcagatcccctgaggtcaggagtttgagaccagcctggccaacatgatgaaaccttgtctctactaaaaatgcaagaattagccagacgtggggtgcgtgcctatagtcccactttctcgggaggctgaggcatgagaatttcttgaacctgggagacaggaggttgcagtgagctgagatcacactactgggctccagcctgggcaacagagggagactctgtctcaaaaaaaaaaaaagaaaaaaaaaagaaaagaaagatgataattggaatgtttcactaatcattttgttgcagaaattcttactcaatggatatataaagtatcatttctataaattgtttaaaatacttaggccagtgctgcctaagtggaatttctgggcagtctgtcttccactgatggaagatagtataatatcagtaaaacctatgagcattttaaatgtggctaatatgattgaaggattaaatttttaattttacctaattttaaaattcaaaaaccactcaactttttcttttcagatgagaacgccagtgaactgttattttaacctttctttttaaatttagaaatgaagattgtttcctttattgttctttagttcctaaatgaatattgcttccttttgccctttgtttcctaagctccaccctactctgtttttgtttttttaaaattcttttgccctttctatcctgacagtattatattttacaggcaagagtttatttccttcattgtaactcaaattagtaatttaaaggaaactgcactcagttatttgtccttgtataaagttattttgagcattttttattttaaggagctgcttaattttctgtcatcatttaaggagaaaaatattcagttatctgccatcatattacttgcctggtgttatatcctctttttaatgttctactaacataaaacagttttaaagtaaaaggagtgtagtttcttaaatgttcagttttaaagggaaagataaattaatatagacgaactctgtgttgtctgataaaagagataaaggtcagtagagaaattatggtttatgatggtagtcagctccttcttccccctcaagccacgacactgaatttagcctcagtttgttgttgccattcagtctagctagagcttacaaaaaatacaaaacccccaaatttggattcaaatttcaattcttgtacccatcaccagacacacccccacatggtgattactaatgattattaaaatactctttgggcccagtatgcaaaaaggacatctttttcctgggaccagcacaatctttagcctgtaggagaagcctctgtttaatgcagagctgtggaaggtttacaattaaatgatggtaggtgttattatattcatttattgaaaaggaagccttgtgggattaagcttagaggaaagaatttttgttgttgctgttcagcccagtctttttcataaaaaatgcttgtggcagggtacagtggctcacaccagtaatcccagcactttgggaggccaaggcaggagcgtagcttgaccccaggagttcaagaccagcctgggtaacatagtgagaccctgtctctaaaaaaagaaaagaaaaaagcttgcctcctttcttactgagtattcatcagttataatttgacagtctgtgtttgaataaatgaaagacttctctagaggaacccttgggtgcctgtgatataagaaacaccagatcttttacatgtgacctttgcctcagtttagggctgtcagttttttggggtgccttttgttgaaggaaaaggtgtattgatgtatttattgctatggcgttgtcctgttatagttacttcatttcaacatagatgtaagtatttatttcaaagtacacaaatgaagaaattgtgtttgggtgtaatgagttgtgcagtgtccatttcatcctcatttcattcctccactgccacgtacccctgagtagcttctgttgctgttgctgccctaatatcagccatgttcctagtggcagcttaggctctgcttggcagtacctctagctcctgaagaaaaacaaagttattatcccttgcctccccagagttgctagaaaagatttaacagctggtgaaaaaaatggagctgattatcatagtagttaagcggttcatctacttgtttaatggaattacaggttttatggggaccactaaaggttttccgattctttggaccagatattcatgatgaatttggagaagagcttttagatcagtacaagtcaagcattttccaaaaaatattcttccaatttaaatgtttttaaagtagatctactgaagttaactttttctaagaacaaggctccatttagttccttggtgtgatttggtacattttgtaatttcgaacttaaaaatccctattaggagtcagtggcctagtgttttgcatgcatgtaagggaaaacctgtatatctccaaatgtgaaattacagtgactgatgacatacttctgtaaatccaacacagccaacttttgtccagtgatgcaacacatcaggtttttgttttttttttcttgcattgtttgcatgtaagggcatgtggtacaaagtatgtttgtttgtttgtttgtttgtttgtttagacagagttttgctcccgttgcccaggctggagtgtaatggcaccatctcggctcactgcaacctcccctccgcctcctgggttcaagtgattctcctgcctcagcctcctgagtagctgggagggattacaggtgcctgccaccatgtctggctaattttttgtatttttagtagagtcagggtttcaccatgttggccaggctggtcttgactcctgaccttaggtgatccacctccctcggactcccatagggctgagattataggcgtgagccactgtgcctggccaaagtagccacgactttttaacagtagaataacgcttagctcagtgaaatggtcatgctttgagaggcacatgggcaacaagagctcatatgagaaaaatatttacatatcatatgtcatcctcattctaggtcatatgcgtaagaatagattattaggaggaatctccacatttgagaattactattttttttaactttagtatagttgaggttttggaagttaaaagttcatttatgaatgatgtagcattttaatattttttatttgctattcaaaagcatttaactattattgcttgattttgaccagacatatataggatgatgaatggaatgaaaaagcatgatagcaagaaaagaacatggaagtctgggtcatcttacacccttgttttatacattagatagaaaaactgatgcccaaaatggtgaattgatacaactcaggttctagatgggattcttataaactgataacttccagtatttgaaattcaggcatttagagtctgggaacttagtacaaaggaatttgaccagtttttttttttctgttctttaagaaaaccaagaatgattattttaaattatactagtactgttcttctagctgtgtcctagccagggaagaaataacttaaatgcctttcattttacagagcattttcctgttcactatttagttctttaaaaaaatccttgttgataagtaatgtagatggctttattctcactttgtagattaaaaaaaccagtaagtgtatgacttaagaatgtcacataccagttaatattagagatgctctaaaagctatgttttggagctccaaacccctatgcctcagagtataatatctgaacaacaaagatgtccattgtttatatgtacaaggtggcccgcatcaggctgcagatgtgtgaaacaggatgtgctcttcatgtcttttctccagtcacttccatttatatgcctcaagaaggctgagagacgaggtgtgatgtccttggtcatcaaatagaacagacacaactagcacacgtggacagaattgacagttttgttattttccaccctctcctagaccagcctggtttaacctttgaattttttttttttttttgagatggagcttcggtctgtcacccaggctggagtgcagtggcacgatctcggctcattgcaagctctgcctcccgggttcacgccgttctcctgcctcagcccaggcgcccaacaccacacccggctaatttttttttgtattttttagtagagacggggtttcaccgtgttagctaggatggtctcaatctcctgacctcgtgatctgcctgcctcgggcctcctaaagtgctgggattacaggcgtgagccatcgcgcccggactaacctttgaatttttagtttcaaatcttttttgtttgtttatttgttttttgttaagaggtagggtcttgctctgttaccaggctggagtgtagtggtatgatcatagctcactgcagcctcaaccctggagctcaaatgattctcccacaacagcctcccaagtagctgagactataggtgcacaccaccatgcctgactttttttttttttttttttttaaattttttgtaaagatggcatctcgctgtgttgctcagtctactctcagattcctggacttaaacaatcttgtttcctcatcctctgaaagtattggaattaagtacttgtgccaccacccctaatccagttcttttctatctgaagagaactgtgtgatttcttaggctaggatactggtgtttaaatataaatgtgattctgactttttaggactataaaatttgcttcctttaagtagtaccaaccttttccggagatgatttaaaagattgttaaggccgactgggcgcagtggctcacgcctgtaatcccagcagtttgggaggccgaggcgggcagatcacctgaggttggtagttcgagaccagcctgaccagcatggagaaacccctctctactaaaaatacagaattaatcgggtgtggtggtgcatgcctgtaatcccagctactcgagaggctgaggcaggagattcgcttgaacccgagaggtggaggttgcaccattgcactccagcctgggcaacaagagtgaaactctgtctcaaaaaaaaaaaaaaaagattgttaaggccaagcatgacagctcatgccctataatcccagtactttgggagtcacaaggcaagaggatcacttaagcccaggagttcaaaaccagcctgggcaacatagtgaggtaccatctctataaaaataaaaaactttttttaaaaaaaataggtggttaatacagtcaattaaaataccaagaattaaacttcttctttttagtgatgcattttgttaggtaccatttaattgtcatattttgttcagttaatagttaaaaactttgaacaattaaaaaccaagaaaaggtataacttctgtgtgtgtgtgtgtgtgtgtgtgtgtgtgtttatgtgtgtgtgtgttttttggtatgtatggcactccggtgttatttgtagttgtgtaggcattattggcactttgatcatcagtgatgtacttaaaggacatcgtcatttactcaccttctcttcccctcttcctcaccattaacgacctcacttcaagcacgctttcagttagtcctcataacaatattattaatcatctgtattttacagacgaaaaagtgaggctgtgagataacttacccaagccacagaaccgatcattttttgaattgtctcttttacaacacagagtttatgaggacttagttagtatatagagaaaaatggttaatagctggagaaaagaccttggagatgataaatgtaagaaagtttgttactatgtggccttgtgcagtcgttaaaaagcccatggaagcatggtttggatttctaggtcacatggtaccgcaagtaccagggccctcaagttttctctacagaagactgaatgtgaatgcccttaggaggcacaggcccactccagtagaactaggacccagcatttactgtctgaatcttagtgcttctcactcacctgcctggctcttggaagaatttgagctatgagctgttcacaaaaagggaaaagcttcctttattgggaaatgtcacttaagtggaatccatttctctctgacagttcagggaaagtgaaagattgctgtcactaactgctggcaacttactgaaattgttaaaatttatagttgattgtcttcagtactccaatacttcagtatttggcactgaaaaaaaatatatatgctttaatagaaaaggtttctgtctttgattagtgaagaagtagatagaagttgaacccaaagcagtacctctcagtttctttgttggttttatctaaatgttggcccttcctcagtgtcactgtcgtaggtctgttgctcttctcatctgcattctctttgaaaatgatcgcatctgtttccatggtgttaataccatttgtgggctggtgactaccacatttatatctgtagctctgtattctgagccacagatctatatgtccagctgtctactttacatcactacctaaatgtctgtcgacatctcaaatataactggccctaaaccaaactcattatcttgtctaatctttcctgaccgtaatgaaagatagatcatatggcctgtgcttcattcagttttctttcttgtaaaatgttgcagggtgagggggagggaataaatattccttttggtttatggctgtccttaggggctctggggtcggtgacagaaattactctgtgtgtaactttctgtctgtgtttaaatgaacatcataaatatctttgaaagaaagtagaaggcaacaagaaattttgtaaggtctatgtaagaatagaattaagttccctaatcttactctagcaaatagtaaggatttttgccgatgtaaccttccagcttttctttttgcagcagctgctagagccattatcctctctctgccaggcttcctactcatgctagttgttaattgccagggtctacaacagtggggcccacaggctttatcctgcctcgcggtgacctaacattttgtcactctgctatttaatttttaaaagtgtctccagctgggtgcgatgatgtgtgcctgtagttgtggctactctggcagctgaggtgggaggatcacttgagcccaggagttcaaggccatagtgcatgaagattgtgcctgtgaataaccaccgcactctagcctgggcaacagagagaacttgtctcttgaggggaaaaaaagtgttttctaaatgcagaagcccgagttactttatctcctcattttcccccgtagtctgtatctagttggtcactagatcctaccggtttctttgcaggagtcctctccaaatgcttccgtcaaaactcgctgtactgctttcatctgtcattcctcatttgccctcaaatattgttcactagcctctcttcctgttcctccgccctttgcatcatccccagaattatattcctaaaagagactcattaatatagcttaaaacaggtcgttcacagtctggtggtcctctttatctaaagtcctcactgatcctgccatttctggctcttttacccttcttatcttcataatgtgtacttccctctgcctggacctcactgagaagatgccatgtcccctgcacgctgcccttaccatcccactgcagagggtcctgctgcctcctagagcaccatctagacctttgtactgagactcagtgcttctcactccactagctcgagacgcaaggagctttaactgtctcatgttcacgtttctggtgcctagcacgttctttggcctatagacacaaattttatttgaataaagatttttatttctttcccacttggttaggaaatactaagaaaaagaggtgtgtgtgtgtgtgtgtgtgtgtgtgtgtgtgtgtttgttttgttttgtttttcctctcaagctgttctttatttcagggagagggcagggaagggggctcagtctttcttggcagcggctttcctcatggcggccaggacgttgctttgctcctcccgcttcctcttggcgcggatgtgcgcccacacccttttcttgatgaacttgaggacccgtttgtctttggagacctttcagtaactccttggcgtgctgcttgtacggggcgaagccacatgcctccgggatcatgtcccgcacaaacttggtgtgtttggtcagacgcccgcggcggcggctgtgcctgggctcgctcacgttcttggtcaccttttggcccttgttgaggcccacggccatagggtagcgcagagccagggctgctgctctccaaaggcggccctggcgcgctggggctggcgccgcgtggaactctgggatttttttattgttgttgagacggagtctcgttctgtcgcccaggcgggagtgcagtggcacgatcttagctcactgcaagctccgcctcccgggttcaagcgattctcccgcctcagcttcccgagtagctgggattacaggcgcgcgcctggtaccatgtgcagctaatttttgtatttttagtagacacagggtttcaccatgttggccaggctggtattgaattcctgacctcagatgatccaccagcctcggcctcccaaagtgctgggattacaggcgtgagccaccgcgcccggccctgtattttttaataggaaatattggacagtatctttttgttttactgccttctgaacagccttgcaaatgtttctttttatagcggttttaccccaacttctctgtgttctcatggactcagtggggtctccacctactacagtggttttggttggcctggaaaagcctcctgaccagcggacgggacttgggccctctacccctgccagctcttcagccctcgtggggcttctttatggcagctctttccttctagaagttcccactcaatgtttgaaatacccacaagttctgaaccttggaggcacactcatcttattaatggcagagttgggactccaactcagttaccttggctgtttctcttccattttattgatggcagcagccagaattcccgacaaaggtctctggattggactggtaaattttgttcattccacttctcacgtgtgaatttaggtaatctgctgagctgcagattcttattgtgttatggtttagagataataacatctttgtaactgaaattaaaatttttttttgtcttgctgcaaattcagtctattgtaattctcaagtttcttcacagccctaaatttaccgttcgttatttgagattgcttggcatgtggttttttttttttttttttttgagatggagtctctctctgttacccagactggagtgcaatggtgcggtcttggctcactgcagcctccacctcctgggttcaaggcatgcactaccacgcccggctaatttgtgtatttttagtagagagagggtttcaccatgtcggccagactagtcttgaactcctgacctcaggtgatctgtctgcattgtcctcccaaagtgttgggattacaaatgactttaggattttaattgtaatcttgccacctttgatcctatctcaggctcctcaactgtgaagtgtcatcatctagatttagagaattaagattagaatgtaggcggggtgcattggctcacatggaagtaatccctgcactttgggaggctgatggggaaggattgcttgaagccaggagtttaagacaagcctggggaacatagggattccccttatctacccagataataaaagaaaaaggagctgggatggtagcgggcctggagtcccagctactctggaggctgaggtgagaggatcacttgaggccaggagttggagtctacggtgagttagtgtaccccagcctgagtgacagagtgagaccgtgtctctaaaaaggaagaagaagaataaaaaacgattagaatgttaagatatccaggctttttgagccctggcctcaccttctaccagaattaataaaatacagaagtagatttatatttgaaatgctacttctgtggtaagctttaggcttttgtagctttccattcctcatgttcatttgatagctgcagtcaagccagaggtcactttaaggattggagatccggcttgcctcgagactcaatggtgaacatggttcattggctcttttggatcagtctgggccccctcttgaatgcagatgaggtaaaaataggtgattcatttcaggttggcaagaataaactctagattgtttttgtcacttgtttcagattagacatgtgtgcatgcacacctgcctctgagtaggtccttgtgtatattgcagaacctaataatgatcacttgctttacttactgtcgagttttatctgcctttgcttatacatttccagctgctttttatttatttatttatttattgagatggaacctcgcccttttgccagactggagtgcagtggggtgatcttggctcactgcaacctctgcctcccaggttcaagcaattctcctgcctcagcctcccgagtagctgggaatacaggtgtgcaccaccacccccggataacttttgaatttttagtagagatggggtttcaccatgttggcgaggctggccttgagctcttgacctcaagcattccagccgcctcagcctcccaaagttctgggattactggcatgagccactgcaccctgccaaattttcagctgctttctcacaagcaggcaaaggaagaggggatgtatgttagattaacttagagctctaaggttgaagggtcatttgatatcatattcattttatagatgaagtcacagacttagaaatgttgcctgccgtcaaccagctgataatgacataagatcaaaatgacaatgggaatatttaaatttttattttaaatatgtattgaatttgacctgatccttgggcttgttggagtaagattatcaggtagaatatggcagactgtaaaagtggccccaatgaccttttcttggtgggaacatttcctcctacttttcttcatcgtttatggtcatctataggtgtggtagggggagtagctgatagtaatgccaatctatgagaagatgtctggtcattttgctgggaggagaggtgatatggaacgtgtgaagggagaaagatgagagttgggctggtaatgaaatatcacgtctgactcgatcttcctgcacagaatcatggtttcctgtaaaggaatagattgttgcgtgatgatagatttgtagattgttagagctgaaagcagcaaaatatattggatagaatatatgggctttggagccagggaccagaagctaaattctggaaagttgcctaacctcattgtgctagttttccttatccttataataaagatgataatgctcacctcacatagggttgtgaggatttaaggggacagtcaatataaagtagatgctgaagaggggtggatggtatgagggacaacttgatttagaggaatgatcacatgctttggagtcaggcaggattttcatatgaacttggtcactgatgtttacctagggcaaataggtaaccttctccggagtccttctccggagtccagtttctctataatgcatacacattttgagctttaactgaaataatgtacataactgtttagcacaagttacctattcaataagtggtctaggagctggcggatgctttaaagaaggaacatctaaatttagctttacagtcctgttatatacctcaatatgtcaccatctaattttggcatcaaaattagagttccttagaaacaacatttaaaaagtttacatccttttcttaccatgcagcctcttttaaagctaatttattttattttctgacaccatttctgtgctttcacttaagagttcttacatctttttgctttcaatcccttccctccaattttgtaaaaatgatactggaacattctttaaaaaacaggcaaatgaagtcagaataataacaataaaacattgcaggctgtgaactggcatagtactgacaaaggttactttataaatatttagcagataggtatttcagtacatactggacgagtattttatttgtggaaattgaaggcccataataaattgagcatatttaatatgcaacataacagaaaaaaattgatggtaaaagttgccatttcaaagtgcaattctttctcatcacctgtagatcttcccatttttagagtcaagtgaggttcaaagtttggtgtcacttctccttgtactttctgaaactacaatctatggttaggctttaaaattaaaaaaacattttttttttccttttcttctcctcctccactgccccctaatttctgtccaggaagggtttatatgtagaaaacataataaatcacatgatttctatacctcttctatattcttaggactcagtttaaagaattgttttaatgtatgttcattccatacttcctccagatagaatgattatttcaccattgctccatgaaaggataaaaataagttttacttttgaccatgctatggtctgaatatgttcccctaaaattcatatattgaattcctaacccccaatgtgatggtattaggaggtgaggcttttgggagagacaattagatcaccaacacatagctctcatgagtgggatgagtatccttataaagaggactgagaaaggccccttgcatcttccaccatgaggacacagctggaaggccccacctgtgagctaggaaaccagccctcaccagaatcagtctgtcggcacattgatcttggacttccagccaccagaactgtgagaaataaatttctcttttttataagtcactcggtggtattttgttatagcaacctaaacagagtaagaccttttatgttgtgcccagtgtatttgatccagaggttattcttctgtaagtagaatttgatcagtggagatagggaatttcatcaggattcatctttaaaatagagtattttgagaaaagaggtaagaaaatagcctgtaggtaagtagtttctgagaaaggcaggaagccaaatctgacactgctgcgaagatcctagtttaacaggatcaatgttaagctcagagaattggctttcttattcttatcaaccatgtatcactgtatttgaatctagacttggattttccatactttagtggggtttctgttgttgctttatattgtggagtattatttttaagtcagactccgtctaaccagattttgttaattatggctccatttttttgctctcatcccagaacatcttgtcagctcctaggagtatgtttgaaacaatatattttgatgttcaggctgttaccctgcttccagcatttgtaagggctctgacccacttacaggaggagaaaacaaagatgtattattttggttgagaaggactagatgtaactgcctcagtgataccttgataatttaggaaaaatgtcctttgttctctctatatttttatttgagtgacctatgcaaagataaattgtaatgacatttttttctgacttaataggaaggaaggaatgctatctatactttgtgctttctgatgttaaattgtagcttttgtttgagaagtttttcataaaaattttaggtcgcttataacataggaaggtttattttattgttgccctttttaacaactgattaaattgtgctatataggaagaatttataattcattgcctcttctgatgaatgggactatttctagagtagggtttcctaatcaggaggctggactattcagatatgtagtgcaattgtacactctggtttgccagggatggctgtgatttatatgttttttggcttgcttattaggagaagtggaatgaagccccttcgttcttagaagtgtattggatgataactttacctggctgccccggcctaatgactccgtagaccacaagtttgcttactgccttcgtgctttgttctcttgtcaagttgtccattttggaagaaagcttagaagagtgtgctccaaagtggtcgtgggtatttcggtctaggtggtggggttataaatgatgttactttcttcattgtgttcatttctaatttcctactgaaaatgattttcttattaaaatcaaaacacagaacaaattttcagaaattatttaattttaataaaaatgaaataatgactgtgtaatggtgaagcttgtcattcaggcttctgggttccaaataatacaaactgactggctattttatttctagttacagtgattgaagtaggttgtgtaataaaagagtgggcaatgggagaggcagcagctgtgggcaaaccactggatcagccttgaggccatggtgctagatgtgtcttgccactgaagctgagtccttccagtgattttcccctgtagttttgccgcttgtgacctcgagacttctttggagagtcaccaccagtgggcatgttacaaactgagcctaggccgtgggcctctgccttggctgcctgggagtaaggacagactgtacctcctgaggctcctggagtgggaagcagtgctttatgctgactcctgtccagacttttctcagcatcttttctcacccaagggatgatgatgatgaggatgatgacgacgatgatgattttgttaccttgactattgatcagttaggactttgaggcaagtatcacctttcaggggccatctgccttgaagtgaaaatgattgttaattttgttgctagttgtttattcaagtgatgctgctttgctgttgtttaccctgcacgattcagcctttacttagaagcttttgtcatttgtctggttgggggagtatggaatagttattttgacagaggagctgatttagatatatgccttgcctttaactctaggttattttgctcatgagttgtgtcaaacttaataataatgtggcttttttagtgctctgtcagactctactgctgcttttattgcctgtttataaacatttaaatgttttcccctaaatcagtcttaagacttaaatgtttataatgcacctataaccaagcaggaaaaatagaaatatcttgagttaattgccctggatggtgcttccttacgttcttcatgtttggcttgtagctttaccacagcactcagatgtctcatgtctggttgtagaccctatccccattcggtctttgtgataactctgcttatctgtcaaggtattcaagttttaaagtatgtatcatggtcacagcaaaagctttgtgccctcttctaagtttgttttttcatttttctagttagaagttgaatttgagatttaagtagtatttagagttccttttagagatgaaaactatctgggctccagaataatgatcagtttagactgttcgctcctctgagctttgagttgttttaatgaggaaaatttgtttgatgaactagaatatctgcacattcttctcctaggaattagaacatgtcattgagccaagtaaaggtgtaatgtgcttttcagaatgtactgagaagattgcataatttagtgtatcttttattagtagacttgcagtggggagtaggaatatgcaggatgttatgacaaataataatggttagattttctattctgatttttcctttaatttttcaaaataaaaaatcatctggcagcctacagaatggtatttagaacatcacacctttccagacagggtttggtcagaagctaagtttgtgggcttttgagaggtgttgcatttgatgctgctgcagtatcttgggtttctagtcatctttcagaaagctggtcatgtatggcattctggcctctggccactctccaggcccagtgcctgtctttacacaaacttgacttcctagtatcaccaactataatttaaatccttaagctgatgtctgttgctttggagatgttatgtcacattctgcatctctcagcactgcatgaaacagtgttcccaaactagtcttttgattctatctctatatttgtggaggtggttcattgtgtcttttcatttatttagttttttaatgaaaatcttgagacactttttcttgattacttaaatttggcatttcacacctggtacccatggactcttctctttgctcctgttgttggttagggtacactggtatgctcttgtcttgtcttctctctggcaagtgaactacaggttgttataagtggtatcattgaggggaatggtgtttgttttgtgtgtcaaaaatttctgaatttctcatcttggacctgtcatttactaggcatgttatttcctgtattgtcctgaaacctatttcctcatctgtaaaacgggaataaaacctattttcccccttcacagtgccattatatcagaggtgataatactgtatgttagtgaatctgctgcctgtaagtgataatttacaccattattttatgcaccaccaagaaagaaaaatcactgctaattaaactatgatatactgttgatgggaagatgcactctgttatcagaaattgtgaaaaaatacatattagaataaatgaaatatgttatgtgaaaacactactgtccataatgctgtcagtgatattttaaaaaccacaaatcctataatgtcatttccctgtcctaaactcctgaaagataaaatcaaccttcgtatgatgaacagcgtctagcataatctagatcagagtgtggcatctgcagcacctgagtacttgttaggaaggcaccttctcagaccctaccccattcctatggaatcagaaacacagggatggaacccagcaactgtactgtaacaaggtcttgaggagactctgacatatacctaagtttgagaaccacagatcttattcaggcctatttcaagtttctttccttttgcttttcctctaatgtacctatagatgttagtatagaagtactgctagaatataaatgaattcccctttccccaagaaattatcccccggagaatagtgctgtgcaacatctctcatattagagggaactatctcaatgactttattttgaatagctaataattctttgtgatgacataaatggaaatggtttcaatcttttgttagttttaggtaatttagagttcactagtagaaatagttttttttttaaagatattttaacacctgttttgttaattatttctcatagtttcaaatgttgaatgtttctcatgccttttatagatcatatgaaaaagcaaaacaataagtgattgtgatatagagaggatatatttgtttgtgtataaaaccaaatggaaaagctaactgacatgaacgagaatgagtagttatttttgacttggggaacacttcctttggcaataccatacatatttaaaatgcatgcacatgcacacacacacacacacacaatcccagacaacgtagaagtgaaaatgctgcatttcagaaaactgactttagactaaagagatggctttactgatgagtacaatgatggtaaaggtgcatgtgataaagcatttgaaataaacttgctttgtgacaatgggaaatacagtctttccaaataatctataacatgaatttaaatacatatgtacttgaattaaacattaaatattataagcaaacatttgactattttatctctattcctacaagtttacaaaattttggtgggagccgttgccaaataatacttgtagtttccaaaaaattacattaccctgtctgcctcagatggtctcccacagaggtatctaatcttttggcttctctgggccacattggaagaagaagaattggcttgggccacacataagatacgctaacactaacgatagctgatgagcttaaaaaattgcagaaataactcatgttttaggaaagtttgtgaatttgtgttgggcctcattcaaagccgtcctgggctgcatgtggcctattggacaggcttggtctaacacctctttcttcttgtggaattcatgtgttctttgaaattctgttaccatcttctccatgtctgtgatgccctcttttcttacccacactgaacctttttttttcctgcttcatatagcatgtggtgaatcttatatcagcacacctatcttcattgctttggtgcttttctgcttgctgcttttcttcttctaatgtgtaagttattttaaggctgcctctccaacgcaatacatagctaagtgcttaagatcctgggctttgtagacagtctttgttttgaaggatggtttagttactatttagttatataccattgggtaagttacttaatgtttctcagtctctggacgttgataataattagtttgttggctgcattattttacgggttgaagtggcacatagtaagcatcagtatagcctattattaaattttgtcttcatggtatttagcacatcgtagagatccaggaaatatttcttaaatgagatagtagaagtttctctaatgatcttttggtagattgaaaagcaatagcaatccattgatgaaatattagtttacatttcaaaaatcttatttactggttaatatatttgcattgttttaaacagtatttaattctgtccctttgtttaaaacaaacaaaaaacacccacaaccgcattttccagtggcaactactagtataaatctttgtagtctttttctttttacataactgaaattactaaaataatcagtctcatttaccttattataactggtgcagcaaaggtgttcttaatgtgaatctgtttaaaacagggatctaaattttatgtaagtcataaaaaaatttaattgggccttattttaataataatagatactaattattaaaatgaaattagttttattttaatatttaacaaaatttatcactcttggatctgttagtttatagaatgaacaaagaattgacccaaatattgtttctcttgtaatagtttccaaaaaaatatgattttttacttattttatttttattttcatttttcattttttttgagacggagtcttgctgtgtcgccgaggctgctggagtgcattggctcactgcaatctctgagtcccaggttcaagcgattctcctgcttcagtctcctgagtagctaggattacaggtgcacaccaccatgcctggctaattttttttctttgcatttttagtagagacgggatttcatcatttggccaggctggttttgaactcctgaccttaagtgatccaccggctttggcctaccaaagtgctggggataacaggtgtgagccactgcgcccagcccgtattttatttttacaggaattataaaggaactattttgtaaaagtagttgagagcttcacctcttttccactgatctctaattctctcatatgcaagttctccattaaagagcctgtcagtccattatctttgttgatattgtcttctacagttgttagttggtctgctgggttcttgtttgccagtacccttggctgttactaaggtcaacaaggcttttattgctaccatgaagtcttgcatattttgtaaggttttcaggtttattgaattgtatctgcattctcttgtcaactgcttagtttcagatgcgattaggtgttttcagggtggcgtgactatagacagccactcagtttctatcaaagactattaattgacctgtgccttcattaaactccttccttccctttccccttccttccttccttccttccttccttccttccttccttccttccttccttctttccttcctttccttccttccttccttgctccctccctctctccctctcttctctcttctcttttcctttctttccctccctcctttcctttgcctaggctggagtgcagtggcgttatctcagctcaccacaacctccgcctcccaggttcagtgatcaagtgattctcctgcctcaggctcctgaatagctgggattacaggcacccgccaccacacccacctaatttttgtatttttagtagagacgaggtttcaccatgttggccaggatggtctcgatctcttgacctcgtaatccacctgcctcagcctcccaaagtgctgggattacaggcgtgagccgctgagcctggttatcttttttttattattattattgttgttttttttaatggggagagatatttgaaaagggtctgattttattaatggttatttcacatgtgaatatttctgttactgttttttttgttttgttttgcagccttttcactttagagacttagattacaagtgtttgaataatgataatatcctaagtacaaatttttattgccgtttttgttttacttttgtacttaaaaactctttgcaaacttgatcttttttttttttttttttttttttagataaggtttcgctcttgttgcccaggctggagtgcaatggcgcgatctcggctcaccgcaacctttgcctcccgtgttcaagcgattctcctgtctcagcctcccgagtagctgagattacaggcatgtgccaccatgcctggctaattttgtatttttagtagagacggatttctccatgttggtgaggctggtctcgaactcctgacttcaggtgatctgtccgcctcccaaagtgccgggcttacagacgtgagccaccgcgcccggcctgcaaacttgatcttaaaaataaattttagtctgggtgtggtggctcatgccttgaattcttaaagcaggcagattatataggcaagaggattgcttaagcccaggagttcgagaccagtctaggcaacatagcaagacccatctctacaaaaggtaaaatttcctgggtgtgttggcaagtgcctatggttccagctactcaagaggctgaggtgggaggattgctagagcccaggagttcaaggttacagtgagttatgatcacaccactagactccagactaggtgacagagtgagaccctgttaccaaaagagtaaatggacaatctacagaatgggagaaaatatttgcaaatgatgtatctgaccaaagtttagtatccagcatctataaagaacttaaacaaatttgtaagagaaaaacaataccattaaaaagtgggcaaaggacatagacacttttcaaaagaagacatacatggggccaataagcatatgaaaaaaagttcagtatctcagatcattagagaaatgtaaatcaaaaccacagtgaagtattatctcacatcaattataatgactatggttaaaaagccaaaaaataacagatgctggcgagattgcggagaaaagggaacatttatacactgttggtgggagcataaatttgttcaaccactgtggaaagcagtatggtgatccctcaaagagctaaaaacagaactaccattcgactcagcaatcttattactgggtgtgtacctagaggaatataagtcattctaccatgaagacgcattcatgtggatgttcagtgcagcactgttcacaatagcaaagacatggaatcaatgtaaatgccgatcagtgaccgactggataaagaaaatgtaacactatgcagccataaaaaagaagagataatgtattttgtgggaacatggatagacctggaggctattacccttaggaaaagaatgcaggagcagaaaaccaaataccacatgttcttatttataagggggcgctgagtgataagaactcatcaaatcagcacaaagaaggaaacagacactggggtctacttggcgagggagggtgaaaatagggagaggggcagacgaattaactattggtactaggcttactacaataatctgtacaacaaaccttagtgacacaagcttacctatatgacaaacatgcacatgtacccctgaacctaaaagttaaaataaaaaacacattttgcttgtaataaattcaagaatattgcatttatagtattaacaatatgttggctgtcataaacaatgatttttgataatagttgtatacttttttttaactgaaaaatggttggtttattttccagaaataaattcctaagatagaatcacaacatatgacagagatcatattcattcctaagacaagaatcaacaagatttttcatgcatattgcccagctattttaacagttgacgtttgtcaacatgtgagtgtccatttcagcattcctttatctgtgtatatgattgtctttaaaaaccgggacaaatgtgagtggtgaagcaagggcacctcgttggtatacatgtcctttataggaaaagaaatctggtctctgggtaaatctttttaccttcctgtctttatttcttcatcatgcttaagtgtgctggagtaatctttctaaagcacatggatggttttgccatctccctattctctatctactgcttacttgcttttttgccagtgtgagagcctggtggttatggtctccagtgtcggtgtccaccacctttgcagctacattcattatattggacgtatgccctgctgctgcccagctggtggaatgcagctgtttgtccgccctttgttcttgttactgctccctctacctgaaatgttccagcctccatctctgtcaaagtcttccacaccttccatatccatcttaggtatcattctcatttgtacctttctgttttattaaaggactctgtggttttgggccctcttatcctcaggcattcttgctttgctcaggatgagcattacagtgttcagctgacagaccttggtaattcctgccttagcattttaaggatagaagaggcactgattctccttttacaaaatgtcttccccactgctggctaaaatctacctatatgtcagatccagttcagtcccacgtcttcttgaaaccttccggtgtgattaagtcctcctcatttccatcaaaaccacttagtacttaaaataaaaactgtcgtgcagtttttgccttgattcctggactagatccctgggacagcgactcagcttcgctgttgattttatcccacccccattcccccccacccactgcctctggctgaacacagcagtgcaagttcttacttgaaagaatattgagatctttttgctctgtatatgattgtttgatatttctcagctcttaacctcagttctctgaggaatagtctaaccaagacttattcctactctatgatagtcctgtaacctgactctagaattttattcctgcgctcccccttcatctgttgtgggcactgcggaaggagagggagagatacctcctccatagctaagatcaaagctacgtatttgatataataaaaatgacatatttagatgtctggattttttatgttagcacaaaaaggatggccttttttttttgagacggagtcttgctctgtcgcccaggctggagtgcagtggcgcaatctcggctcactgcaagctccgcctcccgggttcacgccattcttctgcctcagcctcctgagtagctgggactacaggcgcccgccgctatgcccggctaatttttttgtatttttattagagatggggtttcaccgtgttagcaaggatggtctcgatctcctgacctcgtgatctgcccgcgacggcctcccaaagtgctggtattacgggcgtgagccaccttgctcggccaaaggatggtcgttttaaagcaacaagtgtaccttcaaaattttgggtggttttatgtgctttgtctgttgagttgaactcactgcagttccctgaactcggtgctggctctcttgggccagcctttttaaaacagctagctgttggtgtttgtaccattttcattccagcttcaatttcacagtgaaaaagtagcagagagaccactactattgtgagcagtagttatgatgcagggcttttctcggcctcttcactggacttgtaacaggggcgccctgtttactcagcctgccattctccagcgcttgcaggagggagcatgtgagcgagcgagtgcgggatccggctggctgctccaggcgccaacacgggaacaagctctcgcagcgcccaggtgagggtgcctgggactctgaagccccagagtgagtgttacggtattctcttagttctgctgtctgcagacagcagtgtgttagcagctcatcttgccgcttgtggcgctgcctaggtgagggtgcccgtgaccccgaggcctgagagagggtgttacactgctctcttagttccgctgtctgcggacggtggtgtgttagcagctcagatggccccttgcaggcgtgagccactgcgcccgtctccaaaaactttttttaaaggtgttgacataatctttctacattcttacattaggcccattaggatacatctaaagaactttttatttcatctttcaagtttgtgttagtatccagaaattggaatttcagcaatttctctttaaaacaacatcttttatgaaatgtaatttcagaaagttgagttgatgtgctttctttataaagcttccaatggaaattttctaaacagtatttgaaggatctaaattcagccactgtactattctagtgacagcccattaatttcccaggtatactgagatttttccagtctttgtataactttttttcatatgaaattaggagattgggctgggtgccatggcccacatctctaatcccagcactttgggaggctgagcccaagagatggaggttgcagtgagccaagattgcatcactgcaatccagtctgggcaacagagtgagacctcgtctcagaaaaaaagaaattaggatattggttttcaccatttatatttgttattaaaatcttccttttctaaatagtaggctagaaatagtaaagtaataaaaattggattactgatccattatttggagtcttatcgttgttagttacttttttttttttttttttttttgctgaatgatactctgttttgtggatacactacatttggtttatctgttcatcagttgataaacatttggattgtttttactttttggatgttctgaatattgtgactgaacattcatgtacatgtttttgagtgaatatatgtttttatatctactggataaatacctagaagtgagattgctgggtcgtatgataacttatatgtttgaaattttgtagaactgccagaatgttttacaaaacagcagagtcgttttacattcctacctgcagtgtaagagatttttaatttcccaggatcctcaccaacacttgttagcatccttttacttgtagttatcctactggacatgaagtggtatttcattgtagtttggatttgcatttctctgatggctaatgatgttgagccatcttgtcatgtgctttttggctacttgtatgtcttttttggaggaacatctattcagatcctttgcttttttaaattgtgtcttttcacaaagacataagaatgatgcaacggactttggggacttaggggaagagtggaaagggggcaagggataaaagataacatatatggtgcaacatatactgcttgggtgatggatgcattaggatctcacagatcaccactaacgaacttactcatgtaaccatatactacctgtaccccaataacttatggaaaaagttttttaaaaattgtgtcttttgtctttttttattactgagttaagagttctttgctttgttacttggtttgagaattaacttttagggagagaaggaccaagcagtgttttatggtccccattctctctgctaaaatgtttccagtaatctggtgacacacaagcgctagagggtgccagcaatgagaaacgatttgctgctgagcagatgacagaaatcactgctcgctctctctttatttggaatttttggagacagagtcttgctctgtcacccaggctggagtgcagttgtgtgatctcggcttacagcaacctctgcctccgaggttcaagcctggctaatttttctatttttagtagagatggggtttctccatattggccatggctggtctttaaccctggcctcaagtgatccacccaccttggcctcccaggattacaggtatgagccatcgtgcctggccagagatctacactgtcttatccttaagtctgaaagtatattcttttgttttaatcctgcacttgaaaaaaggccttcttttaaaggggaggtctttggtatgcgtggcttggatatcttcttaaaacatgaattttggcccggcatggtggctcatacctttccagcactttgggaagctgaggtgggcagatcacctgaggtcaggagttctaagaccagcctggccaacgtggtgaaaccccaactctactaaaaatactaaagttagccaggtatggtggcgcgcacctgtaatcccagctactcgagaggctgaggcaggagaattcacttgaaccctggaggtggaggttttggtgagctgaatttgtgccactgcactccaacctaggtgatagagtgagtgagactctgttaaaaaaaaaattatttctttcttgagcacatatatagtgcgttttttaaaaaaaaaaatcaagcaaaatatatcttccattttgtttattgggaagaatatgatcactaaatgtttcatagacaaatattattttatgtttcttttattgaaaaaatagatctaatattttgacatgattattaatatattttggaagtctttaggttcctagacttaacagaacttcttacttggtagtaacaagctacattttaaagataattttattagcacagtttacagcttttaaactctaagcagcattgttcagtagaactttctgtgatttttctgtccagtctgctaacccccgcatgtggctgttgagcagttgaaatgtggctagtaagactgatgtgctgaatctttgtttgcttatttttactttaaatagccacatgtgtctggctaccttataggacagcagaagtctagaaccccaataacccacttttactttttttttttaagtgtaagtttagttgtaagacatttataaggaaaagcacaagatattttgggaaaaaaattactgaatttatttactattttctctacagtcttaagaatgcttgttttttagaaacagcctattaaactttataaatacaattaaaattgtatctctgtgtctgtaattgcaatgtgaaaaatgactaggtagattttcaccaaatttagaaggttttggatgatctgactaaaaatataggatatgtgtcatacttaaaagtggttttgttgggagtatggtggccatcctctgttggagaggctggctaatgatttgggagctctgccatacttcattcaggacatggagggagaaactactggtttcatgtatgagtcataaataggaagttactaaggcagacgatctgctggttggcagctcactgcagcttgctctagcgttaagaaccataatgattctcccaatacatattgaaagaggatagttgctagccttaaataaaatagatcttaagaagctacagcctttataggcagaaaagcaagtcagattttattgacagtggtgttttgttttttgtttttgtttgtttgtttgtttgtttgttttaaagagagagatgggggtctctaaaaaaagcctaggctagactcaagtgatctaaacctcctgggctcaagtgatcctcccacctcagccttccaagtagctgtgactgcagtcatgtgccactgcgcctggcttacagttttttgatggtggcagtcttctaggtaaatttaactattattaacctgattaatgaaagctcagtaaggaaagggaagttttcgatttaatattttaacgtcttttttatgttttagctcgtgtgttttaagattggggctttttatcatgagaagtttaacttcagcaaacaaattcattttggggtcaaggggaatgttttgttcactttgaatactaactgaatgtactaaattcatgaaagaaaataggaatgaatttcatgatgtattttaactgacagtttggagtttaatttagaattctaagtgttttaaaatggaagatgaggggaaactgaaacttgagccaacattaaccaaatgataaataagagatgtatttactggataattaaaatatcttaaagttattattattattatttttagacagagttttgctcttgttgcccaggctggagtgcagtcgtgggatctcagctcattgccacctccacctcctgagttcaagtgattctcctgcctcagcctcccaagtagctgggattactggcgtgcaccaccattcctggataattttgtatttttagtagagacggagtttcaccatgttagccaggctagtcttgaactcctgacctcaggtgatctgcccgcctcagcctcccaaagtcctaggatgacaggtgtgagccactgcacccaccttaaaattatttttgagtaaaggttacagattctgaattcctaacagtaactctaacaaaagtcttattgtatgacctttatgaaaaaaattacaaaatattattaaagggcataaaatcacttttgaatgaatatatagactcataaaatataaatatttaaaaatatagaatggggctgcttaatatggtacagatgtcgtttaaaaatctgtaaattcagcatatgtgtgtaactcaatctaaaataaataattgctggaacaattggttatccatatgaaataaactaaaactagagctctgtttcagaatttaatcaaaaattccaggtggggaatatatatctaaatttgcatatttgaagatatgcatagcctgctccttaagacccttgagcaatattttttatatgttattttgtgtaactcgaggcatatacagatctgttcacacacaactgaaatatgtctcaagaaacaatacttttaccgcatgaagcacacttaggtattttatacttttatttcattttttaaaaaagctgtgtattgatttcattgctttctgagtatagcttgacaaaaattagcttcaagaaactcttgtatgtgtgtgcaaggagagagatgtatgtggaaattttagctaaaccctgcaagtgcttcatctctagtggcagaggaaaacatgtatgtggttaattaaaatacaagaggaaccccgggaggtgctatagttgagatctgtgggggacatagacaattcacagggagtcaataaggtttgagatgattgttgaaagaaaagtagaatctggctaaaataaggaagaatggctttttatagggtagaagacacaaggttgagctgagatgggagacatttaattttttgacacttgggcagggaggtatgtatgtcagggacaaagtgcaaagaaacagccttcaactccgtgttctgtctgggttattaaaatgtggaaacagattctgtgactttctggtcagcctattaggagcctctttggaggccttttcaggtttgctcacattaggaaaaggatctggaaggcagtgacaaagaatagttgcagttgagcttttttcagctgaagagatgacagatgttttttggatttattgcgcttgagcccggtctggacaaatggaggttgtgagatcttgtggtcccaacatgccgttcctcgactggggccctgggctgaggccctggactgtatgcgctcagtggtcagctgggccacttcagcctacctcttatttttcacaaagagtaattgtctcagtaggaaagttttttctgtgtcatttgtgcctttaagaaaattaaaacttaaaagaatgtatttgaataaatgtgaaagcaaatagataatgcctgattcttaccacatactagagtttagctgtttttttttcatcagtaaaattataaatttctctgctaattccactgtcgttccacagacgactccatgaggtcagaggccatatcattcttcttcatgatgaaacaaacacagaactttatagtaaatggctggtgtggttatatttgccataagtgtaaatctttctgaattatgttttaaaactaatgttattatggattgaatttctatatttataccagattgatctttctcaaaaatgtaactaatgatggaaaacttttaaggaatgctttggcattatagtatttaaagagttagcactgctcagagtagatactaaagtaggcaaaaatagaagtttcaaacttactaatgattttatggttaaaaaactattttctgcttaaaatgcttaaattgttagactattgtcttcagttattgtttggttaaattttacttcagattttaagttttaagcctttgattttagtgcttttaatattttcctaaaaaggaatgttacttgttaatattaagttacaagttattgtgaggaacaattcttttgttggtacgatgtctctctattaaagtctgtgcaagggcatcagaagcagtttaactgccaataaagattcttcctggtgtttagagtgctacacagaattttgcaaagcagtttggcattatgtttggttttaaaatgtgtataatctttgatctggcagttttacttctggtactgtgccctaacaatttaattggtaaggtatagacaaagatgcatgattaaagatgtttttcacagtatatacaatcttcccaagactggaaacaaaggaatggttcagtagttttggtagacgtgtatgatgaagtgcctgctaaagtgatattttacagtgtttttaatgataggagaagatgtttatgaaaagagggatctcaaattatatctgggtaaaaattgagaggaaataaatggagttattttggtttatctgtggatactagggctgtaaagaattagtttgtttatagccctgtgatttacagataatgaacaaatattattttggtaatccgaagaaaaataaatactacttttcaagcagaaaaatcaccagttgtatgttaattttggaaagttggctctgttaaaaaggaagatgggttgagtggggagagggatgtggcgccacagatagatggcaaaggatatggttaggactgttgtggacagggggttatataagggagacaccacagaaaaaagcagcatcttgtttcagggatggaaattgaggcagtagtgacagaatgctccgtgatgctgaccttggcaaataggtatggttggggccaaagtagcatttggcgttggtgtgatattggtttgaaatcccagaaaaaatgtacaggctttcgtaaaccagatcatcaggcagtgtagattcttgtctggattcaagaagggcatgaggactgttgtagctggagaaagaataagattggtgagaaaagtgggtatcactcgctcaaagccacagggtttataactgatggagctggaacttaaaccaagctctcaacttttaagactatgcctttaactactactctgtacttttcaaattctagtgacaggagtgaaatattatttagttagtaaagacaagcgtataatggcaacagcagatacaagtccctcataatgacttgacttaggatttttcaactttatgaagggtgttttggatattcctcatcgtgagttgaggaatatccgtaatatgttttagagatttttgtcgaaaactggtgtgtgggtttagtaaacctttttattagaccagttagctcacatgaactttattttctgattctgccaaataaatactgctaatattttttgaagtaatgatttataatttattttttcattttctactcttatttacctccagtaccaaaaaattattgtatagctcttcctgcccctgaccccactttttgaaaggattagactattgtaaagggaaacctttaaaacattttaaacaattcaagatggcttctgaaacaaatgagacacatcctgggatgacatcaaatcagggctgggggtctggatgtcttgatggaaaaaaaaaatggttaaagtgagtcttagtgaaaacaatatagtgacattcaactggagtggtaaatggtatgctagttttagattcttttggtggtttgtttcatatactaataaatgattgaaagactttgttttagctaagtatgacaagctagactttttttcttaatgttagttcttttacaatttaaatttgagtttttgaacacttgtattaactctttttttcttttttgagatggagtctcgctctgtcgccaggctggagtgcagtggtgcgatctcagctcactgcaacctctgcctcccaggttcaagcgattctcctgcctcagcttcctgagtaactgggatacaggtgtgcgccaccacgcccagctaatttttgtatttttagtagagatgggattttaccatgttggccaggctggtatcgatctcttgaccctgtgatctgcccgcctccgcctcccggttacaggtgtgagccaccacacccggcacaagctagactgttaaaatcgtaagtggatctaagaattaggaaaaacaaaactacttattctgtatataaagtatttattttatagccacatttaaactgcattatttttccctatgtttagttttttgcctgcttattttaaaaacattaatcacttgattaaaccgtatttcattttttatgattaagtcagatactatttgagttcttaaacttctccctactaagtagtgatgaataggctatttggcttacatggctctaagtcaggtgtacactggttaggaatttttgcctgttcttgccaccagtttgtggctgagtcattagcaagattctttactcatgaactcctaatacatagaaacattatctccactaaataaacagaattttgtgtgctttcacacggtacctacatattttgggaaaataaatgagtaggaaatattactcttaaatactgcaaatttgagtaacattttaaaagtttatgatcactgtcagattatgaaatcagagtattagattgtaggcttaaatagtttaccaagcattaggcatatactttttcacttgtgatttttcattcaacatctgttatttaatgtctaagtaaggagctctactaagtacgtagggactaaggctcagtctgttcttaggcacatagctaacgtcatacttagtaaacagggagtggcttctagcacttaaaagcctgaaaggatcttgcatataggagcagaacctagtgagtaaaacataagtcttcttgaagatcattagttttaaagggaagggtgaaaaaagtaattctgttataatgatacataggcctggcctgagtggggctatttagtttctccagtgaagaagtctccgtattcctgtccagggcgtagacatgagccggggatatgttctgggagcagagtggagtaaggagactaagatcctggtctgattctaactgttcatcataaagactgtttcttagcccagtactatatatccttgtgcctagtgtctccaaaatgttccgtcttctgccttggaaaagattgtgatctggttacactggaggtgtgggagtgtgggaagtatgcgccgaccactccatccaacgaagctatgtgtctccagcatcatcccccagaatgtctcccccgcccctggttgtagtgctgaagctcttgtggtcccagggtggactgttttctggtcagtatctatttctgcggccacttttgcttatagctgcttatgttctttctagttgtcatctcttctctattctcattatttttttaaaaaaaattgttgaatttcttgttccttgattttttttcttttatttgttctttggggttttcttctttttcttttcaactacgaaggagaaaagaaaaatgaataggatttatcagtcatatttaaggtgtcactcagtccccagtcatgcttaaattataactcccttaggcatgcttttctgagttggaactctaaatacattgtggtatgattatttatattttaatagaattcactaaaaattagttttacttcacttgtagtaggtgattgaaaactgattcatgcagtaacttcttaggaaacatcatttattataagtggaggtccttttcattaaaccttttggaccattgcaaattcttatttctatctgcctttctttacctacgtctatttgtatctactttccttacttgtgtttggaccataaactcacgttagtgcattgccagttgacacccgttagagatggtaatgattccttggagcattgattcttaaccatgggtgtgtatcagtcacctggtgacatgctcccaggctacattcctgacctactgagtcagaagaatttcttgattctcacttttgcattttgaaaaacttccacttgtttgtgctgtatagttctatttgagaactattgtgttatagcttccgaaagaaatagatttaactttgtgtagcattttatttcctagcaaattaacttcaaattcttcaccccagggtgtcaaaatctggtctcaacctttctctagcacttctgccaatattctcctttgggtaccttgtgtgccggcagaagtggatgagccctttcttgctgccataccttctcctgctcaggccatcatgtcctcctgcctagaacgccctttcctagctagatctattgacacctttttcttcgtcataggcctcttcaattttctctcctttctttgagaatttttaggcactcagccagctggagagaacatgtatacctttccacatgttttgtttttgctattgtatcccctgggaattatacaggagactggaaattggatacattgaatatgccttgagttaattaaagaagtaatgttatcaagctacgttctgccttgttttatgctctaatttttatttctatctgatctatctgttagattcctggtaccatgagaaaagactcatttttttctcattttagcagtaaaatagtttgagctttgtaagtatttcttgaacaagtaaataaggaatattctctatacttgggataatcctgcagaatttggaactgtgggttagaatcacaagattcatgacacaagggaaggagaaaatcagttctgagagtatcagtctgcattggtgggatgcttccactggtggggctttagtcctgctctgtcaggtatatggatttgatacatttcaggacagtcttcatttgtcagatacagttgtgctgtatggcacagtgtcttctgtgtcttctgtgaatgcaagagagaataatttatagtatttggtttcatgggtgctagtctcagcaccactgtatgttttgaatttctattccgcttaattaggtaagtcactttttatgttcaactttaaatctttttttttctcaccaaatactgcctttgtcatattgccttgtagaagtatgtgataattaactgtttgtaaccttctcaagaaatctcttaactaatcatgattataaaatacatagatttagaagcagagggttgttaggtggtgggatcgatgttgacctttgcagttaggatagtcagagatgaacagagaggaatgggaggaactccagatatgccaaaaggcctgtagcagtatcgtgcgtaatgtatcaaggtgtatttattggtcacagctggaaccctgaataaacagttttattgtcaccacataccagaagagtggggaggtgaggattaacctttattgaatgcctaccatgtacacagttaccatggcaggggatttatgtgtcatctcttttaatatttacaacactctaatgtgcatcagaagcctagagaaatggtcactggcttgagttctcatggattggtaagtgatggaacaggtattcagcctaacctagagccttgttaccagaaagctgtacatttggactgtggcttgtatcttgactctccagccctaggataattagttgcaactttaccatgactgtaacagttattttgttgtggtggtggtgtctctctctctctctctttttttttttttttggagacagggtctcattctgttgcccaggctggagtacagtggtgcgatctcggctcactgccaacctctgcctcccgagttaaagtgattctcctgcttcagcctcctgagtagttgggaccacaggcgcgtgccaccatgccctgctaatacttgtatttttttgatagagatgagttttcaccatattggccagactggtcttgaactcctgaaaggagtttttggggggtgataagaatcttgaaaaaattacctcctttccttcatctcaccagtcactgagttccttttcctggagacaaccattattggcttgttgctccatccagtgcttaggatgtctgtgtaaaacaaatgatacatagcatacacagtgctctgcatctttttattcatcagtgtgtatatctttcatattaatacatgtagaagtgtttcattatttttgcataacaactttattaaaagattaattgcacaccatgtaattacccatttaaagtataccattcagtggtttttcagtatactcagagttgtgcaaccatcaaccacataatttaactttttttttttttttttgtagagatggggtcatgctctattgcccaggctggagtgcagtggctatttacaggtgtgatcgtggcatattatagccttgaactcctgagctcaagtgattatcccatctcagcctgcacagtagctgggacaatcagcttgtgcagctgcacccagccctcttaattttataactattttatcacccccccaaaaaacttcatacacttgagtagtcacccctattttctgtacccctccagccttacgctgttactgatctaccttctgtttctatagatttgtctattgtaatcattttatacaaattgaatcatacatgtggtctttggtggctggctttgatttataatactttaatgctgtcaggggtcatccatgtggtagcatctatgagtacttcatttctttttattgttgagtaatagtctgttgtattggatataccacattttaatttatccattcatcagttagtggatgtttgggtggtttctactttaggctataagaaagtgtggctgtgagtgttcatgtacacgtttttgtgtggacatgttttcatttctgcagagtatatgccaggagtggaattgctgcatcataactcttttttactttctgagatactgctagactgttttccaaactggctgcaccattttccattttcatcatcaatacttgtgggttctcttgttttgtacgtcactgacgtctcgttatctgtctttttgattattgccatcctagtaggtgtgaagtggtatctcattgtggttttgattttttcatgtttctgatggctagtattgttgtgtctctttcctaggagttttataattttagctcttatatttaggactttgatccattatgagttagtttctgtgtatggtgggaggtaagaatttagctttattctttcacatgtgaatattcggttgttccgtccccatttgttgaacagactattctttcccaattgaattgtcttggcaatcagttggaaatcagttgactataaatgcaaggctttatctctggaccctcaattctgttccattggtcttcatccttatgccagtacgacattgtcttgattactatagctttgtagtaagttttgaaattggaaagtgcgaatcccccagttttgtgtttttctttttcatgattgtttgactattctgggaccttgcatttccatatgagttttaggaatggcttgtcaaattcagcaaagaagctggctgggattttgatagggattttgttgaatctgtagggggcattttcccatattggcaaacagtattaagtctccaatccatgaatatgggatgtcttctgtttatttaggtctttaatttcaacaagatattgcagttttcatagtacgttttaaacttcttttgtttaatttatttctatgtactttattattgtgactagaattgtttcttctgcctcatcctttttgagagttttgtatggttgtgccataattttatcataatgttattaacaagtttcctattgatagacatttagatcccaatatattgctgtttgcagacattgccacagagtgtgtgtatcactaaggtgaattctactaaagagaactactgagctgcagggtatcagatattggaatcatctgtgaaatttaaaatggctatatactgactgtttatcattttactgcttattttaaaacttacagtaaggtatttaaaataagctgtataaaaaatgttctaaactctttttcagctaaccttactacttattaaaaatagtgatatgctggaagaggctcatgctccttaaaaaaatgcctagagcagtgctacagcatctagagcctgcagcattactgtccaatataactttctgtggtgatagaaatgttctatatctgcactgcccatactgtgccatagccaccagccatatgtgactactgagtgcttgaaggaggatgactgaatttttaattttattccattttaattaatttgtcttgttgctaccatattgtgtaacacaggtttaggatttcccttatttcctgtgttctaaattactttagaaggtagaaagttgactgcatttgaattttgttgatccattatatattagtagttgtgtatgcctttagatctaaagcttgtggaagtttgcagaaggcttgtgtaaagtggtacatcttacattatttcctgaatagcatgaggcaatcgttagttgttatagcaactttcaccaatataagtcttagtaaacagttccttttttgtgacattttattcactctgcacctagctggcttcagattgtctacaaacatagcttttagatagaagagcgtatgggtctttagtttgcttgttcttcttatatgtatatcttatcctaatgtaaaaggtaggcttacttttgtatatgtatgtgctctaaaatctgtatttgacacttaaaacttatattggcaattatagtaggggtccttgactatagattataatgttggtggcttgtttaactttgttcttcggctttgaactgggctcttcccttggctcttttattccccagtttctccccagcactcttacatgcttggaaaggctttggcttccagctgcatggtcatgcttcagtatgcttcagtttcaatcacctttgcttcaatttgcagctcaaacctttacttttcagctatagattttatatatcaagcaatccctaccgtattctatgctgcttggtatcccacttgcctgtgaaactcagaggagctagagccggttacttttctctaaaaccccttcccttcttcatccacctgctctattctctgtcgaaatgaatggtacagtatttcagaccagaaatgaagagtcaaacatccacttctagcaaatgaattagagttgtccttaggtatttgtgggagattggttccaggatcccattcggataccaaaatccatggatgctcaagtccttgatataaaatggtttagtatttgcatgtcacctgtgcacatgctcctatatactttcagttatgtctagattccatcacctagtatggtgtatatactatgtaaatagttgtaatacctaattgtttatggaataatgaccaaaaaaagagtctgtacatgttcagtacacatgtagccatcaccccatgtttaggatccatagttgtttgaatccatggatgcggaatgcatggatacagagcaacaactgtactgagttctgagttccagtttttaatcatctctgtcctggactaacaattgcagcgttttcccatgaattttctttcttcttgcttttatcctttctacctgttctacactctaatttcatatgttttttgcagaaagctaatccttgtttctatggttgcatttcagtggctactacttgcctcagggatagagcccaagcttcttagcattgtggtttattcttttgaattgtggattattcctatgcctaacctctttcctctctccagtcataccagattagtttgggcctctgtgcttttgatgatgtggttccctgagacatggacctcctgcagtcagcctcattctggccagtctgtaagatcacctctagatgtctctgacttggcccactaccatctctgtttccataacgataccaggagcagttgcttacatttgtgtgtttacatgcactttcccctcctcactagactgtacacccctcagtgctgggcatctgtgtgcttctgggtagttgtagaatcagtggatgtcattttacatgcatttggactcactggtttaacttttctgtcagtctttctccatttcagtagtaatattttctgtcagatcccacaagtgttttataaaatattaatagtactagtggcataagacatatgtagtgctgaaatgcaattttagaaccagaggtttgctttttgcaaagaatatatggaattaatgtgtaaaatgggaaggataaaagcaagaaacaaggaaattaatgaggaaaagttagtccaggaaatagatgataaaaacctgaactcagaactcagtgaggtgatcaggcagcaatacctttagaacaccaactcctttcttttctaaaatgtagattagttgggaagcaggtctgatttacttacatccttactaactttgagttggctgtgtactacgttctagaaaacagtatggtcttaggaaataagtaagtagtatttggcttggaattacaattgtttgctattaggacttggggagtgatatagtttggatctatgtccctgcccaaatctaatgttgaattgtaatcccgaatgttggaggtggtacctggtgggaggtgattggatcatgggggtagatttccactttgatgctgttctcatggtagtcagtgagttctcctgagatctggttgttctaaaagtgtgtagcacctcccccctcactctcactcctgttactgctcccacactgtgttgcgcctgcaccccctttgccttccaccatgattgtaagtttcctgaggccttcccggaagcttagcagatgccagcatcattcttcctgtatagcctgcaggactgtgagccaattaaatctcttttctttataaattacccagtctcaggtatttccttatagcaatgcacgaatggactcattcagggaataagatactcctattcccaaaagagaactgtttcccattctggattacccagcttaagtcccctggccatttcaattatttaaaaaaaaaaaaatcagatctttttgaggccaaagtctgataattctccatgatctactctagtacagtttgaggaacttggcagtgtattcactttcacttgctgtgtaacaaattactgcacccttagcagcttaaaacaacacctgtttattaactcacagttttgtaggacagaaatcagggcagcacagtgtggctggattcttactagactgaaaccaaggtgttggccagatctgcagctctcatctgagcttcagagttcttttccagctcactggttgttggcagaactcatttccttgagttcgtagaactgaggtctttgttatcttactattcttctagctgttggcagggagcaccgtcactcctagaggccactggcagttctttgctctctgtggccctagttcacaaatgatgtctgctttttttccaggcagctggagcccgccgctccgcttccacttctttgaccagccaaagaaaaccctctgcttttagggactggtgtgattaggtcaggccacccagtgtgatctccctttggcatgtagtgtagataattggataacaggtgtaatatctcacactcacagatctacccatactcaagagaagcaggagatttaacatggatgagggtcattgagggtcattgcacatttaggtttgatttacacaaagtttttgaacttaacctttcattaaagaggaatacatgaaattatctgaagttcgaaacattatctggtcccaagtattttgaatgagggatactcaacctatattgaccgattctactattaattagaaattgggtatttctcaagctgacagtaattaccaagagaggaagaaggagggagggaggaagggagagagaaaagttatagatatagggtggacatagggaggaaagaaaatgaaatttgactttatgtgaatgtccctcaaatactaactgaagaaattcatctggagctccttttctttatgtttgattaaaaattaactgaactgtatttcttaaattgtgtcagttgccatctaagctgatagcaaaggagaggacatttttcctactaaatgtagagtttattttttcttttctctgctgaaaagaaatacgcagtagcagctgagaggaaatcggaactctcatctggttgccatggcaatttagagcagatgagacttgtagtttcctcggttgttgagtttttcctcccttttctgacagagcaagtgtacatgcagaatatagtatgaagtacatagcatgatgataattttagtattatagtatgatattgaaagaaaaatatttttaagtttttttaaaccacattttaaatttagagtaatgattagaattttctttgtagtgtaaaaataaatatagttctttgtgaaaaatataagtagctagtggaattttgctttctaaattaatttcattcccatcactgaagtgctgtgtttttcttttttctctcctcccctctttttctcttttgctttgctttgctcttttgttttcctttctctttcctttttcttttttctttctcctttccttttcctttgctttcccctttctccattgtcctttccccttccccttttctttcccctttcctttttcctttccccttcccttccctttcccctttcctttttccttttctattttcttctttctttttttcctgagacagggtctcactctgtcatgcaggctggagtgcagtgctatgatcttagctcattgcagactcgcatgctcaagcagtcctctcacatcagcctccttagtagctgggactgtagatgtgtgccaccacgcccagctaatttttgtagtttttgtgggtattgccaggttgcccaggctggtctcagactcctgggctcaactgatatacccactgtggcctccccaaagtgctgggatcacctgtgggggccactgcacccggcctgaagtggtatatttctttatatttcttatagtacatgaaaacatgttcttaaattagcaccttgtttaaactttggacccttagataaaatttcagtctcctttttaaagaattacagattaattttcactctgaatgtagctgagcttattgtaaaagagactatgcatattgattgcttaaatctctacatagatatttgtttcttgaagtcatacattttataacggtgtagtgttggatatttaaaatatctatagctgtattggggttttcttttatttttttaaaaatttattgttgtttttgtagagatgaggtcttgctgtgttgcccaggctggcctcaaactcctgggctcaagcgatcctcctgcctcagtgtcccaaatggctgggactacaggtgtgcaccaccacacctggcttcttttattttttaacaatagctttttgaagtataattcacatagcatacagtttgctcatgtaacatatatattttagtgttttttattatgttcacagaattgtacaaccatcaccacattaggacattttcatccctcctaacagatatcccatatctactagcagtcagtccccattttcctccttttttctccatttccccaacccccgatatgagcatccactgatttaccccatctctataaatttatctgttctagacatttgatggaaaatggaagatcatacaacctgcggtcttttctgactggcatctgtcacccagcataaggttttggaggatccatccatgttgtagcatatatcagtacttcatttctctttgttagtgaataacattcccttgtaatgatataccccattttatttatcagttaggggacgtttgggttgtttctgcttttcgttaaaaatagtagtacttctctgaacactgtggatgagattttgctggatatatgctttcatttctcttgggtatatacttgggagtggaattgttgggttatttggtaattttatgtttaaacttttgaggaactgccagaccgttttccaagatggctatgctatattacccttcccaccaacaatgtttgaagatccttatttcttcatccttccttaaacttattatctgacttcttttaatagccattctagtgggtatgaagtggtgtcagactgtagttttgatttccatttctctgattactaatgatgttgagcatcttttcatatatttattggtcatgtgtatatcctctttgtagaaatgtctttccaatcctttttatccattgttaaattagtgtgtctttttattgttgagttggaagagttctttatatattctagatacaagtcacttatcacttatcacttatgatttacaagtacttccccccattctgtggcctttaaattttcttgatggtgccctttgaagtacaaaagttaaaaattttgaagtccaatttagtttttcttgtattgcttatgcttttaatgtcacatttaagaaacattgcctaacctaaggtcgtgaagatttactcctatgtttttttcctgagagttttatagttttagctctttcatgtaaagcctgtgtgtgagagagaggtccaactttatttattttgcatatgagtatgtatttgttgtagtaccactgttgaaaagactattcttttaccatttaattattttggtattgttgttgaaaatatttatgggtcatttccactgccattgctgcttatatacttctgataatttttatatgaaatagcttccttacggctttcattaggattgatgaaagttgttttttttaatctgttgatagacttaatgagtatgtatttggtgagataacctgtcatgtcttggtcttctacagtgttgtaatttaaccaggctttgcagtactctagaagccatcagaaaccactttaaagaagccagccttggccaggcccagtggcacacacctgtagtcctagctacccaccaggctgaggcaggaggattctttgagcccaggagttcaagattgcagtgagctgtggatgcaccactgcactccaccctgggcaacagagcgagaccctgtctcaaaatgaaaataaaataatccagccctaagacagtatggcttggctttctcttctctatttctgccctaggagaaatttaccttgattttcctatgtggtagacagtaacaaggatggagggatgaaaaagaattggcggttacattgaactgagactttctgtgatgaactgagtgatttgagtattggtgataattagtatgaagtaggtcattagaagtcctaggaaagataatcatcacttatggccaggaatctctcaacgtgaggctgaaatgcccctcagtacaggttggatctgaaaggtccagagttctaccatccactagaaatactcgtgtataaaacattttaatattgagcaagtagaaaattattaatataatatttttacttttttgggtactgagtcttggcaatctaacatgtattttatacttctggcacatctcagtttgaactagctacttcatgtgcccgataaccccacgtggctggtggctactgtattgggcagcacagttctagatgttttgatatgacagccagttgaactattaatcagcattactaaacctcctctatactttggggtatcctgacttaccacttttcatttggtagagctggcttttaagaagctttctgtctgcctgttcagtgtggccctcactggaggaatgagaagtgcctacacacttagactgcagggtctgagaattttgagggtcatccatgtaggcagctcagcaggtaggtaaagagtaagtgagagagacattataatgaaggtgcgggaatctctcaagtgagagaaaatggtggtgaaaattagaatctcttctccatactgcagtctactccattgaggtaaagccatatatagaaaatgctactagtgcactggttctcaatgggcatgactcccctcctcccccagcacacacacatttgtcagtgtctacacgcatttttgatggccacagctgggtggtggggtgggggtggggggctgtgtgctactgacatatagtggctggagggcagcgatggtgaaaagcatcccacagtgcacacgacagccccacagcaatgaattatccagtccaagaatccattgtgctaagtacagtagtgccgtgcactggcagcacaagagccatcatttcttgtcttttcttcaagtagtttctacagcaaactcaatgtgtgtgtgtgtgtgtgttttcagagaatgtactcattttttatataaagtttctgagttaggaagaaacagctagctttcaaagtatttctcattgaggaaatgtgtcagacaaattgattctgcccacacccctgaagagtgggttgtgcttcttttggacgtcatctcaaaccttttcctcccgctggggaagtggcaaactactgaagttccttacttgcctctcctccttcagaactctcttttgcctgggaccattccactttcagtaagggcacatgtgttaaaaagaagcgagcatttacatggcttccagaaagattcttgtacttctgtaaggcctgttggaagttttgaatgtattctggaagtggtgtgtgtgtgtgtgtgtgtgtgtgtgtgtgtgtgtgtgtgtgtgtgtgtgtgagagagagagagagagagaatgaatattattctctttcagggctctgtgaagagaatggttaacttggagtgttatcatcactacaatcctgatgtctgttacccagggagctgtaactgttgagtcttcataaattccagaaagcagcaatcagtacattttcagcttataaatattctttagttgtcctgctaaagatattcatacctttgattatttgcctttaagttgacctattgtgtgtgatccccaccccttcctcatgatgtcaggtgtttctgctgccttctattcctactccttccttcagttgtggccgtatgggtttttttgttggcaagccacatgcattagtggtggtgttggaggctctcagattgggcaaggatttagaggcccagtttagaagaggcagtggttgaggcagctcctttggcctgtctcttagtggcagctacagatgagcttgcattgctaagaccctgaccttctcaagattccagggctgaagagtgagctttgactgtatgccgcaggctgtgctgcagtgaggagagaaaggatccagaatcggccttccactgggcagagagcaacagtgttccaaaaggaaatctagcaataacaccaagattccacctgctctcaacaactagggcttaggtctttgaactcttcattgacaacggctatacccttaaaatagggcgcatgctgggtgacagcaggtgcatggtgtgaggaactggtgctaaagaattttgcttgaccagaaccagaccacaatatgtttgtcaagcttgttcttctagacgcagcaggcctgagggctgccgttgcagaaatgccccaaggaatggcactcacatgtcgggcaactgaccctcagagcaacctttccacagcagccgtcatcttcagcgcacgcattcagtggtagttttattagtgggatagcttaagggagagatgtgcttccggcatccagattgagactgtagggtcctatttccccgcactggggcatggttaggaatagtaagtgaatcccattatgaaccattctcctcatagagccctgaaagggaataatctcaatcaatcaaacacacacacacacaccgcttccagaatacattcaaaacttcgaacaggccttatagaagtacaagaatctttctggcaatcttgtatattttagctacagtgtatgttaatcagcttttatgagttattgaaacctaacctcattgccacctatttctatgggaaaagaattctcattttcagataacaggaaataagtgctttcaaaagttgagtgctgcttgcgcctgtctttttataatcgttgtgatgttttctaaccaataaggctatataccatggaatacgctttcatttcacttaaatttcccagaattggtaggagttgagtggagcgcactgaaatttcctaacattggtagttcttgaagcgctaagtgaaaagatacctacagaaaaaaattccttagctaataagggcagattttttttttttttggcctgacttatatgttgaaacactacttgaattcaactaaaatgggtgaagtgacattaaatgacatttcttcttagtatgtgacaagttttattttttcccccatattaagaagtgctcaaatgcatccataatgcaagatgtacttctaagtaaatagcaattttctctctgctctttcaggccggagcctcaacagaaagctcctttagttcctccttcctccaccgccaccaccaccaccaccgccacctttgccagaccccacacccccggagccagaggaggagatcctgggatcagatgatgaggagcaagaggaccctgcggactactgcaaaggtgatgtgccaagcatggtggtgtggggcttgccttccccattgggctgtgtagtaatttgttgggggaatggacaaggggaggaggtagtgatgcaaattgcttggtcttcattaaattagcctccttgtgtcattatcattttaaattcttaggtcattgtatagagactgatatcagaaaatattaagtgatatgagagagaattgtaagacaaaatacatgtatttgtacatacatattctaggtactttcagaaggacttaaatctgttagaattaaaggtagtatacagcaggacagttagaggacataataaaccatctaaaaggagcactgggccagtgcggtggctgaagcctgtaatcccagcactttaggaggtcgaggtgggcagatcgcttgagttcaggaattcaagaccagcctgggcaatgtggtgagacactgtctctacaaaaagtgcaaaaaattagctgggcatggtggtaagtgcctgtagttccaggcacttggggcgctaaggtgggaggaacacttgagcccaggaggcagaggtttcagtgagctgagatcgtgctactgcagtccagcctgggcggcagaaccagatcctgcctccaaaaaataaagtacaataaaaacattaaaataataaaagaacatagagaggagaaagtgtaccaggctcctgaggggagctaattataactcttgtgcactgtatttgactttctgttttctgactgctaaggctaaaagaaaaccattcctttctttgtgtagcattgaattacatagcgtttattgtctgtgggaagcaagcatgcacatttgtttacagagaaagattctttcctggcattgtacttaacgaaaaagacattctgtggggttctgccattgtgtgacatagtgggttatgttttcagctatgatttcacggaagacacagaaactattcaagtggagtgttcttgtattgatgctttgtaaagaccaagagttaaactcctaaagggcaagcgtgttgtgtgatgaatattaagaacaatatgatctagacaccatgctttgtgtggacccaactgagaatctaggagaaagagaaatgactattcagctgcttctttgtcacttaacttactgatttggacattaattttctggaatttggagctcctgagccaaagttggtgagatgaatttatttgctacagattttaaaaattgtaaatcagattctatatagcattagaataaatggcagaaaatgcagacatgttcagaacataaagcattaatgaattttgggttccatatgtcttaataattcatcatttatctagtagatatagatcatttgtatgttggttcagaaacagtgtacatttaattacctgctaagaggaagagaaagttactgtactacaaaagtgtaggaactaatctactctaacctgattctttcataggtgcacgtacttccacatagaatcagtgtgttccttagaaaagagtgtagatcttacttagcatttgtctgaatagtggttacaaccccaaagatctatgcagtctagtaaaagaaaagatagagccagtttgaaaggtgacaagaaggtgttttccatcctccctcttactcttcatttcttatactgtcttcgatttttctgctgaggcccagcattaggttcatctgtaggtgccattcttttttcttttcttgttttttctttttctgagacagtcttgttctgttgcccaggctggagtgcaatggcgtgatcacagctcactgcagcctcaacctcctgggcctgagcaatcctcccatctcagcctcctgagtcctgggcttgagcaatcctcccatctcagcctcctgagtcttgggcttgagcagtcctcccacctcagcctcctgagcagttggaactgcaggcatgtgtcaccacccctggttaatgaaaagttttttttttttttcttctggtagcgacagggtctggctagaaccattctttaggagctgtttccttcagcaaataggttctaccaagcaggagtgaaaactgtcttgttcatctggatcttaagtatgtgggtcaggagatgtaaccaatactctcatccccttactatctctgggaaccagcacagtggacatccaaaccccaaatatagggctaagaataaagtattccacagccggggctgtttctaggtaacattcactgaactctaaccttcacagagtattaaagtcagcatcagtaaggtcattagagatagtaaggttccctccttatacccgtgccagccccccccaaatttggtaagtaacttgtacctttagttagcattacatgtgacagatgccctactttgaattttgtggtatattccacaacagtttgtataagattactgacatatacatattcagggagtccaaggaattgatttggaatgtctggaataagacctgtggccttctcattttttgttcttggataaagagataaatcccctcaccctctgccaggactggttgagctaaaattactaatatggtgttttatcatccctgaatactttagtacattttacctacaatcaagtacattctcctatatatcaaaatacaaccatcaagatcagaaatttaacactgatacttcactactattcagacctcgggcttatcaggtactgccagttgcccagtgttgtccattatgtgtaatgaatctgtggcagaagcgcatattctgttttcttgtttttgtaatttcttttaatttggaacagttctcagtgttttcctggctttcatgtccttgacatttttgaagattgtaaaccggttattttatataatgtttctcaatttgggatgccacagtagtgatgttgtctttttgcattaaatcctttcagatggtacacaggtttgatttattccattggagttgatgccttcacttgatcaagattgtgtctgccagatatccctgacagctgttcttttcccctagtaataagtattttgttgagagttactttgagactacatatataacccattcaaatatttatccctacccccgccgccaccccgggctgactttctgtctcgggtggactgataaattcatggatctctgttttattcagtgggttatgatcacttactctccttatatgttttgatgcttagattatcccaaattttgttcttaggagccccttcagattggttctgtgtccttttgaaatgcctcaatcgttctttgatcgtttatttttttgttttgttttgagatggagtctcgctctgtcacccaggctgtagtgcagtggtgtgatctctgtttcactgcaacctccacctcctgggttcaagcaattctcgtgccagcctcctgagtagctgagactacaggctcatgccaccacgcctggttaacctttgtatttttagtagagatggggtttcaccatgttggccaggctggtcttgaactcctgacctcaagtaattctcctgcctcagcctcccaaagtattgggattaccggtgtgaaccaccatgcccggtcctttgatcatttctttaccttcaagtacagtaggatatgccaggttcatcttgtgtttttcctatcccagccctggagtctactcttttcacagagaatcctgctttttttttttttttttttaaattaaacaataatatttagaaagctagacctgggcattaggtgtgcttattacttttggcttgtcactttcagatctcagtacagagctaggaacacaaacatatgcacctgcttcctttatgtttatatttatttatatatttacatatgttttgaaatccatgagtttattaatctgatacctctaataccagaagattcagcctggtgttctccctttccatctttgtggtttctttctctgatagtaagagtctgggctcttcccatcctcattgcgttgacttagttgattgatttccctgtatggtatgaatcaccagtcaccatcactatgtctctcccttcccttctcacctaactcatgctctgacatcctttgttgattggccctgcctcatggcttgggatttaatggtccaggatgggaaggggagagagctttcccaggctggtagtgtgtgttatgtaatctgaggtatcatttttcttctgatacttcacctctttctcttgcttttattgacttcattcctggagagtctctgccctcaattacttctcagtttcctcaaaatacaattaaaaaaaaattaacaacaaaagacatcacatgtatttctttttaaaaataaaatttgttcatcacaggaaatgtagacacttgggttggagggcagaagtcacctgtgatcccactactcagcaagagctgcagcaagccttcatcatttatgatcagctagattacatcttaactttttacctcatctttacaagtttcccttatttaaaatgtatgaaccctcagctgttttaataagagggtccatatttaaagttctgatattgcaaaagcattgttcattgctcttgtgtacttacttgccttggtattctctctggagtaggactcttcatttcctgacagccatgttcctactcgcgttatcttagatctccaagaggattatggcattattgactgattcctgagccttggttcaaaacctggctgtgttgctttgtagctccgtcttcttggacaaattcctttctctttaggctttggtttttcatctatgatatgataatttatattatattaatgttaatacctaagatttttatgaggatttaaatgaaatatatgaagttcatgacacagtatctgatacgaggctcataagaaatatgagtttcactcttcttctgtctgttctatcattcttctttcattgtgttctcatctgtacttcatgctgtctatacccatcagtgctggctcccttaactccctgaccgtgtctcatgttgggtgtgtttccttaacctctggagagagagctgtcagcactgcctatcttttttacatatcacctctggtctgttgtctgggcacaagctgtagcagtaggctgtgcagtttattcagattctgcttccaagccctggggattaccaagatcaggggcagggtcagcctgtaaacaaacactgtcgggaggccttgtgtcatacatgcttgtttcatgagtttgagcaaaaaaaacctgtgtcacagccaaacctccttttgtgggaagatttgtgtttcatgtggggttttcagaggcagtagggggtgcctggtaaacattcctaggctgcactgtaaacccctgaattggaatccttgagagtgggacttaggaatccaaatatttaacaaattcatcagtgatttttctgcacattgaacactaaaatctgctccattctaaggtctgcatgtatcatccttctaaaactccaaggatataaccacatgaaggcacccttcatactatacgtgcaatataagcggaatcattgctttgaactaccttatgttcctaactttttccagaaccctcggtgtatacctgctacaaggacatactaaatggtgactgtaggaacattgccttgcaatatcaggctgcctgtagtagctgtcctcagacatgagttttgttgctctcttaaatcattcttagataagttggcacctttgtacagttttcatctcttgaattatttctggagacatcaacagctgtggtctgacttggtatgaaaacatgtcatttccttagaaatgcatttattcgacctctaatcagaccctttcctttattacccacggtattgtcccccgcatccccaacttatcatagtgtggaattgtacatttatttctgtgttcatgtatctccccctctctagtctgaaaggttccctttggtcaaggccctgtagtttgttaactccactgcatttgaaccatccataatgcagtacgtattttgtttggataaaggcattttctctagtgttgggttgcaagtacgggataggcagagtgctgatgttcaggtggatctggggaaggcatgtcggcatgagcaggctggcatgctgactggcagatcagaatatagggcctttgtttctgcctcacgttttcttaaaatcatccatagttctccggaatacttaacctgtcacacacatttgagtgacatatatttcttacctgtaaaaacttagggacattattttcttcaaaatagagcataaaatattataagtatacacactagaagcatgtcagatgagtttcttcctatacacaaattgcctttacccatgtgtgtctattttccatctgtgaaaacggtagactggttgaattttaataactcacaaaatttactgttggtggctatttgctgtcattggcatccctcctccctttctccttccctccctgccccccaaccctccgagtctatgactttgatttattttattttattttttatgagatggagtttcactcttgtcacccaggctggagtgcaatgctgcaatctccactcactgcctctacctcccgggtacaaacaattctcctgcctcagcctcccgagtagcttggattacaggcatgcaccaccatgcccagctgatttttgtatttttagtagagatgaggtttcaccatgttggccatgctggtctcgaactcctgacctcaagtgatccgcctgtctcagcctcccaaagtgcagggattacaggtgtgagccactgtgcccaatctgtgttgttttttaaggaaaaaaaagcaaagaaccttaaagctgctttagaattgatatttgtacagtaaaaagaataacaaacaaaagaaatatttgtacagccaagtaatgttggctgtgttacatcagaggttcttcgctgggtgcggttttgacccctgggagtccatttgtgaatgtttggagacatttgcttgccgtgacgggctgctactggcatctcttgggcagagccagggatgctgctaaaggttccacagcgcacaggacagttacccataacagaaattactcagctcctaatgtcagcagtgcccagatggaaaatctctgccatagaaatgcctgtttttgtctattaaaatggtgttgtgtggctgaagtattttatagacgtgtggtctttactttctgttccttttgatagaaagataacctttctttattcacagttcttttacttaaaatcattaatgctgcacagatacttaattcactatgcttttcatttattagttggcttaatttggcttaattcaagccttaaaaagaaaccctgcctatctatgtgaacaaagcaatagatgctcttgaacctattacataaggcctcattacatttcttttatggagaccaaggagattctgactcctgatctgttggtgctttaaattgacaaggatatttatgatacaagctttaaatagcatgacaggtgagttcatggtttattcattgaggcttgatgatgtgcaaaacgttgtactttactacagggcacatagaggtaaatgagaaacagccctactttctagattatggcctcttagactttgccactagaatgccagctacttaagggcagagccttgacctgtctagcttccctggcaccccagtagaacaatctgtggcctgctgaatagtgactgaatgaatagactgctcaaatatcttttttttcatctaagtgtggttcgttaataataagtgagaaaagggaagatatgtgagggctaaaaggaagaatgttatatttgaatagaggactcagaaaagatgttataaaaaactgaaagggactttgtcagtaaagaatatttggatgatgttgagagtatggggcactactcagactaaatcctggaggcagaacaaggtgtaagaagccctaactgcttgtgttttcctaacaaatggggaaactaaaaattgatggtagaagattaggtttaaaagcagtttgggagcatcatgtagaggatagagatgagtgtgagaaatttgtggtgaagtaactttaaagcatcacttcaaaatattaccaaaaatccccacagaaaaccgaaagaaagcagagtagaaacagaatcctggtgttataatctctcctctttttacaaaacatatttagcaggccgggcatggtggcccacgcctgtaatcccagcactttgggaggccgaggtgggcagatcacgaggtcaggagattgaggccatcctggccaacatatcgaagccctgtctctactaaagatacaaaaaattagccgggcacggtggcacgcgcctgtagtcccagctcctcgggaggcggaggcaggagaatcacttcaacgtgggaggcggaggttgcaatgagttgagattgcgccactgcactccagcctgggcgatagaacgagactctgtctcaaaaaaataaaaacaaaaaataaaaatatatttagcaaaagagcagtgccaaaatgtcagcagtatgtggtaggcctgaggtgtttttttgaaatatacttttatcttgttgctgcagcaccatttatcgagaagacttgttcccccacctattcagttgcttgcctttgtccatcagtagacagaatgtatgggggtttgtttgtggactccatctgctccatccctcttttggtcaatgcttgctctaaaggtctggttactatagctttgtatagcatgccttgaatgggtagtgtcagtcttccagctttgtgcttctcttccaggattgttttgacctgtctcgatcctttgcattttgtataaattcagagtcagcttatacatataaattttagatacgccttaataatattgaatcttccaacccattaacatggtattgtgtctgtttatttaggtctttattgttctcagaaatgttttgtagtttttggtgtggttttgatgggttatagaaatgtaactgattcttatgcaccaaccacgtggcctgtaactatgctgtttgcttatttattagtgtttgtgcatgtgtaaatttctctaggttttctctacacacaatcatttcatcatttcagggcaaatggaggtttttcttcttccttatgattctttataaattattattcttttttgcctcattcttttatgcatgaggttgaatagaagtggtaagaatagacatctcccttgtcttgtttctaatcttacagtgaatatgtagtttttttttagatacctttatcaggttgagatggatcatatatttaaatataaagttaaaactgtaaagtttctagcaaaaagtaagagaatatcttcacaaccttgggagtagggaaggatttattagagagcatataagaaacattaactataaaataaaaaattaattagacttaatcaaaattaaaaactgttcctgattaaaagacatttttaaaaatgaaaagaccagcttcagactgggagaagctctttgcaatacatttacctgacaaagaatgtgactgggagggaacttcaagagtgagattttggaaaaatgttctgtatattgattagagtatatgtatttgtcaaaaagcagggaatcgtacacataaaacctttgactttcattgcatgtaaatatctgaattttaaaaaacattgatagtagctagttacatctggattgtagggttttggtttttgtcttctttacctctttgtattggttttctttgttttctgcattgagcatatatttctttgtaaatacagaagaatatgtgcttttactgctgaaagaaatcatagacgacacaaacaaatggaaacacatcccatgctcataggtgggtagaatcagtattgcgaaaatgaccatactgccgaaagcagtctacaaattcggtgcaattcccatcaaagtactaccgtcattcttcacagaactagaaaaaaccatcctaaaattcacatggaaccgaaaaagagtctgcatagtcaaagcaagactaagcaaaaagagaaaatttgaaggcatcacattacctgatttcaaactgtactgtaagagcacagtcaccaaaacagcatggtactggtataaaaataggcacatagaccagtggaacagaatagagaactgagaaataaacccaaatacttacagccaactgatctttgacaaagcaaacaaaaaagggaacagacaccctattcaacaaatggtgctgggaaaactggcaagccatctgtaagagaatgaaactggatcctcatttcataccttaaacaaaaatcaactcaagatggatcaaggacttaaatctaagacctgaaactataaacattattagaaggtaacatcggaaaaatccttctagacattggcttaggcaaggatttcatgatcaagaacctaaatgcaaatgtgatcaaaacaaagttaaatacctggaacttaattaaactaaagagcttttacacagcaaaaggaagagtcagcagagtaaacagacaaccgaaagcgtaggagaaaatcttcacaatctatacatccgacaaaggactaatatccagaaactacaatgaactcaaattagcaaggaaaaaaaaatcccatgaaaaagtgggctaaggacatgaatagacagttctccaaagaagatatacagatggccaatagactatgaaaaaatgctcaacatcactaatgatcagggaaatgcaaatcaaaatcacaatgcaataccactttactcctgcaagaatgtccataatcaaaaaatcaaaaaataatagatgttagcatggatgcagtgaaaagggaacacttctacactgctggtgggaatgtacagtagtacagccactatggaaaccagtgtggagattccgtaaagaactaaaagtagaactaccattgatccagcaatcccactaactgagtatctacctagaggaaaataagtcgttatataaaaaagttacttgctcatgcatgtttatagcagcacaattcacaattgcaaaaatgtggaaccaacccaaatgtccctcaataaatgagtggataaagaaactgtggtgtgtgtggagtacttctcaaccataaaaagtaatgaattttggagcaacctggataggattggagactctattattctaattgaagtaactcaggaatggaagaccagacatcctatgttctctcactcataagtgggagctaagctatgaggatgcaaaggcataagaatgacactgtagactttggggactcagggggaaagggtaggaaagggatgagggacaaaagactacagactgggttcagtgtatactctatcggtgatgggtgcaccaaaatctcacaaatcaccactaaagaacttactcatgtaaccaaacaccacctgttcccccaaaacttatggaaattaaaaaaaaaaaaaaagcagaagcagaagtggagcttttaaaaggaataagtggaccaggcatggtggcttacacctgtaatcctagcactctgggaggccaaggcagaagatcatttgagctcaggagttcaagacagcctgggcaacatattaagactttgtctctatttaaaaaaaaaaaagttttttttgtttttttttacaaaaggataaaaagaaccagtgtaggttttaaagagggaagtgctatatttaaggaagcttaatttgaaatcttagttgattgacattaaagagagagaagatacaaggagaagacaaaagcaaacaatgttatggaggtaccgtctttattattcaacaatctgttgagtatggagggcagtgaccagaaaaccccacacacttctaagtcctggaataatcagaagaatagtaccttctgggcatcatttattttagtgtactctgaattatgaaactgcttttcttccccttccccatagagatagagtgtctcattctattgcgtaggctggaaggcagtggtgtgatcacagctcactactactacaacctcccaggctcaagctatcctcctgagtagctgggactacaggtctgcatcaccatgcctggctgatgtttaaatttttttgtagagacaggattcgctatgttacccaggctgttcttgaactcctgagctcaaggaatctcctcctgtttctgcctcccaaagtgctaggattgtgggcatgagtcaccatgcctggcggattttaaaaatgttgatagagacggggtctccctatgtgtctcagggtggttgtcatttcttttttgcattggatatcgtttggctatgaaaaagctctgagccaaatgtgcagcccacctctaacaagtgaacagtaatttatagcatgcattctgtatcctaacttcactgtagcattattctgttttactttttctgggctattttttctgtgccccaatttctttctaattttgtatcttatattgtggttttataagctgcctcaattccttatagaaaaaaatagtgtaacatatattaaaacatcacatcataccccatacatacaattatggcttactaattaaaaatagctttttaaacaaggtgaaataatgttggcattattagtagaaacagtgaagtcgcagttggattggggaagatgttgatgagtttgactgttgatggaaatatcaagaaggtggttagaaatatgaatcggagaatcagaagtatcagcaagcaggtggtttagtaaagaatttaaccttgcctaaagagatatctagcctttgtccttggagccttccaagggcatagagatctgggtgccttgggccacacctgatagtctaacagtgtggcacattattgaacgtgaggatggtctttgggacccccaaactctgtgattcatgtcagaagggaaggcagttggtggactgttcccaaaccttacacagatattatagatttgataggtaaaacagatcatataatggtaagtggtttaaaaaaacaaacaaaaaaaggatgcagagaggctgttcaatgacaagcctttgagaaatttaatggaatgcaagaggaaaaggaacacgtacaagaaacagacatagcagtcaaggaggtaggagagcaaccaagatatgtgttcattttgacctagagtggactgagatggcagccgtggtgttattctgaatgacacattcctgaacacattcagttgtgtaacccaaagtttatattgtttgaatatagatgggcagtcatacttgcagtcattccagatgtcagtggctcttgtcctcacttgtcagcccctgcataatctgcccttttggatctggaagtcgccagagggagcgcaggatccagaccggagtccccatgtgtgatctgttgtgatcctccttcctgctcctggcctgctcctgctggtgctgccattacccactaagagaatgctgtggcgttctgccacaaggctgtccccactgtactcagtgccagagcacagttgtgtggcatggcagtggtgagagaccagttcatatgtctgcaacagccccatgccatcacgccacagcgtgcccaccacccctatagccagtggcctcacccactggtccctggagtccagtttaattttttaaaaatttgtaaaaagagttataaaagaacttctagtcaaaaagaccaaagcccatgccatcatcacactcctcagattcttctttgtttttccttttctttatctttttcttttcggagaccgagtctggctctgtcacccagtcactgcaacctccgcctcccaggttcaagtgattcttgtgcctcagcctcctgagcagctgggattacaggcatccgccagcccacccatctaatttttgtatttttggtggagactgtgctttgccattttggccaggctggtctagaactcctggcttcaagtgatctgcccacctcagcctcccaaagtgctgggattacaggtgtgagccactgcatccggccgagattcttttttctttgcttacacttccttctcctcagctggagcagctgctctggacagggcaggacctactgttgatgcagcagcagctgctggagcaggtccaccaacccctacattaggatgagtctctcgatgtcaccataggccagggcctttgccaacaaaccaggccgaaaaggttcaacatttacaccacctactttaattagggccttgatttatcctctgtgacggtcacctcgttcatagtgaagaatgagggtggagtagatgcaggcgaattcaggggctgtggtgcgggcgagtggcggggctggtgctgctgttggatgcagtgcaagttgctggatgaagtgagggcctctccccagtgtgactgtagctttcccagaagtactgagccccttggcagcagctgaggaaagggctggagtctgggtttagaaagtgtcgacaattaacatggtggcttcttcttagctcattctctgtcccttcctccctccaccccctttaggctcactgtagcataagggtttttttccttttatgctcccagctaaaagctggaacactcttgcaagtctttttgttagttggggctatccaccaattctctttaagggcccaggcatgtttgattcttatttgggatctaaggtagtattctaaaaacatttacaaacagaacctgttacgagtaatatcttttctcttttatttcccatttggtgctaatttaaaaatggactgtattcttagagttctttattcagatttcactccttaacattgatgttctggattcagtagaattgttaaaattttttcctctttgttttggatcctgttttaacctggaattgaaaagagtgaaatgaagtaatggagttccagattttgttggggattttttgtctggtttatgttgactaggaagcagtaattgaaaacatgctattttttccctcatacattttaaaaaattgagatataatttgcaaacataacattctctgctttaaagggtacaattgtgtggttttcagtatattcacataattttgcaactcaccactttaaaattccagaacattttcatcattctccagaagaaatgactgtccattgacagccagtccctattctcctcccctctacaacccttagcaatcactaagctactttttgtctctattctggacattttcatataaacaaacacaatacatcactttttgtgtttggcttcttttacttataatgttttaaagattcattcttgttataccatgtattttattcattcatttcatgattaatatttcattttctggatgtatcacagcagttcatatacatttgggttgttatcacttttggctattgagaatatgctgctgtgaacatttgtatatgagttaaagtgtacatttgttttcatttctttggtatgtatctaggagtggaagtgctgggtcatatggtaatcacttaaggagctgtcagattatttccccagatggctgtgtcactgtatattcccaccagcaatcctatcttggttataatttactcacctttgtcccttttatgtttatttttcttgtgacttacttgcttctgtaattctattataatgaatgagttttacctatttttttaaaaaacctttgattgatcctgtcaatggcctcttcagctctgcttactacaccacgcatattcaccatgagactttaaacctgaacgtctggtcagacacccacaccaaaatccttcccttggacaatagtaattttgcctgtgttggtaacacactgagatggtggtggtctttccaaggctatatggtctgaggtataaaaaaagagttttcaagacggaaggatttaataatagcatttagtttaagctaaatttcagtttcaggaaggtaaaagctgacaggaacagtgaactacctgtggggaattctctagagactcatgtgtggggccagtgatgagtcaggcagatgtcaaggtgaggatatattagcaaagcatagcagattattcggtgaaatttagcaatgaaatgattgtagcttctagggagtggggtcagatttgtgcaagaaaaagcatttattttagtgtgacatatctgggcatatttctaggcagaagagataaggtttgagtagagttgaaaggccagcaacaaaggaattaaatgagtgatttttggagctagttgatcagtcttttaaagattgaaggcacatcttacctgcagaaccgaggaggaggttttgcatagctgttgtggtgagcagaataaagaccgttgtgattattgttgtataataaattatcctcaaacttagccttaaacccctttttaattttgttcatgattttatgtatcaagaatttagaaaagacaaagctgggatggcttgcccattgcttcacggtatctggggcctcaactgagacatctcaagggcttgatgtggcttcatggctggggactagaattaactgaaagcttacatctggcccctgggctagaaagataaacaactaggacagccttatggagcacctatccatgccctttgcatatggcttggctttctcagagcatggtggcctcagagcagtcatacttcctacctggcaacttagagttcccaaaggtaacacacaccttccagagtggaagctgtgttccttttatgacctagcctcaaaagtcacacagtctcatccactatattctttttggttagaagcacatcagacgctcattcagtttcatgattagagtccatttcttgatagtagaacatcagagtagaagggatagtagaagagcaggtagttggggagatactgtttcggcctttgttgaagaacacagtccgtcagaatacagcaacaagaaatcaataaagcagccatagagaatgaaatgatttcctttgcagcaacatggatgaagctggaggccattattttaagtgaaaaaacttagaaactgaaaatcagctactgcatgttctttcttgtaagtgggaactaaacaatgggcacacatggacttaaagatggaaacaatagacactgaggactccaaaaggggcaaagttgggagggtggtgtggcttgataattacctattgggtataatggtcactatttggttgatgggtataccggaagcccaaaccccaccattgtgtaatatatacacataacaaacctgcacatgtactccctgaatctaaaataaaatttaaaaagtaaaaacctataagcaagggcattcttcctactgtcaaatgatacaacattcatagaaatagagatttgtgtagtttgaaaataccttatataaatcaagatgaaacctttattttgcagacattaaacctaaagttgactgataaagacatattcgtcccatagcccagaacattctaggggaataaaatctataaaaagatgcagacttccaaatatatgtagttatagttatgtaggtacagtaaactaacccccttttttaggacatgtatttatctaattctctttttgtctggcatggattataagccttctaagcctagagtctactaagtatgtctaaattgctatgttgggtgcctaacaaaggagtatgtacaagttggtgcatgagttagactttttgatggtgattaaactggaaagcatgaattattcttggattataaaactaggtggggctttcgagtgaggctcaaaaatcagttttgttttccacatagagaccttttacttattctttttgtagtcagtttgtctctaagaccttttttctctttctcattttttagaataattaagaatttcattagagtagtttagaatttagattatttacagtgtattattattattattttttgacaagagaacgtaacatacacctgggaacatgtcttcagttatgagtcagacatggatatgtgctataatatatacccttgcactccatgaacagcaggagcctgaaataggtcctaacctttggaaggaacttaattttttagttatattttgaggttggaatgtggataattagggcttttagttttaaacagccagagagctgttttctgagttattttaattgttaaatttttttagttactaagaattttttcttttagatataaatcttatttctttttctctttttttaattttttcttttaaaagaaatctcatgtcttaagtggattctgatttctgaattctactttgactcagctaagactttctcattctaagatcagttatgtttcttcagttcataattcaatatattatacatttatttatctgaaacataattaagaaccgagaaatgagcccaaagtttttgaacagatacaaacaatgtccaagttcacgtactaaagttcatgtactcaagctcatgttctttattctggaggaaagtccttttaatgatctcatagaatgtctactcctcctttgcccatgaaacaaggagaaggttaagaataagaaggaattagaaataatatataaaaactatcataaagtcccaataaacattgcagcctagataaagtggtaaaattcttagatggaaagaccacatgacttattaggggataaccagattgttattaagtatttttgcagcaaaatgttaggccagaagacactagagaagtacatttaacatactcaaggaaagaaaatgtcagtcaaatattttacatccagccaaactgaccttcattatacaaatctcatacaaactgttatatacatttaagcactgagggaatattgttcttttgaacactgaagttaaaagcttctagcaacctaaatcaaggaagaggcctgtatagacatacagactgctttcattaaaatacaaagtatacctgaaaaatcaaatctgtagcattcctctgggacacttagcttatagaatactattaagcgtcttaactagacagttaaatggacttgaaagatcgtgtatttggtttccatagaaatttaagggtaaattttataacaacatatattttgtaacagtggtttggattattctgtcaaggtatcctaaagagagaaatagctgtgtctggcattatgtatgtaagaaataaaggaaaaatattagtaatagaccaggtgtggtggctcactcctataatcccagcactttgagaggccaaggtgggcagatcatttgaggtcaggagttcgagaccagcctgaccaacatagtaaaaccccgtctctactaaaaatacaaaaaaaattagccaggtgtggtggcacattcctgtactcccagctactccggaggctgaggcaggagaatggcttgaacctgggaggcggaggttgcagtgagctgggatcatgccactacactccagcctgcacaacagagagactccatctcaaaaaaaaaaaaaaaaaaaaaattggtaatagtgtacgttaactctttttagttatggaatctgagatttacagggtatcagtatacttaaaatacattcagcgaagttgaacacttagttgtatttgtgtgtatgagaaaaaacagcttgtttcccaaattacagagtcaagtaaatctctagacatggcctcttaaaaacagccacgcagggcgtggtggctcacacctgtaaccctagcagtttgggaggccaaggtgggcagatcatttgaggtcaggaattgtagaccagcctgactaacatggtgaaaaccccatctttactaaaaatacaaaaaaattagccaggtgtggtggcacatgcctgtactcctagctactctggaggctgaggcaggataatggcttgaacctaggaggtggagattgcagtgatctgggatcatgccactgcactccagcctgggcaacagagtgagactctgtctcaaaaaaacaaaaatagacaaacaaacaaacaaaaaaaacccgctagccatttacgatctgatatgttaaccattgtgcagttgtaggattcctgctgatccccaagtgcatttaaaattgtgttctaaagtactcttggtattgagacatggttctggagtgttctagactagaatgtagattaggattttagttattggcttgtatagtaatgtgactttgcattgtgagctcttattctctagggttttttctgaaaaatcagtatcagtatattgaagaaaattttttacacagctacaaacttatagcactaaaatgacaaaaaaagatgattagtcataaaaacataagagatccttatttgtatttaaataattttctttgtctagaatttgattccagctttgtaaatgtatggagcttttagtgaactttaacttcataaatgtttgtggatcccgtgatagcttggctcaggatcttgtaaatactatcacagctcagtctttcttactagtttgccttgagtactacacattttaattttacattgtaatagaaatatgatttttttttcccctatacagttgtcttcgtagtgttttatatgatactacttgggatatatttagattagtagtttactttccctccttctggtcataagagataaggggaaatcttctaataaatactttgttaattttttccttacaagtaacaaagtcaaaacttgccaggcactgtggctcacgcctgtaatcccagcactttgggaggccaaggcaggtggattgcttgaggctaggagtttgagaccagcctggccaacatggccaaatcccatctctacttaaaaataaataaataaaaaacacaaaaattagccgggcatgttggtgcacatctgtaattccagctacttgggagactgagacacaagagttgcttgaacccaggaggtggaggttgcagtgagctgagattgtgccgctgcacttcagtctgggcagcagggtgagactccatctcaaaaaaaaaaaaaaaggcggggggggaaacaaagtcacaagttttgcacaaatctcaaggctcttcaaagtctgattcaatgtaccattcttgttttctttctcagcctcaaacatagttaatttatttcaccttaaactgctgtgcttgtcgtcatgctatccttttttacgtcagggctttcctcttttttgctgttagagtatacggttgaattttttttttttttttttttttgagacagagtcttgcacttgttgcccaggctggagtgcagtggtgtgatcttggctcactgcaacctccacctcctgggttcaagcgattctcctgcctcagcctcctgaatagctgggattacaggtgcctgccaccacgcttggctaatttttttgtatttttagtagagttggggtttcatcatgctggccaggctggtcttgaactcctgacctcaagtgatccacccgccttggcccccgaaagtgctgggattacaggcgtgagcccccgcgcctggccatctcagttgaattttagcctacatttggtttttgtgtgtgtgttttctgtttttttttttttttacttttatcttaggttcaggggtacatgtatgtgcacatgtgttatgtaggtaaactgtgtgtcacggggatttggtgtatagattatttcatcacccaggtaataagcatagtgccctatagatgttttttctaattctctctgttcttccaccctccatcctcaagtatgccccagtgtctgttgttcccctctttgtgtctttgtgttctcattgtttacttcccacttatacatgggaacatgaggtatttggtttctgctcctgtgttagtttgccaagggtaatgaatggcctccagctccatccatgttcctgcagcggacatgatcttgttctttttttatagctacatagtattccatggtatatgtgtaccacggtttctttatccagtctactgttgatgagcattgcttccatgcctttgtcattgggaatagtgtcgcagtgaacatacacgtgcgtgcgtgtgtctttacagtagaacagtttatattcctttcggtgtatacacaataaggaattgctgggtcgaatgataactctgtttaaatttccttgaggaattgccatactgatttccacaatggctgaactaatttacactcccacctgcagagtataagcattcccttttctccacaaccttgacaacatctgttaattttgtgactttttagtagccattctgactggtgtgagatggtgtttcatcgtggtttcaatttgcatttctctaatgattagtgatgttgagcaggtttttatatgcttattggccgcatgtacgtcttcttttgaaaatgtctattcatgtcctttgcacactctttaatggggtggttttttgcttgtatatgtgtttaagttctgtgtagattctggatattatacctttgtcagatgctttgtttgtaaatatttctgccatcctgtaggttgtttactctgttgatagtttattttgctgttcaggaagttcttaggttccctttgtcagtttttggttttgttgcaattgcttttgacattttcatcatgaaatctttgccaggtcctatgtccagaatggtatttcctagattatcttccaggcttttattttttcttgttgttgttgagacaaagtcttgctgtgtcacccaggctggagtgcagtggcaccatctcggctcactgcaaccttcatctcccgggttaaagtgattctcctgcctcagcctccccagtagctgggattaaaggcatgcgccaccacacctggctaatttttgtatttttttagtagagacagggtttcaccatgttggccagactggtctcgaactcccaacctcaagtgatctgcctgccttggtcccccaaagtgttaggattagagacgtgagccactgcacccagcctttccagggtttttatagttttaggttgtacatttaactcttaatccatcttgatttttgtatatggtgtaaggaaggggtgcggtttcagtcttctgcatatggctagcaagtaattctagcaccacttatggactaggaagtccattccccattgcttgtttctgtcagctttgtcaaagatcagctggttgtaggtgtgtggcattatttttgggctctctactctgttccattggtctttgtgtttgtttttgcatcagtgccatgctgttttggttactgtcaccttttagtatactttgacatcaggtaacgtgattcttcctgctttgttctttttgcttaggattgccttggctatttgggcttttttggttccttatggactttaagatctttctaattctgtgaagaatgccatttatagtttgataggaatagcattgaatctgtaaattgtttcaggcagtatagctgttttaacaatattgatttttcctgtccatgggcatggactgtttttccatttgtatcatctctgatttctttgagagtgttttgtaattcttattgtagagatctttcacttccctggttagctgtactccaagatattttattcttttttttttttttttttttttttgagatggactcttactgtgttgcccaggctggagtgcaatggcgcaatctcagctcactgcaacctctgcctcctgggttcaagtgattctcctgcctcagcctccccagtagctaggattaaaggcatgcgccaccacacccggctaatctttgtatttttagtggagatgcggtttcaccatgatggccaggctggtctcaaactcctgacctcaagggatccgcctgcctcagcctcccaaagtgctcggattacagacattagccaccatccctggtcttttaattttttaagtgacatttaccagctgtaaattatcatacctgaattgctatttgggctactgtagtgaatcggattatgctttgggccagttagttttacagttttaaatagccatagacaatactcttaactctgacctgctcatttgttaatctgtcattagtcacagtgggttagagtactggcagaacagtaaacactaacgtggcacataatatatacccaggtatagttttgagtgaggtagctggggcaagtgctgacacaggttaagtaactggcttaatgttatagtagtaaatgccaatgctgatattcaaatcgacatccctgaattcaagcataaatatctgttaagtaattggtagtaggcaggggtttagaattatgtgttggccttgacatgaacattttaggtattcagggttgctcaatcaacggactgacctttaatctgtgtgatttcactgcaaaaatggtttctgaatccatttatatttttatattttataaaaagaaaacactattttccttattagtaatttaaagcacaatttacattcaccacagcataatttttgatagtattattattattagtgtttcttctgtggtgaatgtaatttaaattgtggtttaaattactaatgaggaaaatagtgttttcatttatatttatcttacccttaagtaatttttgttgttacttgttttttttgttttgttttgagagagggccttactttgtctcccaggttggagtgcagtggtgtcatcactactcattgcagcttcgacctcctggacccaagtgatccttcggagtagctgggatcatacgcatgcgccaccatgcccagcaaaattttttaaattttggaatgatgggggactctcactcttttgcccaggctagtctcgaactcctggcttcaagtgatcctcctgcctcatgtgtgattatcagcggcgtgagccaccatgcccagcctgttgttacttttttaggttgtagataagtaggaatcctcccgtgtcttttggaatattagcctttgctctggtttttcctctagagcagtctcccattcattactgttataggaaatatttgactgtaataacagagattgacttgtattcaagagttcttaaataacaatggcttctctgattgactgcttttgaatttcttccagtttcaagggagtttaatggttgtgccagaggcttcattattgtttatatttttggttgctactaagtgcttttaaaaacgtccttagtcttgatgctttttttatatttagtattattattattagtgtttttgctgtggtgaatgtaatttaaattgtgctttaaattactgatgaggaaagtagtgttttcttagattgaaacatttttattgatatcacctacaggcattttcttcacagctcagggaatgtgactgtcaaatcttaggaagaatgtgttgtgaatttttttttttttttttttttgagacggagtctcgctcagtcgcccaggctggagtgcagtggtgcgatctcagctcactgcaagctccaccttccgggttcacgccgttctcctgcctcagcctcccgagtagctgggactacaggcgcccgccactatgcccacctggctaatttttttttgtatttttagtagagatgaggtttcaccgtgttagccagggtggtctcgatctcctgatcttgtgatccgcccgtctcggcctcccaaagtgctaggattacaggcgtgagccaccgtgcctagcctgttttttctgtttttgtttttgtttttttaagagcagttttaggttcactgcaaaattgaaagcacagtgataacctatgaactccctgccctgacgcatgcatagccgcccccaggatgagcatcctccttcagagtagtacatttgttagaattggtaaacctccattgacacatcatttgtactgtttttaaaaacttacattttaactcttttatgttgaaaatcttggtttttaaatgacatttacctatttgttttatcttgtaaatgagatatttcaataatattcataagaacatcattgacaacaaatatgctaaggttttaagattttcttgcagtcctttgtgtccttacattgtatcacacatcttaataatctaaagatatcctttcattgaagtaaaaagattggttgcatatgttctaaataatttttttttcagtgaagaaaagtggtggttagtgcatacataatagcaagtcatgccgtctattctcagtgcttttaaaaaaagcaagtcatcaaaaggtttcattgatatctctgcatatcatgtttttattttcactttaccagctcttttttatgtgtttttttttcctgatttaatcactttcctgacaattaccaggtactttttggaagtggttaatattagcggaattgcagcatgtataaccaagaaggtattaacatgtatacggaatatctacagtgataagaaaatgacagtccattagaaaagtgatcaaaatcattgaacagattcttacttcactcaagaaaatatatgactaggcagggcatgatggcttgcgcctgtaatcccagcactttgggaggccggggcaggcggatcacctgaggtcaagagttcaagaacagcctggccaacatggtgaaaccctgtctctactaaaaatacaaaaattagccaggcgtggtatatatatatatacacacacacacacacacacacatatacacacatacatacatacatacacacacacacacacatacacatacatatatatgtacacacacacatgcatacatctatatatatgtatgtaaaaccatatgccactgtgcatatatatatatatatacacacacgtatacacacacacacacacacacatatatacatacacacacacacacacacacacatatatgcaaaaccacatacatctctgtggcttgtctgtgaataaagataaattttatttcttttttttccagcagtgatgcctttttatttattttgcatgactgtactagttagagcttccaaaacagcagactagaaatggggagagcagacatccttatcttgtttctgatattagggggaaagcatttggtctttaatagttaaatctgatgttatctgtgggcttttcattgatgttcctctattcctgcttcattgagaattgtgatcaagaatgaatgtttcatattgtcagatgattttctgtgtctgatgtgctcatcatatagattttcttttttagcatattaattatgatgaattacatcagttggattttgaatactgacccaagtttgtgttcctggaataaaccccatttgatcatgatgttttatccttttgatatattatttgatttgatttgttgaacgtttgtctggaacgtttgtatccacattatgaggaaaattggtctgcagttttcttataatgtctttgcctggctttggaataaaaaatgctggcttcataggatcaaaactggaagtatttcctctttttttactttttaggaggaatttgtagtatttttttcataatatcaagataaaatataccaatgcattttttatgggaagattttgaacaataaattcattttttaaaatagatacatggtttttcagatttttttttctgtttggaccttgagtggtttgtgacttttcaggtatttgtccattttatctaagttttcacatgtataggtataacatgataatattcccttctatctttttaatacctcaaaaatacatagtgacattacctcactcattgctcatgatggtaatttgtgttttctctcactgcccaatctgcctggcccgaaatttgttaattgcttttattttcttaaagaaccagcttttgttttcactgattttctcgactgttcttatgcttttttgttttacttatttatagttcatattattattatattttcattcttccgtttgctttgggttaagtttgctatttttttagttttctaaggtggaaactaagattacttttttgagatcttttctggtataggcatttagtgctataaatttccctctgagtttgctttaacagcatttcatagattctgatatattaagttttcattttcacttaatgtaagaaatacttgctattttctttttgatttcttctttatcccatgggttatttttgaattgtgttacttagtttccaaatttctgagtattttctcttcttggtttgtaatttaattctgttatggtctgaggacatactttgtgtgatttgaatcctcttctttctttctttttttttttttgaaacggagtttaactctgtggcccaggctgcagtgcagtggtgtgatctcgactccgcaacctctgcctcctgggttcaagagattctgcctcatcatcccaaatagctgggactacaggcgtgcaccaccacgcccagctaatttttgtatttttagtaagagaggcgtttttgtcacattagccaggctggtcttgaattcctgacttcaggtgatccacctgcctcggcctcccaaattgttgtgattacaggcatgagccaccatgcccagccgaatcctcttatttctattgagacttgttttatggtctagtacattatatatcttggtaaatgttttgtgtgcccttgaaaagagtatttgttgttgagtgtagtgatctataaatggtaattaggtcaagctggttgatagtgtgttcaaatcttccatatccttactgattttatgtctgcttgcttttatcagttttgggggaaggaaatattaaaatcttcagtgacacagaatgtgtctttatgttatgttactgtgaacaaatttcttttttccaccccttcctttttttaatcattgtgtgtgttgggggtgattctcagctttccctagtcctttgaaagttttcagtggttatgtagagaaaccccacaatcagagggctgagaaagcattctcagcggaactcaggtaatacttaatattatctttattaagaaaataaagagactttgttgaaaatacttccagaacattgtcatggagttctgaacttctggttaactccataaatagaatctatttttgctaggcaaggaaaagggaacctttatctttggccagtaagtctcccaaataggtaaaaaggagagttttaaaattttcttctttggagtcttcttattagcataggtagagttttagttacagaaatcttggctgtgctagaggcatggaagtagaagaaaccagagcaatgaatttaatggttacttaacagtttgttcttgttctctttgtgtttgtaatccgataagagtttttttttttttttattagagacagggtctcactgtactgcccaggctggtgtcgaactcttgggctcaaacaatccacctgcctcagccttccaaagtgctaggattacaggtgtgagccactgcacccggctaagatttgtttttttaagcagccaaaaaaaaaaaaaaaaacaccaacacacaactatttgataaatgcatggtttttatattaaatagtacaaatagtgaagtgtacaggtgttatcaaccaaactcttaagtcatggtgatcttcaagtgcctgaggctttctggcaccctgcctaatgctattagcagggtccatagcagtgttattgtcccatactccttttctgttctctggtgaagcagcaaactgaataaagtttgagtctttgtctagtgactgtacttgttttcttgtgtgctgggcaatgtggtagaccatggggttccattgctaatagccattatggtgcacatagttaactaagcccagggaattggggtcatttctggtggagttactggagtgttcattttttcagattccctgggtattaggttagtgtggtctggtgcacggggacagagaccactcttctggcagcatgggtgttagaggagatgccctgtgagcaaggctgccattctgtgagaagggaatgaaaaatgaatggtcagaagatacttgattgtgtaggaaaccaggagttacaatatgagaatatacatagacttgaaattgtgtatatcacgttttcaaaatagaagtaagttaagtgcgttatactttcagttgttttaaaaatactattactagccaggcatggtggcatgtacttcttggaggctgagttgagaagattgcttgaacccaggagttcaaggatgtagtaagccctgttcgtgctgctctactgcactccagcctgggtgacagagctagcccgcatctctttaaaaaaaaaatgcccctcttgtgtaatttgcctttttatagagataatatttttagctagactgagggcttcagggatactttactccagtagtaattttgttgttgttagctttcaaagcccttgagaaaaggagctgctatgcttacactgtgattacattggaaatagtgctcttctgtttttgctcacatgtatacacttcggctaattgagaatttgaatctgaaacatatactagtgatacaggtttctttttatgcataaattatttttaaatttagtgacaaatattagcaataatgtacgtttaagtagtatatagattttaattaagacatcccatgttttctgtgtactaagaccaggaagcagtcctctagttattaaaattggagtgtatttcttactagttgataaaacatgggttttggagtcatacctagtttccagccgtgaacctagtacttcataatctatgatacttggtgttctctgtagcattgtagaaataataccatctactttgtatggtggtttcaagaattatggtagatcagtctttcctaaatacttgtgttataaaatgtaactaggtctctgaagaaataattccatgaacacgtatgtcaggaatatgcagcattttctgttctcttaaaggttctcactctgtattaaaacattaggcctatggtcaagaaatctgcttttctttgttcaacactgcgtttctcaaacagaacttctcccttcttccttcctactcccctgctcctctattgaacacctgcagtatattatagtttatttttgtttcatggaacatagttttgaaaataaagtgcctcgcacagtgttcctaattatactggataaactgtttcatttcctgctttgaatgttaattttaatggtttgaaaactgtattgtaggctgggcgcagtggctcatgcctgtaatcccagcattttgggaggccaaggtgggtggatcacctgaggtcaagagttagagaccagcctgaccaacatggcaaaaccctgtctctactaaaaacgcaaaaattagccaggtgtggtggtgcaagcctgtaatcccagctacatgggaggctgaggcaggagaatggcttgaacccaggaggtggaggttgcagtgagccgagatggccagtgcactctagcctgggtaacagcgaaactcggtctcaaaaaatataaataaataaataaataaataactgtattataaactcagagctcatttcttttaattaattttagtttaatcttctaagtagtaagccatttaataatttgctacattttattcctaattcactatcatttagttcatatatttagcccaaaatgttgtcatacaccttgagattcaaatccaggacaagcaagtgcagaggcagtagaagggtaagaatctcacgaactcagtatctggtcagattcctgcttcactaatccaacacaatttaaatgttcagaaatatattcttgaagtattattgagagccctctgggaatatattgaaggatctggttagatacttcctataactgctctagagctcttaagactaggcacaagccatccacatctttattgagtaatttgtaagaattctgcagattaaaaaagaaataacatctttacaataaaaaagcaaatgttaaaagaatgaaaaatctgtttccaaagtaaaaaagtagtaaaatattgttttagaaaaattgaagaaattgaaaaagcatagataaaaagaataaaatgtagataaagagacttaagagtaattttatacccaggaatgtccattcctaacatcttatcctccgtatttcacaaaaagtgtaccatattatccatgctagtttgtagcttgcttattctgcttaaaaatgcgaagtgaagaacttctcatgccagatatcagtgaggcaccctacttgccctcaagaatctaccttaatagggtgccctctatagctgatttcttcctctcccttcccgtcccctcccctcccctcccctttctttcttttcttttttcttttccttgcctgcctttccttccttccttccttccttcctctctttctttctttctttctctttctttctttctttctctttctttctttctttctttctttctttctttctttctttctttctttcctttttctttttctttctcctttctttctttctttctttctttctttctttctttctttctttctttctttctttctttcttcctttctttctctttctctcctttctttctctttctctccctctctctctccctccctccctccctccctcccgtccttccttccttccttccttccttccttccttcctccctttcttccctttctttccttttctttctttcttgtctttcttgtctttcttggtggagtctcactctgtaacccaggctggagtgcagtggcttgatcttggctcactgtaacctctgcttcctgggttcaagcaattcttcttcatcagcctcccgagtagctgggattacaggagttcgccagcacacctgactaattttttgtatttttagtagagatggggtttcaccgtgttggccaggctggtcttgaactccagacctcaggtgatctgcccgccttggcctcccaaagtgctgggattacaggtgtgagccaccgtgcccggcctcatttcttcatttgtgaggaatgtttccaggcaggagttaggagttggcagaagagtgatgagaggaacaagccctgttagagggtaaattaagacatcattgtacagtttctagttattaataaaccattaatgtatgcagaattatacagagtaaacattgtttattttggtcagttttcttgcacatatccaaaaagatttgaatttaacttgtttaggagaaaaaaagtctttaaataccaagagctggtatgtgcataacgtacacacctagattgaaatacagaaccttggccaggtgtggtggctcatgcctataatcccagcactttgggaggggagatgtgcggattgtttgagcctaggagttcaagaccaacctgggtaatgtggtgaaaccctgtccctacaaaaaatacaaaaattagctgggcatggtggtgtgtgcctgtagttccagctacctgggaggctgaggtgggaggacctcttcagcctgggaatcagaggttgcattgagctgagatcatgccattgcactccagtctagacaacagagtgagaccctgtcttaaaaataaataagtaaatagagaacctcaagttatcattacggtgtgctagatggttcattgcctctttaaattaaattaaaacaagaagtctaataggaattcatagaacactttttggtcaggctgtctggattgcagtcgcacacttttcactcaggctcattgcagcctccacctcccagtttcaagtgattctctcccctcagcctcctaagtagctgggattacaggtgctcgccaccatgccctgctgatttttgtatttttcgtagagactggatttcaccatgttggccaggctggtctcgtactcctgatctgaaatgatccacctgccttggcctcccaaagtgctgagattacaggtgtaagccaccacatccagccaacactttttcttgttgaaagatattcctgaaaaaaatgttgtattattaaacatgttttagtctgcatgtattatgtagagctttctttaatgacatcaagaatgacaaaagagatgaaatgtttattactacttttcgaatattttgaatttttttctttctttcttgttttttaaggtggatatcatccagtgaaaattggagacctcttcaatggccggtatcatgttattagaaagcttggatgggggcacttctctactgtctggctgtgctgggatatgcagtaagtgttctttgtcatttgtgcatttgtttcctggagtagttcaacatctgtgttctaagaaggtatggctgagggtcaccactgctttgttgaggtatgtgaagtgcttagcacaggcctgcctcagctggctagattccttcctgccccctgccttagtttgaagttcatttgaaatcttaaaatattacttgcttccagctttatttcaaagttaattcattgaaattgttttacactgggattatattatttttctagtaattcatccatatcagacaaacataatgtatagtataggcgtttcaaatcagtcatttttaacttttcaaagccatgacccatagtaagaaacttcattgctactccatacacacacacacacacacacacacacacacacacacatttggtgcgtgtgtgtgtgtgtgtgtactgaaacaaaagtgttaaaagagaatggttttcactattaggttggtgtgtaatattcgtgataactctgatgtttatctagtcttattttaattagggaaaaaacaaaacaaaacataaaagagattgtcttgacccatactactatttaatgtggccccaccatttgaaaagtactattttaaaggaaagcttatgtttctgtgtattggatagatctcattacaagttgaatatcccttatctgaaatgctttgagaccagaagtgttttggattttggaatatttgtgtatatacacaatgacctatcttggagatgtgacccagatctaaacacaaaattcattatatttcatatacaccatatacacataccctgaaggcaattttatacgatattttaaataatcttgtgcaacatgcaaatcttttactgagttttgattgcagtcagaggtggaattttacactgtggcatcgtgttgacacactcataatgttttaggttttggcgcattttggattttacattttccaattagggatgctcaacctggataccagtgattctttctactgataatatagataaatagactctttttttgttttttcttttagggggaaaagatttgttgcaatgaaagttgtaaaaagtgcccagcattatacggagacagccttggatgaaataaaattgctcaaatgtgtaagtactttaaaaatgtgaatgatataagaaaacttaatgacttaaaattttacagaaagatttttctgggtaatactaaattaaagtcaagtttggctgggcacggtggctcatgcctataatctcagcactttgggaggccaaagcgagcagatcacttgaggtcaagagttcgagaccagcctggcaaacacggtgaaaccccatctctgctaaaaatataaaaaatagccaggcatggtggtgggcacctgtaatctcagctccttgggaggctgaggcatgagtatcacttgaacctgggaggcagaggttgcagtgagccgagatcgtaccactgcactccagactgggcgatagagcaagactctgtctcaaaaaataaataaataaataaataaataaagtttattttttataactttgtgatgaattttttattttaaaatatacttttatttaaacagtattggtgttataatgggaaaacatgctttgtctcaaactcctgtgttcttgcattcatttttcttggcataggttcgagaaagtgatcccagtgacccaaacaaagacatggtggtccagctcattgacgacttcaagatttcaggcatgaatgggatacgtatcctttacttcctgatttatttgtatttttaccttttaaaaaatgaaaatatttcaagctcctataatctctgtttactgctgtatcaccttcaacataaacactctaggaacattgtcaagtattatgaagtggtccacctagaatagttttcatggctttttggggtgtttggtagagtagcatcttagaaacttatttttaacacaacaacttgacttaattttggtgtggaattaattattgatctcttcccattaatagtggtaaagttttttttgtggtggtagataaaagcatacatcagcaccacttctttgtgttttaaactttctaaaaccagtgcataaggacaatctgtgtgtgccccagtggctgcaaagcaccatgtgaaaatggagcattggttaagataaaaggaaaaatgctctgtaaatgtccacatcccaaggtggcgcttgactgctcttagttctgaatagtactaataattgccaaattctttttccaaaatgatacaactgagcctttcaaataattgtcctgcagaggctcatctttctgtcaggtgagtatggaaacattttggttttcttgattttattcctggttatctatattgcaaaagttaaggaaaagtaaaatgatgcattttctatactctgcattttctatactccttgataaatctgacataagccagtgcttgatcgaaaatacctttattgtttttctttacaaacttattgggagaaatttcaaacatataagaaagagatcatactacagtaaattgttgtaaattcgtcactcaagtttaataattgtcatggtctggccataattgatccatctatcttttcttgctgaattattatagagcaaatcctagaagtcatgtccttttacttctgtgtcattgtgaatctttgaaaaaaatatgaacttttaaacataaccttaaaactcaccaaagacattaacgggttcttgatatctcgtcagatatcgttggtattggagacttcttaatacagatttccttggtattgcaaaaatgaacttttaaagacatatttgaatcatttttaacaatattgtttactcctaagtctgtattcacttactttagttgttcagtttcagattaatttgctcaatttacatttttctgtttcttgttagactatgatccacagagtatttaaattatcctgacagaagttagtgattcttaacagaggaaagtgtttcttggtcagctataagtgtaggtgtttctcatgttttttaaaaggatggatggccttagtcgtaatgtgtccgtttccttctggtgggttcttggtctcactgacttcaagaatgaagctgcggaccttgcagtgagtgttacagctcttaaaggtggcgcatccagagttgtttgttcctcccggtgggttcgtggtctcgctgacttcaggaatgaagccacagaccctcatggtgagtgttacagctcttaaagttggtgtggacccaaaaagtgagcagcaacaagatttattttgaagagtgaaagaacaaagcttccacagcatggaaggggacccaagcaggttgctgctgctggttcgggtggccagcttttattccctcatttgtccgtgcccacgttggagaaatggacctgccgattggtccattttacagagtgctgattggtgcatttacaatcctttaggtagacacagtgctgattagtgtgtttttacagattgctgattggtgcatttacaatcctttagacacagaccactggtcagtgcgtttttacagagtgctgattggtgcatttacaatcctttagctagacacagagcactgattggtgcatttacaatctttagatagacacagagcactgattggtgcatttacagtcctctagctagacagaaaagttttcaaagtccccactcgacccaggaagtccagctggcttcacctctcactaatactagttatctttggaagtgtgtctaggaagaagacaagcaaaggtgtcccttgactttcctttcttttttgagaatatcagttttgaccatgctactaagttatgtggatgcttgttggttttgatggggactcaggaggaagtgaattaggattgtagaaagggttggcatgttatccttatccttcctctacctgaggagttggcaaagggtagctccagggagaagtgacagagagcaaagtatcccaaaacctgtagctcagagaagaaagcaaaaatgaagagaagagatgatgccttcagtgtcatgagtactttttctttatgtgggtgttggatcctctgagatagccctttgtgtgcctggagtaggcagtactttcattttccaaggttcaagaaaatcggaccactttactcagaggcacatgactgatgggtgctaggttgtgtcagtagctgtggtcttctggcttctttcagattttttgctctttatatcatgtttggaacagatccaccattttgatattttactttcacaaatgtcagaagcctaaggataaggctttttcccagatttaaactccaaaatgacatccagtttatgcatctactaagtcatgatcaactagggaagcatttccttcactctatatatttgagaaggtttttatacaagggaatgtcaccatgttcatagaaaaactagattaaaagacaaaaataaagaatataaactttatttctcacataagtttcatcaagttcaagacacttttgtaaacaatcatatcagccatttagttgctccccaaagaaccaggggtcttaggaatttaaccatgtcagtgaaatcttttttacattattaactgaagaaaaatgggtgccctttttaagattaagaaacaaaaattaggagtagccaaataaggataataaggtggatgtctaatgagtttccactgaaactcttcacaaaattgccctcgtttgatgagaggaatgaacaggaacatttacatggtggagaaggactccttggtgaagttttctgaggtattttcctgctaaagcattcactgactttctcaaaattagctctcataataagcaggtgttatcattctttggttctccataaagtcaacaagcaaaatgcctcagcatcccaaaaaacggttgcagtgacctttcctcttcactagttcactagtgctttgactggaccactgccacctcttggtagttattgctttgattgtgctttgtcttcaggatcatactgtagaaccatgttttatgtcctgttacagtcctttgaagaaatgcctcaggatctcgatcgtacctgtttaaaatttccgttgaaagctctgctcttgtcttgatctgggaacaatggttttggcacccattgagtggaaagtttgctcaacttcagttttcaattggaattgcataagttgaaccagtcgtgaagtctgtggtgttggctgttgtttgtgctgtcatctgtcctcttcaattagggtgcaaactttttttttctttgagatggaattttgctcttgttgcgcaggctggagtgcaatggtgcagtcacggctcagcacaacctccgcctcccgggttcaagagattctcctgcctcagcctcctgagtagctgggattacaggcatgtgccaccacgcccagctaattttgtatttattttttattttttatttttttagagacgggatttctccatgtgggtcaggctggtctcgaattcccgacctcaggtgatctgcccgcctcagcttcccaaagtgctgggattacaggtgtgagccaccatgcccggccgcaaactttttttccacacaaattgatgcaaatggtctgccgctgcaggcttcatcttcaacattatctcatcccttcttaaaaccggttattcatttgtaaactgccgatttatttgcggtattgtccccttaaacttaccataaagcatcagtgatttcaccattttttcacccaagcttcatcataaatttgatgtttgttattgctttgattttagaattcatgttgctctgttagaggcttttttcaaactgatgtcttatcttgcgagtgcctcaaactagatcctgttcagatactttaacaaactagtatgagtttattttggtgcaaaaaaatttttgaaatctatgcatagtgttttcaaaatacacattttccatagactttttgaaaatccctcatatttcttttagaaattcatcttgagtatactaggaagtaccagtggctgctaatgttacctcgtcctttttctccagttaatttctgctaactgctgagtatatttttccctttggatagataaatcagtaagcagatagcggcagagcactcacttcttctgtgtccgacttgcaaggtccttcttgggacagctaatagaacatttctttggagaaactacttaatccgtgggtaaatagaggtttttgaaatatacgttctagtgggtatttttactgttaagcaaaatgcgaagtaatcatcatatccagatatgccagtgctttgagaagacttaggttatgtttgggatatcctgggcctcgccctatgcctgctgctaaatgtagtccttaaataatctgccgtttttgtaatgagcctgggaaatagtaagaaacttctggctttagattatctgcgcataaatctgtagtgcttacattcttaaacagtatagaaagatttttctttttttcactaaaaatatttaaaataatattgttttaatatagcatattcagttattatagttgattaaatcaactactttttttgattctaaagtcaaatgtaagcctccagggatgaataaaatgttctcaaagggtttcagagccatttgtaatcttcctgtatgaatgacatgaatatataatgaaattggaggtatcatagttgtgaaggctgaaatacctattttaaaaaaaaattaagttggggccaggtgtggtggctcatgcctgtaatcccagcactttgggagaccaaggtgtgtggatcacttgagattaggagtttgagaccagcctggccaacatggtgaaaccctgtctctactaaaactggaaaaatcaactgggcatagtggcacacgcctgtaatcccagctatttgggaggccgaggtaggagaatcgcttgaacccaggaggtggaggttgcagtgagctgagatcgtgccactgcactccagcctgggtgacagaacaagactgtgtctcaaaaaaaaattaagctgggcatggtggttttcacctgtagtactgactacttgggaatctaaggcaagagagtatctttagcccaggagttctagtccacctggcacagcgtagtgagaccctgtcttttttaagaaaagaaaatccagattcctgagatgttgttactatagattaagtcttaataccatgtcttaaatggtgatcatacattcttaacacctgcctatagtattaaaattgatctagttgtataatgtaagatattattcaaggaaaagattaaataggtcttaactgtgtttactaaatttttattttataatgtgttttatgtagcttatcaagtagaaatttaggcaggcagttaggacacttgagatactggagctctgtatttgtttcatgtcagttcctaggaggtttcagtcttgcctgtttcatcaggctgatttccagggagtgtgctgagatgggtgagagtgcagctcagtgtaggcttgagtagtggctcagccacctggcactttctaagtgcactctacacctagaaagtgccatgtcctcatgcctacagtggggttaattacattattgcctaaggttgtttggagtacacgtgaaataatatatggcacagagtaagtacacttagcccttttttatctgctggttccccattcatagatttaataaacgttggatgaaaaatatttgggaaacaccagtaaaaagtagtagaaattaagaaatagagtataacaactatttacatagcatatacattgtattaggtattataagtaatctagacatgatttaaataaagtatatgggctgggcacggtggctcatgcctgtaatcccagcactttgggagcccaaggcgggtggatcatgaggtcaggagatcgagaccatcctggctaacatggtgaaaccctgtctctactaaaattacaaaaaattagccgagcgtggtggcgggcacctgtagtttcagctgctcgggaggctgaggcaggagaatggtgtgaacccagaaagcagagcttgcagtgagccaagatcacaccactgcactcctgggcgacagagcaagactccgtctcaaaaaaaaataaaaataaagtatatggaaggatgtgaataggttatgtatatactacaccagtttactgaagaggcgagcatatgtacattttggtatctgagagcggtcctggaaccaatctcctgagatactgggaaacacctgtatttagtaatgtcagttcttgttatttaagtgagatacaacattttctcacttttggtattactgatagggttgatgttgtattttataaagtaataagtgctttgcaagtgacacaatggtgctgctttcaataactgcctcactccaggcagtgcatccacaaacgatccttaactgtgtcccagatgtctgcatggtcttcgaagtacttggccaccatctcctcaagtggatcatcaaatccaactatcaaggcctcccagtacgttgtgtgaagagtatcattcgacaggtgagacttttgacagcagcccctaggccctagtacctaattggttaggctttcaacatgaatgctgtttacaaatatgtatatgtattacatatgtatcagtgcataatgtatatatgttatgtatgttacatatgtatcagtgcataacattttgaactcttattaagtcagtatttaatgatattttgtgttgtgaagggaacaacatgtaattgtcaggcatacgttttttgcctgtcgtttttttttttaaggtatgtgacatggtacaattacattgtttttgttcagtatctactataaaacatccacttagttcattaggaagtaatttagaagaaataacttactgggtttatttactaagtatccttggatggagattaaataatagataattgaagagttgtgtacaaagtttcagttataacgtggttaaattctgcagatctaatagacagcatgatgactatagttaacattattgtgtacttggaatttgttaacagagtagacttgaatgttctcatcatgtacacacacacagagtctatatgtcatactgggttaggttaattagctgttttgtgctaatcatttcacagtgtacacatatttcaagacatgtacactactaatatattcagtttttattgtcagttgtacctcagtaaagctggggaaaaaaatggaaatgtttaactcatatagaaattactgtattagatgtgtgttttgttcagttgccctgccagaagaaaaccctcagctagggtcaggcttagagatgatgctctagtaaacatctgtagaatgaaagtatgcgtagatggaagaactcctcctaattagcagtgtttgcccattccagtgttctgcatggaatcagtatgtattctactcattgcctgtaaaaagtttgaagtttaaatttgtgtagtaaaagcatctttgatatttctgttgaatttgtgtgcagataactttgtttagcctgcctgtgtgttcatctcttcttccttttgtacgggtttttttttttttttttttttttttggagacggagtctcgctctgtcacccaggctggagtgaagtggtgcaatctcagctcattgcagcctcctgagcagctgggactataggtgcttggtaccacacccagctaatttttgtatttttagtagagacagggtttcaccgtgttgcccagggtggtctcaaactcctaagctcaggcagtctgcctgcctctgccttccaaagtgctgggattacaggtgtgaaccactgcacccagccttgtatggaaaattggcagcttattctgtaacatgacagatgttacttgagaagaggggctggagagggaaaagttcactacattgtcttctatatcagttgaattgaggtgtttctatgtagtattatgctaggtatacatgtgggcctagatttatggctaacttttgttcagtactgtatctgtttgcccttagctttcaaatagtagcatttttattcattatttcgacaggctgatatctcaaatgaacaactttaatgtagaagaggttatgtggtgagggcagaaattagtatgttaagtggaattatttgatccccaaataagactagtgtattatttgtaacatttagcagcaactctaaagtctttaaaaaaaaaaaaaaacacaaaaaaacacaaaaaaataaaaccatattgttaaaacttgggaagaatctcctaattatttttgataaatcttgaaaatattaaaggaattacacattctaacaaatactgaataatttcagaaatagctgcctgcatgtatttcccgcaggctccatcatttcccagaacctcatgctttcagaggggcttgctgttgccttaagtgactgaccacaccaccaccctttaggcttagtgtgtaagaaggtgaatttggccaggcgcagtggctcacgcttgtaatcccagcactttgggcggccaaggcgggtggatcacgaggtcaggagattgagaccagcctggccagcatggtgaaaccccatctctactaaaaacacaaaaattagccaggcgtggtggcacacgcctgtaatcccagctactctgccagctgaggcaggagaattacttgaacccgggaggtggaggttgcagtgagctgagatcatgccactgcactccagcctgggcaacagaacaagactccatctcagggaaaaaaaaaaaaaggtgaattcacagatgagccattgacatttattttatcttctagagaagaaaatatagccttagcaagttgaaggagtctgtaagttgaaagatgaaaatctgaggttcagtggaacctcagtgcatccttgttgaatgaaccgaagattaaataagttaacctgtgttcttcattttgtttttgttttttgagacagggtcttcctctgttacccaggctggagtgcactggtcagtcacagctcactgcagccttggcctcctgggctctagtgatcctcccacctcagcctccctagtagctgggactgcaggcatgcaccaccgtgctagctaatttttatttttttgtagagacggggtctcactgtgttgctcaggctggtctctttgtctcctggactcaagcagtcttcccatctcagcctcccaaagttgctaggattataccacacctggccaatgcgtgtgttatcctcactgtaattcatgtaccctgtttttggtggaaacttagaaagagctcttatattatttctttagttcagagaaattcaagctgaaaatttgattgtgtcatgtggtctgcactttgttcttatatgcagtgttaatggaattttggtttggttttggttttgtgtgtgtgaacccatctttctttaagaaaaatattatcatggaatctggattttttccccctaagcttacgcagaactttcagtgtagtaagttgttcaagaaattacatactccagttaataatctacttacctgaggtttcccttcaacccctttgattcagcctatgttttcagtatttctttctcccgggtagtactaggaagattttttattgcagactgacacagttatatcatttcccagaacaagccagagcagaccaattttcttagtattttcttagtatcctttcactgtagaccttcttcttaagagtcatggataaccgaccatgttccagtcattctccttactctatcacttgctgtgcttccccaggaacccgcctgttgaactctcctttgccatgtcttttactcttgatgttctttgtatttctgttgctgtcctctttagttcaggcccttatcacctccagctagtaccttttcacaggcttttcttggctctctgtgcatacagcccatccaattcccggtcccttttccagtttattctcctttctattgcaagtaaaaccttgctttaatgactcatattcccattgagaattctttagtggcttcccattgcctgtttgctgaagctttatgttcttggccttcatgaagcaatatatggagttgttaagagcttgggtttggcatcaaatataccctactttcaccaaagggctttggccaagttacctaacttctgcaaaccacaatttcatcatcaataaaagtggggaaaataatgataccagccaggcgtggtggctcatgcctgtaatcccagcactttggaaggttgaggtgggaggatttcttgagaccaggagttcaagaccaacctgggcaacatcgcaagaccgtgtctctaccaaacaaaatttaaaaattagccaggtatgatggcatgcacctgtggtcccagctacctgggaggctgaggtcggaggatcacttgagcccaaggggtcaaggctgcagtgagccatgatggtgccactgcactctagcctgtgtgacagaacaagactgtctctttaaaaacaaaaaacaaacaaaaatgataccttcctcattagtttattgtaaagatgtaatgagagatagtaatgctaatagtagcaaatagttaattcagtgcttactatgtgccaggtataatttgagtactttgcatagttgagttcctcacaataaccctgtgaaatgggtattattactttcctgatttcatcaagaggaaacagaagcccagagaggttaagtaacttgcccctagttaggaagtcgcttaaaaagtgctaagtggtgaagcaggaattcaaacccagatagtctggcttcagagctcatgggtttaccattttggccgttatataatgggttttatataataaacttattatgagcctgtaataagtttggaattgtactgggcctatgtccagtagaagttaagtcactttctgggaacctgtttaagattttctatcatctggtgtcagcctgtatttccccttgcagacaaaaagtgatgtccctcaggtaccctatttccctctggaatctaccagcttacgttttttatgaatgttcaaagatgtcccaaacatttataatgtgcagatttaccagaattttcattcatgaatgtttactggttttattttgtaggtagtttagagaaagtactcactggtaatcatcttgacccctaagggcacctttccgttttttatctccacatctttgatcatctcttttgttctaggctgccagaaatgccatccttgtctacccacatttttaagactcaacgaaaatcccaccattgtgacaaaggcttctcacagtacccaattaagaggatgccttcccttcttgaaatgccttcagctcacatttggtcccataactacgtgtaggccccatctcaaccctagggctgctggcacttcagaccagataggatgtttagcagcgtccctggcatctacccctcagagccagtatcagctgtcaccatccctgattgtggcaattagaaatatctctgaactttgccagttttcctctcactgagaaccactgggataagagaaagtgtaaggtgtattgtgctttggtgacagacttgatttaacatcatagctttggcacttctatcttgtactcctgatcagttacttagcctctgtgagtctgtttcctcatttgtaaactcgaaatagtaatgcataatttgtagtttgattgtggagattaagaataagggggctgggtgcagtggctcacgcctgtaatccctgcactttgggaggttgaggtgggtgtatcacctgaagtcaggagttcaagaccagcctggccaacatagtgaaaccttgtctctactaaaaatataaaaaattagctgggagtggtggcacatacatatagttccagctacttgggaggctgcggcaagagaatcacttggacttgggaggcggaggctgcagtgagccgagatcgtgccattgcactccagcctgggtgacaatagcgaaattctgactcaaacagacaaacaagaataagggtgggccaggtgcggtggctcacacctgtaatcccagcactttgggaggccaaggcgggcagatcatgaggtcaggagttctagaccagcctgaccaatatggtgaaaccccatctctactaaaaatacaaaaattagctgggtgtggtggcacgtgcttgtagtcccagctactcgggaggctgaggcaggaattgcttgaacccaggatacggaggttgcagtgagccgagattgtgtcactgctgctcttcagcctgggtgacagactctgtctccaaacaaacaaaaaaagtatagccattagattttatgaagtagatattataatatgtaaccagatgagacctttaaaacccaatgtttttccagacttctccctttggggtgcaaccctctagtatgccgagagccacggtggtgccccgcaggtcctctcacctgtatcattggctgattttgtctctctacacttagtatttatttaccattgtaattctttcagtggccctgtttatcagtaaattttgttatgactgaaccagtattgttcaagttcagaccagaagctttcatgtcaatttggtaaacattttgatattactgggtttgttcagcatggtagtgcacacgatgctgtattgacttggaattctcctcaggatgttgagcccttgactcaggaaatgtggtgaggtggctctgtttcaagggactaagctgctttcctgagccattgctttgtgcagtcccagtgctgggcacagcagctttaactttcttcctgatgacattcagaagtacagctgctggcttttctcattaattctcaccagttagagatgaaagaaaaaggagcagaggctatttcaggacaatgtgggtaaggacgccgtcccctggatttttggtttgagcgtgtctctggctcttgtcctcttttattgttaacaggtatttccaagctcctccattgagtttaacatcttggttttcacaggcagttggtgggacctgccttgtgtgtttcactgtggaagggaaatctagtggaaccctcagtgtttccagcaggaaacttctaggcttgcggagaacccctctggtgtcccgcacgcccacaagtaattaatattctcaatgaagaactcctgcttggggtcgcctccttcctctgccagcccatctggctgcccacgtgggtttctctgggtgcttcattaggttctgttacccacagagtaggaggagacagagtctccctgctctgtgtcctttgttcaggtgtgggaggaagaaagtccaccgcttatcaccagtagcagagcataatttggaaagttgctctcattctatttctttttacagttcagaattttgggggaagctttgcactctgggctgtgagcaaggccagggagacagtctttagaggagtctccacattatgcttgactgttccccgacttatctacaagattacaggacctatttcaatcaagttgtggtggagaggagcagatttgtgttgcgaagaccagtaatagatggtatctgacacaaatgttgatgtacagaaagcaagctttgagaccattttaaccaagccccttattttgaagatgaatttgaggttcaaggaaaagaaggaactttctctgaacctgtagctagttaatttggaatgggactcggggcttctagctcccagccctagacttagccttcttttccgcactgctgctgaactcaaagtctgactttacccagagaaacctggcacttgttcctcatgtgtgtgaaatggctccctgagtgggatgattgagagtcacgtccctggctcgtctgggcttaggttgatctcagcttccctggcagccaaaggatctctgctgcctcctgctgctagcaccaagtattaaggttttttgtttgtttttgagacggaatcttgctctgtcaccaggctggagtgcagtggcgcgatctcggctcactgcaacctccgcctcctgagttcaagcaattcttgtgcctcagactcctgaatagctgggattacaggcatgcaccaccacacccagctaatttttgtatttttagtagagatggggtttcaccatgttggccaggatggtctggatctcctgaccttgtgatccgcccatttcggcctcccaaagtgctgggattacaggcgtgagtcaccgcgcccagccgtattaaggtttttaggcaagaaagatgaacatactgtgatttgacaagtaaaagcaacagaggaaagaattagtaaagacttaactctgtcagattttgcaaggggagatctatccatggggatgaaacatgattccttttggtttgtgtttttgtttttcccattgtcacagttatcctgtataaataattgtaggagttctcgtcaatgttggttgattctggggtgcattattacttaaaacttcactggaaagacaaatgttatttttgaaaataaaaccatttaaaaatagtagttctggccaggcatggtggctcacgcctgtaatcctagcactttgggaggccgaaatgtgtagatcacctgaggtcaggagtttgagaccagcctggccaacatggcgaaaaccccgtctctactaaaatacaaaaagtagctgggcatggtgacatgtgcctgtaatcccagctactagggaggctgaggcaggagaattgcttgaacccagtaggtggaggttgcagtgagccaagatcgtgccactgcactccagcctgggtgatagagtgagactccatctcaaaaaaagaaaaaagtagttcaaaattaaattatggaatcaaagttttgttgctgggatgtaccatacgggttatcaagtatagtccttttatattagaaatggaaacaactgagacccagataatttttttttttttttttttgagacagaacctcactctgttgcccatactggagtgtggtgacacgatctcagctcactgcaaccaccgctttctgggttcaagtgattctcctgcctcaacctcctgagtagcagcgattacaggcatgcaccaccatgcctggcttatttttgtatttttagtagagagggggtttcaccgtgttggccaggctggtcttgaactccagacctcaggtgatccacctgccttgacctcccaaagtgctgggattacaggtgtgagccatcgtgccagccaacccagagaactttaataagtgacttaggaagctggatgtggtggctcacacctgtaatcccagccacttgggaggctgaagcaagaggatcacttgaggccagaagcttgaggcttcagtgtgctttacttacacctctgaatagccactgcactccagcctgggaacatagcgggatcccatctctaaaaagaaattaatttttaaaaagtgatgaaaaatcataattcaataagtcaatatcagtacaagtcttctgacttagatacgttttaccatttaagtttcttgtgtgctagactttgtttttgtgagttttccgtagattatttctaaagcttattgctacatttgtgtgtaacaggtgtttccccctcccatagatgagaatgaaagctcaaacagcttaaacagcttgcccaggggtaacacaatgagtaaatggttgagcagtaatttaagagcagtctgaatccaaggtcatgtttttaacgctgccctgttgccatttcctttaatggtttcaattatcttaactaactttatttgtcccagtggcaaagtatttttcttgtgtttattgcccattgctgttttaggaaagttagcctagttgagtgcaatagccaattttttttaaaaaaaatctggaactttaagtttttactgagatcacttcttgcttgtcatgaggtgcatcattgtcattgggacctcatgtgaacacatttgcacactgaggcacattaactcttaactgtgcagcctcccgcacagtgaatcaacctttgaactgtgaaagaagccaaggtggaaagataggacaactctcgtgcatgagaaaatggtcaaatatattttaggaaagaaagatactgacatttttaccttgagatagtatttgataccgaaatacaattttagttggaaaacgatttttcaaaaatcgtattcctttgacctctatgggctggacatcatcaatgtgcctatccattaatttcttgtacttttcagaatctcttttgttgttcagatatagaactccacatattattcagtttgcaccaggaagatgcatgaatgtcgttgaataacatgagcccattggattgtgtttccttcaaaagtataaccatgttctccatggaaatattttacatcatgttatctttcttactattggtcctttgacattttatttgctttttttcttttttccttttagacagagttttattctgtcgcctaggttggagtgcagtgccatgatctcagctcactgtgacctccgccttgtgcctcagcctcttgagtagctgggattacaggcgtgtgctaccttgcctgtgccactatgcctgtgcagtttttttgtgtttttagtagagacagggtttcgccatgttggccaggctggtctcgcactcctggcctcaagtgatctgcctgcctcggcttcccgaagggctgggattacaaggcaaggctgagcccggccttgacattttaaatgtaatttaaacatatcctaattgcagtattatccaaaacagtaaatattctaaggcaaaaaatgtcttaaaatcttatcctagttttatctacttcactggtacttactaggaacttgtcagtatcttattaaatcatatttgccatgcccatgattcatcttggttttttttttggccaattaccccacccgtcatactcatttcctgtcctgaattggtaacctctgtgaggatatgaggactgtaagcaacatgaagcctgggagcttttatatatcaaacacctggaataatggcatgtgataggagctcaggcgatgcacattcagtgaatttatgtaaaaatactctgtaaggtaaagttgttttaaatgtttgtagggattttgatcgtttttaagaggtattcctgttttcattttccttgtaaaatctttgttccctctcacttcataatgctactttaacttctactaacagtaggctaactactaatagcttactgttgatcagatgccttccactgtcgattaaactgggaatatttcagtgttggattgaaggagtggcctgcccctccacacctgtgggtatttctagtcgggtgggacgagagactgagaaaagaaataagacacagagacaaagtatagagaaacaacagtgggcccaggggactggcgcccagcataccaaggacctgcaccggcaccggtctctgagttccctcagtttttattgattattatcttcattatttcagcaaaaaggaatgtagtaggagggcagggtgataataaggagaaggtcagcaacaaacacgtgagcaatagaatctatgtcataattaagttcaagggaaggtactatgactggacgtgcacgtacaccagatttatgtttctctccacccaaacatcttagtggagtaaagaataacaaggcagcattactgcaaacatgtctcacctcccaccatagggcggtttttctctcatctgagaattgaacaaatgtataatcgggttttataccgagacattcagttcccaggggcaggcaggagacagtggccttcctctatctcaactgcaagaggctttcctcttttactaatccatctcagcacagaccctttatgggtgttgggctgggggacggtcaggtctttctcatcccacgaggccatatttcagactatcacatggggagaaaccttggacaatacccagctttcaagggcagaggtccctgcagctttccacagtgcattgtgcccctggtttattgagactagagaatggcgatgacttttaccaagtatactgcttgtaaacattttgttaacaaggcatgtcctgcagagccctggatcccttaaaccttgatttcatataacacatgtttttgtgagctccaggttgggtcaaagtggctggagcaaagtggctggggcaaagctacaaattaacaacatctcagcaaagcagttgtttaaagtacaggtctttttcaaaatggagtctcttatgtctttcctttctacatagacacagtaacagtcggatctctcttttccctacattggatgatgtgaaacatataacacttcctgtctcttgtgaacaaaatgcctattcaattcattgtttgaatggtcattgatgtaatatttgcttaacatttggaatttctaatgcttatatgagaacatgatctgttttgtaaaaataaattttgtttatggaaataattgaaaaaattattctccagtggaaataattatagaaaaacactgaccttgtatttaggtcactgacactgtaagtttttgattgttttaatatgagaaatatgaatatcttggttcatcactttcttttagtataatgctgtagggttgtctagataccaaggctattttctatttaaatcaagccccccttctcttgcagtgttaaaaatgtatggacatcattagccatcagggaaatgtagatcaaaactacaacaagatacttcatatccacttgggtggataaagtaaaaaacgatagtaagtgttgttcagggcgaagaattggaaccctcatacattggtgataggaatgtaaaatggtgcagccactgtggaagacactttggcagttcatcaaaaagctaaatatagaggcaccatatgacctaagtacggtaactcctaggtatatacctcccctcaaaaaaagtatgttcacacaaaaatgtatacacgagtgtgaatagcagtattatttttatagcccctaaagtgaaaataacccaaatgttcatgaggtgaagggataaacacaatgttgtatctccatacagtggaatactgtttgccaataagaataagcgaagtactaatacatgctgcacaagagtcaaacttgaaaacattatgccagttacaaaaaaatactttatatgattccatttataggaaatgtccagaatcagcaagtagattagtggttgctaagggttagaaggggtaggagagagatgggaagtgaatgctgatgaatatgttgtttctttttggagcaatgaaaatgttgtcatttaaatagtggtggtagttgccgtgtgtggtggctcacgcctgtaatcccagtactttgggaggtcgagacaggtggatcacaaggtcaggagttcgagaccactggccaatatggtaaaaccccgtctctactaaaaatacaaaaaaaattagccaggcgtggtggcatacgcctgtaatcccagctgcttgggaggctgaggcaggagaattgcttgaacctgggaggcggaggttgcagtgagccaagattgtgccactgcactccagcctgggtgacagagcgagactctgtctcaaaaaataaatacataaaaaatttaaaaaataaatagtaatgatagtcgcacatctaaaatccattgaattgtatacctaaaggggtcaattgtatgatacatgaattactagcctactgttgatcagaatccttaatgatcacatgaccaattaacatgtattttgtatgtgtgttatatagcatatttttacaacaaagtaagctagagaaaagaatgttaagacaatcataaagaagagaaaatatacttactattcattaagtggatagatcatatgaagtagatgatcataaaggtcttcatcctcattatcttcgcgttgagtaggctgaggggttggtcttgctgtctcaggagtggcagaggtggaagacaatctgtgtataagggaacccatgcagttcaaacctgtgttgttcaaggttcaactgtatgtagatgcatttgcttccacgagcataaataatctctgaaattatacacactggttgcttatggaaaggagagctggattccaatgtgggtaggcatgggagggagatttttactaaatatccttttgtgtttatcaaactttgtaccctggcattgtattacatgtttttcaaataaataaaagttatataatgagatattaatagcttatcttctctcttgattttactatatccaggtccttcaagggttagattacttacacagtaagtgcaagatcattcatactgacataaagccggaaaatatcttgatgtgtgtggatgatgcatatgtgagaagaatggcagctgaggccactgagtggcagaaagcaggtgctcctcctccttcagggtctgcaggtgagggagctgagccagcttcatttcagtgtgggggcattgggagcttgcaaagttgcagttgttgaaggtatctgaatcaaacgttacacataaggaagattttggaaaagtttaattgctggaaataactgcacccttgaaatggaaaatgccccagctacattatattttaatattggaagtatttacttttgtccccctttaaaaggccatttaaatttgtagttgctgcttcatctatatttgaacagttttttctgttgccagcttctctgcagaggagaacatagtaacagctttcctgtagctgacctttagtcatcagaatatttttctggcttcaattttgtgtacataaattcttgttgtccatttagcatagctatgtcaatctgagttgtatcaacagatttggagttagttagaaaaggcctgatggtgggggaagaagatcaagtgacctgagtattgggatatctttatttctggggcggggtcggggaggtggtgcagtgaagtgtggactgtgcttctcactcttcgacaccatgatctgtgcctttgtgtgttgtcaggcaagcatggatactaaagggctgaggctcctgggactgcctggggctctcttcacatctcctttactgccatcagggtgttgtttagatcatggacccagcctgttaagcttttgaccctggtgtaggggtttaatcatgtgattcctagactatttgctgcataccaactgcagtatttgatttaaattatagaaagcttgcaaaatagattccaaatatcgatgtacatctacattgttcatttcattatattttaaacaaatttggtttaatgactgtgatatgtattcttttccattttcttaagtgatctgttggtgcttgagcttgactgtgtttgagatgtattagtatttcattttagataaataagagaaatggctcagtatgagtaacttctgctgtgacttcaggagtcactcatttgtttcagtggcataaacttactctagatccttgtgattaagaagctctgattaatagtttttgaagttggatagccattaaaagacaataattatttcactttgcaattcgaatgacctacatgaaggcatgtgtctgttttctgctaaatacagattttgtttgattttattttagtgagtacggctccacagcagaaacctgtaagtacttacgcatattactttatatgcaccatgttaaaagagaccgtttattattgagttgttcaaattataaaaaagttgtgtatttaaagggtagacacatttataaaagctgtgtatcctcaaataggtaagacttaatgtcttgttaattttttttttttttttttttgaaaactgagtttcactctgttgctcaggctggagtgcaagtggtgcgatctcggctcactgcaacctccccctccctggttcaaacgattcttgtgcctcagcctcccgagtagctgggattacaggcacctgccaccgcacccaactaatttttgtatttttagtagagaggggtttcaccatgttggccagactggtctcgaactcttaacctcaagttatctgcctgcctcggcctcccaaatttctgggattacaggtgtgaaccaccacgcccagcctgtcttgttaagttttaatgatctgtgcagagttgggatagttagagcctttcaaaaattgtcttctttatgcattttctggactatggtggccaagtttagtgaaatgtgaggtgatggagttgaagtatttttatttcaaaaccactttacattatttctgattggctgctaagttacctgtttttctgaagctgttgttctaattttttccatgcggatgttaaataagaaagagactgatctattttgtggtcctgtcaaaacactatgtccttattagatactgggtgtggtgactcacgcctgtaatccctgcactttgggaggctgaggccactagatcacttgaagtcaggaattcaagaccagcctggccaacatggtgaaatcctgtctctaccaaaaatgcaaaaactagctgagtgtgctggtggacgtctgtaatcccggctactcaggaggctaaggcagtagaatcacttgagcccaggaggtaacggttgcagtgagctgagatcacgccactgcactccagcctgggcgacagagtgagactccatctcaaaaaaaaaaaaaaaaattagccgggtgtgatggtgtgcacctgtagtcctagctacatgggaggctgaggcatgagaatcacttgaactcaagaagtggaggttgcagtcagctgagatcacgccactgcactccagcctgggcaacagagactctgtctcaaagaaaacaacaacaacaacaacaaaacactatttttactgagacagctcttgatttggaatgtaagttctggaacaagagggagctttaataattaagcttcctggcctgctgagaagctcaagttgtttcccatagttcttccctggcttgagctgcttgaatttactgattgattgaaaggttggaggctgtcattgccagtgctttgcaagtcaggtaaccatgacgggaggcagacaaaagctgtagctttttcttttttccctttgcagcataggcttatctcttacagttcatgttgtcttggctgctaagagcttcatatgtgagacccaaacacacagtgacatacacctgctcgggcacctgtttcatttttggcattgaggagctgggatgttgttactttgtatatagacagcagcaaataaaacttgcaagaggagcttctcctttaaggccaagagaatttcgaacttcagttctcttagagtttgaatggtgaagacttactggatttaagctatatccctctgagggcaggacctggtagtagacctagtacgtgatatcagtcagcactgctttccctttgattttatcgtaagccttaccacaaagtggatctgtctgggtttgggattttaatagaatatggcatgagaaagcagagtttattgctatttgccatgctgctagtcgttatactatcgtggtgctttaaaaagaagaatactgacctgtggtctttccttaacatagataggaaaaatatctaaaaacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcagagactgcaaaggacaatggtcagtggggcctggaacctgggctgcatggggttctcagagctccattagtagggttctgccaggtcaacatgggggctgatttgtgctgctgctgcagatgacaaggatgattctctccaactccctattgggaaatatgggaaatagcctcgtacttcatttgtgaactgtatgccagaaatatgttaacatttcaaaatagtttttaaaaatgtaaaataattgagaaattccatgtttctatcatgctaatgatggtgctttattttgtcattaactttttacctaactgtaatgcaccacaagtctgtttctgaagattatagagggtagaaatggaagtgcaactttatttagaaagagttattttcccttaaagctaactttttcttataagagcaggccaattactaaatgaatgaaaaatgagatttagaaaacctgaaggttttaccccaaaagccaagaggtgtttaccaggtggtacataagcatattcaaaatgtattttattgatggagataagtacttaatgaggctgtattaaggagagtaacaagttctaattcttgacccatcaaattcttaaggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaaggtaagtgtttcttcccatcaactgtctgccatcgctgactccagggacgtgcctttaacaaatgctgtgaaggaattggctggaagtggccaagccctgtgtgtgtgtactgatcagttttattacttttatactcctgaagaagtaatgtgatttaaataaattttctatgccattaggctatttcttgctctctgcataccaaatcttatttctgaccagttttcatttttaatatatttagtcagcagcatcatttgcaaaaaccttccagttttagcaacttacacctttctagaatgtgtagtttagtttaaaattcgtatcttcttccatctaatgtcattatatttagtttagtttagttttgttttgtttctattcaagaaaattatgcctcctctttgactctattgagaaagaagtgtcatattgtcttttgatagttgttcctgattataggaccctactattggtaactggcccaggattgtaattttcaaggaattggcatggatttaaatgtgatgacagattatagattggctcttgtgttcttgtctacctaagaaggcttgacttattcaaagccttattttgggagtgaatgccaagtgactctagtaagtgaaaactgggtaacacagctggtttccatactggcttatgggggaaaagctctgaaacctccctctgctccctctactgacaagactgtttaacacacagcgagtaaaattgatgagccagccctgcaaacagcccgacattctgcagcccctttggttccagcagtctggaattgcacgctgagtaagctggctttgttacgcactggctatgatgaatcctcctaaggatttgctttctttacttggctggacgtggtcagctcctgttcccctttccagggagtgtttgaaggtgcttacatagaatgtaggttaatttctgggaaagggcagtagtgagaggtaccttatccagacttattgttgctgttgcagttcaatttttctcttacttgaagtttctttttttttttatgagattgagtcttgctctgtcacccaggctgtagtgcagtggcgcgatctcggctcactgcaacctctgcctcccgggttcaagcgattctcccgccccagcctcctgagtagctgggattataggcgcgtgccaccatgcccggctaatttttgtatttttagtagagacagggtttcaccatgttggtcaggctggtctcaaattcctgacctcgtgatccacccgcctcagcttcccaaagtgctgggattacaggcgtgagccaccgcgcccggctgaagtttcatatagaaagtaatttacaaagtacctttttaattatttctattttattcattcatttatttatttattttttgagacagtctcactctagttgcccaggctggagtgcagtggtgcaatctcagctcactgcaacctccgcctcctgaactcaagcaattctcctgcctcagtctcccgagcagctgggattacaggcgcccgtcaccatgcccggctaatttttatatttttagtatagacagagcttcaccatgttggccaggctggtctccagtgcctgacctcaggtgatctgccctccccagcctcccaaagtgctgggattacgagcctgagccaccatgaccagctcaaagtaccttttttattcatacttattttgcaagtattagcttgggctgcagtggcttcaagtacagtcagccctccatatccatgggttttacatctttggatttcccatccatgtgttcagctaacttcaggtgggaaatagttggaggggaaaaaaaactgtgtctttattgaacatgtacagatttttccccccttgtcattactccctaaacaatacagtataacaactatttacataccatttacattgtagcaggtattataaataactagagatcaactaaagtgtataggaagatatatgtaggttatatgcaaacactacaccgttttatatcagagacttgagcatctgtggattttggtatcctcaggatgtcctggaaccagttcccctgcagacaccgagaggcacctgcatatcagattaaaccccagctcaaaacttaataactgtggaactttggtttcttaccctgtctgagccttggttcattcctctatcaaaagaaagaaatggctacctctaaggttgttagtagcactgaattaaataaaacaggtcaatggcaaaggtacataaataacatataataataatatattgaaaaatttcccattgaatgtaagttgccttggtcatcacaatccatgtaaaggagcagaattgctgcttgttaccacatggtcatcattggaggcccaggcaagtcataagacttatcctattgtttacatgacagctccatctctgtgtcacaggaaacttcaaaccttacatgtccaaaaccagaatacaactttccctgccaacctgctacacatactgtatttcctacacttgttgccaccatttcttgttgctccagtgagaaacttgatcatcaggatgtcttctttttttctctcatgtccagtaaatcatctcattttgccagtcatacctcctaagtaggggtcccccttgccttgtccctaaagtgggcagtgtcattgcttgcctctcctattatggaggttccttactggtgtcttggctttgtgttctctccagcttttctccccacctgcctttcagcatgcccttccatggtgctgctagagtgtctttgcagtatgctcacccgatcagtgtattcccctgctcacagtttccacagctccccatcatctacagcagtggtctccacagtggagagtgtacatccctgcataaccagcaccatccaggaaggtgcaggaaggaattattagagcatctgtgtatttttttattttgaaagaatagtacaataaacaactgtatatcctccacatagattgagcaattcacattttgccgcattgcatatactttgtgtacacagacactgcatgctacacatattaggatacttcactcctaaatacttaagcattcatcttctgagagatgaattagaacgtcctccattgtaacaataatactattacaacgtgtaagaatagcactaattttatattattattattttgagacaggatcttgctctatcgcccaggctggagtgcagtggcgtgatctcggttcactgcaacctctgctttctggctcaagtgatcctcccacctcagcccccaagtagctgggactacagttggcactaccatgtctggtcaacttttatatttttggtagagaaagtagggttttaccatgttgcccatgccagtcctgaactcatgggctcgagtgatctgcctaccttggcttcccaaaatgctgggattaaaggcgtgagccatcacacctggcctaatatcatctattatttattccatattcaaatttcctcaataattctaaaattttctttttaaattttcctgatctaggatatgatccaacacagtagcctgcctcctgggtgagggcttcctgtatccccagcaggcttacttctctttcccctctgctcctgctggccatgcttgtcttagttgtatgggcagtgctcattgtcactgtctgtcttctcattagaatgtgaactcttggagagtgcagtgtgtttttatctttgcatcctcagcatctgattcagtgctaagataaatatttattgaataacgaacaaacaaatgagtgatacctttttacattcttcttctctttcctttctcccgcttttttccatttatagtcacaattttactgtgtccaacacacataccatccccaatacctgttgcatcaggtagaaactggaggtcttgaagagcattttaatattggcaaattctagggatgtaccagggacaggatctcctttgtttggaagcactcagttttcgcccgcagcttggccatttgataagcaagagcagcctcccccatgggaggtgtgttttgttttctgcatgggaaggggtataagcctagagtcttgcacttgaccacacggtacttcgtgaatttgaggcaagagaaacaatgaagagtttgtgtagatcctgactttagggcagaatgtacatgttagggcatagtagaagaaagactggggccagtttgaggaacttgaagaaacctaaatgccaggctaaagaaggtacacttttttcctagagtaatttggcagccattgaaggttgagaagaggatggtccctcttagatgatcagctgccagagccttagtgtgtatcttggctcaacacatctgaaggacaaaggccctggaacagggtggttttgttggtcttacctgtgggctatttctggaatcctttctgtgtcactcgatggggacccacaccactgtcagtccttgctaggctactgttaacacagcctccgtgctcctatcacttgagcttttgctccccagtctgtctctgtctggcagtccagagagaactgtttaaggcttaacttcttcccccttacccaccctcgcctcaccaacatgatctccattgtgtttcccatgtagagtagtgatgccctgagttgtccttcactgaagctgacaaactctccagtgtgttccctggcaggtctctgttggtgcctgctccagacccattctctgtttccctaattcattctacaccgttcacactggcttctttctaaagtttctcaaagttgcaagcctgtttctgccttaggatttttgtacttcccgtgtcctttgcctcaaacttctcttactttcatgcctgcctttgttcagacctctcctgaatgtcaccttctcagaaaagatctcccctgaacagccttggcattatccatctcctttctctgctttgtttttcttcatagcctgtttagctacctgacaggatgtgtggattcctcgtttatttgccttattgcccatattttcaaccagtacacgagtttcctaatttagcttgtgtttttttcttacagtgttcccagtaccaagaccatgcttagcacacagaaggtactcagtaaatatttgttgcacgaatggttgaggtggcaacattaaatctcttagttccactacttccttgggcctcatagtgaacctcctccatatagaggggatattcttgtcgtccttgtaaggaccccttatgatgtaaagagtcagtgtgtgcctagctccatgtgttatgtgcgtgtgacagcagctgtctcattatgctgaggcactgttggctaccatctaatagttcctaggatagcttcttgtggaatgagtgaccacagtgtcacccaaagactagcgtatcagaaggtgacttaaggggcccagttcttcccgaagtgaaagctttccactcattcccctcttagtggaagcagagtgcaattgcaagcttttcattttggaaggaagacagctccagtttgtcctttgtgtcaccattatctgtaagaaggaaaccgtgtgacaggtcactactgtggtgactcagtcagaggaggtgtgacaaaagcattccagttgggtttcagtggacttcttgggaatgtagcagtctggtaccttagttcaggaactatcatactgagaaaagaaagaaaagcaaaatctcttttacctcctgttgtgtttttatacaattaagttattgagatacattacctagcatcatttggaacgcatcagaagctaagtaactgtttacaaacccgaaccaggaggataacagcatgtcaccaaagagattctgttcagtgaaccttaatgagggatattaagtacaagaaacacccctgaatttaggccaggtgcggtggcttatgcctgtaatcctggcactttgggaggccaaggtgggcagatcacttgatgtcaggagttcgagaccagcctggccaacatggtgaaaccccgtctctactaaaaatacaaaaattaatcgggcatggtttcaggcgcctgtaatcccagctactcgggaggctgaggcaggagaattgcttgaatctaggaggtggaggctgcagtgagccgagatcgcgccactgcactccagcctaggcgacagagtgagactctgtctcaaaaaaaaaaaaaaaaattccctgcatttaaatgtgaggtgatgggtctttgaaagtatatttcttctagcgtgattgaattaagcagctcctgagaaatgtttttaaaaacaacatctcagagtggtggcagattacagatcatctccttccacttgagtgccctcagataacagccaactcggctactgttctcatggagaaaaagaaatcacatcgttctgtggctcaggaggaccacaatatgtctaaccgggcttcgccctcttctcattagacctatgatttgagttgtttgtgggggcggaacttgctcttgggcctccccttccctctgctgctgctctctggtccctcactgaccagttgggagcctctgccccagacgatggttcagctggtcacagcagagggaagcccctgcgtctggccaggcgcccagatgctgtcctgactctcctgtgtttgggtttttagtgtcttcggtggggaaggggtggtcccttccgattcttcttttcctgaacaccaagcctcatagagtttaagtcatttgccagtcttacaacttgtagatattgaaacttagatttgaatccaatttttcaaacctcaaattccattttccttcttgctgattcttcttgattaaatgacatacggggcattcatctagtcatgtctagtgttgttcatctacccattgggtcagcatttttatatttatcctggacctctgttctcagccccaggtgaatcagtgtatattcattttgccttcttttttggtctttgtgctgctttctttctgaatttttgctgagttctggtgtttcttttcctgagctcatacctggcctttggtgaggctgtgcagaatccttataaagaaggaaacaggcatatggaaggtagcaagcagggaatatctgtacctggctggctcatttgattaacatgctagaggaacaggtcttgagggttaagatactggtcagaattctcttggcgtcctctggagcccccctagggagctgtgtgggcaccctaggtcctgaggcccttgcctgttcactgccttacggcaagttgcaaggctggccctccttcctcttatggggcttgctgaagaatcagagcctccccaagcaccctggtttcacagctcgtatgtaccccaacagaggtttagttcatttcagcagtgcccagcttcaaggaaacaaaggggctctcctaggtaggtgtttatattagtctgttctcacattgctgtaaaaaataccggaaacccggtagtttataaagaaaacaggtttaattggctcacagttccacaggctgtacaggaagcatggctggggaggccttaggaaactttcaaatatggtagaaggggaagcaggcatcttacatggctggagcaggaggaggagagaagggggacgtgctacacacttttaaacaaccagatctcgtgagaactcactcagtatcacgagaacagcaacgtggaaatctgcccccatgatccagtcacctctcaccaggcccctcttctaacactagggattacaattcgacatgagttatgggcagggacacaaacccgaatcatatcagtgtttaatgttctacattgaacaggcttttctgcttggtttttaaataccatttcaaaattacttatacagtaaataaaagtcctggttttatttcatctttaccagaaatctgatcttgtaggtcagtctgaggtttggtgatgaagatgctgactttaaggactatttttctgggcctcaccagattatttttgtttgtcacttgccccttggttaactctgcttgatacaggcatgatctgaacttgtttgagaagatctggccccagaatctctgggaagctggccctatacctgcctttgagattccctggagtcatcctggaatttagaatgactgctcatgtacatgacaagttcatgactgacctcagaggttgcctttatggcccaggccatctcaggagacctctgtctgggaccttccttgtctaaaacaaaaccagaatagtttagtccctgcctttaatctgtgtttgttaatcaacagtcatctaccccttgagatctgtgtgtgctcagcccaagcagtgggaactgtaggggatgatgtgggtgtgaggtgtcggtgccagggaccctgatgtcttgtggcgtccaaggaactgtgtgtcactgagagtgatcggcccccacagcagtgttctttctaccttcatgttccttgtaataatgcatcagcaagctcgatctgggccgtgaagggatggattgacaccatgaagagccgccacaaagctgcagacagggggacagcaaggctggcttgttctagggctgacctggacccgaagaaactggggataaaaagagaaaggtcaaggcagtgcccttggcgtcctgtgggcagcccagtttgctcttttctggagtattttccagaggtggagaacaagcaattttagttctgtcaagtttaatttacagtattccaggcctaagtgatcattccactactcttgaggaaaggagactgaccctggcaaacactgtgctcacacatgcaaaccacctatcccgatcactaactgtcctgctgtttgctcatgccagcaaaaacccgggcagctgacttgttggtgaatcccctggatccgcggaatgcagataaaattagagtaaaaattgctgacctgggaaatgcttgttgggtggtaagtagagttttctttctaaaacctttggtcttgattctgtgtgcgaagacactttttgaatgtctgtgttgctccgtggtaatgcagcctgttcccttccagcataaacacttcacggaagacatccagacgcgtcagtaccgctccatagaggttttaataggagcggggtacagcacccctgcggacatctggagcacggcgtgtatggtaaggacggctgtgccctttgctgccatgggaattggctcgttcctttcacactctggatggggctgagtctctctgaggcatgcgacctcagtttttctgactgtaagggtcatccaccgtgggctgggtgaggggaaggttgctgccgcaggcatcttaagaagtggaaggatcctcctcaggcgggccctgggtgtttggtgtggttgtgggcttgtgagagagacatggtctcttcttaaggccctgcacagcccacagccccatgaatcagactcagttgttgtgacacagtgacttcacttgtggtccctgaaaatgtgcagggtatagggagcttttcccttcactcacactgtggaggaagatgaggtagcatctccaggggaagactgcctaaggcgggcaggtgggagcccctccaggtaagcctctgcctggtcaaccagacatgcagggttcctcacctttccagactggaagggatttccccagatgccaatgcataatctctcttcccttataaagcaagagctagcagatattctggcttattctaggatgtctagccccttctgaaacagtggcagcaacgcccactccctctgacagagtctgttcccagagtggttgagatgacggcttccacagggcggcagaagcctcttcttctatctgtcaggcctgttttgctgctggttttgtgctgcacagttgcattgtctgtaaactcccctggccctgcctggcatcgtttggtcattgaccctgaacctgtgagttggtgaacacaaagggccctgcatttgcgagccagttcctggttctcttcctctgccctgtttcctggcccattcagcagctttttctcagtggtatttacttaggcgttccgtgttgggaaaggtgggttgcttgctgttgggtttcatgcttttcctattccatactgctttttatccatattcttccaatatttaaaagaaaagattgtgtgcaaggcttagcatttttcttctcactgaaaaaaggaatgcagaataaatatattaattttctgttattcagaggttaatttaacaattttcttgaatttactgtgttttacctcctctaatgctcaagtaaaagcattgttgagcagatagtgccagctgataggagaaaaagagggtgctttctgtctttcagctttgactcagcatgatctgagtcagcacatggccagataggtcctgaaacaccaggcctttctattccctcgttgctcttaaggataataccagacaataacgtttaaattattaaaggtattaaagttcttccatatcaaaaaccaagtccctgccttagctaggtatagaaaagaacggttaaaagaaccggtggccaatgatggtcactttgaatttagagagtgctgtgtggagaggcatttgaccctctctgtgtgaccccagcaggcagactgagacgtgggagttagtgtaacgggagctgcggagacactgagtgggagtcggggagcaggggccatttcaggatgtggggaggttagaccacaatggccactagcagcagggctgccccgaattaggcgctaagtactctttgaactctgaaatgctgtgcttctaatttggggtattaagtttggtgatataaccagaaaaataggacgcagtcacggatgtagtgggttaatggagctttcagcacaattttataccaggttatctgacctgccttccattagatgaacgtttgtccctccatacaatttccctgtcctgcttacttcttgaaatgctattgctgtgaacagtggcataaatatcaataacagattcccaaggaaaagcctttctgtcttctcacctgcccccttcccaagaattaagcataagctccctcagtgctgtcaggacggcttatgaggtttgctttttcagttggttgtcataagggaggtttttttttttttggaaaggggcaggccctcattcactgcttgccccaccccccaaaagtcatggctttagaggtttcttttgttcctcctagagaacctaggagcaatgaggcagtttttcttacctcatcgttctgttgtagtgtaaaaataggacatttaatatattaaatttgacctcataataccaagctgtcataaggccacagatggttcttggtggtaaagcctatatatagtctttgagggttttgtttgtttgtttggagacaaggtcttgctctgttccccaagctgaagtgcagtggcaggactatagttcactgcagactccacttcccaagctcaagtgatcctcccacctcagcctctggtgtagctgggactacaggcacatgccaccacgcctggctaatttttgtattttttgtagagatggagtttgtcacgttgtctaggctggtcttgatctcctgagctcaagtgatccacccgccctggtctcccatagtgctgggattacagggatgtgacactgtgcccggctgtctttgagatttataaatagcatcaaatctcacagagactctgttgggaatgagagctgacgggtggtagccattggctattgtcagggaggacagctttaggctctgcagctggagaagcacaacagaatgagggaccacagcaagggtatgttgggtttggatctgttttacttttcttgagttttactttttttttgagctttacaccttccagtgtaagtacatataatctgaaacttctttgtggctgaagcattggtttctctgcatttatgtattagagtctctgataggactttttatgaactccatggtgagtcctggttagtgccatagaaacaagaaaagccattccaacaaacttcaccagacttcttcggcactggtcacattacagaacaaatacgtgatcttatttgttcagaatcgggatacttcagcataggagaatgttttaggagagaggtagttggtctcccaagaatctggaaacaagtaggtccagggaagagccctttgaggggattgagccaagtagagaagaatccggagttcccaggtattaaaaataataataaagattatacttaggcccagcgaggtgatgcacacctgtaatcccagcactttgggaggccaaggcaggcagatcacttgaggccaggagtttgagaccagcctggccaacatggcaaaaccccatctctactgaaaatacaaaaattagctgggcatggtggcacgtgcctatagtcctagctactcaggtggctgaggcaggagaatcgcttgaacccaggaggcagaggttgtagtgagccaaaattgtgccgctgcactcagcctgggcaatagaaggttatactgggagtaactgagttgaaggcagagtttttttcattgtaatgtgcatttgccctgttgtacatgttgtattgttaagagaatcttgccactctccaaagaatcaaaaatgggtagcattacagccttcatcttccttgttcctttaaaaaaaaagaaaattatttggccgggcttggtggctcacgcctgtaatcccagcactttgggaggccgaggcaggcgggtcacgaggtcaggctaacatggtgaaatcccgtctctacaaaaaattagccgggcgtggtggcgggcgcctgtagtcccagctactcaggaggctgaggcaaggagaatggtgtgagcttgcagtgagctgagattgattgtgccactgcactccagcctgggtgacagagcgagactccgtctcaaaaaaaaattatttcattgattggcttctatacatgttttcttgggaatatgtgggtgctaatcaaaatgatgatttttttcaaagaatacatacctgacatattttggcagtaagaaatatgtacaaagctgggtgcagtgtagtgcgcctgtagtcccagcttctctggaggctgagagaggatcactggagcccaagaggttgagtccagcctggacaacatagcgaggtcccttctctaaaaaatatgaaagaaaaagaaatatatgcaaccagattgaagtcattttgaaaattaattaaaagagttagttagcatagggctcaaggcaggggttgaaaagcagcttggaacttgatccaggcttttcaagtcctcgttgtcccattagagttttcagatttttctcttagcttgtaagatactgaattgattgtttcccaggctagaaggactctcctggccattgagtgtgtaatctagttgttccacttggatttggggccagttatgaggttttcctgccctcatctgggattggcccaactgtcttctttgtttattgggtggaaaggagaggccctacataagggctttcctgggttttctgctggtgccttcgtgcatccacagtgctgggaccaccagctcaccatgctgagatgtgacatgtccgtgtcttgctcagacctatgccaggttcagggcagggatcctgagttcataaattaatgcttatcgctcggtcagctggaagccatcttgtcaccatccttccttccttcaagtgattgacaggcagtctttttttttaaaaaaggtgaaaagatgtggtcctgggctgactgcactcactcttggtttgttaaagacagtgccaggagaggtggcccctcacccaggcaggtgagccttcccttaaaggtgcctttccagcactgtgtggtcattgaaagaaaaagaaggtaggttgatgcagtgaagtttccccagtattggctccttggggcgggaatggggagggcagtcacagatccacaggcatcagtgattgggcctctgagcaccttttgggacagcaagatccgttcagaatagaagcagctatgagaaaaaccagaaatgggatttagcttattctttttttctcttttaaaacattctctttgatcagcagagcagtagcagttgccatttttgtatattgttactagcttaaactcatgtttttgagggtttttttgtgagcaagggaaatgggaacaaatggtgttccctacatgctggcatgctgagggacagccagtggccacccaggaagccagtgctccgtgacatccacaaaagggtctgcaagaccatctgcttcctctggccctggggacaaagagggtcttttttgtttccaggttttcctttggttgaatcagaaatgaatgaaatgatgatgaaaatggttgatgagatactgaaaatagtccttggttactaaaacatgaaggtcttcgcctaaaagacgcagcagtgtctgctatacagaggccaaggctattatagtggttgaggcaggtgctggagtcagacgggccttgttgagtcctgggttgaactctcgttctaccatttatagagtgcataccgcgctctggccaggcctgcatgcaggtgcggctgactcactgacgttttggttttgcttcctgcaaaatgaagagaatacatagctcttatatctttccttagaaatgtaaaaatacttctgaaacttctttgaatgtggaagaaagaaaaaaattagtattgagcactttcaggaggctattttgtttgattcagatcttcataaagtggcggtctcttctataaggagaaaaagctgttgacttgggggccagtctctgaagtgcttagcatgtcgtctgttgtatcctaggcatttgagctggcaacgggagattatttgtttgaaccacattctggggaagactattccagagacgaaggtgagtattggtgcctgctgaatacctcggtctaggtcttctgccagccctgaacttctgtagagtactgtatttttgtactgaaatagagccatgtgtttggttttcaaacaccaaattcagatgcttttcctttgagtttgatgccccctcagtctcagtgaatgggcagagcctgcctagcacaggcagcactccagcgagccctcaggggccctacaccagcggctcttcctggccttgcacagggcaggaacccagctggctgagagaagacagatgatacagacctgaagcctctatgtggtccttttgaccattgatgtgctgcccatttctctgtcctgtttgggagctgagttgaaaacccaggaattctggcttgaatgccatctgtaaacctgaccatctccatgcttatttgcttgcgatgctggggtggcctggggtgagctggcctcagtcactgttactgctccaggtggtgcctgaggcctgccattcccacaagcctctgcatggatgtgctgcagacactgttgatttgaatctatttctgattttttactaatttcaatttttccctcttcttttatcccatccttccctttgcccctcccattcccatatcctttttttctctcctccatagaccacatagcccacatcatagagctgctaggcagtattccaaggcactttgctctatctggaaaatattctcgggaattcttcaatcgcagaggtagtacctcttctttttgaaaagcgccacgatgcagacagaaactgaagagcagctgctgattttagcattaatggtgacaaaggcatttctcctaaattcgaaacgcaacccagcagaattcctatgctgatagaaaaattgtcagggaagaccacatttagccctgtgctgcggtcaccctgttcaccagcccctctcctgtgccctccagctctggatcctgaatccagcaacgcgaggaaggcctgtacttttggtcattcaagttgcgctctgtttctgtctgcgcgggcggtggtagtgtctgcatgcagtgtactgattaaactgtcgtgtgtttctgttttgctggcaatgtttcccaatgcagatcacatagcattgatcattgaactgctggggaaagtccctcgaaaatacgctatgttggggaaatactccaaggagtttttcaccagaaaaggtaacggtatttatgcaacactaattttcagcatagtcttctcccaaaaggagaaattgtgcattcgtgattgggcagtggagaaagatctggagtttcacaactggggaattcttccgaagaaagctctcaagaaataaacctgacccatctgatacctggagtaagaattttgtaagagaacagccttcctaacagcattttttcctcctccgcttctctcttttactccaagttaccaatctgtatattatttataaaaaggagtttaggtgattgttaaaagccagctagacttatctttccatttcatggactctctgtagtagaacagaggtggcctagagactggacttagggaacgtccagggacattgcttttggtctgcctgggttatttctgtagtgggtgtaggcctgtgaaatgctgcgtacctcacattcttaaaaatgacatcctacattcccattgtgttatgccacactgtattaaggtgattattttcatgttgtagttcttactgatcttccaactgtttatttgcccagtatagtccccagttagtaatttataaaaacacccaagagccctaggagtatttttaaaagaactccttctaagtgctatattcttttttttttttttttttttgagatggagtcttgctctgttgcccaggctggagtggagtggcgcaatcttagctcactgcaacctgtgcctcccaggttcaagcaattctcctgccgcagcctcccatgtagctgggattacaggcacaccaccacgcccagctaatttttgtatttttagtagagacagggtttcactgtgttggccaggctggtctcaaactcctgacctcaagtgatccacccgccttagccttccaaagtgctgggattacaggcatgagccactgcgcccagcctgctgtacttttttgtgatgagtgtagttggtccttcatatttttcaggttagattttttttttggatgtgacagcccttaataaagaacttttaaagttgatgtgagtaggacatggacttttagaaatttctgaaagtcccagatgctctgtctaccttacttagctaaatttggagaaccacattgattttttttttttttttttttttttagatggagttttgctcttgttgtccaggctggagtgcagtggcgcaatcttggctcactgcaacttccgcctccaggcttcaagtgattctcctgcctcaacttcacaagaagccgggattacaggcacctgccaccacgcccggctaatttttgtatttttagtagagagaggttttcaccatgttggccaggctggtctcgaactcctgacctaaggtgatccacccacctcggcctcccaattgctgggattacaggtgtgagccactgcgcctggctgtgcatttatttgtctttgttaatcgtctgtctgttgaggggatcgaggactccatactgtgcacagcgggaaggaaggaaagagggacagaaagagaggccttgaatgatcaagtgaagtcactgagttgttggaaggcagggcctgtcagcggcctgcaggcatggagctggttgcaggcatctgctcttgggctgtcactcctgtgatggttcctttcagtgagagcggcctgcgtgtggccataaatggctggaaggcagcttccacgtgggcctgtcagcaaccttgctccctgagacagcttgtggatgtgtatctccaggttactgccatcatcaccacgtatacttaggacttacgtgatcgagttctttttgagcagcttatttgaaggtaacctgcagagttaaaatgcatttggcatccttcctaatgagagaccaaaaatattttcacttggtgttcctgtggtacctcgagttcttttttcctgtttttggatataagagaccgtttgtgactaggtgagaaatcccctgaaatgactgggaattgggacttcagttctttcctgattattatttctaatggcagtagagatcagaagggatttagggtttttacagaagtcacaggataacattatgaggaatgagggccggtcatggaaatagatttcaccgttgtctcttaggatgaggggaatggcttgctgcgtgaaacatgtgttttggcatgttcccataagtaatataggggaaattccataatttccataattttggaaataatggaatcttaaaaatatccatttaaattttttttcctaaaatagctaaaatactttgtgctagaactgataacaaaatttaaaacagctgttgatatgccgtatcacttttgaaagcagttactgatggagagtgccttcccaggaggttttcccgctctttctcctctgggtcagaggcagattttcatccttgccacgcagccagagaagagtggggtctgtgtgttaaggttgaacatcaaatgcagctcatttgtctcctctccttgcgtataatttaagaagtcatgatcattactagtttgaatcattccttggccagaaagttaaaaattgagctgtatttttggtcagggaatgtaattacagctctcaccctcttaaggttaatttgctggacatgagccaccaaaaagcattaagaaactactgtgttgataggtggtccaatagaaatcagcacgtccatgaattttttccctgtcctgtcttcaagaagtgggtggtccccagaagctttccagccctcagatcatggtaggaaaaacggtgcagccaggagcagacctcactgggctggtcaccaggaatttttctgaccattcagcaggcatattttagtaaaaattgctgcgtggataatgggattatcaaatgagacagtttacttaaaaaaaaaaaactggtctctagatgacagcatcgagtgtgttgggataaaagagagtgattgtgtgcatgtgtgcgcgcgcgtgtgtgtatgtgtgtgtgtcagactacagaccttaaatacaattgaaaatttcaaaagcaagaagcttctgtgcagcagcataaaatccacgtttccctgagtcagggacaacatcaagagaaatgtgagaactgagggctaaaacccaggagctgagttttaaaaagagatactgtattctgtatttttaatatttagtgtctgagctgaacttgtcacagtgttttaaaattatctcctgaatacctaaaaagcaacagattcttttgatgctgtaaagagcaaagaaagctctttcgtgggcatttgacagctacacaggctgggcgttgtcactgccactcctcttgtttatccctccatcagatgatgggcgtttggttttcccccactttttggctattatgaatgatgctactatgatcattaatgtacaagtttgtgtgggcagatgtttccgtttctcttgaatacacatgtgaaagtttaagtataaatttttaaattttgatgaagtccaatttatatacattttacaatttgtgcttttgatgtcacatctaataaatcattgcctacttcaaggtcatgaagatttacttttctaggaattgtttagttttagctctgaggcatatgacctattttgagttgatttttgtatgggatgtgaggtagggtttatacacattttaaactccaatatttacctacatttggttgtctacttgtgtaagaattcattcagatctcttcattgtctcttgctttgtattggtatttcttggtaggtttactttctacgtgtacacaattgatgctcatcagttttatatcatggtttgctttgtaattaccagtgttcatgtaaatatagtccaggatttgcctttagagtcctcccacatgtagtgtggaacctcatgggcttctttatttaattctggaatatgacaatttcatggataaaataatgtattttccttcacaaaccactttaagattcaagagaagtataatagaacttccctgtttccttagaaggactctgcaagtccaggactggccagtacagttgctgtcacaaagcctttactctgcaggaggaacccttcctcagagcctgcttcctgttggttttccttggctctttcaagctgtttctcagagcaaattcagaagcctaaggggctcttggggaccacacaattggctgccaggctcatgtttgcttgtgtgtgtgtgagttgatactgagattgacagctgatagtcacaggaagggtgaagtgatattccacattctttaaggaggacaggctagaaatggaactttaagaaactaaaattgtcacagttgtctagttatttgcaaaacttgtttcagtgaaacacatcttcatatattttcttttctctctttttttttttacgtcttcatatattttcttttttcctttttttgagacagagtctcactctgttgcctaggctggagtgtagtgatgctatcttggctcattgcaacctctgcctcctgggttcaaacgatttttgtgcctcagcctcccaagtagctgggattacaggtgtgcaccaccacgcctggccaattttgtatttattagagatcgggtttcaccatgttggccaggttggtctcgaactcctgacctcaggtgatcttcctgccttggcctcccagagtgctggaattacagtcatgagccaccgtgcccggccgatgacatttctttaacttgttagggtgctacttttatagtaagagcaaatggtgaaaatgtgtttttaaaatatgctttcccctcttattcttaattatcattctaagtgatggaggtggctacatttcttgggcatcatctgcagggctggagctggctcatggactcgagaccctcactcattcagtgagcccactcttgttgtgtctcctagcaatagatacagagttgggggcttgggctttgtgtttaagtaaccttatcaactatttccagggcaaggttacttcttatactgagcttaagggtttgcacacataatcattatagcatctgggtgagttgattttcctttgcattatattataaactttttccacaaaaaaagtccacacattttttttttttttagaggcggttcagtgttttgttatattgcagtgctgctctgtgctcaggaccataggtgtttaggactctcctgcatatactgttgtttatagactgcttctttgcacagtctttaccttgttaaaagtagttagatattttactgctccttgcgaatatttttaccagtttatagtatgcctagttatggatgaatagtttctcatggcctttcactattatattgttttgctcactgttactatgcagctgttaagcatttatagtggtaaaacttctcttttcatggaagattgtacttaaaagatgccttgttgatggatcttagtttaacacctggcgcctcagaaataggttcctttactattctcagcacacagtgcttctctgtagttacctatatttgcaaacctggagagtattttttctgagatagaatagattcatgtcataaaagttcgctccctttcccagagaacttggtttagtcacatgtgagctttcttagtttgctttaactgttgctgtggtgagatcaacagtctaaatcaatatagtcatattacagaaaatgtggaaattgaaataacctactaacaaaagctgatgttttgattcagttgatttccatcttaatgagcattttaataatcttgtgattatctgtaggacatagtttgactgttcttttactgcctaatgttgtaccatgatcttctcccatgttgttaagtaatattaaatactattaagtgaatctaccttggttttcttttaaccaccattttactattactggctcttcgtaattttgcgagtacatataattttgtgccagcatatattaggcatgaatttggggtggtgcaaccagggtttatctccttgggctggattcctagagccggaatttcaggcttagagggataaacctgcagtctctgttcagactttgtttttatggagactgtgtttccttcaacaggagatcctttcccgcctctaatattacaggttcatttcttcatcaacacagacctgatgtctagtctggatgcgatgctttactctagctccagtcctcatattggaaacagaagcttattttacatctcagcccctttagcaagcagccctcttaaaagattctttatacggaaccctgtgcacagcatgattgcaactttgtagacatactagtgtgtaagaacactcttcacaatagacacaaaagaagagcagttgtgggtaggattgtaggctacttccccttttgttcttatacttttctgtaatgctctttccttttcattgtgtttttaaacgggagggcttttccaagttgactcgaataaatgggtgaaacagaacaagcctcctgagaacacctttgtgagcagagcactgattatctattgatgcatctcatgaaaaaaatgtaccttgtttaaattaaagcagttgaaaggggagagaagtcagtccttgcatgaagtgtgccctgcaggtgcttgaatgcctctctccccccaccgagacctggctgctctgaggtgtgggcacaggggggtgtttcctctgcagaagctgctcaggatgcactgaggggcacctaaggaggtctgtgggcaggggtgggatgtcctatgaaaacttcaaacaggcagagaaaacgagttattcacagtgaaattatctggagcttttgacagtttattgcctttttgaaaaggttatggggagacagggtttcgcttgctctgtcccaggatggagtgcagtggcatgaccttgactcactgcagccttgacctcctggactcaagcaatgctcctgcctcagcctcctgagtagctgggatgtaccaccgtgcccagctactttttttctttttaagtagagacagggtctggtctatgttacccaggctggtctgaaactcatgggctcaagggatcctcctgcctcagcctcccaaacggctaggattgcaggagtgagccactgccctcagccctttattgcagttttgacttaaaaataaccttttttttctcttatgaaatgaccattacagctcgtaggccatttactagcttgttagtcattctgttatgtcaaccaaagctgcctgtaaccgacacttttcatactgcagctagcacagtttgtgaagtataacttcaaggtttacaaattaatgtcctaggatcttagatcttacaacaaatgcgtagacatgaatggtgtttgatttgggttggcctcaagtttgcaaattttacggaagatcccaggttgaaatgagagtggcttgcttcaacctttggaaaagaaaacactctgggcaaactgagcccactccacttacttaaagaagcttagaactaatgtgaatgaactattaattaacctctatttagatccaccaggcttacttgaaatatgccttggtcatatgtacatgtaatgattattgcttagtggggaaaagctggtgttctttgttgttgctgtacaagtgttgagcaggtggttgtccgcttcactgaaaagaacctgactggaccaacaatggggaatgcagatttggagctttcttgacattggcctgttttttcccctgtaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaagggacatcattcctgtattatagtgtatgtaaatgcaccctgtaaatgttactttccattaaatatgggagggggactcaaatttcagaaaagctaccaagtcttgagtgctttgtagcctatgttgcatgtagcggactttaactgctccaaggagttgtgcaaacttttcattccataacagtcttttcacattggattttaaacaaagtggctctgggttataagatgtcattctctatatggcactttaaaggaagaaaagatatgtttctcattctaaaatatgcattataatttagcagtcccatttgtgattttgcatatttttaaaagtacttttaaagaagagcaatttccctttaaaaatgtgatggctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtgatcacattcattccataggtagctttacgtgtggctacaacaaattttactagctttttcattgtctttccatgaaacgaagttgagaaaatgattttccctttgcaggttgcacacagttttgtttatgcatttccttaaaattaattgtagactccaggatacaaaccatagtaggcaatacaattttagaatgtaatatatagaggtatatttagcctcttttagaagtcagtggattgaatgtctttttattttaaattttacattcattaaggtgcctcgtttttgactttgtccattaacatttatccatatgcctttgcaataactagattgtgaaaagctaacaagtgttgtaacaataatccattgtttgaggtgcttgcagttgtcttaaaaattaaagtgttttggtttttttttttccagacattgccttggtcattgccctataaatgatagaatcaatgaacatttgctatcagagtagtgtcactaaaactaaataccagcattcctgttgcagcagatgtagttgtagaacatgcattgaggcgtattataaggaaatcatttattgttttttaagggcagaagggatttaggagaaaagctacagtatagattgattctctagaatatcaatgatcccttttcatccatggttcatcaaaaacatactaactgcatttgtttgatcattgcaaatttaaaacaaaacagcatttgctgttaggaaacaagacacataatcctcttaggaattaccattatatcacattaccactgtgaggtagaatggatcattcattaatttctttatgaaatttgcatgctaagtttttctaatgaggctgtaggtttccatgtaaattctgtgatagatagtggctgtagactggtgatgctatccgtgatttctatgagaaacatccttacaagaaccatagggcataatttatatcttccctaagtgtaaaaggatttttatcagggtgatagtatacttgaatgaaatttgtctaatgcagtttttgcttatgttggaaaataaactagattatgaatttttacaggtgtgtcccttatgataaaacagcctaactagtttataatacagaaacggttgttctagaaggaatatacatttgtattaggcataatatggctttatcagattcttggcggcttgttgataaagaatgcacaaaaactaaatgagaaccactggttatgctaaacattataactagctctctgacttcaattgaatgtcctatctatcttttcctttctgtagtccatgtgaaatcttcatggaaaatgacaagcagtggatcacatatgtgtttatagcagatacaggagctggctatctagaagttggcagacagaactgcccaaaggcagagaaaaggtggatataagatcttccgagtcataaacttcttaggtgaaaaccgatttactaacttgcttcttcccatacctggaccatacataactagttaccacgataaagtaaggaaactttccattggagtagagaacttcttcagtttctatccatagttcaggttatttcctaaattctccttttttctcccccttttaaataacttgaatgaaattttggtagaagactgtattttagagtatatacttcatcaaggaatcaaaatgtataagattctgcagttcacacaaaagcttctgtatgcatatttctgtagtaggcacatttcaagccagtgaagaatttaaaatgcttagaaggacaaaccttttaagaagaatatttttatttcacatgctagttacctttattctgtttgaaactatcaggatagatgatgtaaaaccatttcttctcagacaaatgtttctttactaaataccataaatagaattttgttggacaaattgaggatggcaaacttggcctatatgttcttctaaaatttgaagctgtgattaggattgagccctaagtgagctgcgttaatgtaccatcattagctaattttcaaaaggaaataaatagaggttcaaagtgtaaaaacatgactgaatgaggtcacgcagtcattttagtgtttactttctctgatgcacagaatttgtatcctgtgccaaattatgtcaggtaattggatgatgaaaaatatgttgattgataaaacagtatcattattattggatgtacttactgaatcctcagaggtagaagacaaaggctgggaaatttttaattttttgaagattaataattaataactaactagcattttatattttagcaataaaaacgttcacttaagaggccattttcatttcactgagagatctaggaataatgccttttttctttagtttttacacccaagacaaattttcctgttttgggcaaactacccatattttcaaacag

SEQ ID NO: 17350 - DNA, 19408 bp, Human
  misc_feature (1)...(19408): n = A,T,C or G
tctcaaaaaaaaaaaaaaaaagaaagtaagatatgcctaagatttggtcacaaagatttccaatgccaaattcctctgagtccgtggagtgtattcttaactattatataaactgccttttctaacttgtggtcgtgaaatctgccttttgacatgaaacaacacgtagcacactcttagttaagttctggttcctgtgcatgggatgacnnnnnnnnnnnnnnnnnnnnattacaggagagagccatcctgccctgcctgttggcataactttgaaagtgatctattaagtttggtttggcaaacactcgcatatgacaatgaagattagaattttgcttcatgttatagtcttaaaataggcaaaaactgcaatttttgtattttgcaccttattattattattacactttaagttctagggtacatgtgcacaacgtgcagatttgttacataggtatgcatgtgccatgttggtgtgctgcacccatcaactcatcatttacattaggtatttctcctaacgctatccctcccccaggcctccaccccccaacaggccccagtgtgtgatattcccctccctgtgtccatgtgttctcattgttcaactcccacttatgagtgagaacatgcggtgtttggttttctgtccttgtgatattttgctgagaatgatggtttccagcttcatccatgtccctgcaaaggacatgaactcatccttttttatggctgcatagtattccatggtgtatatgtgccacattttccttatccagtctattattgatggacatttgggatggttccaagtctttgctattgtgaatagtgccacaataaacatatgtgtgcatgtgtctttgaaaattatctgggcctggcgcggtggctcacgcctataatcccagcactttgggaggccgaggtgggcagatcacctgaggtcaggagttcgagaccagcctggccaacatggcgaaaccccgtctctactaataatacaaaaattagccgggcatggtagcttgtgcctgtaatcccaactacttgggaagctgaggcaggagaatccctcgaacccgggaggtggaggttgcagtgggccaagatcacgccattgcactccagccagggcgacagagccagactccgtctcaaaatcatcatcatcatcatctgcattatcattatcttgattctatgtgtcaagttaaagacaaggttctagtctatttgcaaaggacattaaaaataacaattgttaacacagataatctttagtctttgaaaaaccaaattagatacaattgttgcttcatttccccctttaaaatttttcctttaaaaaaaatcctaatgacattatttatgctaataagaattttatcggatgtaataaagttcgtcttgaggcaaactgcagaattatcacttaacgtcagtgttctttaagcttcccgtctttaccaactagccagtaatatgttcaatttttttagaagtcatttgaaacaattttcagaaccttaatccaccaagatgcttcaataccaaagtaccagtaccgtcatctgaggctggagggtttaaagctgctctaccttaggtatatttaagataatattgtttaacctttataaacgattaattttatttggatattttaaaataacacttgaaataggtgtcacaaaattctttcaaaacgtgaattctcagaacaacctccccgaatctggggcttgaagcctccgcctcactaaaagtagatcccaccattacccggcagcgcggaggcatacccggagactgggacccccacctcccccggggcgtgacctgtgatccttgacccgtgaccccacctcctctagggcgtgaccccctagccccacctcctccggggcgtggcccggagataaccctggtaagagtcgcgtagcccgagccgggcggaaccactgttcgcgctgccgtgtttccgggcggggacactcagggcgcgacgcttttctgttacccacagaggcccgccgcggctgcgccatccgcggccatgaagtttcgggccaagatcgtggacggggcctgtctgaaccacttcacacgtgagcagggaggccggagaggagcgagggaggaacggaaggaagcagtgagcgcgcggtggggaccgcgcaggaggatcagaacggggatgggcgccggaaggggccgcgggaggatggggccgggatgggggtgctggtgtaggccgcgggagggtggggccgggagggcgcggggcgggtcggagggcacttgtggggatgaaggcggctttcaagggacgtttctgaaacttgattccgatcacgtggctttaaaaaaaagcggccactgctcccatagacggctttatcaggcattgacataccttcaaggccccattcgtccctccaccctgacagtgcctaaccttgcatttaactgtgtattgcagtacctagtagtcaataaatccatgttgaatgaatgaatgactggtaggtgcctgttttcttatttgaacactgatgatgtgtgctgtacatctcccctagtttgttgggagaattgcgtgacatcaggggtattaaagtactttccagtgtgataccaacgttaagtggttatttttccaccgagaagttgatgaacaagaaattctgcaaaataagttggtctctaggatacattatgtgcattttagtaattccttattttaacccctgctttaggaatcagtaacatgatagccaagcttgccaaaacctgcaccctccgcatcagccctgataagcttaacttcatcctttgtgacaagctggctaatggaggagtgagcatgtggtgtgagctggaacaggtgagcaaaagcttctgagaggcctgcacactctgcagattgtcactggaaagatcacatataccctccctcatccctcattttttttcccttaggagaacttcttcaacgaatttcaaatggagggtgtctctgcagaaaacaatgagatttatttagagctaacatcggaaaacttatctcgagccttgaagactgcccagaatgccagggctttgaaaatcaaactgactaataaacactttccctgcctcacggtctccgtggagctggtgagtaggagagtcagggtttctaacacagaagtcttggcctcgaaggaatagacatagttagcctagcctttttaacaataaatactgttgaaagctgtttggtttatttaaatttaaagatctggtccataactatattttgcattagagtcagttcctcctcattttaaaattgtgttgttatcatatgcattcagctagaatgctgctttttccaagccgtgaaacttccagcctctctgtttcttgtagtggtattgtcaccttgtctagaaatcatggtttctatccattttcacctttgacatgttttctccccactcccaccctgcctcatctgctataataacctttaaatggcccctcgttcttcagtacacgtatgttttatatgctactgccagatgaatttagtgcacagctgtcctccaaacacacaaatacacaaactcatgcgcatacatacaatccagagttgctcttcctactcatagaatgaggttcgtatttccttttttttgagacggagtctctctatcacccaggctggagtgcagtggcgcgatctcggctcactgcaacctccatctcccgggttcaagcgattctcatgcctcagcctcctgagtagctggaattacaggcacccaccaccacacccagctaatttttgtatttttttagtagagtcggggtatcaccatattggccaggctggtctcgaactcctgacgtcaagtgatccacctacctcggcctcccaaagtgctgcgattgtaggcatgagccacggcgcccagcccagcttttcttcataactctcaactctttgcagtcaggcagttctcagagctaattagggcatttcatgtcacagtataagtttggtatgttttttctattgcttaaggaaaagcaagatagtaacgtataatactttttgtccaaaagtgcaagatattttggtctgtgagtctcataggagcccctagaaataaatatagtttgccttttaactgttagaaactgcagcactctgagtgtcctatgcccaaagaatggccttctcttggttgcgtcaacatagcaggcttgcttctttctgcctcacggctttacatgtgctgtttccccagcctgaaaccctgtccccttgttcttgtcttcccatggctgctgcttctcctgcttttggtggtatctgaaatgtcacctcctcagtctaaggaaactcccccacactcaccctggtctctgtggagtgctttctcacggctataatgagcatttcatacagtttcatttgtttgcatttttattgatctgtttgttccactggaacactaaggacctttttgtcttattcaccacacttcccagttcctggaagtacccagagtctgttccataaatattggcaccatcaatattggtcgaatggcttttgagtgaataaactgacagcattccacttagatttggtatttcaacttttttgtcccgggtcttcgggtttgttttgttgttgcttaatattaacaacataaaaatatttttaaattcttttcttggcagttatctatgtcaagcagtagccgcattgtgacccatgacatccccataaaggtgattcctaggaaattgtggaaggacttacaagaaccggtggtcccagatcctgatgtaggtgatgcctgcagtcctgctgtacaccccacattaaatggcatgacttgaattctctagttttagttgtagtcttgcagtatattttatttttaaaggatacttaacgaaaacattagattatttgccttttgttatttacataaagcatcttaaaaatgttgcatatgatagaaatgtcatgccatcctatatgtagaaaatgtctcgctcagtaacatcacttaaaacacaaatgatacttttggaggacaattagtatttattagtattcttggccttagacaccaatttgggtttcacaggacttgatcttttcctcagccggtcaggagcgatatctggatgtgcacgaaagccaagaagagaagaatttcatggcttagggctaacatggggtaacggtcatgccgatggttaaccctagagctcctgaaagtaaagatgatgccaaagggcccatttcctcttgctcacaatttgtttaagaagaaagtacagaaatatgctgggtaaaataattacttgacttttactagatggcacctacactgattttgaaaaagcctgtgttttatagagcactcttggtaacagtctcagatgtgatgcagtgactgtctgccatgtttttgtacagagcatggaaaaggcccttgaatcataggtgtaaatgtcccttagaggagggcctcctgctgattgcctgagttatattccccctggaccaatataggggcatctcagctgaagtaccctattccttcttgagccaaaagaatgcccacagggacatggttgctgaggtaaccagaggcaggcattccattctttaattttgcttgagcatccttgagttagtgaaatagaattggttttctttttatatttttaaaagaactttattcagaaaattgtaaaatagtatcccatagtttttgagcatgcatgtgttctagagttagttatggggcccttgtcattactagagtatattaatatttttaatacttgtgcttttttctcattggttttgtaggttagtatttatttaccagtcttgaagactatgaagagtgttgtggaaaaaatgaaaaacatcagcaatcaccttgtaagtcacaacttctttagaaaagaactctgaagtatttggtgggacggcgtgggttctccagctcaccctgcagcagtccatgcaggtgggcacctcctaaccgagttcccacttatgaggacctggcctggtgctgagaacctgcagattgctagttggatttagaaacctattccaatacttttcaactctaattctttgaggaaagcttttatatttgcctttaatctgcctgtttttcctcttatattttgtatgaaacattgtatctttcttttttttttttttttttgagacagagtctcactctgtcgcccaggctggagtgcaatggcgccatctcacctcactgtaagctccgcctcccgggttcatgccattctcccacctcagcctcccgagtagctgggactacaggcgcctgccaccatgcctggctaattttttgttttcgtatttttagtacagacggggtttcaccgtgttagccaggatggtctccatctcctgacctcgtggtccgcccgcctaggcctcccaaagtactgggattacaggcgtgagccaccgcgcccggctggaacattgtatcttttacctgctaacgtgcccgtatttttctgtgagtcactgatatgactgacagtgagtttggagtttcctgtctgcgtgccaagtgtctttcagtgagccagggacaaagatatgccacaccatagcagcctttattccaagcacacctcacaccaagctagggggcacttttatatttctgtttattttctgtttattttgtggaagtctcctatggccacatggctcgaaatgttacagtgtgtgacagtggtgggaaatgtgtaggttatcctcattcatacctggggttattgtgaattcttccttcactcactgcccctccctcctccccctgctccctcctatcctgctccaaaaaacacccttggttatgtccctgaatcttctaaaaaccactgtccacctgatgaagcataaacttttgatcttgacagtgtaccaggccacctttatagccacatctctgttgtattgccacaccctccctgcagaacgaggctgggttctggtattcccccacaatgcctcttcttttttgttcagtttctttgccatttgacacatggcttcttctctccatctccctggaaggcacttagccattctcatgcttcatcacagacctttccccaccacccctctggaagctcctcctccatggagctgagctgtccagtgtacatggtaaatcacctgctaagatctctgaaggtctcgtgaaccaccagcttcttgataaaggaaaccccatcttaatcatctttgtgtcccagctgcccagtgtgggattgccactcagtaggcagcaataagtgttgcatggatctggaacaaaatttagcttcaagaggtctttgaaatcacaaaagtattttgaagcctagaaaatgtacatttgactgtttttttctagagttctgcacactaagagcaatgctgtcattggacctgggtaactcaaagcttttccttcataacttaatctataaaatctgttttccatgaagcagtgtgcactgtgctgacgttggtgtcacctgtgactgcagtgatgctgatccagttgtcaggctggcttcatctggggataccctggggacttccagagaaattcagagaggcccaggagagaaaagacagggctgttaattgaaggatggcatttgtttgttctttctgttcaatgaaaatgagtcagcaaggtagagaggtagaagggtagcttagaatcatcagaggtgttttgttttctcttttttggagtttaaaaaaacatagaaatattgtggagaggctactacgatctggaattactaaatggaaagttatcaagttactgtagcaaagtacataatgaggtcttcctgggtatccagaattctgtatctgaatattacaggcagtagaattaaggaaaatgggtagacttaacacactaaaaatgcccaccttcccattagagatgcccagttacttcctttcattaaatgcgaggtgtgactgatggggtgggttgtatgtgactcatgcaggagcagaaaaagaagcaagaactggagggaattgacatcatgttctaagacattgcttctaagttctaccatgcgtgtgaatcccctggaatctggttaaagtgcaggttctgatttgggaggtctgagctggagcctgaggctctgtttctgaccagctcctgggagatgtcgatgctgcctgtcttcagaccacatcatgtagcagtactttgtgatgtgtgcctgtattactccgttttcacgctgctaaaaagatattacctgagaccaggtaatttataaacaaaagaggtttaattgactcacagtcctgtatagctgaggaggcctcaggaaacttacagtcatgacagaaggcaaaggggaagcaaggcacgtcttaacatggcagctggagagagaagaacacaggaaaaactgccatttttaaaaccatcagatctcatgagaactccctcactatcaagagaacagcatgggaaaagctgcccccatgatccagtcacctaccaccaggccccttctcagcacttggggattacaattcgagatgagatttgggtggggttgctgagccaaaacaaaccacatcattgccatactatattgtacttcaaatgttatctgagaaacggctctgcagggtcacctaatgatagaaaccagagtctatgtttaggagtcatgatatggaagaggggagtcattggagccacatacctgggttcagctccaggctgcgctgtgcagtgagtaccctagtgctggatactaccccaaatggggataacagtgcagctatgacaggggcttcgtcagtttttaaaaatttagagataatttttactaggtgcccagtatagtcagcattctataaacaatagttgactattttaaggaaatcattgaaagatcttaccctgatacttaagaaatcaagtgtgttgttgtgtataatatcccaaataactgaatcttaaaatagacatgagtgaccagtgttcagagaattagttgtttgttagtttcttcagtaagtattgacttaaggccaccatgtgctaggcaccaggtgttaatggttaggagggagttggaatctaatgttctgttactgagattcttaggaatttgaagaaaacacaagagaacatttaagcctgaagtgcatctaggcccattgcaagttgcatttttaaataagtatttatttatttatatctaaaaccattgcttttcaaaacaatgggaatttacagatcttgggtgtgtggttgtttggaacaaatgagctaaggtcatgtgttagccttagccccactaagcagtctagcatattcacaaagattgttttatatattttatttcagtcaactattgttccagattgtaggaaaacgggttaggaaatataacaatatatttttttggattaatgaaagaaaagggttgaaaatgagtatttctcattcaaagtagattatacaacaggtaagtttggggcactatttttctattaatgtgaaaagctcagaaataagagctcacccaaattagaaaaactttgtttctggaatgaaaactattcagagttcaccaattttaaggaataagaacaaggaacactaaattgtattcagtaaacatgaacactgatacagagccgtgcagacagagtgccttctctgttttctttctgtgacactgtgaggatggaatggccctaaataagaccagttgctaggtggcacttttctagtactagatggcaaaatgctatccagcagactacacactggctttccagagacctcctaggctttaacattgggcagatatcaacatcaaaaagagaaataacaggtactggttcttttaggaggaaatttcattgtaggtgcgggagtggaccaggataggttagcaaaacctcaaaccatactgtggcatatgcttcacttctaggttccatccaattaaaagaactgattggttgttggggtgggtagaggagcttcaaaggaaaggagtcccttgtgacctgtggagacagtccccgggcagcaagagcaggagtagaagaggggtgcccgatggtatgtgaggggatggcagaagtctggtagcctgggcgtgtggagtttggctcagccatcctcagtcctggtaacccaacagcagccccagacccttctggatttggacatttcattttccaacatgtgagtttattttctaaataaatggctatgttctcatgagattctgaaggccttatagtcatattaaatgtgtgtttatgacaaatggttgatttatattttataaaaataagacactgatttccacattcttctcattttcccccttcctgttttgtaatggttatattatgtctacatcatcagagcataaaattttattactacacgttattctgtcctcttcattcctgttgtttagttttggttctaaaggtcaaaataaggctcacactgtttatgctgtaacttctccaatgatttttttggttattaaaagcctattctctagcatatcactcaagaaggactcacaggaataggatttcattggttatcatgtgtttataatgtcagtttggctcactgcactgcattgtctgctggtgtatattattgctatcaaaaagaatgactccattctgattttgtttcacagcttggatttattcatttgaaagtggggactaaataccctggggatttttcccatttttctttcaatccaattgtcttgaccatccggggtcagttttcccaggtgtgtggtgtgtcctttcaatatgtgggccgaactcttcattcacttcaggaaagttttgagctgtagttgatagcatttcttttccagtgctttgtttttcttctgggactcagagggcttggatcttctccactgtctttattattttctgtcagatccttttaactctttgtttctgtttggtaaattttatctttctcctttccatcccagtttctcttactattctctctgtggtgcctatttgctctagtcttccttctaaactagtttctgtttctgaaatttttccttatgtttctaattacttcctgtgctgtcagctgtgttttatgtgcgtgctctctggtcatctcatgtctgagcttccctaattctgatttatgttgttgtgtcatagcgtctattattgttcatttctcttttttttttttttttttttttttgagacagagtctcgctctttcacccaggctggagtgcagtggcgcaatctcggctcactgcaagctccacctcccgggttcatgccattctcctgcctcagcctcccgagtagctgggactacaggcgcccgccaccacgcccggctaattttttgtatttttagtagagacggggtttcaccgtgttagccaggatggtcttgatctcctgacctcgtgatccgcccgcctcggcctcccaaagtgctgggattacaagcgagagccaccgcgcccggctggtttttctggttcttttaggaggaagtttcattgtaggagtgaaagtggaccaaaatagttttctaatttaatgactctagaattctctattctttgtaaccacaaaatattaaaacatgcatcctcaccacatccccaggactttctgagatctgtccctctttttccttcatttaaagtttcattcccttttttttgcccaaggtgcccattctgcttagttgaggctcttacttcccgtggttccttctcagtgcaggactctctcctgctgtgagggagttctcatcagctccacccagccctccctagagccctgcccttgtgctgctgtagtctcctggcaagtcctctcggagttccacctgttttcacatcttcactgagttcttcattccgggaggcaggcagggggacttcccctttgagatttttgggagatttctgagttcttggctcttgggccttatcttctcactttccctgatagcacgggggtctcagtgtgctctgaggtgttttgaggttttgtagggtactttgtcatctggttgtgtgaaagctgttgcccatggagtttttttccttttggcttccttttctaagactatgtaaaatactcaatttgcaggttattgaagcaaacctagatggagaattgaatttgaaaatagaaactgaattagtatgtgttacaactcattttaaagatcttggaaatcctccattaggtaagttttctagtgggttatattttgctttggataagttaattgtttcagataacctacctgttgaggtctcttcatgtaaaaaggttgaaattcagttgactttgtttcatgcttgggtgaagaacaaaggaattgagactggactacgtatccctgtggtgtagtggggcagttagccaccagggggagaagctgtgccaccaagtagctgacagatctgtgcagggtctccatcctctgtagaattcggatcaagttacataacctccaagatcccttccagctattcaattcctgtcctactcctaaagatttctatttctcaacctggcatggattcagaaaggtagatacatttgttcttatattctcctccttcagttacttccatatgtatgaaattagtgtagcagatgcaaaactgtttcacttgatcacatttcttatctcatacaaggtaataagggacgatagagtcagttcagcaagtggggagagaggggacggttggacagtttggtgagttataagccaagagggggttagaatcatggctggaaagtggcagctgcacagtagcaggggctgcctgagcaggaaagcaggtaaaggaccaggggagaaacacctggggatgatgagaaaatcattttatgatacataagtgtgccagaaccaataaaatcggccctagtcacatttaagttactacgagtctgcttgaatataaacacagattttagcatagagttggaaggaatttttactttctagttaagagcatcctgctccagcagagtgaaatccatacggttatgcctttgataatattgtgtaaagcgattcattctgatgtcactcattttgtttcttttaataaacataaggtgggacttatctttggtactttctcagaggtagaaaggatgttttctttttttttttaattccacttcagaatgacaggccttgtattagttaatgtatatattttcactcttaaaatacatagtaagtacaaataaatacaattttctttgacctgaagagggagattgagttatatttcaagtcccctgtaaataaagatgccttggaaattatcatagtattttaaatagttaggacctaatgcttaatgaatgacaacatttacaagttgcaatatttcttcaggatgctaaaatcagtgctaaagtgaatcatttatttaagtaaaatgcattgagtatctccaggtttcctgttacgtgggaagatgttgtatttaaatgcattcctatcattttagcctctgaaagcacccatgaggacagaaacgtggaacacatggctgaagtgcacatagatattaggaagctcctacagtttcttgctggacaacaagtaaatcccacaaaggccttatgcagtgagtgtgcttctctgttttgtttttcatattctttcatattctaaatactgcagtcaactctagtctaacagattgcatatagtctcataaatccaaaaaaaaaaaaaaaagctcaattatgtggactttaacttcctagaacagtggggttttttaaattttcctagattcagaagtacctaaggtggcagcagagaaacaacccctgggcactctgttagggcctgaaacctgcagccacactggttggtaggtgggttgtgtgctgcctcagttggccagcacacctggagatgccatcgggagaatgggtgcagatcatcccaccttctccatggtcatctaatttgacctgctcagagtgccagacacggtttggcttggatttaagttttcccttgtgatgtcttgtttcctttctgtggctatgctggcctgcattcgctgccccatatctgtcccttggctgctggttgttaacagttgcctcttgattctggctgggccccatcttgtgaggtcacacacctgctccagcactcttcatctactgaccacacatgagaaaggcattacctgccaagagcttttcaaggcatttttgtcaccttactactgaaatcacagcaacctaaaagcgactgcatcctggatttgaagttccacgttttgtagcatagctcccaggctgagctgagagggaggttgagccaacactgcacctcatccccttcagatctgcagtgtgctgtagagaaggaacagaagattctaggtggcaatgtcaaggaccagcccttttgaatgagagacatgaagagaatcagaagagaccatgggaggggcaatgggtgtttgggaattggggaaggtgtcacacagttggagtgatgggcacagaaggagatatcgccagagaagcagctctgagggtagagatggagaagctagactaggccagatcatggggagttttggggtgaggtacctgtgctgcattttaaggaactttgacatggacgatgtcatatttctagggctgagcatagtgggagctgtgtggcagtgcagggtccttaaaggtgcttctgagaacctcgatgtgcatggagatcgcctgaaggtcatgtaaagggactccttattcatagtttgggctgggcctcatggctgcacttctcccaagctcctgtacaatgcccagacccttggtcctgacaagcacagtgtgaatggtgagagagtgaaatacccctcctgtctgcagagtgtggaaacacagggtgtggggggcccctgcgctgcacaacatcagtctttgaacttggtattttggggaccttctgaatccaaggctgttgaggaacatggaagagttcttatcaaaggtggttgactaagccaagtgtcttcccaacattcactttggtgtctccacgtgtagcagagaaaggaagaccagcaaattgtgatgtagcaaaaattttttttaaaacaccgtgggttgaacttctcataccttcttaacttcccaaagccccttttctgtctctgttagtctccttcaggtgtcggctcaattgtcccctcctctagctaggtcctgccaccctcagtctctgcctctcctgtgcccttgcaccacctctcctaaagaatgtttgtcttcctgcttgtcctttctggtcctttccccaacctcccatctcctgggattggcctctctgcagcctgctcacacatggtttcttgtcactcactcatatctgctggagagctttcctcggctgctgtgctgcagctccccgagctctcggtggttgtcacactgtgtgctcctgcccaccctcatgtgctctttacttccctgcttggttgcatgcctgatgccttggattttagccatcacccatggccctcacgggattggcaggaccgttgagatgcagggatccatcccatgtagcagtgtgtgacacagcctgccccaggtgttgggggatcctggctcttggctcttctcagcacagttcctccactcactggtgaggagctgctcttcgctgcagaaggatgctcatgtgggtgaatgtggtttgccaggaagccagcctgctgggtgttttgccaagggcttgggccgcttcactcttcctctcctcgcacagggagccgccagtgctggggccgtgatgtagcctcagctgtggcagtgagagtgagagactgtggtctctgcagctgcctcagggaagacagatgcctaaaacaggaggtgcaggctgggaaggctgttctgaaaaagtagagatcaaaatgtgtgtgctgcactaggtctctaaaatcatggcttttctcttcccagatattgtgaataacaagatggtgcattttgatctgcttcatgaagacgtgtcccttcagtatttcatccctgcgctgtcctagcaccctgtcgctggagttggcatgcagagactttgtcaggatgggagaggccgcaggtgttgtgttctgatcactggtctgtgccctcacagcaccgcacatcgacacactgtacttatttgtccctctctaacattttaactaaaagttgattcaacaacacacagttggataaacatatcacttcatgttgctcatgtctgttttgctttgtttttaagacactgaaaagaaaagctagaatttatttattcagactttaaagaacaatttctcattgatgttgtgaaaatcgtcatgtatttagacttggtgtagtagccagaattcgtaaagctgttgcctgggagcttggtactttccctccaggcagaggctctagctcagcacggcctgtagcgcacagtcagtcttgcatttcagtgtgttcaccccgctgctcctgccccttggagcccagtgacagaaagaacagcctctgtcaccccgccgccactgccttggttactcagagcactgtggggtgtcacagctgcagcatttggagtctctctcttgctgaggactcaagcccacctgagtccactcccctcttgatgcctagagagctggcccagccaacacagctcttagctgggagctccttctgccattccaactagtttcttcctggggccagttttgggtttaggttgtaattccttatatttctttcttccacagtgtatcggatctgtcgttctggaaagaagacccttctatttagagtagaaacaaacgaaacttctaaggtatcatctgtgttaagtgatgagaccatatttctttgatgtttctgaacatcaaagctgattcagtactggtagatgtgctcattctccctgaaacatacccatcatatttcctattataattacatctcattgtcctgtggaggtggacatgataaacattatcttttgttttcttgttttgttttgtttgagacggtctcattctgtcacccagactggagtgcagtgccacaatcatggctcaccgcattgacctccttggctcaaggcatcctcccacctcagcttcctgactagctgggactactggtgtgcaccaccacacccagctaattttcaatttttcatagagacagggtctcactgtgttgtccaggctggtcttgaactcctgggctcaagccacccgcccacctgggcctcccaaagtgctgggattacaggcatcagccatcacacccatccataaacattatattaatgtcacattacaaaactgagacctaagttgcttaggataaaatgaaattggaagactagctaacatgaaaatttatattttggctttttcatgttttttgataaaaccagtgtatttgaatgattcttttgatgtttagtaatggttttttgtttgttttttggtttttttttttgagacggagtctcactctgtcgccagtctggagtgctagtggcgcgatcttggcttactgcagcctccacttcccaagttcaagcgattctcctgcctcagcctcccgagtagctgggactacaggcgcatgccaccacgcccggctaatttttgtatttttagtagagacggagtttcactgtgttggccaggatggtctcgatctcgacctcgtgatcacccaccttggcctctcaaagtgctgggattacaggcgtgagccaccacgcctggcctatgtttaataatgttgaaataggatggaatattttgttaaattaacattttaaaattagaagacaccgttttaatttttaaacccttcctcctctcattgtaacgaaattaattccagctgcagtgagaaaacttaaaaatcatgatacaaaatgaaacaatatctgaaagtagttttataaaactgaaattgctgttaaagagaatgtgttagtgacttaaccatttgctctatgtgatgtttattatcaaatacatataattttgaagattttaatgaatggcttaagattttatctttgtgtagaatgtggctaaagaaaccttagttgagattcaagaagttggtgtctgtttctgattcttatcacaacttgctacttagtgtctaccaagtcctccacctctttgctcctcaaagagctgtgaaaaatgatggcaggagccggtacaacaccacagacttagagaagggcacagtgctgctttattgaatgatctaccaaggtaaaattttgccgggtcaagaaatagcaatttaatccatttaaaggaatgaatataatttgaaacattaacttatttcaagactaacatctcaaagtgttgagaccttttttaaaagagctttctggattttgagcatactttcactggctgtgatttataagaatttgtggtttgtggagtactgtcctaaatgccagggtaaaataaggcagtcccatgccttacctgccctgggctcagggcctcacatccttttggtacgcacatcttttctcttctcccttgttctgctctcccgcagcatatacctcctagccccaggcaattacttgtctaatatctatctctatatatttgcctattctggcttttagctttttttttttttttcctgagggagacagggtctggctttgtcccccatgctggagtgcagtggtacagtcatggctcactgcagtctcaaactcctgggcttaagcagtcctcctgcctcaccctcccaagtagctggaactacaggtgtgtgccactgcgcccagctaatttttatattgttttgtagatatgaggttttgtacgttgcccaggactcctgggcttaagcagtctgcccgcctcagcctcccaaagtgcttggatcacagctgtgagccaccacacccagcaattctttttatccaagaattttatcacctgagttttgaggtcattctgtgccatatcagagacacttaagaatttcccattccagttgctcctggctagcatccaagtggccctgccatcctcctccagcccttccttggcccagcagggaactgcttggccatcaggtctgtaggctgagtttatagtgaggtactgtgcctggtgtgaaggagcccactcttggggacctagaatgtggcctcaacagtagtcctggggttgggat

SEQ ID NO: 17351 - DNA, 26438 bp, Human
tacaaggtgagctcattgtgagcaggatgtttatctgctctacccacttcctcatctcagtgacttgtacttatttggtctcagtaaatgaagtttttctggccattagcacattatgtgcattctaatcacttacttgcctgtatctcccactggtggataagtttcttgaggactggactcagcatgatttagctttgtgtccagtatgtgaactgagcactgtgccaggcaaaaccaaagtgtatagtaaatgttaaattaaatgggtgaaggtaacttcatttattatttagtatttattacaccttaaataactctaacattaaaagtttagtgttaaaaaaatgaaagatttgccaaaagcagatgagcctataagggaaatggacaaggagagactagagatagaggaggagatctaggagaatgtggtgtcacaggaaaggaaagactttagatggagagagaccaaatatgaaggcaattggtttagcagcatggaggtctctggggagctatgtagagtcatttttccttgggaggaaagggccaggagccacagtggggtgcactgatgagtgagtgagtggaagatgtaaagatggagggaaaaaatattaataccttttcaagaactttacctatacaaaagaggagggtaatagggaagcaaaaagacacgggagcaggatccagagaggattttcttttaaaatggggcatcatgagtatgttaaaagctgacagaatggggaaaactttctgggaaaaatacaaaacctttaataagatctaagatacttaattacataaaactatttttgcatgataaaatcaagtgaaacattgggaaagaatatttttaacatacataacagatgtgacacacaattttgatgatcacaaacagaggtgcaaaaacaacgtatttgtaactgcattctacctgcttctcagctgtcatttctatttgtagtagaagacaaccacaccaacagacaaaaaaattaaaatatcccctcaaagttatttagttattgttctgtactcatccttaaaaacccagattataggttctgtcttcaaggaatccatcctttttccatgctttgtacacacttgtattggccaacataacagtgttttgtaattacatactgcacatatgcatctccaacctgaccctgagtttgttgagagcagagacattctcagtatccagtttatgcccattaactaagttgattcctgttgattgatagtcacgtaagtcccctgtgggcttcggtgttttgcagtgttaggtaggactatttctgcatctgtcacattcctagaaggactgttttcagtctccagcaagctcccctgttgccccttctgagtcggaacccaccttctccaaatataactatgctctgatttctagcaccatcgattagttttgcctgttcttgaacctcctgtacacacagcttgttttcttgtgtctgacttcttttgttcaatggtatgtctgtgagatcaaaatgtgttgatgtatgtcagcaggtcagcagtttgttctttttccttgtgtagtattttattgcatgaatgatgattgttttaataataaataataataaattttttattttgctttttagagaaaaggcttttcctaactctagaatattatttagtcaaggatatgtttggttttaaatgttttcctatcttacatgggtctctaaaacataaggaaaacaagagcccatgtttctttttctccttaaaaacacgatttttaaaaatacacaaatgaaaattaatgaactgttagttgagttcctttccacagagttggggggaagttggtcttccagggtgttgctctgtagggcccccctgaatgttaccttggattatgggagtagcagggggcttccagagtagagggctccctttcctgatgtgcgtttatgtctcctcctgtctccttgcatcggcgatttccagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccaggtaagcggccgcccagccccgcggcaccagttgggcacagcgcgtggtctcggctcccagcacgcccctcccgctccgcaccccactcttccccctagtcggctccgggttaggctccgacaccggaaggcactccagggagactggaaggtgggtgggggagcagggccttcctacctgtttccagctcctgccagcgtcgcttaagcagcagaggagagccctggctcccgcctccagcttcttttggccctctcagaaccagccgccgtgccaagtcccctcagaggcccaagcaacagccagctgcgccccccgcggtggtcagagcgccagccaagccacggtcccctccgaggtctgagcgtcagccacggtcccctccgaggtctgagcgtcagccacggtcccctccgaggtctgagcgtcagccacggtcccctccgaggtctgagcgtcagccacgtccccgcccagaggtccgaccaccgccagccaagcagcgtccccctcagaagtccaagcaacagccgcgcagcagccccctcagagggccaggcgccagccgtggggggtcccccgtcaaagcttctaggttctggtaacaccatctcttcccttttgttccccagccctaaggttagtagttgcttcctgtgtttactaacaccgggctgtctccatggccctcttcagccttattacccaacctgtgtaatcagctccctccattaaatcccctctgtttgaaatacctagtgtggcttctggtttcctcctaggtgctattggtgcatacttcaggtggctgtggccattgcttccgttgtctaataggactggaagttgttaatctatcaattgagattattgaccatggtaacagattgaataaatgagttcctcaatgcctatgcctcagggagataacgaatggtgactctaatcaatatccgtataagtaaaaggagagggtaatccattggacccatccatcttcccaacacacttcatctgatgtcaatctcactggcaataccattcattcattcactcattcacttactcaacaaatcctattgcatacctgtaaagttccatttgatgtgctgggggaagggaatatggcagtgaggaagccgtgttgtttgagatttaccaggaccaaataagagaataggtgtcatcgtgtagggatcagtgccctaatgttttcataatatgcatgtacatgggaccatgagaaccataagcagggagttattggctctgtaggctatttttttttttttttttgagcagttttaggttcacagcaaaattaaggggaaggtacagagatttcctctatattcttgccccagtacacacatgcctggccaattttttattatttatttatttatttatttatttattttactgttctgaaggtatatcagcatgccaactttttagaccttttactatttggaactgaatctgtttataagttagtagtgggtgttaattgtatttgagattctcatatctactctgatacccagcacttgtgtagcatctactatgtgtaggtatcacatgatgtttactgatttagtaggaagaagagtcaatggggaagaatgttaaagatgcccctagaaaatgtgatttttgggtcaccactaaggcctgggtacgtgcctttttagtaagcattcaccccccaaaggtacagttaggtagacagtatgcagactacacaatgagcaatgctgacctaaacaatccataaatgaataatccagattatttgtgatgtgaggtaaagaaatgtggagagtgataaatttatggtaccaaaagtgaaagcattaaaaaggcacaagattaggcaagtttaatttgtgaaggaagtaactagtcactaaaactttaatagcaagttgtatgacaggttacctagtcattaactgagtccctcttaaggagcctgagtagaagggtcctaggacaggtaagtattgatatatggaaatagttagaaaatgtatgaaacagaggaaattaattgtataaaaggcatgccacctatagtggtggctttgggtggctggagttcaatcaggacatggaaaggagttagaagacaatgaaagcaaacttcaccatacccacagatttgtctggacctaaccttgatcagtgtattcacctaaattcaggagataccctagtgttggtgtgctttgactctgtcagttaactaatttcagtgggtatcagagaaggtgcctccacaggccgttattacctcctcagccattgtcccttacctgggaacagaggatctgaaagtcttcattcgtaatgtcccatgacttcacttatgcactgtcttgagtcctatttgagatattcatttttccttcttagattcccaaaggtcttcaggtaatatattggagccacttcttcatcatattgtctattccttttattgatactgattgactattttgaatcaaaggagtgggaggcaggttgatgtgatgggaaatatttgctcttaagcagagctactaacttgcacatgaagaaagggtaaaaaagattttctgaagctaacttgctttctgaaacagtgctatttctgaggtattgcttttagaggttaaataattttggcaaaggcctaattggattcttaataactcccttggataggtcttctcaaaaaccagagaatgatttaatcttagaaactgattgtacgatttccagcatcctgattaaacatggtagcattcataatatttgataggaggaaaccgtggcatctccctcttagtttattctgtcctctcagttctaagattttaggatttcacaaggttgtccttgcctttgggtttaacaggtatgtcctgggcctcttttggtttcagtgttctgcttttgggagctggggatctgtggttctttgaaaaccaccatggctgtgggtggttaatttggagtcaatcagtcacatatattgggaagtgctgtgtgtgcctttgactcatttttttctgcacagcatgttttatattattaaattgagccctgcacacaagcagcctggaagactatgattttccaggtaacagcagagctagagaaaaggcctgagctctttgctttctgttcaggctcttgttctgcctgtgtctcaggttgcattattgcttttattagtttgggtgactgaactcttgaattttgccctatctgtggcatatactctttcctatctgggagcagtcctttatacatcctggtggtccctatagcacaatgcttatgcagaacagatgcttttgcagaggcctaggttagccagagaggcttccagtcctgggagctgtgtgttgttttggagtgtgacagcctctgcctggtcacaggtccttacctggtccagaccacatggttaactacgctttctctgatagccttaacccaattgtctctcattctccttcaacactcgttttataaatccctgattctagatcaagctcacaacctgcctgcattggttttccagctgctgaggatggtcatgtgtgcatagagctgctgagtgcagtttgggaaaagctttatagcctggtgggttggtgccaccacaaatggatgaaccccagccactccccagactgtcctggctccaccagcccccacacgttcatcagaatatgcatctgtctttaaatccttcccctcagcctcagaggttgaagcattcattcgctgatgaggccagtcccccacccctccctgtgatcttccaacctcttatctcctttgaggtcttgctgtacaacttagcaacccccctaaccacttcagcctttgtatcttgtctctttctcattagcattttgacgtgttttgctctctcatattgactgtttgttcacgtctggccctatccttttttctctctaccttagacaaattttaaaaagaatagtgtaaactcgtcatctttacttcctcaaatcccatttgctcttcaattcattgtgttctaatttcttcccttagcacccccgcccctggaattccccttgtgcagattcctccagaagtaacaatgcaagggcaagaagtttatttgggaggtgaaggggacactggaggaatgtgggaagcaagataaggaagggaaagagccaattaaaaaaaagcattatctaaccaattctcaccgtgggttcctgggacttagtcctgccgaggacctctggggaacagtgtagacatgtgcgtcagttatcttaccagaggggtggaggaactgggatatttatacaccagttctcgtcagtcattagtcagccaacgctgcttcaaggatgggggcattcattctttgacacgtctagcttgttaaggagatggcaaagtggactgcagcagcaagataaaagccctcaggaaaagaaaggcaagtgctggcacctggaagtggggctgagcacaagagtggtaagggcaaggggttatgggcaaggcaccagtagtgtttgctctaatggttacctgtggccttcatgctgcttttcctaatgagtgctgaacccaatctgtatatcagtggtgctttctgttggatttgttgggctgttctctcattcagtctttaaactctctgttctcttggtttctgtgactctcttcttccttttctctgcaggaactttccttcttcatcttcttgtgagtgcttccttttctgccaattgctcaaccttgaggtcccctagggttccctactgagctctctgcttatatgattttgccttctcttgtggttttaattatgactcacgtgtgatgacttctaaaccttaattcatcattgacattaatatgtgagcctattcactcagcagatcaatttgatgttggaaaacctaatctgtctacacttgatttctttcctacaaaacttgttcttctttttgtttgctatctcagcaaataacacagctgtccaactaatcccccaagttggaaacctaagcacattgtaacttccaattttcccctgcatataaatgctggccaatttgactttctgatgggaaggggtgcaggattgagatcaagctagaaacaaagtagagggaatggaggtagttgataaaataagtctcctccatagcacatatggagggattggcctttgatgggaacaagaaaagctgttagattgtgcaaagtagagagagacccattaataggcattaagatagaggtcatgcccgagaatgagcgagctagaagtttgagaaggttagggtacacctggaatgttagagaccaggcttctaggcagtagttagggctggctgagctgagctcaacagagctgtatataaatcatttgttcttaaggagctccttctccaatgaaaggaaacagattgccacctctgaaattatcagtggaatcacacaactccacatccacactctgcttctcttccaacttgtttgccaaatgccctcacagcaactgttcttaaactttaccatgtgcctccagtgttctgactcctccatttttatctccatctatcagactccactttcctcgctttccaaattagaaatgatatcccaacattttaatgtcgttcacaaataccctagaatcccctgccttctgaatatttgtcttacacccctgggaaaaccccagcctttgatgaacccagctaactggcttcaccatgtttgtttttgggcagctaagcatcactggagaacagcacacagcaggacgatagtagctgggtataagcagaattgtgtttatcctatcactaagcagtttcctttgggcagttatagttcaattgcatgcattcagacaaaaaaggaagcatgtacctcaaaagtgtcatgtatgcatgtgtagtttatatgctcacacacatacttcatatgtatcaggcttactgaagtataatttacatgtggtaaaattaaactcttttggcatacatttctacgcacatagtcctgtgactactgccacaagtaagatatagaatattttcattacccttcaaaatttccttatatttcacctatgcagtcaactccccagcccatagtaaccactgacctatcttctgtccctaacttttgccttttctaagattccatataagtggaattatgtaatattatagccttttgagcctggcttcttttacttaacatagtgcttttgaaccatattgttgcattttttttttttttttgagacggagtctcactctgttgcccaggctggagtgcaatggcatgatctcggctcactgcaacctctgccttctgggttcaagtgattctcctgcctcagcctcctgagtagctgggattacaggcatgcgccaccatgcctggctaatttttgtatttttagtagagagggctttcactatgttggtcaggctggtcttgaactcctgacctcatgatctgcccacctcggactttcaaagtgctgggattacaggcataagccaccgcgcctggccccaacattttaatctctttcacaaataccctagaatcccttgccttctgaatatctgtcttatacccctgggaaaaccccagccttggatgaacacaactatatatacaggcatccctatacagtatatatgtatatagtatatatacatatgcatccatatagtctctctctatatatgtgtatgtttatatgtatgtgcatatatgtatatacatacgtgcacatatgtgtgtgagagtgtttgtgtgtgtgtgtgtatatatatatatatggattcacatgccacagtttgctactcaccggttgaaagatgtttgtttccagttttggtgattatgaataaagctgtgaacattatgtgaacataagttttcctttctattgggtaaataattgggactggtaatgctgggtaatatggtagttatttgtttaaacttctaagaaacagctaaattattttccaaagaagttgtaacatttttcattcctaccagtaacctgggcttattgttaacacttggtactatcagctttaaaaattttattcattctgataggtatgtaatggtattcattgtagttttaattttgcattttcctaatgactagtgaagttgagcatcttttaatgagtataaagataatccactaaagacacttatttggtgaaatctctgcttaaatcttctacatataaaaatcggattgttttattattgtattttgaggggtctaaaaatattctagatacaagacatttataaacaatatgttttgcaagcattttctccaggtctgtgacttgcctttttattttattcacagtgttttgtgaagagccaaagttttgacaaagtcaaatttatcaaattttactatcacactggtctttaaaaataaaaaattattattttttatttttgataccccagtttcttcacctctctgatgagatacagatgagatactgatgtacaggtctacactgttccccagggacccccagcagggtcatactttttgtgttgtatttaagaaatctttttctaattcaaggtcacaaagatattttcttgtagaaattttaaattctaggttttacttttacagtattatccattttaagttaattttttgtaatggtgtgacgtatgaattgaggttcaatttttttgtatatggtttgcatatggctcaatttttttgtaattatttcaacatcatttgttgaaaagtttctccactgaattacctttgcaatttggccaaaaatcagttgatcatatatttatgggtttatttctagactttctattttttctattaatttatatatctttcctttcaccaaagccatactttattactgtagcttagtagtaagtattgaaatcagttagtgtgaattctccaacattgttcttcatttaaaaaaattgttctggtaaaaaattattcgagtttttttacttttccatataaattttcattgtgtcagattctacaatatattatggtaggattttgaaaggagctgtgttgaccttataaatcaatttggggaaaactataacaatactgagtctgataattcatgaacatggtatatctctctatttatttaggtctttttttgttttgtagtttctagtacatagatcttgcacatattttgtttggtttgtacctaagattttatgctttttggtgatatcaaaaatagcattctttttcaattttgatttctaattgttcattgctagtatacaaaaatataagtgaattttgtatattgatcatgtatcctgtgattttgctaaacttacctattctagattttttgtggtagactctagggttttctatactgcaaattatgttgtctttgaatagagacggtttgatatttttcttttcaatctgtatgcctattttttgtatatgtttcgaactgctattttgttcaaaacatttaatttttagagaaatattttaacaagattaaattcttgccaaattggctctctggcttattacaagggattacagcctgaaggcccaagcctaataacacaagatgcttaggttaggttgttagtttattcctgtgctttctttatatccttatttcaagatatggctcaactttcctcatggcctattgactgatgtactgtatcatcaaaatagaaaattggcacgagcattctttggatgtaaaaaatcacagaggtcctaaatactattagaattactatggtggtaattgttcaaaattgcctaatgtcatcttaatggttatgagagatggttaccaaagctctagggattggatttacaaggtggattcaatttcagttcacatttggggacaatctcagtcttggagggagttaacatcttgaagaacagtcatgtggtagttgtccatgtgtggaccaaagactatggcactttcttctcaaaccctacatggccctgaattatctgtttcctctattcagctatgtgggcagtctttataatttaacctttcaaagctgtgctacaatacgatgactagagcattttatataggacatgacttttgtgtactagtgacctgttattttcctgttttgggtttgtcagggtgattgatgtggggtattttgtggaagcagagtctaaagagtcatcattattggcagtgataaggggtcctggcatagccctctgacttaagagccttcacacttcttgctgagcagatggtcgccctttctgtgagctcccttgatacttccactgctataatttggacatctttgctgatcatcacttacttgtccatcttccttgctggatggagtgtgcataagtcagggtcagagaatcttacactcatccccccagggcctcactcagggcctggctgatgatgttgactgaatgagccctataaatacacttgcagtcagtctggcacagtgagaagggtaagggctctggcatcattccaacaattggaaattaaaatggaaaaaaaaaggcatgaattgaaaaggtttgaatctgagctctgctgcctgtggatttcctgtgtcttaagtacttattctaagtcacatttttcccatctgtaaaatgagggtattatctatttcattagttcatcatattataggactaggtaagtggatattattggaacaattatttaatgaatacattgtgtcacttaaccctatctactagcatattatctccaactcaattgccttccctggttgattgggagttcagggctgttgctatataaactggtcatccccattaccatcaatgtggctgctattgctagtaaaatgccaattagaaaattagatgctcatattacctaggatgccacagtggctgattgcagagatacttgctgagggtgatgcctgcgatctgtgggcttccgtgctagtctcagcacctgggttttatattcagcagtatctatggggagttcgaaaacatgcaggctgccacatgtctggaggtcatacaggcaatccagaaagtgtaaagagattccttcctcaaatttcaagggatgtgttccaacctttcaggctacaattcactctacaagttttaataacatatttctgcatttatttttttctggtatcctcaatccagtttgaagggtatcagctttgctagcgtgatacatcatttgggattttaaaaatggtattgctaatatctgagtataaattttatttctaatattaaaaactttccaaattacacaaaagctgtgatcctcataagttttgtctctagaataaaattatgtgacattcctaatgcatgcattttgttttttgtgtatttgttttttaaactaagaactttgatgatgcactgaaactatttgacatagcctcatttcaaaggcagtcacatagagttctgctatctaaataaattaaagctgatatcacacaacatttcagttgggtaagcttgcaggcaatgcttgtctgggccacatatttataatgtctaatgtctttattggatgttgtttatctccttcttgaacacgatttgttcccccatcaaagtggaaacatgtcagtatgttcacaattttataagtgcatatactctatgtgtatatgtatgtacattcacatctttacgtctataagtagtaaaatattttttccaggagtgggtgtactttaatttcctttgtgtttttctatgtttcaaaattatctacaatgattaaccagaaaagcaataattatcatacataaaatagaactcttaaagaatatctttcctaggctcgggccaagaaaaaaatatcatattatttttggccagagactaccagaattaagaaattaaagagaaggattttgcagaataacctcaaaggtagtctcaaaatccacaattatactaactgaacacagagaaagagagagagtatacatcacctacctatgtcatgtgtttttctttttctctttgtaaaccagattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggaggtgagcagggctatctctgtgtgttgtactccagtcagggggttccagcagcacccgcaggctctagagctcaatgcacagttctttttgtttcacctgcagtcctttcttctccaggatatgcacaggcctccagggtctttcatggctcagggtcagggtggctcaagtgccaacccacatgttgtcctccaaatattcccttctatccctggcatgctgttgctgagctcaacttttaatttttgactttctcctttgtaattaatctctatctgggtttctctctttctctgtgccatttggtttccttaattagttccctgtgccagcccatagtcagagccataattggctctggggaagatccaagttattttctgagtaagatattaggcttccatatgatccagagatgcaaagaaatccctagagagtgtaggagttgtctaaatccatgtgtcagatgtagccaacgaattatgtcagaagcagagagaaaaggcctgaaaagcagctctctcccactcctcaggcccttgtctccaaccttacatgaggctttttgaacatctcctcctggcccagctggggtgagagcaagtcctcgaaggcactgcctttgagccttgctcagcccatctgaactatcccaactctagaattgactgctttcgaattgtgtgaccttgggaatgttatctggcttcaaccacaatgccctacccccagctcctctcccaaatgatcctagatacagggctgcttccccccgaccctaccccacctcgggacacaggctcatggcctcatggcacttcaccaccagaagtggtgctcagagttcctatttccacatctaaccccctaattcctgggaaagtctgaggcctggtccccccagtgctttccctggctggcctctccacattttcatctgatggtggagtgagatcaggaaaaataggacaggagctttgccttgggggagaagagagttaagtgtggaaaggggtgagttataggaggttaagcagtccaagatttctctctctgtgtaggaggccatttcctgatgtgaggggtctgaacccaattatgatgggacagggttgggcattgacttcccatctcttctctctgtttttctcccactatctgtagcccaaaactcttatggaggactttgatctttagtataggctattggtcagggccataggaactaaccccgatcctcactccaccaggatctaccacatcccctacacacaaacacatgctgtggggagggagttttcccctgggtcaagttgaggatccttagatcaccttgtgctcctgtggactggtgtgtgcgtgtgtgtgtgtgtgtgtgtgtgtgtgtgtgtgtgtgtgtgtatgttgggaaacttagctttcagagaatgtctatgggctctcattttctctctcacacaaaaatactcgggacttctccaagtccctgaggagcctgaccactgaagctgatcatgagatgactgtatgctgacacacccccttcaggggcctggccttgacttagggctgcactgtatcctcagcaacggccttgcaggagccccttttggactgctttccctattcagcccagagttggggtggtgggagaagaggggttggagtgaatccatctctattcaaattccagctgggattactctaggagtcttcctggcttgttttgggctcaaacttagctacattgtttattggctcccaaagtcgggattgaagagtgaaaagatgcaggcaatgaatccttctgcacactcctccccaacctttccagcgcttttctacttaggaggccagtggaagggaggagaggccatgccctagcccacaggggacaaggttcattgttcttccaggcttggttcactctgcttttgattcagaagctctttccctacccagcaagactacactttcttgccttctttctattttttctttttgtgcgtataaatggtatgttgtgatatattctcagtgcttgtgcccaccttggaactctgttcttgctcttcattccgcatgtgatactctggtccaagatcttggccaggtgccttctgctcaaatatcgtctcagaggtgcttcccttgaaaactcggtgctgtttccatagttactctatttgatcactctaagtttggttgtcttcatagcacttgtcaccctctggaactattctattcatttatttacttgtttaatgcttggctcttttcccctcctaacgtaaactccatgattgccaacacctgtttacttactacagttccccctccccccacattcctgacactagtaagaaccaataaacacttgttgacggaatgaatgtttgtttgttgttttttataggaatattttttcaaaagttcagatatttttaagaagtcaaaggtgtctgttgtttttagcaacaaggaactgttggcgaccgtgtaggatactctctgtgtgaagtaaatgggaggcgaggaacagaaatttgcaattgtagatgcaattttctccactaggcttgaccacgaaggaaggcagaggagtagggcaagggctggagtgttgcacttactgaggaggcacctgagcatgtgaaagtgctgcggggagggcggtggcacagtgggtgtgtgaagaaggaggagtggatcactgatggagccagcagctgaggagttgagggggccaaatcaggctcagatgagaggatcaggcatggagcaggggtgccttttcactggaaaagagggaaggagaaaaggagagtatagattctggtggatttgcagacttagtagcaggaccttgaggcattttctgcctgtggttttgatttcctctgtaaagtaggagatgaggtggcctgttcacaatgtgggtgatggtgttggggtcagaggcatgaggatgggagagagagttataaagaaatcatttcaactcacatctttgaaatgacctatataattctttctccagatgaatttatatttttattcatttatttaaaattcaagataacattttgccactacagttttgcctacaacttcatatttagatctaaatcccagatctaaacttgaggctcatatggtttcaggtggaaggaataagagttggagaaagaaatgcagagtctaattttcccagcaaataaagattcatgaggaaattttgatgaagggaagctgtaaaaattccaacagattacagggagatggacctgtactctgagacagtaatttgctccctgtccatctaggctgctgtgcttacaccagagaacgtggaaactcagggctggaggggccctgggagggcttcctgcctgactccatcacacatgtctctgtccagctaataacaccattaccaggtacttagtatctctgcttgaataaaaggaagtgtccttagtgggcaaagatgatactgttgacccaagggtcaggtgtgcagttgttacttggagagaatttgcatactcactctttctattgtagtagaggtatacacttgcagggatggttgggtaaggggagtgataaaataacttcttcttgttgagcatcaactatgcattcaccttacatcacaggatgctttgtgtttgtaaatgggaaatgagagaggttgtcatgacccccatggccactgaaaccatgacctttaccttactaccatatgcggcagcctagaattttctaaacagagattggtttagagtaccctggggtacttggagatcccactgtatgagataagaggaaggtagagccagcaggactccaggccacaccttcacatcaacaaaagtaatgtttagtgtctatgttgacttctgacttcatatagataaaggattccactggaacaaaaagagtctgactacattttcacgaatgcaacaaatattgatagaatccttgtgttagtggttttctaaatggtttactgaattaaagagtgtactatttgatatcataagtttgagtttaattgactggtatttcagtgactactcatttcctcttaggcaacagtttactaccatcaagttcagtgctttgactttgatcaactgactgggtttatccaaagtacaggtgagcagaagaacacagatgaggaaacagtcctgataattattcctatatttttagttttaaacaaatttatgtaaaagtattatattttacatggcactaaaatcaatttctgttgcataaggtacattgacatataaacgacattggtaaacataaaataggtttgaggagaggggagaaaacaggaagctacagcttaagtagtggccttacttcatagcaaatcagttatctatcataatttgatcatttggctcaaaaagatctcttaataaaattaagttctaaaaaagtattaaatctaattaccaacattcatattggatttcgaagcatatgcactctcttaagagtcaattcacaacttcaggctggggatctgtgggacccagtagtggtatctggagaggctggtgggctcctccctagaacccaaaaggtgcaaggattttgtagagggaaaggtaaataatgccaagttactggggtctagaaagaaagttttctcttggatcaagagagtgtgagtttcctaagtttcttcagcagggatgttggtcctttagttaggaggtttaaaatcaccaggaagtaagggtgaggaagaaagtctgggtccatgtttgagaaggtgactgatggtggtggaagtccttcctgtgatgagttaatgatgcgtatttctgataaagatgggaagttatttacatcgacattaaccaaatctacccttcatgcagaaagaaagagctcttgggccattctctattaatgaaaccataccagggtcaatattacagtgtctctgaaatacactgaaaatacttccctggctcaggtggtggcccatgctacctccaggcagttctacttgattaatgatgcaatggagataatcctattgcatccaccatcaaggagagttgggcagtcattcagagaaagtgggactcaatagacattctgactattaattcaatcatgtttacatgcagatcaaagggtaaagtttttctttacaccttatatatccttctcttccaaggtggaagtccattcacaaccaattcactgctaggcagacctctttcctaacaagtacagatggatggcatagtggggattagaacacctcagcactcacaggggcatcctatgggagccaggctggcttctaggacctcttatggatggaagttatttagtggatcttcctggatttgattttatttctttgatctcttaagtacatcaatctttgggtttgctacctgtaatttttgtcttaggaaggcagcatctctattctctccaggaagaaatcttgatgcaggaagaagaaaaagcctggtatcctgccctgtttttgttctcatggagattcaacagatttttacgtaatctctttttactataattcaccctgcgtttcttgaattctttgtgaacatccctttctcctgtagctgacagcttctgttctttctcttggggcttatgagctttctgagtcagatcttttagcaaagccttagttttctgctcatggagatcattaaggatctctactaccagctgccagattttgcatttattttcaactagagctttggtggctggcagcagttaaaaaatcattttccaagtttaaaatttttttcttccagctgatgccttgctgacacttcattatttggcttagactataaatggcatcttttttttttttttttttccaattcttgttaatgtgggttttggcattgtctgatgaccctaacttttcatctttttaccatggtaatctgccagttgactctttattttcaaatcatctagttcatttccttttctatgcgttttctcctctgactcaaagatcaagtgctttcagctgtctagtatatttattcattactacaactgcattattttcctaaaccgcagcttctttctgagacttgagatcttatctgatttgctcactgcctcagtaggtaggggctggggcaggagcagttaggggcagaaagagaccacagccttctatttactgcagcctccccatgcccctccaaacaatctgtactgccacctctttctcttcttctaactcctatcttccatctctttcttcacctcaatgcgtacatctctgatcatgacatctgtttttttttttttttttacaacttaaatttaaaccaagaagatcttggtttatagatttgtagcagagctacttaacaacctttccatattcttattgctctggactttataccctcttcactgctttctctctccagatcttgtccctggctgctaactctgatttttcccaaaccagctctgctctgacttatgcagtttcccaccatcaagccaccagcaatgacccctgataagtgtgctgacccatagccaagtgcattctgtctccaagtctctctaattcccaaatggcctgatgacacagttacattagattatgttggataagttctatcactgctgaatctgcttccttaacttgtgttcacctacaattttaacttactattgcttgcattgtttttaagtcttcaaaagtcctcagtctacttgaacacagcttctcttgtgacacttttcctcttctggtctaagtttctttttggtgagctcttggggtcctaataagagaatttctgcagtccagagaaggaggagggagcatctggtaccaaagtaccaaatgtgttcatgagtgtgtgtgtgtgtgtgtgtatgtgtgtgtgtgtgtatgagagagagagagagagagacagagagagagagaagagagagacagaggaaaagagattggtcttccctttttactttttgtagctttcttctttctaccgcttcttgtgttttgggaaaggtgggtttcctcccttcaattccgtatgtctccttgctcaaaaatcatgctgacaggaggtcatggctcctgatacagtaaacctcaggatggtctttgcccatgcaagaggtttggctggcaattcacgttaatttcttctcccttctgacttgaaaaactcaagttgtctgtgaaaatgaaaaaactttagtgtacatatctcacccaacaaggctttataaagctgcttcttaaggcagctctatattcttttttttttttctttttgacagagtcttgctctgttactcaggctggagtgcagtggcacaatctcggctcactgcaacaacctctgcctcccaggctcaagcaattctcatgcctcagctcccgaggagctgggattatgggtgtgtgccaccacacccagcgaattttttgtatttttagtagagacagggattcaccatgttagccaggttcgccttgaactcctggcctcaagttaatcctcccgcctcagcctcccaaagtgctgggattataggtgtgagccacaatgcctggccagacagctgtatattctaaacattaaagccaccattaggatagaactaatttagaacaatgttatatagtgactttctcatacagggaatgcaacagccagttttgttataccaggacattttttatacaggggaaaaatcaggcttgtgtgtgtatgtgaatatagaatttattttgtcttaaaatctgagcccccgtttaaagttttttaagggactaaccaacttttgctcttcactcttaatgctttttcttttggagcccctttcatggaaccctgcagcactaaacacttttatatttgtaatatatttaaaagataaaaatgaaagtgtctgctcctaaattcatgggcaagtctactcatcacaagtgttgctggccaacagggttaatatttgctgactgggtaaaaaatgaaacagtattaaagataaagtcatttagggttttactgagtatgtaaagactcaaaaatgaaaatgtccgactaaaaagcagagtgtccgaaccataacttttgatgccaaaactcatgcaactacctcagaggacaggtgagcacacctaagtgtataataccgtcttctcctcttatgctactatctcttccacccacatgaggcttgataccaagaatcacaggtacattgcgcataacctgtgttgacaagtgctcattttaattggttgatggtcttgtggtggtgagtgggtatgggaggagggtgggtctggactaaaggtatggaatcaggctagctctcacattctcaccagaaataggagttgaccacagcagctattgcttctccatcactgggagaggtggtatgtaaggtggttcagagaaagcaacctggaaacagacatccctctagtggaattcctgtttgaaggttattacttgtgtgatcttggacaagggaatgaaggtctctaagcttcattttacaagtgaagacaaattaaaaacaaacacattaagcaattagcataaagcttgcatgtagatagagctcatacagtaaaacaaaaaaagttgcttattcacatgttcatagcactattcactatttgcatttgctcttatacttatttgtgtacttgattattacttgtctccaccactagaatgtaaacctcataagagcaagaaccatggctttacaccttgatgttgtccctcatttctccccccaattatttgatatggacaactgttgttttctggaatgtatggaaacagtcttgaaaccatggccttaaatccccctctgatctactttttaagccatcatgctattgatttggcagagtatggacttggcttactttctactctgctacaacaaacagactttgcctagaaatgtcccatttttgtaattcatttaaaaaagataattataatagtaagaaaagtcattattatcaaagtaaatatctcattctctttcttaagatgtacacagtatcaacttttacacaaaaggttccgtatactgtaagatttgcagtaagttgctgacccctgtcctaaaactttcaggttggttttgccctccagctcaatcagttattcaataatttcatctgtgatttaggcaaaaatatgactttcttcctagtgggaaataaagcacttgaagggctgcagccagagaccctgtgctagcctaggaccaagtgcaaactaatgccatccatttagagcaaaagaaataggcagagtccttcctctgtgaccagtgaattttggatgcactgcagtcttctgccttcattattcagagtatctagaagtagatgacacaatgtcagatcttccacaagaacccttgccactattccacagagtaactctcatgatcaaggtgcctggtcctacttaagctaacaaaaaattgctttcacaaaacaatcaactaatcaaaaatccttggatgttacaaatcatttttcctctgccctgagcaatatttctatgggtatttctatataggattatctacagttaatatttataaagtaagatttcattggagtatattcgcctctcagtataatctgatacatatcttgattttttcttttataatattgctcttttattattcttgatcattgacattgccatataaatggtagaatcaacttgtaaatttctaccaaaatgccagttggaatttctatcagaattgcattggatctggagatcaatttatgaagaactgactttttaaacataacaactcttctgatccatgacaaggtttatctccccactaatttaattctttcataatttcttttttttatttttaaaagaaatcatctgatttgtaaacatacactcaatttcttgatatttcttcttaacttatggcctaaatcttgattattttgcttaattttaataccttcccataagagcaaatttagtaaattaatacaccttccagttgttggcattttgagagtattggctcaaagaaagtgtcaggaaaatgggcaagaacactgcaatcttggaaaagacatggagttatgtaacaaaaactgggctgagacatggttttatttctcactagctgtgtgagtttgggaaagtcatttaacccatctgtgcctcagtttcttaattaatgactgacttgcctcccccacagcgcaattgtacaaaccgagggaaatgaaagttttaatttatccctgcagcatcctgatggctaagaaaaaaattataatctaaaggtttagcacacctagatggaaatatgttttctgagggaatatcataaagagagggaggggctgggattgccacccttcagacacctctcaccctcttggtcaaggagcagtatccatttgtgaagaaaggagggaggccaattggggatgcacagatacaaccactgggggaataactgtgggttgaacagctgcatatagaattgtagtttgacaggttttcctgcccattagtactttgaagatgtcatcccattgtcttctgacctctataattgccactgagagatctgctgtcagtctgcttatccttccacggtaagtaaattgtgttttctccttgttgcttttaagattttcctctttgtctttggtgttctgaagtttcactataatgtcactaagtacagatttatttttatttattctcttcaggactcaagtttcttcaatctgaagatacatgtctttctccagggacatgtggaaaaaaaaaagatgttatacaaccatcaaagtggcaaaaataaaaaaaatcaagtattggcaaagatgtggggaaaattctcataagctactgatgagaatttataaattattatgacacctttgggttgcaatctggggatactggcaaagcagaaaattgtacaacctgtgatcaagcaataataattttaggcacccatcctagagaaaacttgaattcatagaaaaagtaggtacacgtaaatctgttcaaggaatcattgtttggcattgaaaataggagagagatcatgagaaattaccaaaatgtccaccaatagaatgagtgaatcacctgtggtatatttataaataaaaatattaaatagaaggtaaaacaaatcagacatacacacattagatagataaatttagaggacaaaataaggaacatgaaaagcaaatagtagatggcaaatgtaatataatatactatgcataaattttaacaacacacaatattatattgcatattgcccaataagcagaagccataaggtctcacacttttcttataatgcaatagaataaaaatgacaacaaagtaaaagggtatcccaaaaataaaactatccttttggaaaaaaaaagatttaaaataattcctggtttgaagaaataacaaattaaaagctatatataaacggttaacaatattaggtggacatatttgtttgaagagataggtgaaagatagttgaaaagcctgggggtatattcaaggttatatgtcttagaaaacaaaaatacttgtttgggttcagttttggatctgggcttgttcttgtggcttctgatgatttctgacttggggaaaaatggggaagagttgaaatacgtccttccacccaaacctttgtttagtaataggtaggaaaatgaagaagaaaatagaatgttgcagaatgtggagggatgtaaaatggacagtactagggtagaggggaagtcagattagaggaaagaaagagcatcaggaacagtcttgtgctaggagctggtgtggccaagcacagtcggatgcccaaagatccaacaaggccatggctctgtgtccttgagtgggcacaaccattcctagccaagtttaagaggcaagtaaaaatataggggcaatgtcagatgaagtcttgttcagggtatggggctaggatgagagagaatgccacagagtatgaaggaagagtgatagatccagatgagatacagctcagagtgccacgcccccagaaagaggaatcaggcaagtactgtcccaaggcagctggagggtgagggctgagtgccctggcttcctcacttggggagaccatgggtctctgtagaaattccaatataaaggcagggaaatttgactgcatggagtcttcaggtagaaatgtttctcttgcctaaattcaggtgctaaataaacaacaaaatggtaacctctactatgaagtgtttccaatgatgggatatctgaggccattacattcctgggaataacatggtgaggtgcagggtggtggtggtggtgaaacatacgacagaccactgtaagtgagaacaaattactggcccagcccaacccacaccaaataagaaatttaatatccctttggcctgttttagattttggcaaagccaggcccatagtgcttgctgggctctctcttccacatcatccagaagacacacatttgctatggaatgattgtggaggtgagagtatagtgcatattaattcatgcaaaaagttagatattagcccagaaatgttagtaacaagaaactactgaattctctgtttgtctgttgtggaaataaaaccttctggggatgaatcaaaactatctgacaattacttgaaatgggtgaatagctaaatgtaatgtgccttggatattataactaaaaggtgctataatccagttatattttttatcttttaaggattggttctgaggagcactacc

SEQ ID NO: 17352 - DNA, 39755 bp, Human
ctgatattaggaacccgtacaagtaactgagaactaaatagaagatattaaatcacttgaggacccagtattctttaatgtttaatagataaaatactttgaacacataacatttcattgtacaaataatgtaaaaactaaggtattattcacagtaagtattcggttaaattcctattttctaaaagaagaaatacctgtggtattcctagcaccatctttccatgtatctggagtgataacagtaccaagtttcttttcacctgttagaacaagatagtaaaaggaaaattaaactttattatttaataagtgcattacattgtgcctaaggttcacaatggtatcgactatcaatggtattaccgtaggagcctgttaatgctgggagagcagccaatcaactgagactcatattaactgtggccaatgaatgactgaccctcagtaaaatgcgtaggataataagatgacttataataagctttcactgttggtttatattttaaacaaatctggtaagtctatttgttccataaatatatactaagcatctatcatgtataaactatacaaagtgctgagaaaaatgaagtgatgaatcagacacaattttaaagggattacagtacactaatttctttaacagcaatctgtaacctgggttccacaggtggatcttaagagatatgcgaacaaggtggagttgtacacaaaccttttatatattcatttttttttcctggcaagagtctatagttttcatcagattatcagagggatcagagaccttccccccaaaaagaaccattcaaccaaaatgtaagcttaaaaaataaaaagtataataatcgacagctaaagtactagaagaaattccatgcaggaagaaataaccctagctaaggaaatccaagaaaagaaagtttggggagaaggcaagacagaggatttggatatgtggcaataggactgtgaacaaaaaggagtaaagaggatgaaggcaaactagataaaggacacattctgaggaaaggcatagaaagcttagagtacacatgggcacaaagagtattttgtttggtcaaaatgtgaagaggataagcctcagtgaagatgaagctggaaaaataagttggggccttagtgtggagggtcctgaacgccaggttccaaatatagaatccccaaattattctctgcacactgagaatttattaaaggttttaagttagggaaataataatttgcacttacgttgattttcaattcaagcatcttctgggcttactctaagccatatcctggcataatgactaatgagaatgaataaggcaaagtccttagtctttggttctagtgtctagcatttggcaggagaacaatacttcttacatgaatagaaaggaaagatcaagaattgccaagacagaaaggtgtcgttggggtttaactgcacatttttatatgggaggagagctgatgagatctggggctgggggaaggcaacagaaatagacaaggaggtgcagaactgagaccattctgagtacaaaatatataggactgtatggtcgttgggaggtgcaaaaatggtcaaagggtagggtagaaagacagcggatagaatctgagacctgtgggcgaagaaaaaacaacgagaaagcaaagttcccgggagagctcagttaggttctcccagcctcctcctcccgcagaagcggccccttaactcacatttttcgcacaccatccttccccacgacggttcccctagccgcaacagcagcagcagcagcaggctgaaaacaacaacactacaacttggaagtattccccttccgggctacgtcaacccacttccggcttctaagcccatactcccgcctaccccaaacctggaaagccgctgccccttttgcccgcccctccctttctgcgactggctgttaggccgtgggtctccgccccacagccctgcgcctgcgcgtgggcctgggccgcccgtcgtacctgatggtaggaggcagtagttccccgcttcccttccgcgggagggagagttaggtaagccccgctggacgccctcggcgctctcgcctcacgaggtgcaagctacccccgcgaattgccgaagcagccctgagccttggcgccccgacccgccggcgctcgccgtcagctcagcgccactcttccggcgtgccctgatggacagaccccctttcggatccgagttttcgcctctgtcccccagttttcccttgtcttcaactcccatgctctttgatcctgcctctcagctggttcctcgctgcccacgcttgcgccggcgtaggctcgggcagaatcccgagggacccgggttggggtggggctgccggtgaaggtgcggcgatgcccgcgaaggctcctctgggtgccgctcggaagagccttctctccgctgcggtgcgtagcgaggtgggccgggtcatgcccgtggcacttctgcaggcgtcctgggggcacgccagggcctaaccggtgctggttccctctttgcttactctggttccttcattcattcagcaaacatttgagtttgggtcctgctcactgtattacatccacatctgctgctggcagctgcgattccgagggtggctcagaaaaatcgctgaagggctatctgttgagagaatggattcctgatccccttgccctccctcaatcagcttaagatagaatctatgggaaactttccctttgtcccttcttgccatccgtttgcttttcatgcctagtgtatttccttataccagagagatggctgtagcgcatgggaccttggaccacctcacctgtttgccgtgtttccttatcagtaaaatatctgcctttgaaaagcattgggtgaattaaatgagagctattaggataaggcccaggttcgcctttctgcttttctcactagtgggcgcccctccgcccacgcgcgcgcgcgcgtgtgcgtgtgtgtgtatagtatttttttttctgagatatttctattttctggaatattctccataatgtaacatattgactgttactttaaattaataaagtccttgtttagcagtacaattagtcagctctcaggtaatttaaatacgtgtattttagagacggtaatttttttttcctccttccgttcgtgctctacttttggttggaatttaacacctgtaacagacgttgtcatcttggtatttctgaagcattgggatcccttggtttagtgtggtgctctttgaactcttgattccactggccaccatttgagtattggaatgtgcacttggtgtcatttggcatttgctagaagatgtgaactactgtaatgttagacaagagtaaaaaaaaataccaacaattcagcctaagtatatttgtggagttgttggaattataacctatgcattctagaaaccgcataaataaactttggttataattgcaacaggcagtagataatttaatccacacagttgatttcatctctttgatattggccaaaaaagtttaaatgaattgctttattggtcctaggacatgacccttttgcagaaaccagtcacaatatttaagaaattagtaaatttgttctttttaggctctgagagatgtttgtaccatattaagaaaatcaaaggtagaatagaaagctaagtctgtatgtgcatctacacgtctgcatcttttgtgttttgaaacaaatacattgctcatagaaaattgactttatgacctatttttaggggtcaaaacatttaagacaatggaaaaagtcgttattgcatatgctcttcttttcttgttttttgttagctagccatccaagaaaacaccatgaaagataacgatatcaagagactactgtatacccatcttttatgcatattttcaattatcctaagtgtcttcattccatcactcttcttggagaacttctcaatattggaaacacacttgacatggttgtgcatctgttctggttttgtaactgctgtcaatctagtactatatttagtagtgaaaccaaatacatcctctaaaagaagttcattatcacacaaggtaaggcttatgtctcaataactgatttttggatggagctagtgtttcttttaatggaagaataaagtattcatcaagtctttattagcttatttatagtgagcaaagggaacctgatatttttccccccaaattggtaggctgttacttggtggaaggctgcccacaatgtttgattgatccttgccttgcattaattatggaattatgacttcttcagagcatattataatattgtgagcctatatagtcattgttttatgtcaccattgaaaataaatacgtgtgacagtctatctttaaaccttactcaataagacattgcagtttatttttattatttttgcatttctgaaagccacttagtgggattttcagaaattgcaatataagcctgtggtaatgcttgtttccaacatggccttccttgactaaacaattttcagatattagaatcaattttccagaatattcactgcagtagatattcacttggctattactaataatgtccacacttaacattattttctaccatgtataagctctgttaggtcatttactgcctatgattggaaaagctgaatgtatgtgttatgtttatatattcttaagctccaaatcaagaagatctcatgtttctttgtagatgttcaggtcttttttcatacgggttgtgtaatatgagtgtgatttcaagaattatttagtattttgctttttcagtgcagttttcccaggaattttgttttaaaatgaaaaaaattgttattttctgcagatatttcctctatcatcgcataatactgtattttttgtatcctagctctctgatgtcaatcagtatttgataaatattgattaatgacatagctctatattaccatggaaacagaacctcttttcgactcatgtaggtcggatgggtagaatatgggcggaaggtggtatttgccttttaggcttttttagtctgtatcgaaggctgtgtatgtgacggtacaggacatgtgatctgatttgagtatacccaagaacatttgaactgttttacacattatgggaacaagttgtgtttgtagatgaaatggaagaatttattgtcctttaagcattatcttgaatcttcaggttattcatttctcttttaggtaactggatttttgaaatgctgtatctactttcttatgtcttgtttctcctttcatgtaatttttgttctgtatggagcaccactgatagagtaagtttgaaatttttaccctaaatttatattttaaaacattcatttaccaaactgtgtgctaattcttagcaactagagaaaaaccatgatgtgcatcattaatagatcaagtaaggacaccaacatcattagcagtgttattcttttttaaaaaaaacagcagaataacttaatttattaaatactcttgttacctagccttctagtatccaattgcatgttgagagaagggagagtagagaaactatactataccaataagtatttggcccttagaacctctgaaagaacttactatgattatatgtgtaagttataattagcatatcagttcttataaatgtgattctaaagtacttgaatggagtttttcttaacaaaagtcaatagattcctgtattcaaatactgaataagctggtgtttatagtttaaaggtaaaatttaacactttttctgaactgacaaatttcaaattcttagaaacaaaattcatgaatgtttcttacataatgtttatcatagtttgagaagcttcagtttagcagtgattaatgatcatggtgaaatgagtgatgagatacatatacatatacacacacatatatttgtgttgctaagtataccattttatatatatatatatatttatacatagttttacgtacacacactaaactgacaggttattcttttctagatgggagagaacaagacctttgtaatggaaaatggtggttcctgtctaatccattttaaagcagaatgaatgtgtctggcacagtggttctcaaaatgtggttttcaaaccagcagcatcagcattttatcaaaatgcaaatactcaagcttcagtcagaaactctaggggtagagcccccaccaatctttagtttatccagctctccaggtgtttccaatatatgttaaccactagttgtagagaaccactacaactagtattcaatagtggttcaatagtggttcaatagtgtattgaaccactagttgtagagaaagttccagagagactattgagcagaaagctaactatctagaaatggattttgtttgtttgtttgtgtttgcagtgaaagtctcagcatggatcctagggtctttaacacttctgaaatctatcattaaagcgaaatacttgctagattgttttttaaagctacatgttggtggtaaaattatttatagtcatcattttggtggcattcatgttacctttcaaagtaaagcataggaagatatttcacattttatttatataataaagattatgtatgtgtatgtttacctttaacacttttttaaaaagtaatctttttttttttctaggttggcgttggaaacatttttatttgcagttattttgtctacttttactactgtgccttgcttatgtttgttaggaccaaacctcaaagcatggctaagagtgttcagtagaaatgggtaagttttaattttatattataatgatattgaaattaaaaaataattaatgaagtatttttctattcatggcagtttgctgattattctgagtgcttctcattgctgatggtgctcagagatgccttaaggggtcactgcaattagggactggggacagggcaggcagaactacaagcccctccctccacgttagcaagatcagctctccttttttctgtatggtagaattccacctagccttttgtttgtttaaaaaaaaaaagaagaagaagaaataaaaaaaaattctactattaaaagaaagccttgaaaaccatggttctgggataatttggcactgtgataagactgctgtaaataaaattgcttacatacattttataaggtagaagtggggtccacaatctaaaaatgtgttgtgtaacaatgataatttcttgtttagccttttttgtgataagataccagagctcaagttttatgagatttcatttccttggtggccgtatatattttcagcatggctaagttaaaattttagcttcttgaaagtcatttaaatgatatgcaccagaaatagtggagatctagctaagaaagccagaaggttatttgattctttcctatttatcacccagcagcaagaacttcttgagcacttagtctgtgctctgtgttattgtgttatgctaagctgtgtgtggtttctgaagtattaggaggaatctttttttttttttttgagatggaacctcgctctgtcgccaggctggagtgcagtggcatgatttcggctcactgcaacctccatctcccaggttcaagtgattctcctgcctcagcctcccaagtagctgggactacaggtgcatgccaccatgcccagctaatttttctatttttagtagagacagggtttcaccacactggccaggatggtcttgatctcgacctcatgatccgcccgcctcgcctcccaaagtgctgggattacaggtatgagccaccacacccggccttattaggaggattcttttgctgaggagcttatctgttcaagggacaaaaatgagcaaataacatcagattacaaatgtgtaaatccagcaataagtggtgtaggaactcaaagggacagagcatcagtaaagaatggagggggagatgggaatgatctatgatggacttaagtcaagagtatatgatttggtgagaccaagaaggaagagaaaggcacctcgtgcaaggagaatggataaaagcattgaaactgaaatgaacagggtatttttgtgtgatttgaaaggtaacagcccaatgagagcaaaagatgcatgctgagtagcttggcttcataaattaccgacttattccctttgaaatcagtactgtttgggacgagtgtggtggctcacgcctgtaatctcagcactttgggaggccaaggcgggtggatcacctgaggtcaggagttcaagaccagcctggccaacatggtgaaaccccatctctactaaaaatacaaaaattagctgggtgtggtggcgggtgcctgtagtcccagctacttgggaagctgaggcaggagaattgcttgaacccaggaggcggaggttgcagtgagccgagatcgcaccactggactccagcctgggcaacatagtgagaatctgtctcaaaaaaaaaaaaaaaaaaaaaggaatcagtactgttttcccttggaaccgtcttctaatattcataaagtctctagaaaacagaagtgtaacaactgaaagcattttctacattattaccataatatcccaaatggtattaattgcttttagccttttagtttgaaatttttaaatagtgaaattggattgaaatcttattactttggattagtgatttctccagttttcaagtctatgtctaataatgggtgtatttgggggaaatactgtcatgtgattttacaattagttctgctataatgtggcctgtgtgttcctaaaaatcactacgctgtacaaaatgggcagtaaaaaccacagagcttatgggaaagatggggttaggtcataacactaaaacaattcatcagtgacatgtagagagaagatgggaacttaataaaaatggtagcacagttttacacgtttaaaatggttacaaaatacaggcatacctcattttattgttcctcactttattgtacttctcagatattgctcagatcagatactgttttttataaattgaaggtttgtggcaaccctgcatcaagcaaatgtatcagcgccgtttttccaacagcatgtgttctcttcattggaaactctcacaatatttcaagctttttcattattattatatctattatggtgatctgtggtctttgctgttactttttgtaattgttttggggcaccatggctcatacccatataagatgacgatcttaataaatgttgtacatcttctgactgcttcacctaccaacgtgttctctctgtctctctcccttccccaccctccctctctctcccgtccctgttccctgagatacaaaaatatcaaatttaggccagttaataaccatactatggtctcttaagtgttcaagtgaaaggaaaattttacttgtctctcactttaaatcaaaagctagaagtgattaagcttaatgaaaaagttaagttgtcaagaactgagacagactaaaagtgaagccccttgtgccaaatagccaagttgtgaatgcaaaggaaaagttcttaaaggaaatttagtctactctagtaaacacatgagtgacaagaaagtggaacagccttactgctgatggggagaaagttttatggtctggatgaaagatcaaaccaggtacaacattctaagccaaatcctaatccagagtaagcctctcactctcttcatttctgtgaaggctgagagaggtgagaaagttacagaagaaaagtttgaaactagcagtggttgattcatgaggcttaaggaaagaggccatcgccatcacataaaagtgcaaggtgaagcaacaagtgctgatgtagaagctggagcaagttatccagaagatctagctaagattgttggtgaaggtggctaaataacagatttttaatgtagacaaaacagccttctattgaaagaagatgccatctaggacttttaaagttagagaggagaagtcagtggccaccttcaatgcttgacaggctgactctcttgttaggggccagtgcagccagagactttagttgaagtcaatgctaatttaccattttgcaaatcctagggcccttaagaattatgctaaatctactttgcctatatactgtcaatggaacaacgaagtctggatgacagcacatctgtttataacatggtttactgaatattttaagctcacttttgagacctactgctcagaaaaaaaaaatcctttcaaaatattgctgctcattgacaatgtgcctagtcacccaagagctctgttggagatgtacaagaatattaatgtttttttcatgcctacaacacaagatccattctgtagcccacggatcaaggagtaattttgattttcaagtcttattacttaagaaacacattttgtaaggctatagctgccatagatagtgattcctctgatggatttggaaaaagtaaattgaaaaccttctggaaaggaccattctagatggatgccattgaggacatttgtgattcaagggaggagataaaaatatcaacattgacgagaagctgattccattcctcatgaatgatgttgagaggttcaggacttcagtggaggaaaccactgcagatgtggtggaaatagccagagaactagaattagaacaggagcctgaagatgtgactgaattgctgcaacattatgataaaactggaacagatgaggaattacttctggatgagaaagaaaatggtctcctgagatggaatctactggtgaagatgccatgaatattgttgaaatgacaacaaaggatttaggatattgcataaacttagttaataaagcaaagcaatggcagggtttgagagggttgactccaattttgaaagaaggtctactctgggtaaaaggctgtcaaacagcatggcacgctacagatcaatcttttctggaaggaagagtcaattgatgcaaccaacttcatggttaaaatttcactttaagaaattgccggctgggcgcagtgggtcgtgcctgtaatcccagcactttgggaggctgagacaggcagatcacttgaggtcaggagtttgagaccagcctggccaacatggtgaaactctgtctctactaaaaatacaagaaaaattagctgggcgtgctggtaggcccctgtaatcccagctacttgggaggctgaggcacaagaatcacttgaacccaggaggcagaggttgcagcgagccgagattgtgccactgcactccagcctgggcgatagagcgagactcagtcttaaaaaaaaaaaagaaaagaaatttccacagcctccccaaccaccaccctgatcagtcagcagccgtcaacatcaaggccacatcttccaccagcaaaaagattacaacttgctgaaggctcagataattattaacatttcttagtaataaagtatttttaaatcatgtgcatttaaaaaactaatgctattgcccacttaatagactatgatacagtagaaatataacttttatatgcactgggaaaccagaaaatacatatgactcactttattgtacaatttgctttattctggtggtctggaaccaaatctgcagtatctaaaaggtatgcctgcacccaaatattacaataaacatagcacttttccttggaaaaggtttccttggtaaaggtttgcttctggaaatagacatgagaagggttgcctattgtgagttattgcgaagtgatgagatggttgttggaaatctgagggaaaattaacaccagatgtgcgtatgtgtggctcatgacacgtagtaaactgaggtagctgggaggtggttattttttaaaacagtattgagatataattcacacaccgtacacatcatctatttaaaatatacaattcaatgactttttgcaaccaccaatctacttactgtctctatagatttgcctatcctggaaatttgttataaattgggtcttatgtgatcttttgtgactgcctttttttacttagcataatgttttcaaggtttatctatgttgtagcatgcttcagtacttcattcctttttgtggctgaataatattccattgtatggatatatatcaaattttgtttacccatttatcagttgatggacatctaggttctttccacattttgcattttggttgttgtgaataagctgcatcaaacatttgtgtataggtttttttatggacatatgtgtttatttatcttgggtatgccttggagcgggattgctgggtcacatggtagtgttaagggtttgagaagcaagctccagtgttcaaactctgtaaagtgcagtttggtactatctgtaaaaattacaaatatacttcttcgacccagcaattctacttcttggattttaaccagtaggtatacttgcacacttacaaaatgttgaatatataagattactcatttcagcattgaaaattacctaaatatcctttaataagggatagggttaggataaatttaacccacactgtgaagtactatgcatttgtaaaaactaaacacataaaaacagaaaaaaaccccaaaacaaaactctttatttaccgataagttagtggaaaaaagcaaggtgaaaaaatgtgtacaggatgctaccatttatgtcaaaagttgtcagagggcacagatacacgtatatttctggaaggatatgtgagaaactgataaaacctgttgtctcttgcgaggggatctgagaagctagaggacaaagtaaggagactttccactgaatatcctttgctatcttttgaaatttgaaccacattagtgtactacctagtcaaaataaaagttataatgagttagagtttgccagtacttaactttcttcttgcttatggaaagtaggcttatgtcaggaaattgctagatttctctgatgtcacctaaacttcagtagactgcaaaagttgtcctaaaatttccaacatactggagaacagcctagtctccagaggactatggctaaaaattatcaatttataatgtgaaacattttatataatatcacatagcacatgacatgaaatagcaatgcaaaaatattttaataacttttaaagcattttcattatagagtttctcagagcaatctagtgagatactcactttcaccattttctagatgaagaacttagaaagctgacaggttaagtgatttgccccagttctgtagccaggaagtagtagagctgggattggaatctagatcattagatggtgtagaagttagacgactccagtaattgaggatcagaaaacaggttcttgccctgtttttactacttagcggccaagtgatcttagacaagctacttaacttcacatatgtaatatgattagaataaaactaatatgtactttgcagggctgtgtcagaactgagtgaaatgaatgaaatcaaataataggttcttaagaaatgtttgttgaatggattaaaaaatgtcagggagcattttatatatcatactttcagtccttactgcaatttgtctcagtatttcttcctagtttaggtgacagaccaaggagcacagtgcatagataactatggaggagggctggttttttcatttaatttaatgtgaagttaatttgaactttgacgtaagagaagaatctaagtctttatgtttccaccatacactagagttagttcacttcttcttagtacttttattatacttccaaattttactatagaaagcatgtcaaattttgaataagctaggaaataattagattaactcgttgaacattagagtttgccttcttaaatgttcacttttaagcaaaaatatttaaaaactcaaagatctatggttttgcagtgataatataaatattcacaaagaattactagttatattgaaattgctccaatatgtagttagcattattcatattgaatcacaactttattttttaatttttatttttttgtgtctacatagtagatatatacatttctggagtacatgagatattttgatacagacacacaatgcataataatcacatcagggtattcacatcaagcatttatcttttgtatgtatggttgtacaagcaatccaattatactcttagttatttttaaatgtacagttaaattattattgactatagtcaccctgttttgctatcaaatactagatcttactcattctatctttttcatgcccattaatcacattctctgcaccccccacccccactactacccttcccagcctgtggtaaccatccttctactctctatctccatgagttcaattgtttttttaactaccacaaataagtgagaacatgcgaagtttgcctttctgttcctggcttatttcatttaacataatgacctccagttctgtccacattgttgcaaatggcaggaactcattctttttttaatggccaagtggtactccactgcatgtatgtatcactttttttttttaatccattagtctgttgatagacacttaggttgcttccaaatcttggctattgtgattagtgatgcaataaacatgggagtccagctatctcttcaatatactgatttcctttcttttgggtatatacctagcaatgtgattgctggatcatatggtagatctgtttttgtttttttgagaactgatctccataatggttgtactgatttacattcccaccaacagtatgtgagagttccctttctccacatcctcgccagcatttgttattgcctgccttttggataaaagccattttaactggggtgagatgataatctcattgtagtattgatttgcatttctctgacgaccagtgatattgagcaccttttcatatacctgtttaccacttgtatgtctttttttgagaaatgtctattcagatcttttgcccatttgtaaattggattattaggggttttttttccctgtagagttgtttgagctctctatatagtctggttattaaccctttgttagatagatagattggaaatattttcttccattctgtgggttgtctcttcactttcttgattgtttcttttgctgtacagaagctttttaacttgatgtgattccatttgtccatttatgctttggttgcctgtgcttgtggggtattattcaagaaatcttagcccaatccagtgtcctggaaagtttccccaatgtttccttttagtagtttcatagtttgtggtcttaaatttaagtctttaatccatcttggtttgatttttgtatatggcgagagttaggggtctagtttcattcttctgcgtatggatatccagttttcctgccaccacttatggaagagactgctctttccccggtgtatgttcttggcatctttgatgaaatgagctcactgtagatgtatggatttacttctgggttctctatttgttctattggtctatgtgcctgtttttatgccagtaccttgctgttttggttacagtagctctgtagtataatttgagtcaagtaatgtgattcttccagttctgttctttttgctcaggatagctttggctattctgggtctttgtggttccatataaattttaggattgtttcttctatttatgtgaagaatagtgttggtattttgatagggattgcattgaatctgtggattgctttgggtagtatggacattttaacaatattgattcttccagttcacaaacatgaaatatctttccattttttgtgtcctcttcaatttctttcatcagtgttttatagttttcattgtagatatatttcacttctttggtgaagttaattcatagatatttaattttatttgtagctgttataaatgggattacttttttatttctttttcagattatttgctgttggcatatagaaatgctactgatttttgtatgttgattttgtatcctgcaactttattcaatttgtttatcagttctaatagtttttggtagtctttaggtttttccaaatacacgattatatcatctgcaaacaaggataatttgacttctttctttccaatttggatgccctttatttttttctctcatctgattgctctagctaggacttcctgagtcacaactttaatttcaaagaattctattattattcaaggagattgtacaaaatacatgaatagtacatgctttttcctactcaataataatttagaacagaaattaaaatttcaatttgaagttcttatgctgtagttctaattaataaaaagtatttaaaataccttgaagtgtcaactgaagattttagagctttaaatatttttatcattcatcctgtattttaatatgtaaaacacagtagagttttgtgtgtattttttttaacttaaagacagcccttttagtattattaaaatgtgaataattcagatgttcagtgtgaacaggctaattttgaattggcatgatatctcaattagtgttgaatcaatataaatgttgtataatatttttaagtgaaataagtttatatactagtttttaatgtatttatttgcatgtttgtagaaaacttatgttgaacacatgatagtcatgtgacgacagagaacaacaaagctttgagcttgtgaactgtataggaactacatcctacaagttaaggatcaattctgatactattgggattttatacataactaaaagacactattttaacaggatttctccttacagtaaatgttaagttactccaggaaaacaaaacaaaagaatactattataaagaaacttggaagtagacaaggtcatttggtttcttaaaatattctgccagcttcttattggtatacttattaaataatatactcagtttgtactaatttaattcagttattgcattggcattaaaattattttttttttcatttgcagactttcttataaaggaaagtaataatctgactactatacacccatatagttcattgaaacttgttttttgacatatcagttcttttatgctgttatttgaatgtttaagttagaagttgatcacttttggtgaactaaatagattcctgaatagtactaaacaaaaatcttgccaagagtagtgatctagccgaggtgaaaacattcaataagacctatttgtgtagacaaagataataggcctctttttgtcatctttgtattgaaatagattttatattgaagcaaccactgtggacactaagagtgaaaatatagtgagtgaccaaagatttactcatataaaaagtagataatttagtataaatgtgggcaaaaaatttagtggcaaagaggcatttgttttaatattcagtggggaaggaaaacatttatattagaattttgtaaaatacctttagccactaggaggagttgtacagtgtctcttttttagatgaagagactagcagttcaaaaaattaaatctatttaaacaaacactattttgatgacagtgtatttaaaccatgagtgtttactatgaactaccctcaggtgtctgatacagtgtctggcacgtagtaggcactcaaaatggcctgtttacttcaattaatatttgatgtaatgaattccagtggagtcaaataatttggacaaatagttggagcacagtgtcatgaaggctggcctgtaacattgctgtagtcactttttaagtttgttcacaggggagccatttatttattctgagccctattgactgtgcatatattccttaactttgaaaaaattagccaataaccgtagaattcaaatagctttattatggaaacttacaaaatgagagtacatcaatgtcagtgatgctagaaattagttaatagaaaggaatttacctattttattctttttatcttatttattacaaaataatgtatataaatgtttgtagtaaaaattcaaacagaaaaatatagaaagttaaagatcctagtaatgctatcatggaagcaatgaacaactagcagattttatatgttcttcgaattttgtattaattatatatatataattttaaaacaaaatagttaaactagtcatggctttataacttttttcccactaatgtgttatgaacatcgttatctgtgtgtgtgtataatctacctcttcttacatagtattcttagctactgtatctctataagtaacataaaacttcagcttatattggtttgaataataaggaaactgattatgtcacataacggaaattggatggttctagacacagatagtcatggtatggttgtgcttcttactgattctccttgttattatcctcaggctggtagtgggatggcagcagtttctcttccttgagttttcctaatcattgagaaacagaatgggatcatcaatagttaattaattagtctcatcatcagggttgagatgaatgttgagcaattaatcatcattacaagtattccatgtaccatgatttatttaactaatttcctattaaggtttaatatcaaattttcatgataataaataatgttgttaggtatatctttgttccatataattttgtatacttgtgcaaaggtttttgtagactagattacttgagtaacattcctagatcaaaggaagttaacagacactgtcaaactaaagttataatttgaagaatatgtatatacccccatacatattcctaccaatagagtgtaggtttccctgactccccatcaggcctctttacctcttatcaatctaccagggctgctacctacagggatctgctaagggggcagactgtgcactatagtagcttcatctgatttctaagaggaggcgtaagccttggccatgaatttttaagtctcaattatagaaccaccatttattaaatttcagtggaatattactaactgaatcacagagatagcatttatcttacccagcctccctacctccattctctttcctgcctcatgttacagaaaacttattagaaaataacatccagtcctcaaaaggcagcttcaagacagggaaaattggggctagttaagataggatgtgtgcccatgtgaagtgtgagcaagagaaaagaaacggcatgacaaccctaaaaatgcactatagaagaaggaaaaggggtgtgcagaagatgaagaatctggcctgaaagaaagtgctaccctagaagcaaaaataaacaaaaaaacctccacacagtttaccatgaaaaatagtactaaggatatgaattgaataaattaagagcaaagatgagatcatgaaacaaaatgacgtggagaagaagattgcagaattagtgaaataaattgagaatgcaaaggtcactattacaggacataaattaaaaatatcaagaaacagacaaattagaaagtcaggttttagcatggaagaaaggtttgagctaatcaaaatgaatgcggggtagggagggggttgggaagaataaagcatttagagaagatgtgataaatatagaggagaaatgaaagggatgcaaacaagactagttagtgcctctaaaatacccaacaaaaaatgattcaaagatgtgatagaagacagttttcacaaatgaagggattctccagtttgtacatcaaagggactcactatatcaagaaaataattgaatgaattggagttgtagaacaatgtaaataaaaactaatacaagcaatggaagttgaacagtgcagggaggagaagtgaagaaaatataattgtacccttcatatcccagctattctagctgtccccagatactgagcctgttgggtacaatctctttggggaataagttttaaacgaaatcctacatctcaaaccatgagttcccaccttacacctagcccctttcccctggttggcccaaagtactgggagccaggcttataccatctaggcagaatattgaaatatttctttcgagggaaaatggtactgacattttgggattctctaaaggaaagtcaggttcctaccccgtccctagttctgtgcatccccgtgcttgaattataagcatccagtcagctgttttaatgtttcattttgttgttgctgttgtttaaaaatagtgttattgagatataactgtataccatagaattcactcaaagtgtataattcagtggtttttagtataggcacagttgtacagccattgccacaatctaattttgggacatttcaccacatcaaaaagaagctataactattagcagtcataccctattcccactcttctctccatggcccaggcaaccactacaggagtgtccaatctttgggcttctctgggccgcattggaaggaaagaattgtcttgagccacacatgcaatacattaacactcacgatagctgatgagctaaaaaaaaaaaaaaaaaaaaaaaatctcataatgttttaagaaagtttatgaatttgtgttgggccacattcaaagccatcctgggccacatgtggcctatgggccgtgggttagagaagcttacactaatatattttctatctctgtagatttgcctagtctggacattacatacatggtgttttaagtagaatgagaagtaaagaatcaccagatatttgaggaatacgtcaaataaaatccagaaatgaaaacaacaaaaaagaaactcaggggaaatagaggcagtatataaagacagaagataacttaaaaacttactttttttttttaaagtttaccataaaaggtgaacaggaggcagtcaaaatgcatattcagagaacaagaaaacttttggggaataaaaatactcaacggaagtagagacaaaacttgaaaagattccctagtcaaacaaaaaggtaaagattgcaaaatgaattaaaagataaaagcagaaattagttcaaaataatagtatacctagcaagagtaagggaaaaattcttaagtgatctgatcaaacaaggtctttaagtagaagacaattttaagaaccagaatacctgagattttagattaagaaggcccatatattttcagcatagtggatgaaaaaacactttaaaaaacatttttgtgaaatttttgataaccagcaataaagagatcattctaaaagtttttagagaatgagagaaacatgatacctacagaggacgggaaaccagaatggcactgaacttctcaagtgggaatcagaaaacattggagcagtgccttccaaattctgaggcagggccaggcgctgtggctcacgcctataatcccagcactttgggaggccgaggtgggcagatcatttgaggtcaggagttcgagaccagcctggccaacaaggtgaaaccccatctctactaaaaatacaaaaatagctgggcatggtggcaggcgcctgtaatcccagctactcggcaggctgaggcaggagaatcgcttgagcccaggaggcagacgttgcagtaagccaagatcgtgccactgcactccagcctggatgacaaagtgagacttcacctcaaaaaaaaaaacaacaaaaaaccccccacaaattctgaggcagaatgattcccaaaaattacagtaaaatcattttcagacttaaaacatctctaagcatctattttccatgtaccctttctcaggaatctatggaaggaggtgctgaaaaagaaaattcctttctcaggaatctattgaaagaggtgcttaaaaagaaaagaaaaaggaagatagatggaggaagtcttggaatttaggaaagagcagatccaaaagaactgagagaggcaaagggaattcacaagatgctcgtgaagggaccccacagcacagcagttttgcagcagtcctaggtggctccaaaaagatggaaggagcggggagaagaaatcaagcatttagaggtactacttagcttctttggaatatgtgaaaattacttaatgacaggtacgtaagcaaacagagcagggaaaaagaggcagttcttaacatccatggacaattaaagattatatttactatgagaaaagaaatgtataattgtggtttactgtgtggttcactgtgattagcagttttataatcatcataacgtagacattactattgattcggttgaaaggaggagatgttaccattgtagaaggggcgtgagtcagggagaaatgtgtatgtggaggtaggcagcttgtagataaaaggtgctaaatcttctcccttagaagaaggcagaaagtaagttaatcttgaaaaatctatacttaatttatgtttttttttttaatttgaggtaaatagaagaagcagcaaaaagagttgaaaatatctgtcttggagcagacatcaggagtggggagggatggaagaggagactactatttttattattagtttaattgtactcctttactttaaagatgtcacatatattattttgataaatatgaaatttttactttaaaaacaagctacagagtttttctatttttaaaaataggtctcagttccattttttctacatttattatatgtaggatcataaacacttggctaccacaaaatagagggcaacctcttggatgatcatattttttattttaataaacataagatggccacaagtgtgctggaaccgtgaaaaatgtgaaggcatggattttgcctcttagcccaaggaacttagaacttagaggttagaaagatacatacatcaatctttttttttttttttttgagatggggtctcgctctgtcgccaggctggagtataatggcatcgtctcggctcacgacaacctccgcctcccgggttcaagcgattctccgttctcagcctcccgagtagctgggattacaggtgcctgacgctgcgcccagctaattttttgtatttttagtagagatggggtttcatcatgttggccaggctggtctcgaactcctgaccttgtgatccgcccgcctctgcgtcctgaagtgttgggatttcaggcgagagccaccgcacccagccacataaatcttattgaaacatctctgatcgtaaagttgcgttgattgaaaaccttcatggttccttagtttgatatttaagaattttctaaaatcctaaccctaaatctatcaccatgataccatttcacaccaattacgatgactgtaataaaaaaaagataatgacaagtgtcaggagggtgtggaaaaattggaatcctcatacactgctggtgggaatataaaatggttcagccattttggaagagtctggtagttagttcctcaagtgattaaatataagagtttccataggacctaacaattccactcctaggtgtaatcccaagagagatgaaaacatatgctcacacagaaacttgtgcataaatgttcatagcaacattattcataataaccaaaaagtagaagcaacccaaatatccatcagctgttgaatagataaaatgtggaatatcccttgaagggaatatgattgagccataaaaaggaatgaaatattgatacatgctgcaacatggatgaaccttgaaaacattatgctaggaaaaagaagccagtcatacatgctttatgattccatttatatgaaatgtccagaataggcaaatccagagagacagaaagtagcttagtggttgcctagggctgggaggaaggagaaatggagagtgattggtaatggttaaagagtctggggatgatgaaaatgttctaaaacttacagtggtgatggctgcacgactctgtgaatatactaaaaaccattgatttgtatacttgaaattagtgaattgtatggctagaaaggattttctaggataatttttgactctactcaataaagctatttttaaaaatcctaactgtggagaccagcctgaccaaaatggtgaaaccccatctctactaaaaaaaaatacaaaaaattagccacctataatcccagctattcgggaggctgaggcaggagaatcccttgaatccgggaggcggacgttgcagtgagcccaggttgcgccattgcattccagcctaggcaacaagagcgaaactccatctcaaaaacaaaaacaaacaaaaaaaaaaacggtgagggccgggcgcagtggctcacacctgtaatcccagcactttgggaggctgaggccggcggatcacaaggtcaggagttcgagaccagcctggccaacatggtgaaaccccatctctactaaaaatacaaaaattagcctggtgtgatggcacacacctgtaatcccagctactcaggagtctgagacagaagaatggcttgaacccgggaggtggaggttgcagtgatccgagatcactctattacactccagcctgggcaacaacagcgaaactccgtctcaaaaaaaaaaaaaaaatcctaactctgccctacttttccagccttatttctcgttcttccacgtggcctctagcaatctgacttgtgttctcttgtctgcagtgcagctcttttctccagtcctccagtttaagacctgatgctacctattctttccaatccagctgaacttcctcctgttccataaaatagaaaaagtgaattcttcccaacagaaagtaatctctgctctcaacctctaccacaccttatgtttccaggcacatcactttatgtattacagtatagaggaggtgtgtgttaagttgaagcttagtcatcattgtcagccacatgtagtcaaaaattggcctaggaaatcctttaaattgctaaaatagtacaattccctttacattgaacttggccagtttttccttccaacattggaacacatctctgttctattgaatgctagttgaaaaagctgacttatatttataggtgttacatgaaataaaaaagaataataaagccctacaaatagtacaaatttggatatatgtgattggctccagcccgttcttagccctgcttctcaatggaaacaagctaaggctcttatcttgtgtagttggggagtatgagatggaggatgatagagggattggtttgtgaactgacttgtcatcatttgggacttttaaaattcagtgtacattttgcgtgtaataattggcctgtttctagttaaataaatcatctaacaaaacaaatgttttcccccatactatctagaagaggctacttttcaataacttcaccttgcaatttaaacaattgaatatttggaccccacttagtgcattgcagtgggcttttacctgactgtaaccagactcctgttctacatgatgaagtgttcaccctatgagggccaggctgaaactaacacctactaagagaatggcagaattaagtctttccacctttacactctcagatgtgcacttagtaaataggaacggtaggcagaatcaccagatcttttgaaatactttgttcttgttctctgcctgtttcttgccaagtaaattgaattggtttatataaatgaagtgtgctgtaagaaagactagttgaggccgggtgcagtggctcatgcctataatcccaacactttgggaggccaaggtgggtggatcacaaggttaggagttcgagaccagcctggccaacacagtgaaaccccatctctactaaaagtacaaaaattagctgggcatggtggcacacacctgtaatcccagctactcaggagtctgaggcaggagaatcgcttgaacccgggaggctgaggttgcagtgagccgagatcgctccattgcactccagcctggacacagagtgagactccgtctgaaaaaaaaaaaaaaaaagaaagactggttgaataaatgatgcaccatccatacaatggaatactgttacagctgttaacaaggaaaaacaagcaaaacttggtttataacatgatgcatctgagttttgttttgaagaaatatacatatgtacatgtgtatttatgcaaatgtacatatatccttcaaaacaaaattatgtgtgtatttgtgcctgtataaaatatttctggaagaatatgtaataatttagcataatagcagttgcctgtggggaaaggaaccaggagttgatgataggggtggaagacttagctgtttctacaaatgctctttaacatggtttgactcctagtgcgtctgtatattacctttccaatggaaaacatttacatcttcttaccaattaactattaatagttcatggtaaatatgtatatgtcattttgagattttcattttaaattagcaggaaacatatgtatactgataatgtgtgctagtgcttgttggattctccagcagctcatgtatataccaccaacgatgtaccaatttgtgtttcacagagttacatccatatgggagaatagtctccagatcactacaatttctagctttgtaggagcatggcttggagcacttcctattccactggattgggaaagaccatggcaggttggtttcagttacttaaagcaacaaaataaatgtttgtacaatgatagtaaaacagatgaagcaaactagtgtgtatatgtaaattgttttgttgttcaattaagtagggataccacttctatcagtcactgtaatctgggcagcttcttaatggggactgtccagtgccacaggtgtctaggtagccctggttttatcttctagcactattttttgcacatgtgtagatgaataaacaagcttattttgtgattgtatataggcggtttgtttattgtttttaaaaaagacaggttctcactctcttgcccaggctgtcctctaatgcttgggcctaaacgatcttcctgcttcagcctcccaagtggctgggactacaggtgtgtgccaccgagcccagccagtataggaatttttaaaaactaggttaatagctgcagaaatttcctattttcaactttgatatttattgcccttgtggtcttatattcatattttctgaacttgattgatggccaaattgaatgttcctcttgaaatttttagaagcagatagcaaggtaatttttgcagcagcggcctgtgttatcaagaaagctcacaaacatcagatttttcgtcttgtatcacaataagataaagctgatatgctaggtaaagcactgtgaggtaagtgctctttttatacccattttacagatgaggaaactgacacctagagggtatgtaacattcccaaggtcactgaacttacagtgatgactgtatctttatcttaatattaatgactttgtagtatgccattatatactttataacttatttaacaaattcactattgatcatttagattattgccagtattttgtgataataaacactgctgtgataaaatctttgaatctatagcttcttgaatttttctaattaggttcacagagtaattactcccaaaaagaattatggtattaaaaaataaatgtgctttctttttccaacatgaagataatttttttctgatcacgaagataatgtatatttatttagaaaattaaagcaatattagtaattctaaggaagaaagtaaaaattactttcctccccaaccacccagaggaaacctccatttgcttttggtgataatttttgcagctgtctctctccatgcctgtaactataatattcatgttgtttttaatctgctttttcccctcagcagtatattatggagctcattctatgtcaatgaaaacttacatatatgtaatattcgattatttgtgtaaaatattgtaccagttttttattaaagaacatttaggtcatttcctattttactattattattttattatcaaatatggtcattatcatacttatacatctttgcatatttgtccaattttctctgtagggtagagtcctacctaatgaattgatgaattaaatctttgatacatacctcatttgccaaatgtgggatccagattgtgtgccttgcacataactgcctacatttagctctattctttgtgctttcagttagatgtcgtgtctccccgaaagtcaaattgttgtttcatgtttaataggtctgataggtttgcccttccctgttttaactcttcatcactatattagagaaatccttggaggtttggtgtgtgtatcgtcacagattcccatctcaagtttttggtgctagtaaaggtttcttaagttgacatcttatagaagtcatccatacttgatgtcattcaacagagtgtcagtgatttctaaattggaggacaatcaaaatcattgaaaagtatacacagaaaattgaaactgtgtagattcattgctatcaagtaatgcaattaaatctaaatagaaagtattgataaataaagtactatgggacattagctttaatgagttggtaagatataataaacatatcattttgtatatgatgcaatacattagggtgtaaaggtttgatatattacacataatttaagtcttttctgtttacaagacagtgcagtagtagaaactgaactaagaggaatgaatatatgtgctttataaaatatgtgtttaggtttgcttagaaaatatatatcttaattatttacagttcagtcacccattttgggattgttcaggcttttagctgatgacccatttttctccctcagtgcttgttaacaataaggatgaactagatccaaattgatggtattactttttaaattaatgtaaagtttccatttgaattactgactttttaaaaagattttctaggtagctggaaattaatttaattttaaatctaatttaaatacataacaagtgttggtttccattaagagtgtttcattcagctggaatattactggccatgtaattatctttactattgggttgtttttagaatattccaagttaatgacccacgtattcactgtaaaccttttaaattatgaaatgtattgttgagggaatgatagaattgatgtataattaaaaatcttttattcatatagcactcatctgctccttgcccttttagcagttatttactaataaactaaagaaatgaggtttttttttcactttttatttccagcaaacaaggttgtttgtttttttgttattgttattttttaataattctaactccacagaacagcatctcccagagaagcaataaatcagataagggaatatggcattttctaaaagtggagatgttgttagagcaaaatttcatgagaagacaatacagtatacactttattatctaaaatagaacatgtattaagagattcttgttctgtgttccttgtagcccaataccgatttgatctgcttgtggtaaagcaagcttttctggattgtgttctggttttatttatattccagtcagagaaacaggaatatctggttaagcaattgtacctttaaaaacacacacatgcacacacacacacaaaaccccacaaaatctactacatgttttaattcagttttctttactttgaactcaaaccattgtataacattcctgaggccaagcataagattatagtgatgtggattctgtaatgagctgtttcaagcatatttttatgtttaaaataatttcttcattaaatgactggaaaggcccactgaaaatatgtgatctcaatgtaaaagttttttaacttaatataaatcttaagtgattttaaataatggcaagtgatgaaagattaggcatctttatagttggaggaagcctttcttttgtagaaggcagcaaggggatatggttaaagagaatatggtagggtagctacccattatactgttggtcatctttgttgttgttttaatactttaaagtcatcttcttgcctctaccttatttgccttaaaatctcagcaagaaaacaaatatttgaatttcccataatccagataggctttttcaacttctagagaaagcttatagttgctgacaaaataaatatttggactacagaaaacctttgtattttataatttgattctttatctgctgtaactaaatagctaatcaataagtatttgttgttattactgtatgcatagcatatgttctgtgtaagtaagtacaacagatacttaaatacacccaggactggaatttaattatttaataatttagatttgaactgtgatttagatttaatatgctgtaactatttcatagaatatgtagctatgaggtttttcatctggaaaatgtcttgtcaaaacatggctagtatttcatgttataaaaaattagtggaaggttaagaaatattgttggttattctgagcacaggaaattgaccatgaggtttttaaactcacgttttattaatgggtaggcaggtaacatgatgattaggagttctggcatcagattactgggttgaaatcctggctttgtcacttgctagtgaggatgaaataataaaatccctctaaaatacctagctcagcacctgacacatggttattacttaattaatgttacaggcatttgtgacctagaaaagacatagtttaatgactatatttttagccttcaaaaaatgcaaattccatgatttatttgagttctcatatattagagaatatgttaattgtctcagtttgttgttttattttttctgcccagcagtctttcagttggtagagtggactgttaatttatctatttctctggtatttagttatgccaatttagggtatttggatttcacataattttcaatcctgtctgacatttcagatgacagtagaaagaaaacgtagcacttatagatctctccatgtaccctgcagggggcttggtactgtgaaatgagtaacttaatcctgacaaccgtagtgcaaggtaggttttactcccattttatacactagaaagtccaagtgtgagaggggaggagtacacatcttgcttagcattactcaggtgggaagagggagacttaagattcacatgagagccccactacaccatgattcttttcattgctggaaactaaaacatagcttttctttttaaaaaatggtcatagcttaggtctctttggaatagctaaattacttattatatttcatttctttccccacattgttttcattacatgccttgaccgttgtggtggtgtctgtattttaggccgtaatttatttgtaggagaatatttaaagctaatatgcaatgattttgtccctaacaaatccacacatgcctttaaactatggacttcagtgctacaatctttaaaaatatttgaaccaaataatcaagtctcggctaggatgcttatttcttacgaaggtaaaaaggaaaattgatataaagtattttaaataactgaatttggagattttgaattttagacacctgagatcgtctttgaaacaatttaaagttgttttaaaatatttgtacttattctcaacagacaccagataaatgaggcattgttgtatttaaaaattttttgggtttttttttttcagttttaccacgttagaaatctagtatttgtgaaatatgtatattcatttcctaaagtcacagatgccacagataattctttcataagttgaaactaggaatcataggattataactacatgaattactgcaaaatgctggagggagattaaaactaagattatggatttgattgattgaagagctgcaggtttttacgttaattggtatttccattaccaaagggatgatactgtgttttagaccaaaataaaatactcatttatatgaatatggtttgtatgtttcaagcatgagaaaaatgtgttaacattgaactggcatgaaatggttttggattgaaaaggcgtgttcatcgtagggtaatcatgttgataatgctctgctaacaggactttcatgttagagagaataatgctggccaagttaactcgtttgcacgagttgtgaccagaaccttttagtgtcattttgacaagaattccagaccaggaactacacaccccttcgcaaataactcttcctaaagtagtattcttagtcacaggagagtgtatacatggatgagtgtagatttttaactagagaaatgtatcccaatgagtagattcatttgtgcatgtattcctgtatcagacaataacatttactttaggaatatctggaaaaacatactgttcaagaccaattttggaggagaatataaatgattatttataaccagtaggtcagcaggctttgaaagatgaactctctcagtcatgcaaatgcaaatttgtgataagcacaattaacaaaacaaacatattgaaaagtagctcatgagagattgagaactggattttatcttcctttttatctcgagagagacagtaatcctaatggttgtgagttgttctaaatgtctgtaggtgttctgatttgcagataggtcagtttctccatgttatctgtgacagtgtaaatctcccccaaaattataagtaatatttattatattggaacacatttttaagaatttatactaaaatgtatccaaaattaaataatttaatcttagtttacacctttaactgctgggttaaggtaggggctccacaaatagtttcgaatgaatggagtcattcatatgagcctttaaaaattaacacaaatgcctaccaatgattagtttaaaaccactatctgtacttaaaattttgtttcttcgaatttatgaaaaatgacagctagcagcagggtaaccttctgaggtaaggatacagatggttaacgtaatgccagtatgttgtacagctcctgaatttgctcttgtaacagacatttcacatgaagaacagcatgtattaaagatgattgctttatggctgggcgcggtggctcacgcctgtaatcccagcactttgggaggctgaggcagacggatcacgaggtcaggagatcgagaccatcctggctaacacattgaaaccctgtctctactaaaaatacaaaaaaattagctggacgtggtggcaggcacctgtagtcccagctactcgggaggctgaggcaggagaatagcgtgaacctgggaggcggagcttgcagtgagccgagattgtgccactgcactccagcctgggcgacagagcgagagtccgtctcaaaaaaaaaaaagatgattgctttgcaagggtaaagaatagttcctaccacttcctaccacacagtatattactcatgaactattcgttctaaactgccggttctacttattacatagtagtgtcagtgaccaaagaaatactgtttgtgtaagtttaattttttcaagttaaaacatgtaatatacagaatactggtacgtggtactttatagctttcatgacaaattttaagagattacttcagccctgcattttaagtatagtaggtacttctgtccctgttctgtaggggaaactgaggctcagatgttaaaatgagctggctaaggtcacttaacatctgatgtaccacttattttttaattagatttttcttcttcctggtaattttaataattttacccacttgagttgtaatatatttgattatacaccataggttgtttcttctatttactggctaaaaaaatgtaaatttataaaaaactctcactatcttgcccaggctggcctccagtgcttgggcccttgtcattttggtggcaaacacttgtgaatgacttcctttacatgaatgtctttgttctaagtttcctattttctttaaacaaaataattatataaagccatctcagattaccataatttggagaaatctttatagcagtgcagctgaattatgtatttaatagatatcacttttttaaaaaatcctatttgtggcatgaagaacgttgaatagaaacatgtctgtatgtgagataaggaaatagttttaaaggaaaaccttaggatctaattatgaaaatacctgattaagctaggatttacaaatgaattctgttgccatagtgtagtttaaaaatttttagaataattataagaaaatcagtaggaaacttgcttgaggaatagttcttagtgggcagcctccctccttttgctgttccctattttgataatctattttgatcttcaaaaatcatgaaaacggcccttaaagaaattctcttttaaaaaaatgacagggttacgattaagaaatgcttatttcaggaaagccaaggaggtactcttgtaagtacaaagcctgacccatcattaacagtcttcaaagccagtccacattttaatttgctgatggcatgcacttcttgatttacataacatgaataaccaagtgttccaagccgtaacccttcattagacaaaattttttaacatttcatttttggcattctgttggaggtgaggtgtggcagctgtttaaaagaatgtgcgtggtggtatgtatgtgtttgagaacaaagagccatactgaaattacaaaatgattaaaatacaatttagtaacccaaattggaatctagctgggattcatgagggattactattctccctatactttaacagtgagctttttttaacagagtatagggactcatactttgccaatgattagtagactctcagcataaatagaggaaagagtattatcctaaatgtttacatagggtaataaataaaaactactaaggtaaaaagttcagtgctttacgtagatagtaaactatgcatagtattttatttgtaaccccatgtgttaagaagggacactgttaaagtaacaatcatttaaaagtaacaaccaacaaactggtatttaatttggtattttaaatagttaaaaatcaaatggaaacagtgtctaaagtcactaagataattcataacaaaacccattaatccaagctccacttattgtaaatagaattcaccatgagctaacctaaaatgtacctgtggagataaaacaagagtgtaagttagcaaagtattaaataaaatttcagggagcccctaaatttatttttaagaactttagaactaattctctatatgcaaacactgattaactcaaatatcttgtaagttcattcatacatggccttatttgaggcagtgtatttgtattcactagcaaaattcatgtcagtaaaatatttttgaagcagtttatttcccagatatttcactagtttgaaatagtcatttcagtgattagtctgaatttctattgaagcctaagctttgaatgaagacatgcttctgaaaataaggcagtttttctctagtctgcttatcaatagaaaacaaatctttggttttagttaaagtgacaggaaggatttttgcaaaaagaaaaactaaagaaccaaagcaattaaaaagctcttgataagcaatggggaactccaaacccatcaaggtcagtagagtacctaaggcacctcagcttcagatgtgacagtcatctttgcttagagttctgataatctatatacatgatttttaccatcttgagaatgtgaagctgaaaaggtaacatccaacaatgattactgtgaataagaaaattactgtgataaatgggagagacgttggagatctctgttctacctcccatatttataatgaggaaaccaaatcccagtcaagaaacaggtgacaccagtttgtgtagacaaattcctaatctgtttctgttagggcagggcaaattctagacttctaactttgaattagtaaaccaagtgtgaagggtttcagagatatgaattggagccccctccccccaccaaaaaaaatcctcataaatccccaaaggcaagttggaaatgtgtaatagtttactgttgtaattcgtttataccatgtgttggacaactcagctaatatgttaattgatttatacaattcctttcaattttatctaaaaataagcagaccaaaattaaataagaaagttacataagattccatttgagcatacataaggccatgatactttaatgtgaaccaccatttcttggaagaaagaagacatccaaatgtccgattcagagagaaagttcctggccagtcatccagtagactctctccactcttcaatgggaaggtgatgcttatatttttaaaaatctctacaaagctcacatacaacaagacagtacatcctagatttgtgactgatatgagcatttaaggctgtcattttcaagtataaaagtttagtgttccattacccaatctgtgcagtagacatagctataagctcaagtcatgtgaattaacagaagcccaccaaagacatttaaaaaattataatttgggcaacagcaagtttaaatgtaggaaaggctagaaaaaatgtgatgagattgtttctctaaaatgcattaggttgttcacaatgaagctttgtctaacaccattatctgatgcatccattatctgatgcatggcatatgcaataaggcagatccacagcagaccaaacaaggaagctgaattaggtaatagaactagtaattaagatggttcacctctaacacagttctgtggcctgttccccccagagaaagattagaaatggctccagtgtaccaaataagcttcacagaagaacatgaaaattttcctccaacttttttttcttttttttttcaagcagagcctttcacttagggaccaactgcttgtagatgaaataaatcaacattaattacttctagcctgatgtaatatggctggagaaaaggggtctctggaagccggtattttgtttaacttacattctaggtgtgtatataagttgtcgctctataacttctgctgtggttccaacatctatatctgaaaggtggaagcagctgctctgttacaattttcatgtaacacgcttggattctaggtctttcctctttaacacaacttaaagaaagtttcttgtggtttggtcagcatacacacttctcatttcatttgatgtacacagccaaagtgggaattaaaaaaaaaaaattaccaactagttcagagagctaaattgagtctatcattatggcaaagtctgacccaaaattttaatttgtaattttagcatgtgtctcatgcactttggggagcgtcaaactaaatctacaattgccagaagccttgttacagtttaatgcacattaactaaaatgtgtacatttttagtgttcatgataaatgcagttatgaccttattacactttaggcattctttaagaaagcacattaagctttaatatagaaatatttaggttacacttgtgctcaagtaataataaaacatttgttcttttttgatctcatacattctctcctcaggtatggcccatctcctgtacgcttggagcgacctttggctatgtggctggccttgttatttcaccactctggatatactggaatagaaagcaacttacatacaagaacaattaactggagcaaagggagatatttctttgtgcagattctgtaagggctgggcagaaatgtgtatggtcaaagccaagcagttccatttacagctctgttttttacgtagttacaacatgatgtgattgtagctttttaaactatgaaacccctgagagattgtaccttctagttgaaataaagtatttataatagattgtggcttcagatgctgcttactgcttcttaaacctttaaggaacattcttaatacactttatagaattctgaggacaggttttgttttctttcaagttttgaactgcttcattacctataaaaggtctgggtatagctgtagcatttcatttgctttctgagagaaatggacagtttccttggccactgaagatgtttctcacgtaattaaacaacagtttatacatcttgatcctattcttttttttacagtgtgtttctttggagttaaaatggctatgatagcctcatcaaaaacagtcttcaatcccttctgggttaaagctgaacattccacatagcagcatgctcctatctgggagggagaaaaaaaatcacaaatatataagatcatgtttatacaattggcatgacataaacacatcattataaagaaaattataaaatacagctatgcaaaaagaatacattcatcatccatgttcataaccccagaggggattttaaaatactagtatatgtccttccagactttctatgaaaaattatttcactcaccacatatttactgggtatctactatatgtcaagcactgtttaggtcctggggatatgtcagtgaactgaacgaaagagcagagtccctgctgtgtggcgtccacatgtgctgacatctgctgggtaagaggcacaggggagggaatacagagcagatggttgcaaatgctgtggggaaaaagcagagtgagggaggcggggagtgctgaggacaatggtagtgggggtccggggaggcttctcaatggggaagtttgagcagtgagggatacctaggggaagagctccaggcagatagatcctgatgcaggagcatgcctggagcagtcaaggaacaagatcacactgaggatgtggtatttgagcagagacctgaaaagagtgaaagaatgaatcatgtccatagggaagaacattccaggcagagggaacaacaaaagtacaaaggttctcaggtagaactttgagggaacaacaaaggagaccaggaggcctggggaacaatgagtaaggcagagagggaacagaggcttgtaggccactgtgcggactttggcgtttagtctgagctggggacccactggaggattctgagcagagcagtgacatgattgcgcttacatttttaagacttactctggctgctgtgttgagaacagatgaccatggggcatagacagaagcagaaaggtgagttggaagctattccagtaaagcaggccagagatggaggaggtctgaaccaggtgatagagggaagagttagaaaaaagtgtctggattctggatatgttctgaaggtatgttgtgccgaaggctagatgtgtggtatgggagaaagagcaaggtcaagtacgacttcagggcttttttttttttttgagacagtttcactcttgttgcccaggctggagtactatggttcgatcttggctcatcacaacctctgccttctgggttcaagcggttctgcctcagattcctgactagctgggattacaggcatgtgccaccacacccagctaattttgtattagtagagatggggtttctccatgttggtcagggtggtctccaactcccaacctcaggtaattctgcccgcctcgggctcccaaagtgctgggattacaggtgtgagccactgcacccagctgagggcttctgacctgagtaactgggaggacaggcttggagggtaaaagaagaatcatatcttagacatgttaattttgagatactcagccatgtagatggacttgttgagtaaacagctggataaccaaattgagaatttaggaaagaggtccaggctggagatggaaatccaggaatctttggttgtagactgtgcaagctacaagactgacagaagctcatttaggcctagggagtgtagctatagaagaagacatccacaaagctgagtgctcatcac

SEQ ID NO: 17353 - DNA, 24020 bp, Human
acatttatatctcccctaaagaccctcaagagccgaattaaggtctttaaaactccagcacagggctttatacacagcaggagcaaaatgaaattagttcagcctatttaaaagtaagaaaagtcacacttaccatgagctcgtacacacacagaggtggaaattgctcgcttgccaactaggctaaataccctggtagccaacattctgaaagataaaaatgtacaccttctctatgaataaggacaaacagcaaggaattagtcttctttttgccccagagcattttggaatttttttgtttgcttctccccaacgcaaatgatccattctttatcactgtctctgaattcacaaaatgacctaggatgaggtttttcttagtaattggcatgcttttaaggagcttcattataaatcaactgccataatatatacgcgcttcaggtaattaacagaacattggtctttttaaaaaaacaaggagaggccgggcgcggtggctcacgccggtaattccagcactttgggaggccgaggcggacagatcacctgaggtcaggggttcaagaccagcctggccaacatggtgaaatcccgtctctactaacaatacaaaaattagccgggcatggtagtgggcgcccgtaatccccgctacttgggaggctgaggtagaagaatcgcttgaacccgggaggtagagactgcagtgagccgagaccgcaccactgcaccccagcctgggcaaccagagcaagagtccgtctcaaacaaaaaaaggcaagaagaaaaaatgctaacaaggtgactctgaaaaagctagagatcattaaagcactgtgctgccgtgacagactccattcttcagggagcggtggggggaggtgacagctcacagggaccgtggcacgcatcacattcaactgagtgtttaaaacctaataccgcctgtacatagactagaaggggaaattggagaaggctgccaacacagccccgatcaatttccaatccctgaggagagcggaaaacctatgagaccccccctcacccgggccctcctctattcaggcccatcaaccttacacggccccctttaaatcgacccttcggaggactggtgagagtgatgtggggaaataccctccttggggcagaataaacaagcatgacgtcagggctgaacgcccgcgtctagcttctctccttgggcctagcccttgcgtgagcaaacaataggcgccttccaggctggaaagccgagcgccgcccgggagccccgcaaaacccgggaggggttgcacagggaccttttgaaggagcaagggcggaggctgcaggcacagagcgcgggcccgcctccccgcagcctgagccctcggccagcgggcgctccaaggtcagtgcccgaggccggtccgcagccgctgcgagaccgggtaagatggaccgggcacttcggggcggccccccgagcctggagccaccgagcccggagtccccacgggccggcctcaatgtcacctggctccgaggcccattcggtgcttcctgctgaagccgagcggccaggctgcggacgtgcagacttgatggctcccggccccccgacccggcccggcctggcggcgccgcaccggccacctcctgtctcacctgccgccactgcccgccgcgaccgccctctacacccggtgtcccgcgaccggaagagagcaaggccgcgccgcggagcaccacgggatcgaggaagactccgcccgcacccggccgcacggaggtcaccgtggagcggaaaagggtagcgctgcgaacgtcgtaaaatgccgggccgggctgctttccggcaggcgttggagaggctgctttccggcggcgccgggcgagaagcgcgactggagtctggggctgcggcttcccagaggcgcgagtcgcttttccaggagccgaggcccaaacggggccgggcctgaagggtcccccgccagcccgcggccgcgccatcaatcgccgccgcctcgtcccgcttctcggctgaggcgccgcgcggccaggcagcgggtccaggcctcagccgcgcgcccaggggcctccggggccctcccgggtcagcatgcccggggtgaaactgaccacccaggcctactgcaagatggtgctgcacggcgccaagtacccgcactgcgccgtcaacgggctcctggtggccgagaagcagaagccgcgtaaggagcacctccccctgggcggccccggcgcccaccacaccctcttcgtggactgcatccccctcttccacggcaccctggccctcgcccccatgctggaggtggctctcaccctggtaagcgcggaaagggccccttccccttgcaggcagcctggcctcccctcagtcagcagagaggaagctggcccagcggtcgccctccagcaggctcctaggacccgctccctagggttgccgtggccaggaatggggtgatccacgatggcgcttgggtcttggcgctgaataaatagcgtcccgtagtagcagcgactttaaccgtcgtggatgcttttagaggcactttaaggcgacgagttatacgttagtttcctgaaatcagtagcctttgtagaaacaagtcatcgttcacttggtggggattcgacagagtttcccttgaggatttcgagttgcaggaagtgttcacgttgttgggacattaatcgctaggatttggttcttcgcaccttcgcagagccgattccttatctggcaaagtgtaaatgcttctttggctgtcggtactcgggcaccccggagctcagacacttgtagaaaggtagttgcatggtcagatctgtgtgatgcatcttaggcctggctccccttgattgaatgtgcctgagctttgtgtaaagagaatttgttcccgttaatggttaacaacttatctagaatgtttccatggcttttaaaagctaaagaatttctgtggggccgggcgcggtggctgacccctgtaatcctagcactttgggaggccgaggcaggcggatcacctgaggtcagaagtttgagaccagcctgaccaacatggtgaaaccccttctctactaaaaatacaaaacttagccgggcgtggtggcgggcgcctgtcatcccagccactcgggaggctgaggcaagagaatcgcttgaacccaggaggcagaggttgcagtgagccgagatcacgccactgcactccagcctgggtgacagagcaagactccgtctcaaaaaaaaaaaaaaaaaaaaaaaaacgaatttctgtgacattaaacagcaggagcagacgatctgtccaacacgcttttatgtttttgtttgcaatgacagctttattgaagtacagtgggaaaaaagatgtagcatgcaggtagactagttggtaagtgaattttaggcagtagcttttcagttccggtgatcaatgaagggaaaaagaccatctataaattccatcgagttgttaaaacctgaaggaaaagtaaactgtagcttcagacctgcatacctgagctgaggtgctgtttgtttttcatttaagaataaactgtgatgctaaaaaatagtagctaattgatgtaagaagtagctaagcttgagaaggtgtaagtagaatttctttatctgtgtccctcctccaccaagtaaaacgaagccatttcataatctaccatttataacttaactaattatgacacccaagtcagttctgggcaagcaagaagtatctctgggcaaagagtcctggcgtaaggttcctgggcacatctttgagtgcctgttaaagttaaacttcatatcatttccgggtaggattcagatgattataatacttagatgatatttataaaactaagtattttagctcttgaagatatctgctgtcattactgaaacaccactggggagtgtgtgtgtgtgttttaatccaggtctttccaaccatctttttgtttttttgagatggagtttcgctcttgtcacccagcctggagtgcaatggcatgatctcggctcactgcaacttccacctcccagattcaggtgattcttctgcttcagcctcccaggtagctgggatttcaggcgtccaccaccacacccagctaatttttgtatttttagtagagatggggtttcactgtgttgaccaggctggtcttgaactccttacctcaagtaatacggccacctccgcatcccaaagtgctgggattccaggcatgagccactgcgctcagcctttccaaccatcttaattgttctgttgtcaagagaattattggatctgtgaaatgcattgacttgcagggagctagattcatcagtagcatttatgcgggattattcacttttctaataaatgtttttgagtatctgctttgtgccaggcccgtgctgaggagggatatggctgtggatgaaacacagtacctgcttagcacttgaaggtgcagcaagccagcaagcacagcacctaaacctcacaggcggagcttagtaaaaaagtggcaagggattcgagagaagtcagccagcctaggcttgggcaatcagggcagtcaggttgcccagagaaaggaacatgcaggcagcgggccagcctttgaccctcaggaggtgggggatggagggagaacattcaagggaccagcatgtgcaaagagcaggagaaaatagtgggcgggagaggagagcgagtgggggagtttggagagagcaataggatggagtgtaaaggggcagcgggcagagagagttgagtggtggacagattgctttgtagtgaccttgtagatcatgcagaggcatttgggcaccatcctgaggacagagggaagccactggaggagagttgcgtgatcagatcagtgccttcgagtgatggccccagcctgcagcagaaaggatgctggagacaggagtacacccaagactagaggcagggaggtggcaaaactgagtgcagcatgggtacggagaaggggacagaagagagagcaggtgggagaatccacaggtcttggtgactaatcgtgcatggacctaggggaaaaggaagtaagggtgttacctaggttcctggcttgtgcgctgggacgatggtgcactggtgccatttgttgagggaagaggcagagaaacaggtctggaggggaggtgattacttctgtttggggtatgttaagtttgagatgttcaaatgaagaagtcctaggttgaaaggtgaagaatgggtctgagtacagagaccagagatggatgtagattgagaaccagtggtgtgccggtgacttctgaagccatgagagcaggtcttagcacttgaggactgcgtagggaaaagctctccaaccgcgtgtgtcctctgctctcaccgccaacagtcaacacagaagaagacttgtgtgaccggatgtataggagtttccccacacaccaagcagcggccaccagctaggtgtctccgcattctgttctgacactgcctacctggagatagtgtcagagcccacgggttgagggctcagcagcaagtccaggctctggaacctctgacccaccagcttcaaggtggggtttccatggcttcctgtttggatttgattaatttgctggagcaactcacagagctcagggaaaaccttatgtttatgggtttattatacaggacactgcaaaggatacagatgaagagacacatagggcgaggtatgggaaaggggcatggaagctccccgtcctcttgggtttttatgggagcttcatgacatcagcattccttcccccgaggtctaggggggaccctctcctggagggtcttaagacccaccgtcagaaaggcggagagggaacagtggagtggaaggagggcaggagaaggtggggtcctagcgcccctgaggctcacgcacctggcattctatcaaaagactaaccagggccgtgaggagccaggaacggggaggaaaaccagtgtctctcatcacaccccaggaacgtggcttggggcactctggcttttatgggttgagtggaggaggagtcacagagcaactgaggaccagcccaggagtgggagaagaaggtgtggtggctgctggccatgtaaaatcctgtcagaaacttctaggagcttcttgaagacaaacttgaacctcatttggaatgtcagatgttgcttattcttctcattcttaagtaaccttgacagagttaaacacttctgttccgactatgggatgtgaatgcagtacttgacagagttaaacacttctgttccgactatgggatatgaatgcagtacttgacagagttaaacccaggaactataaacaactgcattcaagtcacctgtacatgaattttccacgggggagcagggctgcctcccaaaccacttaccagggaggaaagatgcccagaggggacagtgactgcctgctacctgagcgtgagagggcaccgggcaccgcaggggcccactctgaccttgctcccgcgcctcattcctagttacagtctgcactgtagacatccagcctccagcacctccccccaccacatgagtccccatccagcaagtaaggtccacacttgactccctgcggtaactactcttcagcagtgaaaacaagcagcaagttttgccaggcaatagttatttatactgacttttccgagatggagtctcactctgtcacccaggctggagtgcagtggagcgatgtcggctcgctgcaaccttggcctctcaggttcaagcgattctcccgcctcagcctcccaagtagctggtactaccagcgcacaccgccacgcacggctgatttcttttttattttagtagacaaggtttcaccgtgtcacccaggcgggtctcgatctcctgagctcaggcagtccgctcgcctcgccctcccaaagtgctaggattacagacgtgagtcaccgcactcagccctgacttttctcatattcacaaaaactcattccctcagcagtgggcaaatatgaaaaagacagcaatccagtgcccatgaaataactttcagaggaaagttacaggggaaaatttgcagctggagtccatccacaaattttgtacttcagttaagctattaaatttatattattcactttttgacttagtgacttcctaacctgaaggcaatgaaaactctcagtgtttagagccatagtttatgaggttatcagccatagaagatgcagttttcacaaagcatctaaatccatgcagctgtgtaaatgaggccttgttctcatggctctgttccattcagagagcttcctattggaattgtttttgataaaggggaaagaccatagactgtctatcaaaggacaacattagattcctttgaaaggcttttcattattttccattaaaaaaatccttgcatttgtgcatgctttttgcatgctttttatgtttttttaagtacttacgcctattaacttatttatccttataaccctttgacgtaggtagtgaaggaattattcctaatagcagaaacccataaaatgttagtatggaaattagcttgaacccgcttctctaatccctttctgcccttttccccttgttgatttctagtgcggtggagtagctttctgttacattctgcgcagatgacttgctggcttgctcactggcctcatcaccatgatttcaggctagaattcttgctgtggcctccatgtgggcctgtcctctgctcctctgcacggcggctgccctggagctctcccatgcccctactccctcctgccctttgttcatctccagaacattcacgtgccaccttggggatggggagagggatgctgtggttccccctttgagttcttccccctgaacttcaccctctatctcggtcccattgacctcccaagctcttctttcatggttcccactccttctcattccatagaaagatcagcagctgacttgagaaggaactttccttctcagtgaaaataacagttgctctacttctgaactccaaggcctactttttgctgcagataggaaggctcagcaggttaccctcatcttgttggtaagtggcaagttgtggtccctgcctcgccttctttacggttattgtacagtcacaaggggcgtggggggatagtgcagattttagcaaggctgctgtgagaagctactgcctctgtgcaaagagtctagttgggaatgaaaggggtggccccagcccttttaatagttctcttccatgtctggaacagaagcagccaaaaaggacattgagcagagggtggtagactcctgccaaggtgaaaatgtcctttctctctaaaaagtaaatgaaattgcatgagtaagtgcagaatgcggaaggtgtctatatcagagtcagtttgactacattgacaacagtctccacagagttttctcctgaccttttattttcatcttgatttttcacaagatgcacatcagggtgtggggtgtcgtacagcgaagcagggacatggaaatggattcattgggaacagaggttgagtggcttctcggctgtgccttgtcttgcctcgcttcggaggaagctagttgccttgactcctagctgccacttagatccaccgcagcttttcatgcaggagccatttgggctgagggcaggatcctgcagccactggagacctggctgccacacccacacctacaccaccagcaagccccatcctcttcccccagcccactccactccagggcactctcacctgatgcctagttccagattccggactgtcacaggaaactacccttattagaactcatccaccctgccgctgtgagtgctgaggcttggccgagtctccgttcctcccttcgagttctccattcctcagttggtgaacgggctgtgtgcacccctcatagccatccatacagctaacttggttattctcatgtgtgtcattcaaaagttctaaattctaaagccaggccagagcttttgtgacctggttcgctttaagggcaacctcttcaaagaggttctacttaaagttccaggtcatgacatttttctgctggaatttggttgggcccttggagttttcttacaggaatttgtccctcagcaggcaaaatgtaagttgagatatacatgtgtttgtcataggaatcatcttttgtaccaggtggtttctgtgctctgagagtgggtacaaggtgataccatatgtgtttactgggctatgagtcctaaccaggtggcttcagcccaggaaagagatggagtagccaactgagactgctgctgggggtcttcaggaagttgcctgtagctaagtaaaaaatatgtcctatggtttttcctagaaaatgttgtatggtatggtcagctgagtaataaccccccaaatatgtccacatcctaatccccaggccttatgtagcaaaagggatttgtagatgtgattaagttaagggcttgagggtggagagaatatcctggattacctgggtgtgcctcatgtaatcacaaagacctttgtaaaggggaggcaggaaggtcagagtgagaggaagagatggatgatggaagcagaggtcagagtgatgtggccatgagccaaggaatgcgggcagcctctaggtgctggaaaaggcaaggaaaaggattctcctctagagcatcctgaagaagcacagctctgctgacccattatagacttctgaccagtaagataaaaaattttggctggcatcatcctcagcaaactaacacagcaacagaaaaccaaacaccgcatgttgtcataagtgggagttgaatagtgagaacacatggacacagggaggggaacatcacacaccagcgcctgtcagagccggggagcgaggggagggagagcatcaggacaaatagctaatgcatgcggggcttaaaacctaggtgacgggttggtaggtgcagcaaaccagcatgacacatggatacctatgtaacaaacctgcatattctgcacatgtatcccagaacttaaataaaaattaaaaaataaaacatgcactttaatcaagtacggtttatttcagaaatggaagaaattagggaatttgaagttagaaaatccaaaaaatgtatgcattaaaaattctaagaaaaacaatcatatgataatctctatggatggtgaaaaatccttcaataaaatttatttcttgccttaaaaaaaaaaaattgggcatggtggcttgtgcctgtaatctcagcactttgggaggccaaggcaggaggattgcttgaacccaggagtccaagatcagcctgggcaacatgatgaaacctttgtctctacaaaaaatttaaaaattagccagacaggatggcgcacacctgtagtcccagctactcaggaggctgaggtgggaggatcacttgagcccaggagttcaaggctgcagtgaactgtgatctcaccactgctctccagcccggacaacggagcgagactctcaaaaaaaaaaagtgttgttttaagccactaagtatgtgtaacttgtcacaagggcaataggaaactaagacagtggccaatctgactgtgaaaataagggcaggctacactggagagcagggatagggacacccggggggcagagatgtgggtcaccttaggggaggacacactcaggaggccggcccatgatggcacatgaaggctgggagcacggtgctcaaggatcagctcatcagggaacttgaccaaatttagagcaagcccctttgatagtgtatagagatgtttgttctaagcagcaatagaaagcttctggaatctgttccattaagaggtgatagaaacaaaatatgagtcgttttggagttgttttcagcaaagtcacaatgatagcaccattatagatattttacagacataatcctgatcttttgggtggatgaccagaatgtctagttggttcactgagccctggttttgacccaatatggtaattcgtgaactcttaggaggccagaaatatcctaatcctgtgcaaggcagggacccttggactgtaactgtcttgtctgcttttggtcgtgaaggagactcagaggcccaaacaagaatttaggaaaaagagcaataggattgtgtttaaaaaacacacacatccatttttaaccagtttattccctacaaaaaaaaaaaaatcaaggtaccaattttgtttcctcttgtgcagactgagaatagactttattacagtgtattcaaattccattatgccaaaacaggatgagcttttgttgttttgaataatggccttagacctgcaggaagctgcatctggtgagaaacatggtaccataaaagaaacccaaaaacttcaaaggtctgccaccttgcttccatttcaaagcacgccggagagaactaaggacatgtgcacgtgccccttcctaacttgggacctctttaccctacaccccaactgaggggtatttcatgatgcggtgcttagaatgctgagatggagtataaaagacttttttttttttttttgagacggagacggagtttcactcttgtcacccaggctggagtgcagtggcatgatcttggctcactgcaacctccccctctggggttcaagtgattctcctgcctcagcctcccgagtagctgggatgacaagcgcccaccaccacgcccagctaatttttgtatttttagtagagatggggtttctccacattggccaggcttgtctcgaactcttgacctcaggtgatccgcccacctcagcctcccaaagtgctgggattacaggtgtgagccactgtgcctggcctaaaagacttgttttgaaagagactgagattcccttctggctctgtttctatctggttgtgcaaacttagaacctctctaagctttgtttccttaactatgaaggataatgatttaaataattttaagcatttctaaagccccagttctttatagtataagagaaggtaggtgaaggtcatcttccctctgactctctgcagcactgtaccaatccagtacctgtagacaaagggtcttctcgctgggactgaggaagatagtcattccttatgttcaaagtcctgcccttcctgaccattttttcctgagtcctaccctttcttctggggtgtagggtatgaggattaagattctgtcatgtcttgtcccagcatgtggcagtgagatctgtggtttttacgacttgatatttaagggagagtcattcatcttttcccaatttttgttcctctttcagattgattcatggtgcaaagatcatagctacgtgattgctggttattatcaagctaatgagcgagtaaaggatgccaggtacgtggatgcagaaccctctgtgggcgaggaagtgagcacgtgttgggcagaccccgtctctcgtgtgcttttcggccagatacgaaacctgtgagacctacaccccttccctctgtgcttatttgtagtatttgaggcgaactgtggtgtggataattccaaacaacagaaattccaaacatttctattaactttggaattctgttttgtgtcttctttattttgcatgaagggaattcatacaatgaaagcgacagttggcttccgacttctgtccctgctcagctctgccttgcttccccttcccagactaggggtggtgttgggcagagcactgggaaggaatgttgctctatttgccggtaaatagaccagcctgtaggtttggggtcagtactctgatgaaaatgtggtatttgctgccccctttatactggctccttctttcttttcctttatccagatccttccccaactggggctctcgctaataacaaagctgagaatttttctatatgtctgcgtcatcttggtcccaacagaaaaacagatgacacactcaggtggtgataatctgaggagggcttaataagcaggctgttgacaaggcctgggccgtagataacgcacagggggtcgtgctgtaaacaaggctggcgacaacagcccaaagggtggggaggaaggagctgggtaaacaagtccaccttgagaaaagcagtgcccttgggcaggtggccacagccagcctgacgtggcctcccattaggggagaggtggcccagagcagtcagtacatgatgtcccccttccattttcctttggctgaaccgagccagaagccagatgggcagctggaaagtccacgccgtatataacgggcatgcgtcaggctgccctgacgtggcttcctcatgttgtcagatagagccgaccctccagtgtccagggagatgggggtgcagtgaagggccctgccgttgggtccacttgctcagcacagatgagaaggtgagctcaagcactttggaaataatacagtaagctggtgacagcattgctatcactgatgaggcaccagtgtttctgatgagaaacatggtatcctaaaagaaacccaaatttagaaacataattatcttaccctaggagggctgggtccaggcacaggatcctgagggaggcagatgtcctaggagatgctgcactcaaagtcagtccgctgaagcctctgccaaggcggttgggagtgcgtggaatccccatgcacattggctcttctgctgcttcctctgagcccacgagcagcactggcctctccgccttcagcgcatctcttctgactctcactgggatgtcctctgtttgatatcgcctgcctccctttgttgatgaatcagtgcctcccctctcagtgccttcactgagcgagagcctacccacggggccacatccatcttagtctttgttacatgaaagactaggcgtgggctgaggaaagcgcagccctctggcccttgccctcacgtggctgagttgaacatgaaggacagtgcaaacacaggctgtggtgcaggacagcggcccctgcagggggcttggtggcaggggccgggagacttagacctggtaggatgatcccagaagtccagggcatggtgtcctgtaaaccaggccctcgagagtgagcagggccttgtcaagtgcagacgtggagaccaggaggtcagcattcctggttggggggacagcagacacaggtgaggacgtggcaagggctggggccgtgcccacatggagggagatgctaggaagtgaggctgcacaggtaggttgggccacagctgagggctcctctgtgctcagaagcattttgaacttcaccttgcaagcagtggggagcacccttggcaggaaggtgttcctggaccaagcagtgtctgccgtggctgtccctgcagaagggagaggagactgggcaagtgggaatggcaccaggttgtcagatgagggcaggggcctccctttccttaatcccccacctgcaaatccatgcctgatgtggtcgccccacatggacctgcgcaggctctcctatgctcctctctgcgcatgcctcatctggctcacagctctcatgttcttacctctgtgctgacctcgttacagcccagcctggaattatcctactcggacacagttttcctgctctccataccttccttctagaatgtcctccctatcctcacctagtccacgtccttctgcgtcctccaggaggttttgcagtccttcattaatactgacttttaaatgcatccggagcagccatttgtcagatgtgtagagaggataaaccttagctaggagtctgccaccctggaatagggaatccacctccccctcccccgctgtgcccagttgtttgaggaggacacctcaggtaggtaatgccgtgctatccctgggctctatcggggtcattttatttcatcctcacagcaatgcacaagtgaagaaaccagccggagaaggtggcttctcagaggccacacagcttgggagctcaggagctaggatcatgccaacttctgacttaagtatggttttgcttctgcctggaaaaccttcccctctcttcagccagacctagctgaaaatttgctcttcttattctagaaatattgcctcattcacagtgtcttgcagcatgatttggagccaagtagacctggattcaaattctaggtgacttactgattaacctccttgggcctctgtggccctgtctgtaaaatggagctgagctcatgcctcagagagtagtcatgaggacagaatgaaattgcgcagtgtgtttgtccttgtgcttggtttacagtagtggctggtgctgttactagtgctgtgatgactttttctattactgttctaacgtagtgtttataacttttatgaatttcctaaactttaggtcattccatcaagttttattatatgattcattgttggccagtgttttgcttcatagttagcatttgatatgagtaggttttggtgcccggcagagagccctggcctgaggcagacactcaggaggaagcttttagatacacattgtaagatggcacctacacgctggcccgacatggtgctgttgagggtgagcagagtggtctgccttcagggtgcctgcagtttcagttggcagctggctcttcctaggaacaaggagttcctgactagcaggaaccacagcgtggcagtcttcattcaggatcaagtggatcagtattggagattcagtgcctaagacagagaaatgcaaagttggcagctgtttcaaatactttgacagttcattaactacacattttttttttggcggggcggtggcagagcagacagagtctcactctgtcacccaggctggagtgcagtggcacgatctcgcctcaatgcaacctccacctcctgggttcaaagtattctgctgtctcaggctcctgagtagctggaattacaggcacctgccaccacacctggctaatttttgtatttttagtagagacggggtttcaccgtgttggccaggctggtctcgaactgctgacctcaagtgatccacccaccttaacctcccaaagtgctgggattacaggcatgagccaccacacccggccaactacaaatttttagacttcttttaaaataataaattttaggccagccatgttggatcacacctgtaatcccagcactttcagaggccaaggcaggaggatttcttgagccaggtgttcaagaccagtctgggcaacatagcaagacctcatctctacaaaaaaatacaaaaattagctggacatggtggcctacgcctgtggtcccagctacaagggaggctggggtgggagatcacttgagcctgggcagttggggctgcagtgagccatgatctcgccactgtactccagcctgggcaacagagcaagaccccatctcaaaaatcagtgaatagaaagacagatgttaagagttcttgagcatctgcaatggtagtttttctttttaatgagtgtttccttaccctctccccaataaaaatcaacaaccagcatgatcagtgttaagtaggagggtaagggctttgcaagctcttcatggcaagcggccctgccttttgctttccaagttcctcagcaaatgcaggagcaggcagaggtgggtacatgggcaggcctcctgagggctctgtacccactcttcaccacttgccgttagtgctgtggggacctggcgcccaccgagtcctggtcagtgcagtgaagcactgccttccctctgcgctaggagccaccatcgcactgctttcttcagtacgattggcttctacctgaaaacctccccttccctcttaagtcatatttttcttaacacagtcacatttttaagtcatatttttcttaatactgcagatttataatcagtacatcactttgtcaattttgaaaacgaaaatacaataatcatataaaataatttgttttttaaaaacattattaattttttttagcctaatcacaagggaaggattgtaattgtatatagtgtgctttgttaaataactcacaataatgcatgtatttttatggctgttaaaagaaagatggggccaggcgcggtggctcacgcctatattcccagcactttgggaggccatcgcgggcagatcacgaggtcaggagatcgagaccatcctggctaacacggtgaaaccccatctctactaaaaatacaaaaaattagctgggcgtggtggcgggcgcctgtagtcccagctacttgggaggctgaggcaggagaatggcgtgaacccgggaggcagagcttgcagtgagccgagatcgcgccactgcactccagcctaggcgacagagtgagactccatctcaaaaaaagaaaaaaaaagaaagatggatggcttggtccctgccacaaaaagctgaaagccttgattgtgcagggcagacaggatgcacagaaggaaagcagcacgtgccatggactctgtgttagagcctcttagaaataaatcctcagaactccagcagggcagggggtctcatccagggtttagcagggctttgtggtgagggtggcatgtcttctgggcactgaaagaggggaagcaattcagtaaggaggccttggtgtggagggccagacgggacagtgtgagtgaaacaagacgggcatgtgaggcagatgacatgtaggcagatttcctgacattgaagacacagcattgcccctgtggctgcacacggtagctcagttcaccgtaacgaaggcctgcctctgccagcctgagaatagcagccttcatcttgcaggcagtggtgagcagtagtctgtggggctgtgagcaccaggggacgtgatggaagttctgttttaggaaaatttagttcaggagaattttcaggttacatcggataagaagagcctaagctgagcttcgtagcacgtgcctgtggtcccagctgcttgtgaggctgagcaggaaggattgattgagacccggagtttgtggccatgatcacacctgtgaatagccaccatgctccagcctgggcaacgaagcgagactctgtctctttttttttgacgtggagtctcactgttgcccaggctggagtacagtggcatgatctcagctcactgccacccccgcctcccgggttcaagcgattctcctgcctcagcctccggagtagctgggtctacagatgtgcatcaccacacccagctagtttttatatttttagtagagacagggtttcaccatgttggccaggctggtctcgaactcctgacctcatcaggtgatccacctgcctcggcctccgaaagtgcagggattacaggcgtgagccactgcacccagccgaccctgtctctttaaaaaagagagcgagcgagtgaccgtagaaattatgagaccggttaggaagcagttttagaagcccctgcctaaggtgagagactgaaggaaataaatgacagggagaatgcaggaaaggagggcagagaaaggacctgtggcctgcagggtggggaagagcagagggaaaggtggcctcaggtcggagaggctggaaatggactggcctgcctgagagtggtgggttcccgctgggaggcttttgagggggtagcagtcttggggccatcaggcagtggtcaggagacttccggagtgctgctctgcaagggaatgggttagatggcagattgcacagagctgtggtgaggacatggagcaagactagcggcttgttaaagaagttgaagaaacagtcatggaagggaggagggaagctggacagcagctagagggaaccggttcaatgcttttgtttttccctgaaaataaagacttacacagatttgaaggcagaactggggcttgggcacagaaagaatataaataaggcccccgaggagaaggccccttcctggcataggatagaagaataactttgtgtttggagacatggtgcaggaatggtggaggagctgctctattattagctctattaacttaaggtagaaaggtgtcatttatcagggttgggtggcggcagggccagagccagcagtggaggctcatgagcgtggagaagatgtggaaaggctgaggaatttctcagagggtgacggactgccagctgccctgaggttgctcttacttgttacagtggacaagctgctttgctagcgtgcagatggagaaggcgggcccgggaggcttggagtttggcccaggagctggcaggtgcccagcagcagtttcactgcccgcttcaggcgactctccactggcttcctgggagccttccgttaggagatgctctctcaagatccccgtcaccagggctttctggttggaatgaggcaaggacctgctttacacggtgcgccccattacccaacagcgtttcctgtccttgctggccacagccatcacagtggggctgtcatcagccactttaaacaggcaaaacgtatttacctgtcagggaaaataccaagatcacaaaggtggttttcccagggcaaggttcgtccattgcactccagatgtgctgacccctgcgatttcttcatatgtggggaactgcactcacactctccccagcaatacaaataaataagtaggctgggcacagtggcccatgcctgtaagcactttgggaggccagggcagtaagattgcttgaggccaggagttgaagaccagtgtgggcaacatagcaatacctcctctctaccaaaaaaaaaaaaaaaaaagcaaaaaaaaacactaaaaagtaactgggtgtggtggcctgtgcctatagtcccagctactcaggaggcagaggtgggattgcttgagcctaggaatttgaggttacagtgggctatgattgcgtcactacactccagctagggcaacagagcaagaccctatctctaccaaaaaattaaataataagtaaaccagcgaagcgagcacgtgcagcctgttggctccgccagtctttctgtcattgcttgttaagtctcagtggtgttgactgtgccttttgtaaacagtgttgaatggcattaactggaatgtggtagcctgactatttctttgacagtccaaaccaggttgcagagaaggtggcctccagaatcgccgagggcttcagcgacactgcgctcatcatggtaagtcgcttctgtgcagcatgtgggaggcccttgcgcctcctctcaccaacctggagcttgctctgcggcggtttcctttccgctaaccccttcactcatttatctgcttgagaccattgccgcctcttgcagttttctctcagctgcagaccagttgaatcccaggccatggcttctgtgcttccgcatcactacacaagtgggagtggggtcccctgccagccgcagcacctgggaacttgttagaaatgcgaattcccaggcacccaccccagaccccactgaatcagaaatgcgggggtttagcccagcagtccatgttaagacaccttctagatgattctggtctgaacatgccaagtgtgagaagcacaattagaacagccagcacagcctctaggggcacagggaaggaaggtccttgtatgtgagcagatgacatcaagggccttgctgaacagccttgattcagacagaatcctaggatgagggaagaagtcatgtttggaagcttcgcttttgtgaaaaaacaatgaaggacttgacgttttcctgcatgacacaacagttttcctcaggccagacactcgcgccactctgcatacaggctctgtcggaagagtctctgccccagccagcgtgggcacggctgcagggagagccccgaggaggcgcctgccgctgctgtttggctggcattctgttcactctcgtgtcctttgccttgtgctcaggtagacaacaccaagtttacgatggactgcgtagcgcctacgatccacgtgtacgagcaccatgagaacagatggcggtgcagagacccacaccagtgagtgcgccccatgctgccacgcgggctgggctccttcagcgcccggccacgtgagagccactctcaccccgcctgtgttttcagttagcgttttctccagaagcatgataccaagcatattccccggctcctgtaggccccagtgttccagcgcttccaggcagtagagggaacctcagtggtacccacaggtcttcccaccccaggcgctagagcacagacactcttcccaggcctgtgctttgatgtatctgtggccactcagaaagcttcagtcatctgcctccaactttctcagaattccacgtgaaaggcgtcccttccatgtattaaccatgtcttctatgctctgtatacctcttcatgcgtttgaaatgcacatgtttctcagtactctgcaccatctctgttcataccactgtgcatgtggctggccttctctcttgatgctgttacaagccgcccgttttcactgttagatgctgacttcttcatgtttgacccgtagtgactactgtgaagactggccagaggcacagaggatctcagcctcgctcctggacagccggtcctacgagacgctcgtggatttcgataaccacctggatgacattcggaatgactggacaaacccagagatcaataaagctgtcctacacttgtgctaggcaggcaccgctgtgactgggctccgggcctttccactacgttgaagaagaaaacctatttttaaatgtaaataaaatatcttgtagcctgtgtggaaagctgaccgttttaagaagtggcatgtgccttgaaagggggcagaatgttcagtcggtcgtgtttttaacacagagtctctagaagaggtgcagacatcccgtctgactgtccctgtggactctctcagttgtatgttgctataatcctccaaatcaaagctctttctgcttgtgcaagattgttcctattaaacagttttaactaaccttttataatctggagagaatactttttaaggcttttgaactatcttttttttaaaaaaaaaaaaaagcccacatcttatactccaatgagtgtgtttgtgagtttttatcctgtttgaattttgatgtcgtccaggcgtcctgggatcagggtagacacgtggagtgctggtgctgagctgtttgagaagctctgtgtgggtgtttctgtggtcaggtaggctgggctgtgaacagcactgctccacatggtgtcggctcacagagccaccgcaactctgcccagcgggagtgacaccactgatgccacagaagcctttatcgttaggggcaaaagcagacatctctggtagcaggagctcagtgtggtgctcttcagccacgcagaaagctcacgtgcctgcagggccaggaaagggaaatgatcgtttcttttgtattaggaaaaacaagacttagacttcccgagttgtgcagagtgacgtctgtactttttatacttagaacatttggtcaagttttgtaaccaaaccttagggaattgagagggaaactttatggtacgtttaccttttttcctttttatatgaattattttgtacaaagttcagagagcggtacctttcctactgtcttttctttgactccatggaggaatttgtaacgatcggtgtgacctgaaagggtttgtgatacagcggtcactattttctcttaacacataggaaaaaagttcagacatcgctacaataaatgtgctttatttgatccaccaaattctctcttcccctttcttcaaatacctcttactcttgattttttaaactggcgttctttcacgtggggagcacaggaaagcgtgaggtgtctgtgcagccccttctctcccctgcccttggatgccaaagcatcacagctggagcgaggtgggcagtcttgttccgaatgggcttgggtttgtttcataaagggagaagaatcacctccagcatttgcacgtaagaagctgttttgtcctgagactgaaacagcagcgtaggcccctccagttagaagtccagggcagctggcagagctacttggaatgaaggttggtgaaggctcgtttgggaggcattttaacgacacagccctcctaaaacccttcaaggtggctttccctctgccacctccctgtggaattcttttccttggttctcctcctgcctcccaggagcatgtgctgtcctaaaacccttcagggtggttttccctctgtgtcacctccccgtggtattcatttccttggttctcctcctgcctcccaggagcatacgctgtcctctattttggatttaggccaaagcttaagccacataacctgttccctgtctatggctgagtcaggcttaaattttctaaagaaaacatatgagataccctgaagggaaggatatatttgtgaaaagccaaaacagatttccaaagtgcagatacctgctcctgtattccttgtaaaaatagcagaagcctctgctgagcccttagaccctgtgctgacccctctctcttggtctacacacactgtgctgtgtggcctgtgctgcctccctcttaccacctccccaaaaagacagagtctggccctcagcttaggctctatcttgccccacccagggtgaaagaacaagcctgttgcagagccacctgaaacttactcacactctgcttttttgtaggaaagacaggagcaacacaaagtatgtttgtatgttgaaaatctgccctacaaaatgttgaagccaggatccagtgctgtgcacctgtggttccagctacttaggaggctgagcaggaggatggtttgagcccaggattttgaggccagcctagacaactagcaagaccctgtctcttaaactaaatctgagaggggttacacctatgttgacgtgtgtttagagacacctgcctttagagccagccatctgcttacagtcattctggtggccattttcatctttca

SEQ ID NO: 17354 - DNA, 26334 bp, Human
agaaccacactgtaatatgacaagtaataacacacacaagcgctaaaggattttttttttttttttttttttgcctcccgatatctgaggggcaggctccgtggagcctccaggctgagaggctgagactggcagagcaggctgggttctggattctgatactcctgggcaggagtgtctcaaagattgagacattatgttcattctttggggctcctgttcttggcactatatctagcacatagtagttgcctcataaatacccattaaataagagcagaactaaacacatctggttagaaattgttcctaggcagcaaggaaccaacacgtggaaaatatggggtttctggagcagtgttaatgcaagccagttcctgtaatgtacatagtgacacctactgccaatgacacgtgctggagcccttccactgttgatttcctatattcacttacccttgtctttaagtggatgttggtggaaacttgaggatacatctttgtgcagcagacagcatttgtaagtaaatctgtgtaggcttagggccacattgataaaaatatatgagagtaaacatatacagaagctgttttaagaacttctgatgtcctagatgctctgatttctggaagctccatcccacatcgtagcaaatatattaaaacactctcatattctctaaatactcttaaataatgtgagtgttaaaacaatagtttcatttgaaattatttgatgttgcggaactcactttctaatgactatgacttcccggcaatcacggcattagggaattcataccaagtgatgtctaagttatagtttcaaaatataatgaaacatttatccatcaatacattacaattatgaaattaacatgttttggggaccttcatttaaacatttattaatctcagatttgcagtatactttttgtattgtgcagtcaataaaattttcagtctcaaacattttcataggtccctgaaaagctcaacgcaaaaaacagcccccatgtgtgattctctactgggcaataaaagccaatcgcgaccctcattttccccccattccagggcttccccaggatagaacgcggaaacgcttctttttccgtttccagggatttctttctttttccagtgtcgttctccctctcccccacttcatttttacaataaatgtcagtgcacacccaggagcgggtggtcccacaggggacatcttaacgcccacccaggagcggctggtcccacagaggacctcttaacgctgacgctttctggagaaaaggatttgtgatgaaaatttccccaaggggaccttctagcgcctagcaccttcgatgctcctgtttcagtcgcggtctcagcgggcagtggcctcctttgaagctgggattctcctgcccctcccgggcagcgcaggccaccggtgacccgggacggtctgtaaacgaccttcgcgtccccgtccccgtggaataacgcgcggcgggcatcactgcccaatatccagcgctcgtgaaggcggagaccggcggggcagctagtttctggttgtggattctgattaatgggccgcaggcgcacggtctgcaccgtccggctcgttgctagtggctcgctcgggagccgccgcactcccggggctgtccgcccgagccggcctggaaggcagaggacgcctccaggtcgctccgcggggcctccggaattcctgggaaagcccccctgcagcgccgcccctggaccccaggtgtgaggagcggggctcggccagcggctccagaagaggcccggaccccactgccgtggctgccgggggcgggaaagtgatttctcggaaagcagagcacttcgaagaaggcgggccgcgcgagccaagctgacgctattggtcggtgtggccgtcgctctgcgcaccgcccgtcccccccacgaccctttttaaggccgcgcgaccgctggcgcatcgcctggagcgcggcagcaagcgtgggaacgcgggcggcgagacggcggcaggacggcggcaggtaggcacagtgggcgggtagggcgcccgtgtcccgcgcggtccggtcccgcggggtccccgacgccaggcggggcgtgggggtggaactacctaccgtaatgtccccgggcgcagctcagtggccacccgtgtccctctctgctttttgcctattttccagccacctaagtccaatctgaatgcccaagtcgttgattgtcgtttgcctgtttccaaagattggtagatagatgcctttttaaaaatctcatttttctttaaatctggtttacatggaaaacgttaggagagctcatataatgaacggcaatagcaaccccctatcttgaaacgcgctctatcatcccactgaaattctaccacgtggaataatgcttggagggtcagagttgtggaactgcccaataaccagtcgttactgagggttagtttgtgaaggaggggacagactgcttctaaaattctgtttaatgacagtcaattaagatttctgagtctggcttgagggcctttgcttccatcacagcccagtcgtccttggcaagagagtctgtatatgggccacagctcacaaaagcattgtttgaaaaaatttattgaaagaacattgtttgtaaaatgagtcccaatacataggacagactttcctaaggtgagatgtgttacttacccagagctgtgaaaggctttacggatggaaactagagactgaattttccagaattttaagaagtctccccaaccaatggccccccactttctttttttaaaccaaaggtaagaactggtagttaaaatgacagttcaaagcttgtccttttgggttacggcagcttcctctatgaaaagatttgggagtgattcagtcacttgaggaaggttggtgccagagagagaaatggctttggtgctttctggtctagtgatgcgggtatgctaggccagagcgagtgccctgggccctccgaggcgggggagagggtggggtctgctgctgccagctcaggtgtgacctgtaatctggattaggtgggcccagggcaacctcttatcacgtccctcctggaaagcctgactgctgtatacatttctagggctgcagatagggcttggccaatagattacctcaaaatcaagaagaggaagttataaacatgtgattagacttattaatttttcctggctgggcatttggtggaattcgtttgttaatgtttaataaatcattatggatcataactgtagtagaatctcaggcttttgatgttacttagaatcttggaggagaccacgaaggacacacagacgtggctgcacatgtgcagagatcttgtaatgtaactatggcttttctctgcaccatgtgtgaaataagctgccgctggcgttggggcgccggcctgggttccaacacagtccgctggctgcctcggtatttgccgtgcctctctgggcctcagtttttcctctcttaaataaagaggggactggattagatgatttctaaagtattttccagctttcagatgctatgacttactcttctctttttccttttaaaatttctttttcctgtaaatcaccaagatagttgtcctgaacagtttagatgttatgaatccattaggaatcctgataagaaagtgttgaccctctttctagaaaaatgcgtgtactaacaaaatttttgcttttggttgcaggaggctcaggaactgtggattctagtttaagaaacttgtagcaaggaaatcaggggagttgaaagtctcagaagccaacccctatgttgtgttctggccacctctgtgcagctcattcctcaatctaggagaaatttttctaccttgccccaggaaagagctgctaacttgttttcggggagtgtgggggggtctttggtattggtgttccatttctcttctcaggtaccctctcccaagtctgtcccttctttatgataaacacagtggcctgctttagaattctgggtctcttgagatacagcctctcaacttacaggtgaggaagcctcagggagaggttcaagtgacgtcacaaggtctggttagagaaaagcctttgccagagttcagagttttcaaaccaaggtctaatttgggtgggcgcagtggctcacacctgtaatcacagcactttaggaggctgatgtgggaggatcacttgaggccgagagttcaagaccagactgggcaacatagcgagatcctgtctctaaaatgtatatctgggtgtggtggcatatgtctgtagttccaggtactcaaggggctgaggcaggaagatcgcttaagcccaggagttccaggctgccgcgagctatgatggcaccactgcactcctgcctgggtgacagagcaagaccctgtctctaaagaaaaaaaaattgaactcatccccttttaaatccataaacgcacaactgaggttgttggatggggaatttaagaaatcccacctcctcctccctgggacctggccctgtttcccgtctcatggccacctgcagggtggctgaagtttccagaatgcgtacttcttgtgaaggttctgattgatattttgctttctggaccagtgtggctctaccatattttgggatgttatgtcttgttactgctgattgtttcaaactcgtttgcccaaagaggtcacattttaatcagaagaacaaaaatgctatttttttttttttttgggtgggcgtctatccagctgtcttggggatttccagcactgttcttggaaatgttggctctaagtcgataggtcatgctagttctctctctctttctctgtgctgttggggaagctgtctgcttgggtgagagtgttcttccaaaggatgtctttgggtgccctgggatggttaggtccctagagtgggacatgttctggaagaggagcccagtgaactttgccctgttcggtagctgcagtttatttcctcactcttgtccctatctttcagttggtcgtaggagttgcccaggaaggaagtttggataataataatgacatctggcatgtaaggtccaggccctgtctcagttgctttccgtgtagcatctgaattctcttacaaccagtacaggtagtgttttgttagctgcatctgggactgggtagctgatgccctgagtttaaatgctgatccagcgtctcccagctgagcggtggcgggacttgaatgagatcgcggttctgtctcattctcaaactgctgctcttatcactgtgaaggaacagctatttagatgggctggcctgagggcctcctctttcccagacggcacggacgcagtattctatcagggaatgtggggccagctgggcatctggtagcccagttggttcttcggataatgggctgctcagtgaaggaacctggtgctgtaaaagtgattccccctctccttccagtcttgggctaaaactggagctgttcactgtggttgtatctgcctgaaaggaaagggcagatgaaagctggaaggagcacagccagcacagtgggaggggcctgcagggggctgctggtggctgcaggtggctgcaggtttcccacggagctttcagtttgcactcagggctgtgaggtcatggaggccagcattgccttctcatggcaggtgtcccggagtccctgaatctgtgggtttcccccaagccagcacctttgctgcaaacctctgagtttcctgttagcagtttttgggttgctgtgatgaatgagacaatatccgtaatatcacagcgtgtatttctgtctttccaaggatgtgtgaccggaatggtggtcggcggcttcgacagtggctgatcgagcagattgacagtagcatgtatccaggactgatttgggagaatgaggagaagagcatgttccggatcccttggaaacacgctggcaagcaagattataatcaggaagtggatgcctccatttttaaggtaaagagcccagctcccttccccactgtgggcacagtgtctcctttccctcatggactagtggagatgttgagtgacatctttctcatttacttaaaaattaatccagttttttaaaagcaaacattggttcaggagtgctgaatgtgtctcagacatgtacatgagctgatttcacatctcttgaattacggagtcacttttgtggtcgcttgtattctgatgaggagatcgaaggctcttttcttctcttttctgctgcttccttttcctgatgagccaagtgggagaaaatacttcgagaccttcacgctaagacctttccccacgggcttccattagaggcgatgcatataccagggaaggtttcagtccttgttctttcaaagctgatacttctgcctggcattgtagggccagctcaggagggtgagatgccatctgtcattcctttgggggctgggccgtgtggggggttgtgaacctgcagcagatgtctaaaaatagtctcacctcccttgagagtaatcggttccccatgcgtggagagacgtgatggagggtttgttctgtgccaggcctggcccacggcttgttttctgctcacatgatcctgtgtggtagatgctgttcccaccctcattctatagaggcactgagaggagaagtgacttgttgaggtctcacagctcttgtatgacggagccagcattcagatgcaagatggcccaactgtgaacccttggtcctaactccagaatagctgatcaacagagatttcttgccattacacctagattcagacagaggaaccaggaattagggcagcccagctctgcagaccagctgggctatcgaatcccttgtgggtcatcagagtcctgtgtgggcatctctaaggctccagatgtccaggtttcacctctgggagattcggagcccaaggtcaaggtcaagctagacttccacgtttgccagtgtggacactacacgtagtctgagtcctagcccaggttataagccattgccatgtgtgcttattctcttgcatttgggggccagagatggggaggggagagtgagtgtgggagaggggtgaaaggggctgagttgttgggggccagaatcagacctgagaccacaaacaaggtgtggagggggtcaaggctgtaggagcccatgacagtgctggactcccagccacagatgactgtcccctgacaccagagaacaaaaatgacaaaagatcacaccttaaccccagagtggaccataaataggtcaaaggtagcttaagatgcattttggtcctgcacgtctctgcctgaccgatgtttgcagtggggctgtgcgtttcagtaattctgttaaatctgcaatttgaggttgctgatcttcttgagaatctgatgcccattactgaccacgccaaggaatatggggacaagggaacgctttgcactcactttcgaggggtcccttggtgcccccacacgttccagattctttctgatcaaggaccccaggtcagggagcctcagcaccaagaagttttgtgatgccactgcctgcctcctcacccttagtgccattgtggatttctctcttgtttgattgcagatcttttttttttttttttttttttttttttgcctttggcatcatggtgaacttctcttgggaaggactgcaaatgtaaacagtgccagagtcccattcagtcggttgggaactctgcattatagataaccccaaaagccggaatttctctgcctcgccactgttgatgtctgggtctgggcaattctttgttgtaagggttccctatgccttgtgggatgtttagtggcatctctgacctctacccaccagatgccagtagcatcccctcccctactgtcacaatcaaaaatgtcttggacattgccaaatatctcctggtggggcagagtcttcccctccccattaagaaccctgataagagctggccactgccaggatcaacagacttaaccagaggtgttgggtgctgaaggcacagttgcaggttggacatcagtaaaacatctttaagacatggcagagggtgctggactaggctgtgtagccctgacatgtggcatgctgacggagacgaagcttctcccttcaccccattccctacttcaacttgtgctcggggggtaatgaaataaagccccagatttatacatcttatgcaatgttcttcatggccgtttcaacagtgttgagaaaaatgtgcaagattcccaatgtttccgttggttacgcagtcgcctgatgtggcaatctgaaatgagtctaccatctcagcaggaatggggccaggagggagacgcgggtgcccactggagcagggaggccatcgggagggccaccagtgccggtggagacatggcgccagcaagagcccatcatgtgcttccctgagctatgcttcttcccatccatcctctgagaggcctgtctctgtgacgttggccggatagatctttggctgttggatgaagtcaacctcggtcaggtagagccatcttagggattttccggttatgtagacacttgtttctttcaactgttcaaagaaaacctttcaacaatttaggagttaagaaagaaatttatgagtttggtttcttccgtaataagtggatggtaaaaggggccacttataccagaaaatccctcattgtctgcaggcatcatcctgaggccggcctcatggtatagatcacagaagagaaattgaaaaaacattgagctcattttgtaccgaccctgagtacactgatgaggccctgatagcaactcatttaatttttaaaaagtactttaccttcttgacatgacgacaaggggggaaaatctagttaagtgaggattatgattcatggttattccaggcatcgtaacagtcctgaatgagttaaagctcacttagtagcacagatatttctcattcagcaggccttgaagggaaaaatagcatttaattaaaaaaatgcaacatgaaacaatcatattaaattaggaagacctcctggtcttagttcagtgctgtcagcctgagttgtgcgtcaacaggagaaataagttatggtggaggctgaatgagccatagtgactgttgctggcggcaggggtgggggggccctgaaatcactctcatgtctagtttttgctctagctcaagaaggatctcgagagatcatcaagctaagttgaccttttaatgctggccagagaggctgggagagggccaggtgcctgctgtgtcacagagttcagggcaggcggcaagccaggtacccgatggtggccctggatgcttcctggccgtgggccctgctgtgatggatgatgtggcctggacttgctcgtggggtgagtgtgagcttggcgtgaacgagtgagtatggcagtgccttgcaggcaccgcggttgcgtatgtgtaccagcggatcacaacgttgccatgaaatctgtgcatttcaaggcccgtttgggatgtgggttaactcagtggttctcaggtgggggaggtatcatgatttaccctccagggaatacttggccatgtttggagaccttttttggttgtcacagctaggggaggggtgctattggcatctggtgggtcaaggctagggatgccgctgaatattctacaatccacaggaccaccccgccacaaagaagggtcccagctgatatgtcaggcttgccacggtggggaaaccctgatttaaagtaataaaaatttgaaactacagttgatttagtacatggtttgctggtttatttctttaaaaataaacaacagcaacaaaacccaaattaatgcccggtcagtgatgcagtcaatgaagagagcattaaagaccgtgtgctttaagaaatagttttagaggggagttttacatcaatgtcacatgaggaaactaccacttatgctcactaatgggaatgttcttccagtctctttaccccaggtagaggtgcaacattttgcatcaacaaagtaggcagcattggccttgaacagtaagcattcttgtcttttttgagaggaaaaacagtctgggctattttaaaggagctgtgactcatgggggcatgatggagtttctggaagtgtggtctcctgggtagctaaatccaaatccctggaatactggctaaagacagctacctgggccgggcgcggtggctcacgcctgtaagcccagcactttgggaggccgaggcaggcggatcacgaggtcaagagatcaagaccatcctggccaacatggtgaaacctcgtctgtactaaaaatacaaaaattagctgggtatggtggtgcacacctgtagtcccagctacttgggaggctgaggtaggaggattcgcttgaacctggtaggtggaggttgcagtgagccagattgcgccactgcattccagactggtgacagagtgagactccgtctcaaaaaaataaaaaaactaaaataaataaaaataaaaaataaaaaaagacagctaccgagacccaacctcccttccccagtgagaatcttgaggggcaaggcccaggaatctgcattttcacaagcttcccaggggcagggggttggtatatgcattaagcctgagaacacttgctgtggtggggaaactgttgggttggaagtgggtacagctggcatttaatcccagactgggtggccttgggaaagttacttacctcttggaattgcattttcctgaagtgggtacagctggcatttaatcccagactgggtggccttgggaaagttacttacctcttggaattgcattttcctgaagtgggtacagctggcatttaatcccagactgggtgaccttgcgaaagttacttacctcttggaattgcattttcctgaatgggatcgggatgtccctacagatctcctatcattttaggctggaggacactgtctgatttttcctgaaaccgaagataattctcatctgactgtggttacctcctagttggtgtgtctgtattccaattttgcaagcttaaaatctgtccattcacctgtcttatttttttaaaatctgtactgccccattctacattatgactttaagatttcagctttgaatttctggtcctagttcagatcctaaggtttggaaaagtcagaaaacagatctattaaaaaaaacacacacacattaaagggaaagtacttcattacattttaaacagcacctggggggaaaagtctagaataaatgcaaaaatgcaaaacaaaatttctattaaaagtaacagggcgatggatgaccattttgactttttgcaaatgttcccttttcatgctaaattttaggggttgatctgaaaaagcaacaacttgttctttgttttgaacgctctggtgaaaccatatgcaacttcctctttgtgctgtgtaaacctcaggtgtctccagctcttcagccaggcaagggcttggctaaaaggtgcactccagggttggaggagccttcagcctgggttcgacttctgactcagctgtatgaacctgggggaccccctccctggcttgggtctttccacatctggtccccagatgtgaaaagactcaagacatctgattggagtctctttgggtcctgaaattgaatgagagttgatggccaacaaagattcatgggaagggaaggatgtgtggggtcctggtcatggtgacggatatttgtgattggagtcggccatgaatttaatgtgcttctgtttctttcttcaggcctgggcagtttttaaagggaagtttaaagaaggggacaaagctgaaccagccacttggaagacgaggttacgctgtgctttgaataagagcccagattttgaggaagtgacggaccggtcccaactggacatttccgagccatacaaagtttaccgaattgttcctgaggaagagcaaaaatgtaactatcctttatgggcatgaaaccttccagaagctgccctggcctgtagccttcaccacagaacttgggtctggggtagacacagggtctggggcacatagtttcagttaaacaaagcagttctctccttcgtgtaagcagaaattgagatctctttccagtgacctcagagggaagggcggaggagattgggtgctgcccaacctgtgccccacttgctgcctgaccacagacatttgtagggcctccctggacaggaacaagcatcctccagcagtttctgatgaggaatcctttcattttccagcagcttgcagaggaggccaggggaaaatatggtgaccacagaaggcctggatcatgagggttgggagtaaagctctcagatgaagttgtcaaagatggcaccatggccttcgttgttggagatgggatatgcctcagtgtgttactagatcctgattgttatttgggaactccgggatgtgatcattcctgaggtttcttccagctctcaaatcccaagaaagcatttgtgacagattaaagcaggacagcaaaaacatgccgcaccctggtcctacatcactaaaataaatcccaaagtactgagctgggatctggcctcagaaggcttctcaaagccctgtgctgtgccgctgccatgaattgtagctgatttatgagataaaacctaattaccagcgctggtttagaacatgcttttaacacattgattttcttagccacttgatgaggcttttagaataacccactctggctttctccttctaagcttctgagtagtccacgaatgcctgtaagaaacagaaacccccaaaacttcttggggctgtgcagaagtttgaagtttgcactcttcccgctgtgggggtgttgacttagaattttttaagaagttaaaatggtgattcaaacaaatctatagtgaatctgtgtcagagagttgtgtaatcgtcatgaaggaggcagcatgatggtaaagatggtggacagagaatccgaggtgctggtgaatgtggcccatgaacgagaaagctgagccaaagccgatgcccgacccggacagtacaattgcggtttggggcgtttgtagcctaatcgtctgcaattagcacctaactctactgagcgtgaaccctagtcaatactaaatagtaaggccaacaaactgaccttcccttggagaatcgggtgccctttaggaggaaacctctatataatagtctggggtgaccctgaaaggctaagcagtcatctttttgcctcatttcccagttttggacaattttttttatcaccaaaaagtaaagtgtgatttgaaggaatagagaagtttcttttggcccctactgccacccccaagatcagtcaggcttgaaccggcaggtgaccccaacttgtttatagcatggggtgcagccagcatcacctgctagtgatgttaaagaagcagcaggaggttctcaggggtgaagcaatgtagcatttgcataattgcctacaggggcccactcgcctctaacctcagtggtttgcaggctccatggtgggcgccccacctgctccctacttccccatcagtagcttctcagtgaattctttaatctatcgaaatggaatcaaaattcagccgggaggaaacagtgggtaaattctgtaggtcactgggaataatgaatttttgtaagtgttggttgtgatacgtctcacactgataaacttcataaggtaagttgtcgactgaggaagcggcatgagaagggaaagagcagaggctggcccagcgtgcccctgtggacactgtgcacctttaggcggtttgtgattacggctggtgcccactgggcatcagtgagggtgctgcggtgtgtgtgtgtgcatggctgtgtgcactgatgcacatgtgtatatttggaaaggccaaaaagagatttcctgccaactggcaatacaaaaaagaccccaacctgccaacacgttttgccaggaaatcggtgagtgttttcaaatgccctggcttataaatgtaaccttcttaagttagcaaatgcttgctgtaaagtatatctgatacagactcattttggatctcagaaaatagaagaaagagaccaaagtgctgtctttatcctttaaaagtgttagcagaaacaaccaccaccaccaccaccaccaacttctctcttttgactttgctgatcagatgactgaagcatgggaaaaaaattctgtgcctttcccaaaccaatgaagacactcactaacttaacgtttccttaaactcagcatttacagagtagattatggcttcagcaaaggctgtgatgcctccgtgccatgtgtcatggtgtttgtctggttttctgtaggcaaactaggcgtggcaactgctggctgcgtgaatgaagttacagagatggagtgcggtcgctctgaaatcgacgagctgatcaaggaggtaagcagaggcagcatttcaggggtctggccctgccaggaggagtctcatgtcttctggcagggaggggcaccgttcttgctgtatgaaggcagccagaccctcgggctcgctgaggaagtggcatctccacctgtacagatctggaacggaaggactggctgggcgccccctccccaggccagcttctgccgacaggtcaacccctcacgccagatccctccttcatccctagggctgggcctgagctgccggttatgtgtcagtgaagttccttccagctccaaactgttcgaacactttggacagcagtcttttaaatggcatcgtgaattcccttgccttcctagcaggctacagagaacaaaatgtaaactttccttgctgcctgcgcttgtcatgatggcgggtgttgttgtaccagctctcatggctatttgattgcttcctttttaatgtgcagtttttattccttaacggattggaaagctggataaccaagcatgttcacattgcacataaattcctaacaggctacaagggagagcataatcggggcctccttaggcaagaatacatggcttttgtatacccatttcagctattgggatgcccttttcttctgtctttggcctcttaactatgcttttcatgggtattacaaggtggacatttgcatgactaaacctcgtgcagcctttgcaaaaggttgtgtgtgagtactgcataaattcttcttcttaataacatagcaataatggaatccttaagagtagcttggctgtcagagaatgaagataacagaatgtaacctacccgaacggccttgctcttctgcacaggcagctgccaagtgtctgggtggtctttggcagccgactgagtgaattcttggcttcgtggccctccaccaatgtcctgttttctgtagaaggcttttctgctgactcagctgagagagtgagataatcggattgccacaccggggtcacaagaaaagcaatttcaaaacatttcataattggatttatcagcctcctttaaggaatgggccagagactgaacatctgcatgtggctcgttgagcgagattcttgaaagcatggcagcctttggccagcatcactgttcactggtgtctcagagcttgtctgcgtgtccagggcgttgagggcaattggataacctggaacactgggtctgcaacaggcaggtcctggaaagggccaggaaacttattagtggcccccaaagagcctagtaatttggccacatggtttgaatgctaagcctggtagatttaaggcctagggcctttcaggttgcaaagtgaaacttgacttttgtctcctgagataaaggtgacaatatggttttacttacacatgaactgttcatttttacaaacactggagccccaggtgggagatcagtgactgagctgccctcctctccctcccctgactgtgcagccttctgtggacgattacatggggatgatcaaaaggagcccttccccgccggaggcctgtcggagtcagctccttccagactggtgggcgcagcagcccagcacaggtgagggtgggtggcctagaattgtcaccaggcatggcctgaagggtttacggcattccaccagccagggacggagtgggggtggttgttgctatcatgatccatgtctcattaaaggtagctcagccctgagaggtgaagaacgatggccctggtttcccaacatgagggcagagcccagctgtgcctttggccctgctctccgctgcttctcaggagggcacaagctgcttgttccctaggtgatgtccatgccagctctccccacgctcctgggaaagtccagggaagagggtctagtgaacttgtgtaaggccagagggaagatgcagctcttggccacgctggcgccccctccctgggtactcccttaggtcggccagtctgttacgacattaaggaccccctcagaaccaaagagagcccagggcatttggaggagaggagaactcagaccaggaacaggaagtttgttcagagccctagatttgaatcccacgctgggaagttacagatcttgagcctcagtttattcatccgtaaaacagagaaaccaggacttgcgccatggggtcacgagggttaagtgaggcattcatcctttgattctcttttgatgagccactcagaacccccagctgcttgaaatgcccccgcccccgccaggcccaggcttctgcagcccgtgaatgtgtttgcttcctccctcggcgtcttccccctagccctacatcccctgtgggagtctgggaggtggcagctggccccggaggccttgaaggttgccaggccttgggtgtcgagtaagaggtccctggaaaggcacctctgtctgtgctgcaggaacaccatccggaaagctagcttgcacccccaggctctcccccagagataagccctgggtggtgggtatgcagtccagtggtattctgggggcaagtgcttgaggtgggaaggaaatgtggccccacagtgtcacattgacacatggtcagaaatcccacagcatagaggaagtccccccgacttgccactctggttttctgcatttgtgaaacaatggctctctgctctggtggggaaaagcactgaattcagcggaagcctgtgctccctggagcctctggcacgccatgtgcagccttttaagggacttttggagaaggagcgattggggttactccctgtacaccacacctgggtggctctgagcttgcttttctgtttctcctgcaggcgtgccgctggtgacggggtacaccacctacgacgcgcaccattcaggtacggggtggtccgggctgagaggggcgtgggcactgtttgaagacaaagcccagataacccaagcagggttgcggggtttcgaggatgagcaggacctggtgtggaagtctaggcctggttccaaggatgagcaggacctggtgtggaagtctaggctccgttccgaggatgagcaggacctggtgtggaagtctaggcctggttctgaggatgagcaggacctggtgtggaagtcgaggctccgttccgaggatgagcaggacctcgtgtggaagtctaggcccggttctgaggatgagcaggacctggtgtggaagtcgaggccccaatttctcctcctcaccatttggtcaggagctggcgagtggcctcttttgaggccacttttcttggactggaccagcaagtagacagagtactctttgaggctgtaactgtgcaggagagacagtgagggacaggccagcgtctgtcccagcgctgcctctcttttggggctgcaggtggagtgatggagcctctcagagcctcatctcaggctcccctgcccaccacctctaggtggatgcagctgttcccatttcgcgggctcaggtggtcacgtacttgtgtgctccagactgggggcctccccgcggtgggcagaggtggcctttgtgtgtagtctcagcggctaaggaccctggctgcacttctgccagctgcccctggaagtgacgctcaggcgtggtgacggcatcttctgaacaaggaagctggggcatcttccagcattggctggttctgtgggaggcgagcagctggtctcatcagatgggccacagaacgttagggctgggcctctgggcaggggaggaaatggggcagggatagaagcgtgctggctgaggactgcatgggacagttttgtgggtagcagaggtcggtgctcacccaggcaggaaaactgtcgagatggcaatgccctgtccatgaagctcttgtctatttcctggcagccctttgagctggggggttgttttcactccggcttcacagatgaggagactgaggctgggaggttcaggatctcatccaggtcgcgcaggcctctggctggagcctgttcttgaggcctccttgtgcccggcagccgccatgctcacagggtctcagttctgggaggcctgggtcatgaggctaagcctccgggctcgccagccactgggctatggcctgggagtctgctgaccagtgctttccgggggctgtggagtagccaggcacagaactgagccatctcggtgagatgcagaggcacaatttggggagagcatgtccttgaattagtccagcagggtcatagccactgcctcatgcacagaacatccttctagaagctgtgagctttggtacctctgtccagccccgcccccacctctatgtaaatccatgcttcagtttccttacctggaaaatgggtataataataatctaccttacagggttaaatgtgctggtaggtcccaagccctgggcacagcacctgatatgagctgtgtagaccatagtctgtggtttataacttcaggagtcttgtctgtgtagataagcatttgtcctgttacccagtttctttaactggtgcttacctgtgccgagcacaaatacaagctccgataatcctcacagcagcccagtgaggtggatgctgtttttatctctactttgctgatgaaaagctgaggcacagagtggggaagcggcttgccccaggtcatccagctgggcagcagctgggctgggaccgcacgtcaggcaggtgggctgcagggtctgtgctgcgggtgtctttgttgctgcctctgtggtcaggccgttccccagcaaggctgttcttgtgggtgagtggctctataagggcagggctgggtcgcagcaggcccttactgttgcagaaggctcacctgcctcaccttggcagcccttggtgagctgcttctcacctgtcaggtacaagcctgacagctggaaccttctcttagcataagacgttctggggtgtgtggtcactaagacactcctgcttaggcgtctctgaagcacttagctgttccgggtgaagctgccagttcacatgactgagaggtgctggtaccaagataaggccccggaaatgacagggcaaagggccaaaggggtgacggagttgcctgaagcgtttcattcatttggaacaaagttcgaaagttgcttcagggtaaagggaggggagtgtgtggagtccgcaggcagtgcagaagttgcagacttggcgtggggggaagatgatgagtgaggaagagcgagaccagcggggaagatggtgagcagggaagagcgagaccagtgctgccatttccttctgggtgaccctatctaggattcagtttcctgaagtgtcaaatcaatgaggtggaccagagcttctgcagctctagcttcctaccctgcatgattctagaacctgcgtaactccagcatggctggaaatggagcccgtgaatggtgggttgtcaaataataaggcagggagcagagcccaatgggagggtccaaggagttctgagtgcccagcagtgtcagcagggaatgcagatggactcagggcctccccagatgtggtcagccttgcacaactctagggggcgccgtggagttaggcacctcacaacttgtgtggctccacaaggcagcctcgaaccggtctggggtacttagaaggagctgcaaactcactaagctcattgctagcgtatgtaattcttttggtttaaggcaattaaaatgcagatacctccctgcatttacatgttatctgcattcctaccttagattagtgttttccaaactttggtcacttgaggtccagtgtcacaattggttttcacagcctggactgttactaacatcatgtttttcctcaaatcttaatcttaaaataaaacttaagtttattttaaatgagaacccactatcattggctgtaaaggaagacctgtggcacctggtataagtaggtaatactgtctggctagaattgattaagattgtatttgtctttcattgaatttgtcttgacctctgacaatgccctgaatttggagccctaagttcagtgccattattcaaaagggaggttgacaggtgttaggtgttagagagctatcagcaccaaactgaggcttgctttttgaggtaatcagaggttggaagaatattgaagatggaataatcttgtgattacatgtatcacccctcccccattattctgtgtgtgccacttttggggaacccctgctttagtttgagtgtttttcagactctttcctgagaacagatttggatgaagggttttgcagagattcttaatctgaaatccaggaaataccaagggcgctgtgaatttgttgagaaaaagattatgtctttattttctttaacttcaggtttaaattgagcatttccttttgttatgaatgtaggcagcagaccgcagtgcccttggcagtgcctatgagacggagtattgtcataagaaatgagttgtcgaaacatcgtttgccctcagcttgacgtgtaaattacaacagttaccagaccttctctagaccttgtatttaaagagtcagtgaagaagtacagagaacactgttgtagttaatatgttcagtcattggtttccttagtcattctgtgtatttattcatgcatataaaaacattacttctacaagcagtacatggatttccccagaatatcaaagtggttcaagacacacaaagagttacccgtgtaggtgtgagacagactgtgcacttgggcaggagggaccctgtatgtctccccgcagcaccgtcatcgtgtccctcttgtccacagcattctcccagatggtgatcagcttctactatgggggcaagctggtgggccaggccaccaccacctgccccgagggctgccgcctgtccctgagccagcctgggctgcccggcaccaagctgtatgggcccgagggcctggagctggtgcgcttcccgccggccgacgccatccccagcgagcgacagaggcaggtgacgcggaagctgttcgggcacctggagcgcggggtgctgctgcacagcagccggcagggcgtgttcgtcaagcggctgtgccagggccgcgtgttctgcagcggcaacgccgtggtgtgcaaaggcaggcccaacaagctggagcgtgatgaggtggtccaggtcttcgacaccagccagttcttccgaggtctgtaccgtcgtcaccttgctgcccccacatcttagagatcacgcctcctatctgtgtgccatttgcagctcagggtggccctgtggtctcatggagggatgtggaggaggagtgaggggcatggtgtggcaaggaggtgctcctttgaatggcactctgccctctccactgagcgatcctggggtgcttctctgtgcctcaacttccccatgtgtacagtgggggtgcagaatcagtaccctcatcaggtgattgtcgggagggtaaaggaacttaacctcatgtaccttggagtatgttccaaggatggtccctgagcgctggctagagacacagagtctgaggccctgctccagccacaagatccgaacctgcatcttagcaaggtccctggggatctgtgtacaggttttgagacacgctgactttccgcacactaagtgctcaggatggcagctgcacacactaagtgctgcctgttagctttcgttacgctgtagggaggatgtgtaggataccagcctgggtgtctcctggagggttaggatggcgtctcccttctccacgtccccatgctctctgctcctctccctgtagcagcacagcccgagatagtgtcaggtctcagctgccactggcctgagaactgccagaggaggggcctggaagggcgggtgcaggggtatgtgtgagctcaggggcataagccctgaggaatccccctagtgaggaggtgtgaggccgcggttatcacccctgagcaggcagagcggcacagaagtgcgtcctgcaatgtacattcccgggcctacctcacatcctctgattccatgggtctgaggcggggcccaagattctacatttctaatgagctcccagggaaggcgactgctgccggtccaccggcccactttgagaccctttcagttggctgtcagagattcgggtgagggctgcagccctccctgggtgtcctcaggtcggggttgccaactcagttgcctccaagggccaggcaggtaagagcaatgcacgaattgagagataagagagagcactgggcagctgtgcccatggagaggcgttcaaacgaggcattaaaatcccggcaacaacctggaatggccaaacgaacagctccttgcttggaatttggcccaagggccaccagtttgagatcccatggtgccctggcctaaatgctacaagccctgggcctcctgatcccccagccctgctgctgcgggagttggaggtcatctcggccttgcttgcaaacaccctctgcctgtgtcattccagagctgcagcagttctataacagccagggccggcttcctgacggcagggtggtgctgtgctttggggaagagtttccggatatggcccccttgcgctccaaactcattctcgtgcaggtaagtatgggcagcttttttttttttttttttttttttgagatggagtcttgctctgttgcccaggctggtgtgcaatggcgtgaccttggctcactgcaacctccgcctcccgggttcaagtgattctcctgcctcagcctcccgagttgctgggactacaggcccgtgccaccacgctcagctaattttttgtatttttagtagagatggggtttcaccatgttggccaggatggtcttgatcttgtgatcctcccagcttggcctcccaaagtactgggattacaggcgtgagccacctcgcccggcagtctgggcagctttgagccctgcatccaggtctcctggccctgtcatgtaaggatcaagttttgggctggagaagaggacacaaggacaagtttccacctgtgtaggaggcaggcctgggcaagaccttcaatatgcgggaagcggattcttgccatctccgagccatcttctggtgtctgggacgcgcacagtctgtgtgtgtgtgttttcttttttcttttttggtttttaaatctaagcctcttctccagaaagattctacctgttcagttgcccgaaggtctaagtgacagattagggcattgccagcccttatttcatgtagtcaagggaatgaatctctaatggtgggatcctgggtgctggctgtcccagctgggacagtactggggagtatggaacagttttggcaggagtactgcttgcccttccttggcattctggctcattcacttgggactcacgtggcactggggtcatcagaggacctggctagggtcaaagacagtgcccaccccctttggagcctccgcctctgcctctgactttctgcacctcccatctagattgagcagctgtatgtccggcaactggcagaagaggctgggaagagctgtggagccggctctgtgatgcaggcccccgaggagccgccgccagaccaggtcttccggatgtttccagatatttgtgcctcacaccagagatcatttttcagagaaaaccaacagatcaccgtctaagtgcgtcgcttgggcgccccaccccgtctgcgtcctgcatccatctccctgttacagtggcccgcatcatgattaaagaatgtggatccctctgtctggggtgggatgccttactttgcacttaatttaataagggcattctcggaggagtagacgtttaatacgaagtggcggcatagccctgccgagatgtcggtgatggcctggatgctgtaaccacaacctgtggctaaaaattttattttctatcctttacccgtcattatcattagttgctatgattctttctgcattttcggttaactatcatttccaaagacttgtcattcagtaatattagcagatagctgcttcgataaaggaatttggagtttaaaaatcaacttgtgaaaacaaggttgtttttgtctttatcttttgttagagttatagatttatgatttcataggcttgattctatgtgaaatatctttttacttttatgcattttaataagatttaaaaatatttagattaaagccccctttaatgagtacaagaaaaactcttggcttgttagaagaaagtatattctttctagaatttggtgcaggaatatgtgttcatatccaggcaaacgggtgtgtttttatcttcagacaatgaaaccttctcctctggggctttgttgccaggaagattagaactaaatttatttttttcatttctgtcatgaaatcattccagatacctcttttcttctttccaaatggttttcacatgtgtttgaaatatttgtactttgaattgtcggattttccatgtcctcctttctcctttgtgcccagcctgagtcagcaccatcccgcattcagaacctcccagtgaaagggcagccttcattttgagaaggtggaaggtgttagggtttgggagacagctcatccaatctcccaagtctcatggtggatttgtgactgtgagagtttccggtttaaaatctgaaaagccagatatgcctgtttccttttcccagcaccatgcctgtggaggggacagtcagacccagaggtcctttacgtgtggatggagttcacaggcgaatagaggagaggaccaggggacgtggcttgtcccttttgtccaacaaagcattatatttttaagaatggcagacctgtttgctgaagtgttcataagataacaataggcttgaatctccaattcaaatgaatgtcaaagcacatatctttaatatgctgaatgaatatttatttttgtatccattaaaacagtatattgatctcttttattctttattaaaataaaatgctcttttttaaagctgctgtgtactgtatttttttagtcactgtcaaatatgatgtaattctcaccagattctaggttctgtaaagggggagttactgctgcaatgtgcagtgttaattcagtgcactggactgaaacaatatcgcactgggattttaaggatttttttttttttttgagacaaagtcttgctctgtcacccaggctgaagggcagtagtacgatctcggctccctgcaacttccacctcccaggttcaagcgattctcgtgcttcagcctcccaagtagctgggattacaggcatacgctaccacatctgcctaattttttttttaaaattagagttgtgatttcaccatgttgcccaggctggtatcgaacttttggcctcatgtgctctgccccaacctctcccccagcctcccaaagtgctgggtttacaggtgtgagccacctcacccaactcctgttttaaggatttttctttttcaacctatcccttaaacaacagcaaaaagatacggagacttagactgatcctatggaatgaaaacattggagaatgtttttattccgaatggggggctgtttgggtttctgtgagctgacagatgagtgtgcggaagggtgtggaggaagtggggtcttgtgctgatttcatcctcctggatgcagctggggtgatttgtacgaggcgtccctggttgggtcagccacacgtggctggagtgtgtgtcctatttacgcacatctcgctgtgctaggccctcaggatacagcaaggacatgagggacccaggttggcagtcacagagatgacttccagcctagtaggacattcccatccatcaacacaacaaaacccatcaattctgggaggtgcagggctggccaaccc

SEQ ID NO: 17355 - DNA, 11406 bp, Human
ggcactcaaagatgtgcccaggaaccttacgccaggactctttgcccagagatacttcttgcttgcccagaactgacttgggtgtcataattagttaagttataaatggtagattatgaaatggcttcgttttacttggtggaggagggacacagataaagaaattctacttacaccttctcaagcttagctacttcttacatcaattagctactattttttagcatcacagtttattcttaaatgaaaaacaaacagcacctcagctcaggtatgcaggtctgaagctacagtttacttttccttcaggttttaacaactcgatggaatttatagatggtctttttcccttcattgatcaccggaactgaaaagctactgcctaaaattcacttaccaactagtctacctgcatgctacatcttttttcccactgtacttcaataaagctgtcattgcaaacaaaaacataaaagcgtgttggacagatcgtctgctcctgctgtttaatgtcacagaaattcgtttttttttttttttttttttttttgagacggagtcttgctctgtcacccaggctggagtgcagtggcgtgatctcggctcactgcaacctctgcctcctgggttcaagcgattctcttgcctcagcctcccgagtggctgggatgacaggcgcccgccaccacgcccggctaagttttgtatttttagtagagaaggggtttcaccatgttggtcaggctggtctcaaacttctgacctcaggtgatccgcctgcctcggcctcccaaagtgctaggattacaggggtcagccaccgcgcccggccccacagaaattctttagcttttaaaagccatggaaacattctagataagttgttaaccattaacgggaacaaattctctttacacaaagctcaggcacattcaatcaaggggagccaggcctaagatgcatcacacagatctgaccatgcaactacctttctacaagtgtctgagctccggggtgcccgagtaccgacagccaaagaagcatttacactttgccagataaggaatcggctctgcgaaggtgcgaagaaccaaatcctagcgattaatgtcccaacaacgtgaacacttcctgcaactcgaaatcctcaagggaaactctgtcgaatccccaccaagtgaacgatgacttgtttctacaaaggctactgatttcaggaaactaacgtataactcgtcgccttaaagtgcctctaaaagcatccacgacggttaaagtcgctgctactacgggacgctatttattcagcgccaagacccaagcgccatcgtggatcaccccattcctggccacggcaaccctagggagcgggtcctaggagcctgctggagggcgaccgctgggccagcttcctctctgctgactgaggggaggccaggctgcctgcaaggggaaggggccctttccgcgcttaccagggtgagagccacctccagcatgggggcgagggccagggtgccgtggaagagggggatgcagtccacgaagagggtgtggtgggcgccggggccgcccagggggaggtgctccttacgcggcttctgcttctcggccaccaggagcccgttgacggcgcagtgcgggtacttggcgccgtgcagcaccatcttgcagtaggcctgggtggtcagtttcaccccgggcatgctgacccgggagggccccggaggcccctgggcgcgcggctgaggcctggacccgctgcctggccgcgcggcgcctcagccgagaagcgggacgaggcggcggcgattgatggcgcggccgcgggctggcgggggacccttcaggcccggccccgtttgggcctcggctcctggaaaagcgactcgcgcctctgggaagccgcagccccagactccagtcgcgcttctcgcccggcgccgccggaaagcagcctctccaacgcctgccggaaagcagcccggcccggcattttacgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcaggtgagacaggaggtggccggtgcggcgccgccaggccgggccgggtcggggggccgggagccatcaagtctgcacgtccgcagcctggccgctcggcttcagcaggaagcaccgaatgggcctcggagccaggtgacattgaggccggcccgtggggactccgggctcggtggctccaggctcggggggccgccccgaagtgcccggtccatcttacccggtctcgcagcggctgcggaccggcctcgggcactgaccttggagcgcccgctggccgagggctcaggctgcggggaggcgggcccgcgctctgtgcctgcagcctccgcccttgctccttcaaaaggtccctgtgcaacccctcccgggttttgcggggctcccgggcggcgctcggctttccagcctggaaggcgcctattgtttgctcacgcaagggctaggcccaaggagagaagctagacgcgggcgttcagccctgacgtcatgcttgtttattctgccccaaggagggtatttccccacatcactctcaccagtcctccgaagggtcgatttaaagggggccgtgtaaggttgatgggcctgaatagaggagggcccgggtgagggggggtctcataggttttccgctctcctcagggattggaaattgatcggggctgtgttggcagccttctccaatttccccttctagtctatgtacaggcggtattaggttttaaacactcagttgaatgtgatgcgtgccacggtccctgtgagctgtcacctccccccaccgctccctgaagaatggagtctgtcacggcagcacagtgctttaatgatctctagctttttcagagtcaccttgttagcattttttcttcttgcctttttttgtttgagacggactcttgctctggttgcccaggctggggtgcagtggtgcggtctcggctcactgcagtctctacctcccgggttcaagcgattcttctacctcagcctcccaagtagcggggattacgggcgcccactaccatgcccggctaatttttgtattgttagtagagacgggatttcaccatgttggccaggctggtcttgaacccctgacctcaggtgatctgtccgcctcggcctcccaaagtgctggaattaccggcgtgagccaccgcgcccggcctctccttgtttttttaaaaagaccaatgttctgttaattacctgaagcgcgtatatattatggcagttgatttataatgaagctccttaaaagcatgccaattactaagaaaaacctcatcctaggtcattttgtgaattcagagacagtgataaagaatggatcatttgcgttggggagaagcaaacaaaaaaattccaaaatgctctggggcaaaaagaagactaattccttgctgtttgtccttattcatagagaaggtgtacatttttatctttcagaatgttggctaccagggtatttagcctagttggcaagcgagcaatttccacctctgtgtgtgtacgagctcatggtaagtgtgacttttcttacttttaaataggctgaactaatttcattttgctcctgctgtgtataaagccctgtgctggagttttaaagaccttaattcggctcttgagggtctttaggggagatataaatgttctcacagggcttggttctagattaagaagtgtttataagtcaaattgaatctcttctggatctttggttatactgatacttccccacttacccttcccttccgttccacttttttaagcttcgagatctacccctttcaaaagatcttctgcaccataactgactgaccttaatgacctccctccccaccttgcccccacaactcccaaccatttgcatcacctctgtttacattatagaggcaatggaaacgaaagagcctggacttcctagcctgagctgggttttcatctcatttctatcaaggactagctactgaagctcaggaatctctttgctcacctgaagtatatggacagagcttagttctgtgtctggcatacagcacatttacttttgcatgtatctggcgtctatctactttgtaccagacactgttaggcaccgagaagaaaaagaatatgaaatacacacactttccaggaggctgtttgcaatctgaagagggacggatgggtgaagacagtgttttattaagagatggctcctgggtagaagcatttagcccgatgtgggtttcagggaaggcttctggaggaaactctccagggtcttttcattgccttagtagagtctacaccctgcctggttagagctggtcttgcctgcctttccgatcttattactgactgttgtactcaaaacccaaaaactaccatcagaaccacccatccccacttgctcactgccccagccccctggccttactccattcctcccgtagagccccgagttgtggatggtcgctcctgtctaatcattcaccctcgatacaaatgtgcttttagaacggcctctcctgaccatcctttctcaggaagctccctgtcacctcaccttgctgtgcttttccttataacactggatgcctcatgaatgcatgtctatttgagtattgctgtctcagcctcttagagtgtaagccttttgaggccagggagcctgcctgtcttactcattgccgtatctccagcacataggaggcagatgaagacgaactgcagactcttagacaagtcttctctgttaagttttaacttacgtaagtcatacatgaataatacatgaatctgttctcaagatattaaagcagtctggaataccatcagccgtcactgaagtcagttgggatatttgtgtggtgatgcacctgagtaaggggtgcccagatacaccagatctccccagcagaggctcaacagaaatcggtccatgttgaagcggtgacaaacattccttacaatctggagtctttgtttttctctctctctaaaagaaatgtttggtatattaaccattgattttcccttaattgctgggggaccaggcctgaagctctgaagaacccctgaaaccatgaattggccattcttattctggaagatgcaattttgaggtttgcatgcaccaaggttttgagggtttatgtcgttataatagctttttccccccagtctccctgtcatggcatttacaacagctttacaagatgtaattcatataacagtcacccatttaaagtgtatcctccagtggtttttagtatattcattgagttttgtcattagcaccacagtcagttctagaacattctcatcacccatatttacatttatttttaataactctcatgtgtaagctgagtgttttaaactttagaaacttctggggggtgctgaacttgataaaaatattcagtatacaagtgttctttatagttcactcatcattttcatagaattagggttttaaaattagaaagtaattcaggccatttccatctcctgtccctcaaatcccagctcagttttgggatgaggtgtcaagtataagtttgtaagtatgccagtcatttgcacggctaagagaaacatctagagaagtctatatacgacttgcttaaagctgaatgttgatttactgttcacatgatttgggcgattttagtcactgggactgagctaatggagttgaagcattgttgcgggcattgtacctccagaccagtgtgtaatacaaagagttcttgcagacgtaggacagaattggagaaacagcttctaacagtgggaagactctcagtacaaccaagctattccttacctttctgatttctgaacttttttccatgtgacacctgctgctttgaaggcactaaaataacagaagcagatagagcagaaatcctcactcagatcttcctccttcctacctgtataacagtttgtggcttgccttgtctgttttgtgtgtttcgttacgcgtatgtgagtatgtgcacgtgatttccagaaaggagaagcgcacgatactgcccgtgctctgtgactcctgagtgcatgcttcctctgcatttgggctcctaggtcggcctcgtcctgtggacgttgccccttgtttcgtgccatccacacattcctgatgcccccctgctctactctttctccagagtactttttccaaacatgtgatttgcacatttgttatgtttattgtttgttttccacttctagaagtgtgccgctaggcaggaatgtttgatttcttcactgatgatcccagatctctagaaccctgccttgcctgtagagggtgcttggtaaatgtgctctgaatgaatggctccatgatcctcgtttctaagagctagcacgatttctcacttagtcctggttggacacaggttccctggaacagtgctgtcgtggttatcttctcacgtgtctttgtttctgaacttgaaacgcttttgagttttttattgtttttgttcttcctcattagtttgagtcccttgcagataggctttcattttgtccagtcacctgttcagggagccctgagggccttggcccatgtctgcaggtaactggtttttttatttttatttttttattttgagatgaagtctcgctctgtcaccaggctggagtgcagcggtgcgatctcagctcactgcaacctccgcctcctgcgttcaagcgattctcctgcctcagccttccgagtaactgggactataggcacgtgccaccacgcccggctaattttttgtatttttagtagagacggggtttcaccatattagccaggatggtctcgatctcctgacctcgtgatccgcctgcctgggcctcccaaagtgctgggattacaggtgtgagccaccgcgcccagccctgcaggtaactgttaatgtaggaagtgctgcctctgggcaccttggccccagggttcattagcagttgcccctggtgggtttttgttggctgtgatgagaagtgcttctgttccccctccaccacactcctgcaactgtttaaacagtggctgtgaccccctgagatgatccagggtttcaaggcgtgcacatgtctgtgtttcggttttcagaagtatcaccttggggtgactctcaacctacatggattttcaaagatttattcaatgtgtttttcagaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagtgtgggtattgaagggacccacaggcgcgcccagcagctctcggaagcgtgtgtgtgacagagcctctgctcacttctgggcctactgtctagagagcagtcttgcacaggagggttgctctgctgggtttcggggtcactgtgccagggccccagtttatgtgctcaccagtcacttagctctgccagctgacaggatcttttgctaggcccccttctctgtgctgagtggaggtagcctctcagcatatctgctgggtaagacatagttaactgtaaattattgaaagaaactcagcaaaatgcatagtgtttggtatgaaaggggcagaaaaataacaagattaaatagaccctaatactgtaattcaagtaagaaataattttgcagttttaatttgcacctgaagcgaactgtatgcattttcttccttccttgccctgtcacatgcctgcgtgggcacgtgtgtgcacgtatgtgcgtgaacatgatgtggcctgggttggtgtatccttcagctctgtgtttcctccttcacaagtgtggttttggggagaagtggttgaatgttgcagaggagggagctgctgacctttgtgcctgtaaatggctgtcctctctgcccccagtgtatcgcattaagttcaaggagagctttgctgagatgaacaggggctcgaacgagtggaagacggttgtgggcggtgccatgttcttcatcggtttcaccgcgctcgttatcatgtggcagaagcactatggtgagtagagagggaggaaggcatgggcgcctggactggggctccagcctgcagtgcccattggtgggctgtgggggacctccataccttgaggctatgagatagggactgcattccagagttcatctcaggattgtttccaggccttggtgacctggagaactgaagtcgtgggaggttagtttataagccagcatctgattattcatagccatgcttgttgggtggtgaaataccctaactactttgtacagcacaccacgttttcagtagcaatttatgtgctcaccagtcacttagcaaaagatgacttcgtgaaggttcgagcaaggataaggggactcattcatttaatgactgtctcgactgttgtgaggactgcatctcaacagccagcatctgggggtcccgacctgatagtttgtgtgtgggcattgccgggttgctcgctcgtggtaatgactcttccccgaggttctttctgtccaggcagaacaggcatttttgcattctgaataggtatattctcgtacttttggtttgaatgtggatgtgggttaataacgacccgaatctatttgatcttccaggtcaccttgggctctgtttgtcagatcctgttatccatagcctttagagaggaccttctgcttttagcttattttgttgctaactttttacaaacaaagggctaattttaaaatgtcagtgttgtcagtggtcagaaaccgtgtgtttgagcgggtgttgagtggcaggtggctctgctgacctggtggctggtgtgtcgggaggatttaacctgtgtgagggattggcctagaaacaacctgttgagatagtcttgccccataacctgtctcacaccgtagtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctgaaaccctttgtgatcagttctttaatgatacctaaatgaaagctaattaaaacaataggtttctcccaagggtctggagtaaatatattttgggtgcaaatgaaatggcaaaaatctagtatcttaaattgtataaggggacattatataaaaactgaaaatatagaattccttgatgtaggaaatttgaggtttttggcaagagatctttatataagtaaaatcccattatcgtaggcacaccggcaggagttaccacaaccctttttttttgttttgggagacggagtcttgctcttgtcacccaggctggagtgcagccgcacaatcttgggtcactgccacctccacttctcgggttcaagggattctcctgcctcagcctcccaaggagctgggattacaggtgcctaccaccacgaccagctaatttttgtattttttagtagagacggggtatcaccatgttgtccaggctggtcttgaactcctgacctcaggtgatctgcccgccttggcctcccaaagtgctgggataacaggtgtgagccagtgtgcccggcctatgaaccacttttcttctgggactgtccctccctccctgcagttttcttttttttttttttttttttttttactgatcattcttgggtgtttctcgcagagggggatttggcagggtcataggacaatagtggagggaaggtcagcagataagtgaacaaaggtctctggttttcctaggcagaggaccctgtggccttccgcagtgtttgtgtccctgggtacttgagattagggagtggtgatgactcttaacgagcatgctgccttcaagcatctgtttaacaaagcacatcttgcaccacccttaatccatttaaccctgagtggacacagcacatgtttcagagagcgcagggttgggggtaaggtcatagatcaacaggatcccaaggcagaagaatttttcttagtacagaacaaaatgaaaagtctcccatgtctacttctttctacacagacacagcaaccatccgatttctcaatcttttccccacctttcccccttttctattccacaaaaccgccgttgtcatcatggcccgttctcaatgagctgttgggtacccctcccagacggggtggtggctgggcagaggggctcctcacttcccagtaggggcggccgggcagaggcacccctcacctcccggacggggcggctgctgggcggagatgctcctcacttcccagacggggtggctgccgggcggagggtctcctcacttctcagacggggcggccgggcagagatgctcctcacctcccagacggggtcgcggccgggcagagacgttcctcacctcccagacagggcggcggggcagaggcactccccacatctcagacgatgggcggccgggcagagatgctcctcacttcctagatgggatggcggccgggcagagacgctcctcactttccagactgggcagccaggcagaggggctcctcgcatcccagacgatgggcggccaggcagagatgctcctcacttcccagatggggtggcggccgggcagaggctgcaatctcggcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggagctggagaccagcccggccaacacagtgaaaccccatctccaccaaaaaaatacgaaaaccagtcaggcgtggcggcgcgcgcctgcaatcgcaggcactcggcaggctgaggcaggagaatcaggcagggaggttgcagtgagctgagatcgaagcagtacagtccagcttcggctcggcatcagagggagaccgtggaaagagagggagagggagaccatggaaagagagg

SEQ ID NO: 17356 - DNA, 7890 bp, Human; identical to SEQ ID NO: 11951

SEQ ID NO: 17357 - DNA, 12826 bp, Human
gagcattgcatagctccattatagaatccatctaattcatctactccagtcactcaaaacactttcactaaggttgccttagatcagtagatatgggaaatatccaatgttaccagtactcaagtaaattttagactatgaggtccacaagaacagagatgtttacctgctttggttactaatttatccctactacctgaaacagtatctgaaataaggtatgtgctcaaagaataatgtccaggacctgaaatattgtatgtgctcaaataataatgtacagttttgcaaagccccacaaaagctacattagtatttgaagtgaatgggtgacaccatggtaaacatgtttttatcttggtgggagaaatgattactagcactctcagatgttcttaaaatatattttcctgtgaaaacaatgtcttcagaagtgttctgagtctctgctacttgtaaattaaataattcaatactcaactgaaaatcattatcactcttattactctaaataaatggctgagaaattactatgtgaaatagaacaccttcaaaatttgaggaatgaccggatcatgatctttcaaccacggaccctgataatcaaaggaaaacactgtgactaaatagttcagatagaatggctggtgttattactttaccaacttggtttagccattttaaattctgtcatctctttttgaaccacaaaaaccaactattctgagaaacagaaaatttcatattactattttactctgtgtaatccaaataagtattctagggtttagaatattgttcctaactttctaagacatgcaatacttctaagaaacagacaggaatatagacataactacaatgctgatattatttcttgtttgtgttctggcagtcctacattaattcctgtaagttcctcaatctggtcaggtcttcacagccaaaataagtcacagttaacattatttctttagaaaagcaagtaaaagaaaatatgctttcctgaattatctaagcaaaattttgtttagctattttttgccaaaatattctcaatgtcagtgggtttgtgatttatgctctaagtcaaaatgactttccttaaaacagaacaattatctccaattcaataatttaataattttttttcaaaatggttcacctatattattgaaatttaaaatcttaaaaaaagtttattcataagaggataataaatcactaagtatgtagtcaatgcatacgggagaaaatgtgctgcagcccaaacgcaaatgattccccactatatactgattaaaatgtttcatatatgggtttgacttttataaggaggtgctcttgggtatgtgtgagatggccaattatttaatttttaaaaatcaataattgtaattctggaaggaagaagaccaaccacagtcaatgccagatgtagtatcacttgaaatccaggttcttaaactaaaagaaacaattaaaatgtgaaagtattgtggctatttttcatttcaacagcagttttaagtttaaatagataggataagttgaataagaatacaattaatatttttaaaaattcttctatatttataaacaaaaaaagattatttaaaaagatatgaatacttttttcaagctttatgagtgatgactctacatccttctctgcatttcttttttattttattttattttattttattttattttatttttattatactttaagttttagggtacatgtgcacattgtgcaggttagttacatatgtatacatgtgccatgctggtgcactgcacccactaactcgtcatctagcattaggtatatctcccaatgctatccctccccactccccccaccccaccacagactgacccaaaggtgaccctgctatcatcatcttattgggtaaaaagtaggagggaaatagaatagcgtgactcaaggtactaataccctttaattggtcttcagttatttttcttgggtcttctctacagctgacaggccaactcaacctactgccaaccaagacctgactggcacgaggaaaggtaatgctgctgaaacacttggagaaagtgatccttttcacagtagttagttgggacatcaccatagttatttcagaatcacattttcttccttttagttattgttaagtttgaatatgacctagcatcactttaaaattaatttctaacctaaacctaagttctggatggtgttatgttcaaatttatttttaactttactttgggttccagtcaaattctgataccaactaaatcatagcagccattgtgaattccgaacaagaaggcgtttaacgtattcctacagacaaatgttgagagttaactctacaggaagttgggctcatgataataatcgcaattaaccccttaattactttcaaattttatttctataaaagtcataattttatttgttatggaataattatttttttaaaacatgtttttcaaatattcatgaaagctggataattctaccatttcacgaattatttcttcttaccaagtgatgagggcaaatgcaaatgtagctgatacgcaaagtatggtcttatctctgtgatttttgtttgtgccaaaaggaaattactatcattttatagaatattttcttttgtttacatatcattttactgtgtgaactgataaggggtctgtgattcatcataaaaacattttcagtctataatcctaaaagatcactagcaagtgaagcattaataaggagcttcatcccacttaaagaaatatgagtgtgcttagattgttcaaattgattccaaatgagttccatcaaatggaaatttgatgacatcgtatgggcagttttgaagtcactttagtagacagccttcctaatcattattgcctgagaatcagacgctaatggagtccagtgggctttccatcccctatctgaggctttaattctgtgaatcttttttgcgaagttcaactttgtagtgattcaagtttatatgagtgtgtcaataacaatagctgcaacaagatgaagttagtaattacttcctaaacataatatatacttaaatataaaaagtttggggtatcatatattattagtctaaaaagatgatttattaaaaatcaaataagcaagtatgacactgtatatactcttttagaaaaataaggctaatgtatttctttaaatattttagtcaaagccactgtaattgtcatctctatacttcttattaaaacaatcaagttaatcatatcagttatgattactggagaagtatgttataaagaaaacagtctcataaccctccacttcccattccatcctacatacttctgttggattgatcatggaattatagaattttagaaatctctaagttcaaaccctggttttacaggtaagaaaatgtaaagcccaggaaagggaaatcacttgatcaaagttacagaggtagagataaggcctggtctagaattcagtcctccaaaaaatgtatagtcatacactttctagtccaaaaacactcaattgttttctgttgtttataaagccatgcctagctttttaacccatcattatcttaaaggtgtctactttttctgctctaaactttccttccaatcttatatttcccttctcatacaagattccaatcaaatgttcatggcgattctcaagactttctcctctacttgaaatatttctctccctgttaaatactgcataggcaagcctcatctatatgtcattttttccacacaaagactgctgcttctcttaactgaaacttttattaatagaaaaccacttttgtggcattttctactttttttccctcttacagttgtttttcagtatatgtttcaacactcttcctaaaattgatgctactcattggcaaggcctgtatcatatttacattgataatctcaacatttgacatagtaatgataatttgataattccgttaatattgtcaaaaattaaattcagaaatttttactccaagtttgagtttttacattcttttgttaaaataaatttttcacatcggctaaatctacctgtaaatctggctttttttcttaatcaaggaaacattgtattcaagtcactcctaaatttctagtaacaaattcttttaaattaatttttttttaaatttatctttaggtgcaataatgaagagttttcttctagttgtcaatgccctggcattaaccctgccttttttggtaagttaatttcatctaaccagattgtactgactttaagaaaattttgtttaagggctttaactatgcaaacttctaaatacaattatgcttcatagaacaaaatatccacatagttgttacatttttaaggttaatttttttaatatttatttctattatgaaatcaaagtcatgttcttttggatatccatttagttctgtgaattaagaaatcacacttaatcatgtacaggaaacttttaaaattctcatgctatagagaaaatacattcaggggaaaaacaatactgaaaacattttaaaattgtaaatgcattaaggataattcagaaagaataaatacagaaatcatagtctgggaatcagaaattattttaattaagttcctgtctcacccagactccaatctctttatggaaacaaaatccttcaaaggtcaactttggttaagctttttcacaagtttcaaagaccttgatacttctgcctttaatatttgaatcattaacttttgttatattcttccccattatgtcaattgactgacccctttccagggatcaatggttataaacagcttgaaggcttgcaggcattatcttgaattatatgcaatgttttaaggctactggacttagaaaaaggttctgtttttttcttttaattttttgacttgtttttattgttgttttggctattgcctctttttattttcttgttcatctgggtattctaggcactgacaaaggaggcaagcataaataatggtatatgtcctcctcctagattgtaaaattttgaggaacactagtcctcgttctgtgaatctctgtaatatttatttattattaagtttagagttgcttttaagttaacatctattaattaattctattacctgcatgttgtgcttgtgtataacatgtccattaattctattaggtcaattcttggagtcaaaattaccttttaaaactttgagttctacaactcaatactttgtggtcacctgaacatttggaacttaggttgtctctttgagtaatagggcttaaagtttaaatcatgaaatgatctacaaatccctgctgcatagcaacctcttcctgagctacctgagccggattcgtctttcaaacattccttcccattttcacaaaggcttcaggcctcagggacatgaacaaatatacagaaaaaaaaaaatttattgattttaccattcaatcttatgagtagtcaaatttatacaaattaaaacatcaatgtgataccatgttatatgtactattttatcccttcccccaaaataaaaatagttagataatattttactagcacttatgcactaaactgcataaacacatagcctattggtgacattataatttgacacaacttttctataccacaatttcataatttctatcaaagaatcaaatctcatttgtgaaaaatcattttaaggtattaacgaaaattattaaaaaggccactggtatacagatgttaatcatcactctgtttataattaaaattttatcttaatagataacgataagaaataaacatttcatgacataatcattgatcacttagttatcaactataaaaatgtaactatgaaacctatgatataaataaaaaaaagagacaccacatttcctataaaaatgcaggatactttttagacaagcatataccaggaatacataacataggttgatatcgcattaaggtatctagattgtcagaattttttaaagtatactttctacaatattcatattacttcttttttttttttttttttgagacagagtctcgcttggtcgcccaggttggagtgcagtggcacaatcttggcttactgcaacctctgcttcccaggtttaagcgattttcctgcctcagcctcccaagtagctgggactacaagtgcccgccaccatgcccagctaatttttgtatttttagtagaggcagggtttcaccatgttggccaggctggtcttgaacccctgacctcagatgatccacccacctctgcctcccaaagtgctgggattacagggtgagacatgtgcccggcctcatattacttctttacattttaaactaatgatttaatatatttaaagaaaagcaagtctttgtctcaaagcaaggaaactttattaccttctcaattttctgattttctatactcacaccttccaaaaggtttctagagtcattttatacccaaggaatacatgtgtaatgtcctaaaacagaactgtcaatttaaaaatatttaatattatacctcctttcaaaagtttctaaaagctttggagtttttagttttataaatatgtgtccataaaaattgttttctcactcctgattctctaaatatgtcacaatccaaaactaagaaaagcactataaaaacaaatgaaagatggtattaaaaacactattatttatatgttaagtttatgcaagaggcaatattttaaatcttctaagtaaaccttatgaatcatcttagtatgagagcagagaaaggaaaaaaggctcaatgctcctctaatttttaacaatctaacaatgtatatttaataaaaactaaatagaaattattcatatttttcatttaagcatatttgttggcatgggagtcagatgactagatttttcccacagtgactttttcattctaggtggtgatgtttaaagacaatataaacatgcagtttattattactaatcagttagactactgttgcttcttaagtagtccataggcctcatagatcactcatgaaaaatgttttaaaaaataaaaagaaaacatattttgtctttaacacaaaagatttttttaactgatttaagtactttttttttcttttttaacttatttctcattatttcttcttctggaactccccaggctgtggaggttcaaaaccagaaacaaccagcagtaagtctattttaattacttctgttacaggcatgaactacaaaatatattctgcaaaggtcaattgtattatagatgccttctgtctaaaacctaaatatttcatttccataaaacaatctaataatatttgcaagaaaataatttcagcaacaggtgatatgaatcaacattgatgttcatctgaaagttttattttcttatataacccaaatcatgtatctttggttttcatgtatatttagcaatatgagaaaactctttcaacatttcatattggaaaaaaatgaaaacataagtaaagcttaatatttcccctttccactttttaagacaagggaagatccttttctgacccatctttgaatacttctcatacatctatatttacttcccctttcgtttcccaaatatgtttgaatacatttaaatgtgtctcgttttaggagaaatgtttgctttgtagtataattttgtcaatttatttctattcatatggaaaggtctactgacaaatttttaaacagaggcacatagatatagacaattctttatctaatcttttgtgaagaaaattaaaccaaaaaaaatccaaaatctaaatccaggaatctctccacatcacattatgttactattctgctatagtttaggaaaaaataaatgtgctcttgggctaatttttaaatgaataaaatttgagaccaattacaaatatgtggtgagaatacatacgtgtgtgtgcgccattctgtgtgtgtctgcatgttgtgcttgtgtataacatgtcaaagttctcaatgagatttttctctgtgttgtacctacaatagctaacatataagatcactttccatatatgccaatctctgggcaatatggtttacattatgaataaactcatctaatttcttgaaacaaatattatattaatattatcaaaataatatttataatattgaaaatcataaagtggaaaggcaatgtacaaatcaacatcttataaaataatattgctgctgggttccatacttctaatatcttactcaatggtaaatactatattatttcaaaaaatgcagatttaaggtatttccacatttgggtctataataataatattctgtataatttattttttttgcagtgccatgagaatgatgaaagaccattctatcagaaaacagctccatatgtcccaatgtattatgtgccaaatagctatccttattatggaaccaatttgtaccaacgtagaccagctatagcaattaataatccatatgtgcctcgcacatattatgcaaacccagctgtagttaggccacatgcccaaattcctcagcggcaatacctgccaaatagccacccacccactgtggtacgtcgcccaaacctgcatccatcatttattgccatccccccaaagaaaattcaggataaaataatcatccctaccatcaataccattgctactgttgaacctacaccagctcctgccactgaaccaacggtggacagtgtagtcactccagaagctttttcagagtccatcatcacgagcacccctgagacaaccacagttgcagttactccacctacggcataaaaacaccaaggaaatatcaaagaacacaacgcaggtaaattaacagtatataaaatgagtaattccgacaagaagcatggatttatgaatacaaccataaattctaaaatagtacaaatagataaactaagtgtgttacagaagcagacaaaacagggtacttacagttttaccttggtaaacccatagcattgatacaccagattctgttccaactagaaatttaaaataattttatttgacaaagtgaaaataattggcaacttcattatcaaacttttttctgacaattgggacactcttagaatgtaatagttttatttcatccttattcacacacaaactatgacagtagagtaaaacagcaagtaacattttcatgatatttcaaaaataatttttagaagaagttatatagaatatgagtttgagtaaattttaattctgtaacaattctcttgcactctcattgtagtatgaacagagtaaaaggaaatgatatgcttccatgcatttctttatttcagacatcatttccaaaatgattcatgaagttaagcctctcaaatttctcctattctaagataaacccatggaagaattataatgcttaacttgaaaaacacataaatattaaaaggatactttcagaacacaatgtgatgcaaagtgttactatttattacttggaccaatggataatggcagaatataaaataatttgaaacttatgagaagaatttaaacaaagagaatgattaataaagtggaaaatatccaaagagtgtaaaataatttggggagaaagttgcaaaatgtggagtttctttacaacaaatattttcagtccatcagatgtctacatgttttatgatctaaaataccagacaatggtctgtgatatcatgggactaccattagcccagaaaaggttgcttctttcatctgcttgcctaatgaccataggctggtcattactttctctgaacttttattttctcataattctggttgctataagactcaagagagaatgcacatgggaaaggattttaaaaactgatcaatctgtaaaatgtcatgtattggaaaagataaagtaaaattcataccagtatcctaagtctccactaaatgataaaaaccgtacataattatgtctgttgattcccatagtaaccatatgaaacagatattattcctatctcaaatttagggataaaaaccagtaggactgaggacattaagtaaattatcacagctagaaattgcaaatgggaggcaaaccaaacctgtttaatttcagatagtggggtttaattactatgtcatttatttttatatgggctgtctaacttgctgaaaaacagggaaaatacactgtgatttccttagactagcatatgggtaaattgtgttgtttagttgctgttcaacaggatatccattaagaaaaagagaacaagagctggttaaacagctggcttattatattttggagaacaaaataagaaaattaataaagacaacatgaaagcaagttatttaataagtagttacatattttactgatgcaaaacataaagaagcatgtaaaagagttttttctgtaaatattacataatgtctattattttcagtttactatatgcctattttaaatatttaagtttaaatatgtaatctgattgacttattggatacagacatgaaagaaaaattgtggaagctaaataaatatatatcatgagaactgttaacatactatgaataaatttctaaactatcattattttttataggacttgctgaaaccaaattactacttcacactctccttcagccatttgtctgccttcagtcaacagaaaatgtgattttcacagattcagctcttctctccttacattttacattcatgccacattcaatattttgattcttgcacaataaagccaactgattgcaactgattctttgagaggagtttgcaaaggtacctcagggatctctgaaactttgaaacgctatgacaaatttagtgtgagttagagtacacaaatttacctaaaggcagtgctcatagtttcatcaggttctcaaagtggttcatggtctgacactaagaatttctcctctaggatgacactgggaccagagaaaagccaagccatagtgttccaatccaggggaccacagagtgactcttgagagccatgggaactctagagttagcattaaatttaagtgaccaaatgtattgctaacttagtctagattattcctgagagcaaattctgggcacaggcaaactacaaatgtccagaactacaaacacagatacgttgcaaaattatagatgttgacagagactctaaacatgcatgaccagatttccccacactggactccacagtctcacatctgttcaaacacacacacacccccacacccacccacccacccacacacacacacacacatcacacaccagaaagcttctggaattcaggtattccagtttggaaaaactcgtgaatattcaaggtccaaggataggacatagttgttttcttaaacaaatattgcaaggaaaatcaggtcacctttgtgcttggtccatatttaacacatcatgccagaaaaaataaaattcactcagcccttacaaaatgtttactggtcacctatctaatcttctgctgtgactcccaacagatgtgctattattaggattgatttacagtgttttacctgctctctcactcaaatagagagtcttgaacagagacatggaaggaatatggcatggctagaccttatttgctatgatcattaatgatattattaatttcttaaaaaacaaagtaaatatgtggaaaaggcaaaatttatatcattaatttaaaatcttaccacctattatacacaaggtattataagaattattgtgataatacaaacaatattaatggctgataacaataagcaacaagcagttataaagtacatactatttgccagtcaatcttctatttgtttatatgtatttactcatttaatatgtagtcatgaactacatatatttattcttgttgttattataagtgaaagagaaatgaagtaattttccccacgtgaagctgagatttgaactcaaagtcttgctttaaagtccatgctctttaaaaactgacacatggaccaatggaacagcataaagaacccataaataaaactgaatgtattcagtcaactaattttcagcaagggtacaaagaagacacaacagcaaaattatagtctttttaacaaatggtgctgggaaaactggatatcacagaaaaagaatgatattggacccatatcttacaccatacacaaaaatccactcaaaatgggtaaaagctcaatgtaagacctgaaactttaaaattactagaagaatacctagggagaaagctccttgacattggccttggcaaaaattgtttcggatatcacactaaaagctctggctacaaaatcaaaaataagtaaatgttctccctcataggtgggaattgaacaatgagaacacacggacacaggaaggggaacatcacacaccggggcctgttgtggggtggggggaggggggagggatagcatttggagatatacctaatgttaaatgacgagttattgggttcagcacaccaaaatggcacatgtatacatatgtaactaatctgcacggtgtgcacatgtaccctaaaacttaaagtataattaaaaaaaaagtcctataagaaaaaatgccatctttatgaatctctgcaataaaacatggcataaacctttaaaaaaataagtaaatggactacatcaaactaaaaagcttctgcacagcaaagaaaataatcaaccaaataaaaagacagcctataaattgggagagaatatttgcaaaccatttatctaataag

SEQ ID NO: 17358 - DNA, 8695 bp, Human
tctgatggccagtgatgatgagcattttttcatgtgatttttggctgtataaatgtcttcttttgagaagtgtttgttcatatcctttgcccactttttgatggggttgtttgttttttcttgtaaatttgtttgagttcattgtagattctggatattagccctttgtcagatgagtagattgcaaaaattttctctcattctgcaggttgcctgttcactctgatggtagtttcttttgctgtgcagaagttctttagtttaattagatcccatttgtcaattttggcttttgttgccattgcttttggtcttttacacatgaagtccttgcccatgcctatgtcctgaatggtattgcctaggttttcttctagggtttttatggttttaggtctgacatgtaagtctttaatccaccttgaattaatttttgtataaggtgtaaggaagggacccggtttcagctttctacatatggctagccagttttcccagcaccatttattaaatagggaatcctttccccattgcttgtttttgtcagctttgtcaaagatcagatagttgtagacatgcggcattatttctgagggctctttcctgttccattggtcttggtatcagttttggtaccaagtaccatgctgttttggttactgtagccttgtagtatagtttgaagtcaggtagcatgatgcctccagctttgttcttttggcttaggatttacttggcaatgtggcctcttttttggttccatatgaactttaaagtagtttttttcaattctgtgaagaaagtcattggtagcttaatggggatggcattgaatctataaattaccttgggcagtatggccattttcatgatattgattcttcctacccatgagcatggaatgttcttccatttgtttgtatcctcttttatttcattgagcagtggtttgtagttctccttggagaggtccttctcatcccttgtaagttggattcctagggattttattctctttgaagcaattttgaatgggagttcactcatgatttggctctctgtttgtctgttattggtgtatatgaatgcttgtgatttttgcacattgattttgtatcctgagactttgctgaagttgcttatcagcttaaggagactttgggctgagacgatggggttttctagatacacagtcatgtcatctgcaaacagggacaatttgacttcctcttttcctaattgaatgacctttatttccttctcctgcctaattgccctggccagaacttccaacactatgttgaataggagtggtgagagagggcatccctgtcttgtgccaatttttaacgggaatgcttccagtttttgtccattcagtatgatattggctgtgggtttgtcatagatagctcttattattttgagatatgtcccatcaatacctaaattattgagagtttttagcatgaagtgttgttgaattttgtcaaaggccttttctgcatctattgagataatcatgtggtttttgtctttggttttgtttatatgctggattacgtttattgattttcgtatgttgaaccagccttgcatcccagggatgaagcccacttgatcatggtggataagctttttgatgtgttgcataaatctttccatacatatttataacttctttatgccttttgaaaaattcaatactgtaaatgggacttttttaaaagtggggatagagttgttagctgaaaaatctgaatagctggcaatgaagtttggaatttgaaaaatgagaatcgcaagccagaatggattttgacctccttcatgtgatataacttctatttagtatttattctatttattttctaaatgcagatatttttgttatatattatctctcttttttttttgttttataaaaagtaaccttacctacataagaaagtatatccaattgaccaatcttccaccattccattttttctacattcacaggacttagtagccatgaaggtcctcatcctcgcctgcctggtggctcttgctcttgcaagggaggtatgtgcacaagaaaaaattcctaaacaatcaataaatagtggactatatgcttatttgtagagaataacatcaccaacattttttactgtataaataatgaagaatttcatgagaattctcttggcttctatcaaaatcatttatatttacccactgtctcaacagtttcctatagtgccccaaatgcttcctgcaccaatgtgctgctagtcactaaagaaaaagcaaacaaatcaataagtaataaaaaatcataaaaatggcaacgaaatataatattgcataaatacaactccaaagattctcaagctagataaatatatcttattccagtgataaaatgtatatataccttacagcctagggcactgggtcaaatcctgtgtctgtctgtacaaagacatccatgggatgaagtacagagacaatcataatcatgatcataaatatattaataataatataataaaaatatttaatacaaattaaagtgactcttcttttacccataaaaaactctgtctttaataaatgtaagataaaaatatattaatagattactaaatataaaagacattaaagtaattaccttttaaacctcaaaagtcatataacattttttatttctcaaatttgtgaaagagatagctctgcataagtgatgtaaaaattaagtaggatgcatgtttaacaatgagttagctatagaagttgaatttttaaacatcttttcagaaggaacaatccaatgcatcctctgaggtgagattatttttttagagaaaatttatgaaccataaaatagtaaaattctctaatgatctagaagatttagctggttgtcaatttttttttcccacagaccatagaaagcctttcaagcagtgaggtaagttaacattctacccaattttagaacagtaaaatcctgtgctatttttctatggtgttacatcatggcagttaagctaatgcagctatgttaatgacatataagttctagtacatatttcttttatgtgtgtttaaggacaataagtatctggataatacaacattctagaactttgtaaattggcttgctacttgaaattgtgttattttgcttcttttttttttaatgaaccatattgtcctgttttctgccttgaactctctttactctgaacttattcaccttaagcatatactgacagccttctatgggtcagacattgactaggagctgtggtacaaactgaaaagttagagatgccagtgatagttaagagcttgctaagtagtaggtaggcagacgtgcaaaaaggacacattttataattacaatagccactttagtaaataagcgagatttagtgtagtcctaaatttacctgagagagtcaggtagatatttattcttacaccactcttcttgggtgtgtgatcacttgataagtaaatggtacatcaatagattctgtctcttcagaaaggttatatgatccttaagggaagtgtttaactcttatgattcatttgaagtgatcataatgtatcaattgttattagaatatattttcaatgagtatttctttttttaaaaatcagatggggttttagatatcatttgttgtcagggaatgagcatggtggtagagagaaattagcatctattaattgcttttttttgtaccatgtccttcttgactgcattcatctgactttcttttacataacaagctcatatagaacagtttaatacataagtttaatgattatacaaagttattaatgatattatcaaagaattaaggcctttatttcctgatttatattgcaaagtaagaattgttaaaactaaacctaattttattttatatttttctgtaggaatctattacagaatacaaggtaaattttcacatttaaaatgtacacattttcaaaatttcctccttttaatctttacagatggtaacatatctttatatatgatatatctttagcagaaagttgagaaggttaaacatgaggaccagcagcaaggagaggtaatttgttaatgataagtatatgtttaaaattattataaagtataatacatacaaaaatatttataatgtgtatgttgattctaaagaatgataataaaataaatgccatatacccaccaaccactttaaaaattaaacattgataaagtcaatatattttctaggatatgcatgcatttttaaactcataattaatttctagaatacagactaaatacataatgatattactaatggtatatctgttttcaacaagtacacattggtgggaacatttccaggttgggaactatgatcctcttatttccaaggtggatatggtaatgaaaaggtgtatacggctggtaaaaaaacctatgtaaaatttgtcccatattgcctttattcccatatggacaacacaaaatcctgtatttcattaaattacatttatggtgatatgtttacccaattataattttcaattgctttgtgtaccaatgaattgtttggagtcacataaaatatttctaaaatcaaatttaaacaaaaaaattgatgtctcttgaaagactcaagagactatcttctcccaagggaaggaatgtaagaatttggccggtgttaaattacttcctgagattagccacaaattaagactgattttctttttcatcaaaccaaaacaaaacaaaaataaaccttggaattgtccctctaagtctttttaaactgatctcttttcactgtatgaaaacaatttggtctactattggcacaactgtgttgaaaagtaaattctctctgaagaccaaagtgtacagctacagctatccaggcaattcaggaaaatgttaaaaaaagtgtttctgaaatatccaaacattgatttcactttggcctgtggagttacccatgaagtgagtggattaaaatttttcaacaaacagtttactcatttttcttcgcatgactcaagatactttcttaaccaaaataagtgaaatattttctcctctctttttactcatttatcattgtctaaaagagagaaatgaattcattatgaatggcaattatagcttaatcaaggactcaaagattctttttccttctttccaggatgaacaccaggataaaatctacccctctttccagccacagcctctgatctatccattcgttgaacctatcccctatggttttcttccacaaaacattctgcctcttgctcagcctgctgtggtgctgcctgtccctcagcctgaaataatggaagtccctaaagctaaagacactgtctacactaagggcagagtgatgcctgtccttaaatctccaacgatacccttttttgaccctcaaatcccaaaactcactgatcttgaaaatctgcatcttcctctgcctctgctccagcccttgatgcagcaggtccctcagcctattcctcagactcttgcacttccccctcagcccctgtggtctgttcctcagcccaaagtcctgcctatcccccagcaagtggtgccctaccctcagagagctgtgcctgttcaagcccttctgctcaaccaagaacttctacttaaccccacccaccagatctaccctgtgactcagccacttgccccagttcataaccccattagtgtaagtccaaatttactggctttgctgtttcattcaagatgtgtatgtgatggtagaataaaagaataaatgtagagtaaatgaattaaaaaaacagtttagataagtgattcttttattattatactttaagttttagggtacatgtgcacaacatgcaggttagttacatatgtatacatgtgccatgttggtgtgctgcacccattaactcgtcatttaacattaggtatatctcctaatgctatccctaccccctacccccaccccacgacaggtccaggtgtgtgatgttccccttcctgtgtccatgtgttctcatagataagtgattcttaatgcttacctatacaacagaatcacctggagaacttttccccacaaatcccaatgcctaagcttacccagagattctgatataattgttctagttttttgtgtagaggaaactgagtgttgagaaaaaaactattgcatgaattctggtttaattagtctgttgagaattctgatttagataaagtaattaaggcttacaaaagccggaattaaatttaataatatgattgaatttggaaaaaaaagctaaaaaatgttctgtcattttccttgtgcacatctcttttacacaagccttacttcacatcttgtttttgctataagtatatatgaaggcaaaagactgagatgcttatttcactacttacaacattcttaaggcaagttttcttactaagaggttatttatttatttatttatttatttattttacacaagccttacttcacatctggtttttgctgtaaatatatatgaaggcaaaagacggagatgcttatttcactacttacaacattcttaaggcaagttttcttactaagaggttatttatttatttgtatctgtttatttttaaggtctaagaagatttcaaagttaattttccctccttatttttggtaagttttgggagtttggagatttaattgatcatttttatacatgatgtctttttacatttaattctcctagagaagtccaatacagtgaaaatttcatacatacaagaactttttttattaattatcaatttaatggttgactatcatttactgacctgaaactatctatcttttgcatttcaaataactttaattttatttatgtactattgacagatttgactggcttgctttcaagggcctatatacttacatttgattatcactatttttaggaaagacagaatatatacttattttacttttatggaaatacatttgagcttttgtcaaaagcctatttgcatttttatttctaacctagccttcataaaatttgtatttactttacttaaaattatcttttaattcatgagttaaaattactccaagtgtaaaggttaaaaagaggagagaacagcattgcaattctaagatataaagccttttgggattatgaaataccagacatttcactgaaacaatttcaagttcactaatatttgatgaactttggtgaagtttggtgaacaaactttacatgcctccaaaccgcaacagaatgcatttgcaatacaatttcttttgtgaattagtcacaccaaagttaaaagtgaagagagttgaatagttacgtgttataacataactaattatatatttgctctctattccacagaattgactgagactggaaatatgatgccttttccgtctttgtatcacgttaccccaaattaagtatgtttgaatgagtttatatggaaaaaatgaactttgtccctttatttattttatatattatgtcattcatttaatttgaaatttgactcatgaactatttacattttccaaatcttaattcaactagtaccacagaagttcaatactcatttggaaatgctacaaacatatcaaacatatgtatacaaattgtttctggaattgtgcttatttttatttctttaagaatctatttcctttccagtcatttcaataaattattcttaagcatatttcagttcttctgtctttttttcaaacctaatcggcctctttaatgttaactttgatttattattgatgttcaaaataatcctggaagaatgctttgaaattgaatagaatgttttgaattgaatattaaaagatatcaaaaagtggaggaaaagaaaggatgcttttataccccatttgctatagaaagttttgggttatgcctattttcccagtgtcattattatagctatgcctttcactttcaaaatgatccagcattggatgttaaattttgtggtgaccctgggaaaaaaactttaaatgtgaaacctgaaacacaacttgccacaggtagctatgtgatgttgtaagagctttaattgccacatggataaaatagtgcaaagaattttactgaagatttgattacatattagtaacatgatgagtgtactgtatagtaaatgatagatgatccctattgctccacattgctgacattgcttataccacagcaccaaagcattctaacaaatcaaaatgaactgggtaatgtggtgttagccagcaacgctgaagaaagtaagggatgtgaaactctgacagccattaattctaactgtgaagtagttgtttattgtgattgattttctctctttctataccaactcctccacttgtacattcaattatatcttcctgagtttatgcagtgactcatgtctagcaattatcccatctttcttatatttccagtgtttccctggcccttattacaacataagcatcatggaagacctgcttatactataatatctcccatcattaaagaaaaaatctgcttccttaacactgtacctccaaacctctcccaattatttagattatatcaattgtcatactaaagtaaccatagggttgtttccatatctcatatcttattctattattaacccact

SEQ ID NO: 17359 - DNA, 31407 bp, Human
  misc_feature (1)...(31407): n = A,T,C or G
ttacaacattaacaacaatattctatgtgcccttttttgactgtagccttcattccgttggcacatatgttttctttggccatgagcatttcaaagtagagaataattgtttataaactataaagcgcattctgactataaatgacacgccaaccccattattgacaaaatgtcattgcaacaacaaagaagttcaaataaatgtgttttcaaatactagttagaattaactctgattattacagtaggatccactcatttcacaaactgtattctttcttccaatctttttttttttttttgagatggagtttcactcttgttgcccaggctggagtgcaatggcatgatctcggtcaccgcaacctccgcctcctgggttcaagcgattctcctgcctcagcctccggagtagctgggattacaagcatgtgccaccaagcccggctaactttgtatgtttagtagagatggggtttctctgtgttggtcgggctggtctcaaactcccaacctcaggtgatccacccgcctcagccttccaaagtgctaggatgacaggtgtgagccaccacgcccggctctcccaatctttatataataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaagaaataataataatcacatactttatgagacaccatacattagattgacaaatatatactaacgcagactacctaattttaacagaattagcatgaatcaactgcaaatgacaaactatattgtagttgaatgtgtagggaaaaaattcttcagtaagagagcaatgccatggttgaaacaagacatcctctacattttatatttgcttcaaattctttatacctgtagtctatccaaagtcgtcaataaaactgaaagtaagatactcttattttaaaaattccatgttttaaacagtttttaggacaagccattcaggcctgaactcagtattcatgaaaattagactttcttttaacagttattttaagtatggtgatattagagagtgtcccagtataaaatttctgagaattttttttctatttacccatgcttttcttattttcacagatagctttccaatgattagacgaattgattctttctgtgactcatcagttcatttcctgtaaaattcatgtcttgctgttgatttgtgaataaggtatcgtaaataaaacatctgttaccatacttgcttatcatttaatggaaaacacatcagtcaacccacattctgttcgcaggagagctccagaaggggtgtggaaggttgtgttgggtggagaaaccagatagtgaggatgcaactaagttgctgagacaagggaagagagatgagggtgagagttctccttagataagatttcaatatgttaatcatgtgtagaaagaaaattaaaaaggaggaatatgaagaaattcagatatgacattattagttctgccactggtaggcattagaagcaagaaaagggagacggaccgaggaagccactttggtgaaacaaaaagaaaagcatttgtttatttagaacgggcaaaatgatacgtttcagtgggtgttttctttgtactttgatctttttgtactgatatttaagcttctgttttatgatctctttctaatgatagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaaggtacaagtagtccaaagaatatgccttctcattttgattgattctaacttctctttttttgctttgtatttacctgctttatatttcatggtaactgctaattttgtatctttgacataaaggtaattatgaaccactgcaactctatatgatgtgactttatgtgaaatgttataagtataatgtatatttaacatgactccattgctgtcttaaatataaataccaaattctattaaaagctgtctacaggtatgcatgttagtagaaataattgttttaagttatgtccaaagagcatgttggcatgcttttgaataggaaataagtgagtatattttgtaaaagcacatttataaaagaagttgcactttagttaatactgagaaaagtaaaactgtgtgtgtgtgtgtgtgtgtgtgtaatgtgtttaatattgaaacataaatccttattaaattgtaggtaaacttgtttggtaatacactgtttagtaatccactatttttatatatgtgtaataatctcatctcataaatattttctatttgtgaagcttcatattggaatcttagaaaatactttcagaaatatgcagaacatgtcttagtataaaacaaattgactgtagtgtgaaaaaacagaatgattgaatagatgggctttgcacaacaacctagaattcatctcccaccctagcttattcgaattagctacacactcactcatcagaaacgttgattgatagggggaagaagagaataaagggaagcagttctgctgaagttctaaatcagggatggcaaattcaaatggctgcaggagtttggatacaggggttaaacaaaatttaaggtgccaagaacaagataaaatgaagaacaggaactgctgtgaactagactgtgtgtttactgcctgaaggcataaatgttcattttattaaacataatactggccaaataaaacgagttctgccttcaactctctacctggttaggatggcaatgacctagacaaagggttagtaagcatagtgcacgatggagaacaggaggaattgaatttttattaaatttttattgctatattgttagtatttttaatatttttgatccacagttggttgaatctgcagatgtggaacccatgaatacagagggctgactgtattgtgtttattgctaacatattgcagaacttcagcctcatgcatttaactgaaaaaacatatgtaaattagtatcccctgccttggaattcttagttttcttgatagtatttttaatacaggccaatggaaacagacaggtaatagtgaggtgtggggcttatctaatagtgggatggagtggccattgatctgacatccttcctactcataaactatgttctcacccagatcttatgcagagaaagtacaagatcagtgtctgtgttaacgtacagactacaacatcatttggaaaagttttccaaattcaaaaatcacaataatcttccaatgcacagcgatttagactacttttttttgctgacacataattattggtcaataactgagtattgatgatttaatttttttctttgtcatgcaacaaaactggtacatgtagattcttttgaatagcatgtgaggtgctagcatttattttaattctttaatatttatctttatgcttataatagttaaccatgagaaagtaagttttctgacatcaaaatgtgcttttgtataatgactaagagaataatataatctcatctattgtaagctataaccaggggaagatatattataataaaaaataccgagacctatgagactctagaattgaattggaaaagtaaatgctgtaatactttgaaagagaaatctctcagagtattcaagaaacttcaggaaaaaggtaggacttgattcagattttaaagaagtgtagaattttgaaagtctcaaataactgcagtaaccatattaaaggactgattgatagtatgaaaaaccctgtgaaaatgctaccaaatgcagtgaagatggaaggaagaaggtagagaatgtgcccataatactggattaacagcagaaaagattagaagttaacatggggttagagttaggaagcaagcttagaacatcaggcagaaaaatacttaattgatgatacaatacacaatagtcgtcggtatgtttttcagcaagtgtaagatatgataaaacctgaatttagagattagatggctaacatttaattcttactaagagtttcctatatactagttcacttaatcttcaaaaatatctgtgagaagttgctgttattttactcatcttacaggcgcaagtccttaaatcaacttgccaactcacctagccaatagggaaagaagtcattctccaaatgtaagcaatctgtaggaagagcctagatgaaaaacctggccttgtatactactctacagcagaaaggttgcaaagtgaggataccagagataggaaaacaaacaaacaaaaaactgtaggatatgaccactttcaaggagaatataagattcccttttagaaagatatttgcataatctgcacattatataacaaaaggcacactggtctggcatggttgagtatatagaaaaaaaaactgatagataataggatgaaatggaagcttggagagacagattaaattagaggagtaaaagcatcaaactcaagatgtccagtgagttattgatagaaggtatgtatataccttacaaagtaaaacagaggttttataagtgatgttttatgaacatcagtctgtgtttcaaaggtcagagttcaaatagatttgatcattgctataaagattaaaaataaaactaaacagtagatttacttttagagagttttaatggagagaggaaaaagcagaagaattattacagaatttgtaataattcagaggcaggaagacaaaagtagaaaaggaaaagaatgatcttatatgaagaaacaaacaaagagtacaatcctagaagttaataggaggccagaactcaaggaaagaaagcataaaatgttctcaggcagatgaaaattaagaaaataatgattagaacatggtcaccaataattttgaaagtatactttgagtagggtaataaagaagggggaattaaatcaatggagtgcttttccttcttgtttttgaaataagaattatccgtgcaatcttttacaaggaaaagagaagattcagacttcctagtgtagattcaaactcaaggaggtggtacaacagagactcataaaaactgtcaaatgacagtgcacattgtaagccccctacatgtccatagactaagactcatcatcagaatccttatattggtcaagatgtatggtacatttaaggctaagcttctttttgctctcagattcctacacaaccatgttgaccttgttaatttagtcatatgaagtaggtggaatattgtttgaatagactgtttcttttttcttcagtttacagactattttttaaatgatattggcgtatgtatatctttggcatagagtaggagtcaaatatttgaattttgtgtaaacctagagagccaagtgtcttactgctgcctcagaaatacttagagtaatgctatttcacaaacatatgggttttggtactgttgacttcttatttgtgtaccattaaaactcatttaatattactttgtttagctgactaatagcaaattaagaaagctattgtatacaagtgatatttggaaaaaaataattaaacttcttaattgagaatgatgagaaaatcatttcatatttagtgtagagttgcagtgctgtgataccttccaattctgaaagatgtcattaccatttgaagtagtctaaaacagtttagcaagcttatttgtactttatttttgctctttattttcaagggatgtctctggtatcctcatgctttttatggattatagctgcaatctttcttaccagtatttttgaccgtgattcttaatagagttgtgtgcagccagcaagtttatgcagtctttcaaaaaaaaaaaaaaaaactaaaaatcaatagcaagagctgccatgaaagtagaaactaccaaagcactgtggaaaagggtcaaaattctaccaccatttacaaaagataatttatcacttgacattattaatgtcagttgataaaaagtttagtgaatattgtataacataacataggtagttgtatgctaagcagattaatgcaggaacagaaaaccagataccacatgttctcacttgtaagtaggagctaaatattgaatacacgtggatataaagaagggaacaatagacacctggggctaatcgagggtgggaagggggaggagagcggaggatcaaaaaactacctatcaggtactatgcttattacctgcgtgaagaaataatccgtacaccaaacctccatgacacacaatttacctatataacaaacttgcacatgtacctctgaccctaaaataaaagttggaagaaaaaaataaaatttaaataagttctatagttctaactatagaacaccaaaaaaggaattataggtttctttgttcctgttagagaactaatattaaatatcatcattcaattataccatttttccttctcccattcttgaaaacaatgatccttctgtagcttgtaagaaatgccttcagacaaaataaattgaaatcatgattcattaaaatggttatacatggctgggcatggtggctcatgcctataatcctagtacttcgggaggctgagacgggtggatcacttgagctcaggagtttgagaccagcctgggcaacatggcaaaaccccatctctacgaataatacaaaaaaattagctggatatggttacacatgcctgtagtcctagcttttgtggggctgaagtgggaggatcccttgagcccaggaggttgaggctgcagtgagctaaggtcgcgcctctgtacttcagcctgggtgacaaagtgagaccctgtctccccccgcaaaaaattatgtttgaattaatagtccatattttaaacatataatttgtttatattacctttataatgtatgcttctagtatttccagatataataaaataatttgtactttttcatagtatctaaaagctcaaaaataaatgactaaaaatattaaagatggtaaagtttgttttatatttaataacgtaagaacaacccaaaatatttaaattaaaatagcagtataaaaacgaattaaacactatgtatatgtgcatatagctgtaataacaaatgtcacttaaagacaatgtttcaagaaatagacaagcatatatgtttcttctactagtccaatttaatatcaacatagtttacttttcatgccaaacacaacatagtttacttttcataccattttaggtacttacataaattcttggaggctaatttctaggtttcagaaacatattaaagcttactactccaatacatttcacctaattttattctgggttttagttgatgatgatgttctgaaactaaagccattttcagattctctgcataactgtcactacaattctaattcattctcaacttacacacacttgcataatgcaaaaacattagaatttcttttaacatggggaaatgattcgttttaggcccaattacaagcaaatggtagcagctagtgggaaggatggaagtatgcttctggtttttaagaaagtttttactttactagaaagagaaatattaaaatgattaaataacagaaaaataattgtcacaggatattatataagttattggcacatgactggcttagacagtaaatgctatgaaccaagcaattaaagcagaatggagaagtaaatggtattagagttcttcctctaaaggatggatagaatttgtaaaatactaatagctgacatttattgaatgtctggtttgtactaacactgttctaagtgttcacgtttattgatccccataacaacctatgaggataaatatttaagccacatgaaaatgccaaaattcaactttttttgattttcaaaaatactaagtctatatggttcaatctaacattactgttataatttcacagataaggaaagtgaggtacaaagaaattaaataatctgctcaaacttcaatgatgatgattattattaagtgatcaaactcatagcatctaatttcattgttggccacttcagtctatgctttagggaagaagccactataccttgttagggtggggatagggtaaaaaaatctaactcgtagattaaaatctgctaaacatacttctgtctcttggtagaaatgtgtaaagtccttgaaaagtgaaacaaaatattttctacatttgtactctactccatgcgtagcaaagtatgaagggcattttaataatgaaagttgtcagttatgtagatgattattgctgttgcatgaaaacagtattcaagtgagtgcatgactacatataggatattaaggtcccaacaagcatctgttttcaaattaatgtagcagaatagaagtttcaaggtcagtgctttcaacccagctatagaacatgctatgtgagagtcaccaggttgaaatccagttgttgttggggcttggtagtctgcatgcttagagtcagggacaaatacacacatacacattagccaagtgagaaaatcttatatcactttttctgtgtacatacttaccagctttgtacttcaaatttagtaaaatatttgcaaaatagtctagacagtccaaattcaatttaaaatcaagttcttttaaattcacaaaggacataacatcttttgtttcttgtgacatatttagtcttggtattcaaggagtgactacaatttaatacatatagtagtggtagcgtcagaagcatattattactacttcgactacttcaatatttttctctatgtctctaaacaaatcatgatgctatggaaactatataaaattgaagtgaaaggacctgatttttctattatctgctagtaaatttgtcacataacattgagtcagacatctcttttctctagaacccattttccacctctaaaaaaatggacggggttagatagtcctgattctaacagttgataattcaacacattcatttcaaccctgtgtttcacgtttgccttatttgtcgctagagatattttttaagggaaaagtgatttgtggcctttagaaaaaaaggtctcatacacgtacaatgtcttttggtgtttagatggacactcattgtagagttaggaaggcattcaatcctgtcaagcacattctgtcacagactctcttcaattctataagagtttgttgagtttctttcattaagagatattaggtcggtacaaaagtaattgtgatttttgtcattaaaatcgcaaaaaccgtaattacttgtgtacaaacctaatatgtaccttgagaggcacttgatgaataacaggtattgtttttgagcattaagattctaatagtgtgaggagaataatgtttgtgtttgtgtgttctcccttgttaagtctcttgaaatggagaaatcaaccgttttcagcttctatttagctttgagcttcaacatcctcaccaaacatatttacatttagaagaatatccataatgctttaagcaattttgtcttaatattagacttagtatggaaataagcctttttgggagcaaataaaaagtttttcaaggacaatttgttgtaaaaagtaataaagattccatcactctagcaggtccaatgtaccccgtataagtggattacagcagcgtaggattttgaaattccattttaacttggtgcccagttcttctctaaggaattcgcttattccctacattaagcaataagtaaaatatcatgaagatatgaaacttaatttgacttctaccaactaagtgcagagggtgacggaaaaaaaaaaaaaaaagacagtcatagcatggtgtaaaggaggactagtctaagggtcatggatgaggatttttgtcatgaattcactactgtttgcctaggctgtccttgggccagccacctggtttctcagagcctcagtgtgatccactggaaaatgtgatcatgttcaatgtcctttcctaatctgtcattctgtgaagtggtgcttccaggtcaaggaaacaaataggtcagaatgttcctgtggtcattgttctctttaggctcattttccatgaaatagttgtattcctcttcctgtagcacactcaggttaagttggagctctttaacctgggcattcttcccaatacttcattagaaataccgcctgcttcaaaatcacctttgtttgcactatctactacagcgtaatagacttctggctcagagagtgaaagctgtggaagaaaactagaagaatatttatgttaactcccttattttacagctaatgaagttgaccctagggaggtttgatgactctccacccagtcccaaagctcctaaagcaaggaatcgagttcctaatgtaggatttttaattctcttattggtgtattttccacttgtctatctttaccaaaggagcatcagtgatttttagtggatttcacaaaggagtaataggacagcttccttgtcctgtttttttctttaaaaactacaacccaataatgatgagtgaggctgttgtaatttttggaaacatgataatgggttgttgcaaatatattgaaagttaggggctgtgtgcagtggctcacacctgtaattccagccttttgggagtccaggtcaggtggattgcttcagctcaggagttcaagatcagcctgaccaatatggtgaaatcctgtttctactaaaactacaaaaactaggtgggcatggtggcacaggtgagaggatcacttgagcctgggaggtcaaggctgcaaggagccaagattgtaccactgtactccagcctgggtgacagagcaatatcttgtctcaaaaaaaaaaaaaagaaaagaaaaagaaaaaggttagggaagccagattgagcaggattttgaagacacggtgtcaaatttgtgttcttcatgtagatatttttattttcttaatgtagtgagtgttaagtaccatcctctgaagtgtccaactcttgaaggaaaagaaaaagcttccaataccattagatttttcactcagtttttgtgttttgtttcatcagtccaacttaggggcagagaagaagttcaactcagtaagaacttttttgaacttcggtaaaatttgcttaataaattatgttgactgttgcaatattttcaaagcgtcactctaaagcttgccgaagggtcactttaaagtttgccttaaaatcaacagtcgtgtcttcagtattacacactgattctctttgtaaaaggctaaaaagactgctgtaataataatttgttgaaaacatttctgctgcaagtgtatggtaaggttgcaaaggttctcatgaatgaggtacttgggcttggtccttttattctggctgactcaaggctgcaaacaatcttccagaagtgcctgtacttactacaaagacataacccaaacttattttctttttcatagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacaggtgagtgagtccccacaaatatgagacactcttaccttgaccatgtatttctgagaagtcttctacttggcaaatgtcattgtattgaaatgtacttattattttcttgccaaaaatatactttaaaatatttttcctgtctgtatagaatcctaatctaagaatttaatgattataaggtatttattttgaaaaaagtggaagatatatacattatccaaatatttattagacaatatatagaaaagataaacagattttattataaacttaccagtatcaaataacttccctatgtttatgaagttagtgttttgttattgtggcatatattctcaacaactctgaaatattcctgctgaggaaaaaaaaatcagttttcacatcttaaaatttaaagcatattttaacagtggttctcaaagtgtagctgggccacagcaaagtgctgggccagctgcatcagcattaacagggaattgggaaacatgcaaatccctccaccccatcccagaccaaatgaatgaaagagttgaggcccactaaagagttttacaaatcctgggtgatttgaatacacaattttgagaaccaccgtgctaaattcatttttcctaactgcggtacctactcaagatttatattcaaattaacttctgggtcatatagatgtttacattgatctattttagtttcactcttatatttcctctagtgttgagacaatattttatatctttcctctgccttccctgatagtttaacacacttttgaacagaatcttagagtattagaactagaggaaatgatcagccagaatctgtcattttgtgagttaaaaatgcctgatccagtggatgtgaggtcacttgtccatgttcacacagatgtaggtactggtagctcctagatttttgtataccttttcttccatttcaattatagacactctgtctttttcactaaaaagggaaaaaagggggagattgaggtgccaaaaacactaccttaaccaaggattaggaatatatttatggtatccatatggaaacatagttatgttctgctatagaatttgttacctaaatgtgtattttccctcatggataatcacaactagttatacaccatgattagttctcatcacaaagttttgtatttctaatgattttttataatttgtagttttagcatcttatctgttttggttatcggatgattgtataattttccttcttccccaaagcattactatgcttccagattgaaaattcacacccaaaataaaatgaaataacaggcatggtgagggtggtgcctactaccatagcacatgacatataagccccagagggccttggtgcatgtcctgtcttagcagttttacccgaatcgggtgtctctgtgcgcatctgtgacaattcataattttgtcaatgaagacttagtttttatgggtacaaaaacatcttaccttagaattttcttcatggtcttaaagtttttatattattagcaagagtctatacaagtatcttgttgcaaagaatgttgttaggtgtaccatatatatatacacacatatatatatatgtattcataggtgtatatatacttatgaaaatctagaattcacatatgacctaaggagagtatcagcataattgtttaagaaatagaacctaagtgaactgagtaagtgtgaggaaagaaaatagttgttagaatttgagaactcatcatgattttttttgtttgtttgggggaagttatatttttcacttctgtttttaattttgtttattttttgaggcaaggtcttgttctgtcacccactctagagtgcagtggcacgatcacagttcactgcatcctcaacctcctaggctcaagtgatcctcccacctcagcctcctgagtagctgggaccacaggcgcatgccactatacccagctaatttttatgggttttgttttgtagacaaggtttcgccatgttgctcatgctggcctcaaactcctgggctcaagcaatctatgtgccttggcctcgcaaagtgttgggattacaggtgtgacccaccatgcccgaccatatttttcacttttaaatatattatttgggatatgagaaaacatattattgaaatagttctcctctggtagttgacagctgatctatattttattcttaaagcctttaacctatctctctaagggacaaaaaggggatgtgttagatatatttggtttgcttagagaggcaatggagcaaagactggagaagaacagttgcatttacagctaaattttagaatccataaatagctctttctgtaacaattttaaagggattcctgattatctgtaggtcatcttgtctcagcatgtcaccaaaatagtcttttattgtttgcctgagtgccttaaataatggaaaaacaaccagtaccttttagaaaaaaaattaacactttgatagtgcatgtgttgagctaaacatgctttttcataactaattataccctaaatccatctgacattggaagtatgtgagaatgtccctcctcaaacagaaccacaggctgtatttggccattgtctgctaaagtaagcttgattacactttgacaagatatgacctgaatcaaagcacgaaattgcttgggttgagatcttatgtgtgtttctacctacaccatctctatgaagatgctgtaattccttcagaatattcttagatctgtaattcattttttgagttactttgctttggaaagaatataaaaagtaatcttgagaaaagcataaattccttcccttgaccttataaacaaacacgttccaaaacttccatacagtctaacttttaaacaaaaaattcagtaattatgttccctttttaaaacaacattctaaaggcagggctgttttaaggatttttcttctagtgactgccatctactggtataatgttgtcagtacactttaggtaacgtgacaattatgttgctattgttttaatatatgggcatatttctgaaaattgaagtactttgatttgaaatattagtaatatgcacactaatttaaaatacaattgtcctgagtgctgtttcagatttttatattctttgtgtgtctgcagtacttcaagaatagtagttttaataaaattatattaaaaatatatttctagccaactttgaatcctctttttaaagaatctgagacatttgtttagtaaatacatttactgagaactcattatataccaggcatgatgcttagagatacaaaacactcataaacccctaccctgtaggaatttacatttttattataatggaataaaatgggtttttaaaaaattcagtccaattgcttaagtctttaccttggctatctactcacttcacaggcattcaaatatgacagtgcaattatgatatatatcttatttcttctcagtgaatatcttccacttgtgaaatgtatttttcctgtaataatcacccttcaccgcgttcctaaaatgtagttggtactttgcagcctagatatgttagagtcaggagattagaactagcaaaagtattcaatatacttgaggggctggggaagttagtctataacccttaaaaatggaaattatattcttatctctaattctcattaaagaagtcctgaaaaagggaaaaagcagtgctggataggccttgtattttgatcattctttctaatataagaaaatgtgctctaaatattcccctgctgaagcccctgtactttttcctccttatcctcaggataaagtctcgtttgagtattagatgcaactcttttatgtttgagatcttacttgtttcaataactttatttccactactctcctcacctcttactctgtaatccaaccacactcaaatatctgcatttcccaaaacatattatgttcgttcttatgcatgctaccatctgccgtactttacctaactaaacttgtatttgttacatagaccatttatgtagacttgtactaaaaagtgttttaaccctcacccctaccctgaccattctaaatctggatctggatctgttttgtgttttcccatggagtctccattataacaatattccttctctctcactattttaatttccagtttgccagtttaagaccccttctcgttagtttgctagagaccctggctgatttctcattttaacaccattgcttacatactatctatctggcatattctgtgtgttcaaaaatcatttgttgaatgaatgacatttgagatctaatgttcacatatgacaaatgttttgaattttgtttactgctgtttctttagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagtgagtagacaaacaacaaagttatctattttaaaatactctagaactcatgtaattaatcctatcattagaattattaggttttacttgtttttccatttttatcaaaacgtattcctatatcattattttgaatggaggcatggtcatttggaaagtgacaaaatcataagaatcgactgcattagaagaccactttatttttttcattattttttgtcgaaacattctctatatttaatttcaattttataacagattacaggaagatgcttaagaaacaagtacaacatttgtttcagtatgtctttaaatgaaagacttttaagtatgtaagcaactatataataaaaggtttccaaacgcagcctgtaagaaatcaggcaaattttactataagcaataaaccattccgagctttccagacagtgtaccagtagctgtaccagtgggcaataacctttaaccaaacaaaaacaaacaaacaaacaaacaaaagcactttgcaatttgttgctgcaaaatggggagaaaaaaagagtatataaacttgatggaatcacaactgtcaatataatttaagggaaaataaagtcgataaggttgatggtgtctattgtttggaaagtcgaattcggctatttgcttggggctctagagaccacaccactgaataaacaaaactctgcagagtctagctatccgccaacagggggtgccgtccaaattcatggcaaataaagggcatttggtgctcaccattcacaacaggcgggcatttatgtggatgaagtacaatttcttcagcaagctcagcaaaaactcttaaggggcaaatatgaactctgcattttaagaaaaatagaaaacggaaacacaaaatcctaaaaagtatatgaaggctctgcattagcacactggcatcaaaccacacatccacagcacatcctaattctatgggaaacaatccttgcttatcggaggtgcatatctaaattcaatagcttaccaatatattcttgggagtaggccaaaaggaaacagaaaacccacattaaaaaaagaagtttcttttcctaaacattttcctgaagctgaaattgaagtggagaggaagtcagttgtcctcgtcgaaatcgtagtcctcctcatcctccccaacctgggacaccggggtcttcaccctggagatgctgtactgagacctgttggagcttgtggccagcatttcatccgcaccattggtcaggtcactggcagagagcctcgtgccgttagacgtggaacctgccgttgtgatgaacacgcctgcaacaattgtctgcgccatttctgtcacgtgtggctccagcgcctttgggaccagacttatggcttttttttttttaagttctgggatacatgtgctgaatgtgcaggattgttacataggtatacatgtgccatggtgctttgctgcacctatcaaaccatcatctaggttttaagccccgtatgccttaatgcattagatatttgagaagaccactttaagtgtatcgttaaataaatagagcttaacttggaatgtcgtcttcttgtggctggcactgaggcaaagaaatgtaatcatctaggaattagacgaattgcattttgagttttggcaggatctggcagtaattttaaagataagctttaaaaagttttgtattaagctcaatattagcatttaatccatttatttgttaaaatctaatattgtattcttgtcttaaacagtgactttgtttttgtaggctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatcctgtaagtaccaaatatgaatggcaatattattacattttaatttaattaattcaatggcattggcaaggcataattttataatttagctcattagtcttattgctgatctggagacatatatcctaactttttaaaaagtccacttctcattatagcttcagctttcctagttgggaaattcatctgaatttaacaattaaatttaaacctgaagaatagatttaataaggtttctactcatttataaatacacaattttttttaaattagccggtaagctagtctgtaaatctttgagcactgtttttggcttttatttccctattcacataatcaagtttaataccatatttttatttgttttaaatatactcctcattcctccttttctagacctcttacaattttaatttatatttaaaagttagcctaatgttcacatctcaatactgataaggtaatagacttcattttaatgggatttgtaaataagaatttttagtagtccataatgtcatgaaatggcagcttgaagattaaggaaaatgtgaacttgatggtgtacttgattaccgcttaatgttttgaattacaaataggataagctaactactgaattggaagttggactatgacttcatttggcactatatgtgaatattatgttctctagttcattgttttacttttagatactgttaggattacaaggttatatatcaattataaatgaatgtagaaagccataatgaatcaaattcattctgattttaactcaatactcatagctctttctttggctaatgctttaacttttggatgtctaatttttatcattttagtaaccacttattatcattttagtaaccacttattaatgactgtaacatttagaatacccctagaaatcattgttcttataggtttgttcaatgtccctcacctcaacatagtaagaatagtgatcaaaatgccctcattggcttaattatgacagagtgctagagttcacatcatgtcagcttctgatatgtatcttctttgtcacagcatctagcacttatttctaggcacctttcacaatttttaaggccaataatttaaaaaaatgtattgcagatgtatttcaagtcatttgagtaaccagtgattgagaaatgtgaaagtgagttatgtattgtacaactttgaaaaaatgacttgtagaagtaacattttcccatacatatatttcagtacaacaatactgcagatggagtttataaagttttcaatggaaaagataacataagtaaagttgccataatcgacacatataaaggtaaaaggtaagtattctggtaaaatgtgcatgtatgttactagggtactcttaagcaggaatagtattcatttaacatctcataagacataggcatcaacctatagaacagacctggttataattcagctctggaaactcctgttctgctaggtattaactctttagttgtggtaactggtgagttcacaccagtgcatagctgctgactatcagctccactttaaggtttggttcacctttctgcacaggttatggttgtgttacataaatccccaaagggactattttttcatctctgctacttatccagcattacagtataattattcttacaattagataaccataaatgaaaaggtaaaaaaaaaaaaaaacaacacatcaactgattgtgtagtagatggaaactttttttttactttttaaatcgagcatatcgaattccatattccagtggcatgacctaaatgtgtctataaagatggaagcttaatgaatccaggcaactgctttcatgaccttccccctgcaaatagtctttaataattttccatattgataactcagcttttttaactttatcaatgcaaaaatagaatgaatatttcaagtgcagttctacaatgtaaatacaaaatgtgaaaatgaagactttgccaactttaaagtggtaaaataacaaatcagcttcctaagccattatttcctttttttttttctagctccagcctattcacctaaagaatttataatttatcatatatgtaaactaggaagaaccctaataaatatcagaggaacaagctttcttctccataaaattaacaattgtgtgtttgactagtttttttctgaaaaagaataaagtgatcaaaaccaaaagagatgaaatgtttttattaatataaagtaacccctacctcaaactgagtctatctaatgattgcttttaacagctaaatattactagtggagtactttttcttctaaagagtccacagttacatatttttatagaaaaagtcagtagagggaaaaaaacacttctaagtattcacttaaaaggaaatcacagcaattttttatattgagaaataacgagcatttcactctaatattacagagagatgtggaggggagttgcaaagcactcctagttagagtaagaatttcacatcattttaagattgtaaggttgatttaactcatggcaagactgaacatgattaaccacttattttgtttaagcaatggcttgtcttgacatgtcactgtcaggagtggaaaaaaagtttttccatcaccaaaaagtgaggatgcagggaaactattactattgtttttatcacttccagatatatatagcttatttagacagcaaagtataagttagtaaactctttcctactttaacgccagtccatgggagaattaaagggaggaaggggcaagaatataaattaatcatctacatgttttgaatgtttgctgatccaaacatctgcttctttcctcttccctgcttctctcttctgcctgccttgtacttagcttatatcagttacccacttaacactttccttctattcattctgaacacttatactactgagtaattcatgtatcccattggaaaaaaaaaaatttcccctaagtagagatctaagtttctgataaatgtttttaatttttttcttattccaagatgtttctaattaacacctggcagtttttattttatgatctggctacctaatggcatcaggtacattgcaataagataaaaggttcaaacaaaacataaacagaattgaacatttcttaaacttagtacttgtcacatttaaatgcatcatattaacagaagtattgaattataatagaaaaagtaatgtaagaaaggtattctttaaataagaatgtttattcattgtctttttctattcctaggaatctgtcctattgggaaagtcactgcgacatgattaatggtacaggtaagaatatttgttttgtggtcatcacagttaatccacctccctttcccacaaatccaccgttgtactgacagtgttctgaaagttgagggtgtgtgtttacttgcctttatatccccacaacaaaattcagagtcactatttgtatataggctaaaggtctgttcaatgtgatgggatttgtaaagattaatcataaaaaattagcccttactgcatgattcagagaaatgtttgctttgtaaaaactttactgccatcctggcaacagaagtaaatggtaaaaaacaaacaacaacacaaaacactttagttacatttcaaatattttataaatagtatacagataagttagaattgaaagaattaaaaaaagctaattacaaaatagaaaacatatctaagcaaggcttatagctgagatagaataaagttgcaagacagaaccatccatttttggataaggtggtcagaatgagagagaaaacaataacaaagtcagatgtcttcttaactgtgaaaaatatatgtaaaaaatgagcattcataaacttagatttaaggtatggttagatcaggcttattctccttcaggaaaagcaaagtacagatatgcctattagtttaagaattaagatttttaaaaagcaatgggaggctggtcacagtggctcatgtctataatcccagcactttgggagaccaaggcaggtagactacttgtgccccggaggttgagaccagcctgggcaacatggcaaaatcccatctctacaaaaaaaatacaaatattagctgggtgtgctggcacacgcttttagttccggctacttgggaggctgaggcaggaggatcacttgattccaggaggtggaggctgcagtgagctataattgtgcctctgcactctagcctgggcaatagtgtgagaccctgtctcaaaaaaaaaaaaaaaaaaaaaagtggtgggaatcgaataccatgaagtaattaatatccagaggcaagctttcaactactaggaaacaaaagcatgaagtttagaaaattagggaatatcccataggaaaatgatataacaaagataaagacacttaagtaaaaatgaagtacagagaatgtttactttgccaaaggtatgattattgacttcgtatgcgtacttgattctatcattgccttgtaggaaatgataaacaaaaaaagcaaacaaaaaaaacagcaaaaacactgttggatttgcaggggttttcttttgtttttttttttttttttttttgagacatagtctggctctgttgccaggctggagtgcagtggtgcgatctcggctcactgcaacctctgcctcctggggttcaagtgattctcctacctcaatctcatgagtagttgggactacaggcatgtgccaccacacccagctaatttttgtatttttagtagagacggtttcaccatgttggccaggatggtcttgatctcttgaccttgtgatccgcccccctcggcctcccaaagtgctgggattacaggcttgagccaccacacctggccaaggctttgcagggttttgagccataggagtgggcaaataagctattttctaagtaaagcatttctggaaataaattttcaagtcctcaatactaccaatgctagtagttgtataagcggaatacttagtccttagatgcagagataaatatactgtgttaatcctagtaaaggattctttaaggagaaaaatctttaaaaagaagattcattgacaataatagaaatgcatgagcatcaggcatgatgttaaaaatatctatggggaaaatagggctgatacaaactaggaaaagagggaatttggacagagcaggggatgatccctgtgagagagattcttgcttatggcactagcgaaaagaaagtaataaaacagtaaggttctaatgtgttttcatcgtaatttagaagtgcatcctctttaccttcttcagtaagtttgaaaagacttaaaatgaaagtattggtatacatttagaatgtttcttttgggaggacagaaaaaaagctctgcaaatatcaactatgttgcagtcattgtccatggtagttgctgggtataattaggacataatcttcaatgatattttagataatgatcttaaaagcttttcaatgcatttttctttaattattaaggaaatggaaaagcagttgttgtcaatgtccatatgggggcttatattttacttgtcacaagagtgtaaactaatgaaaacaaggtcacaaggttgacacacttgccagagaaagaacctacaatgcataatcaaagatgagacttaccatttaaaactcattcaatgacggctcgtattagtgatattcatgtgagaagtacatggaggagttaactatttcttcatatatccaatgtttgccatggatcatagctgtagcaaaaagtaaattcaataaatgacttttttatacactttcaaagcatttgaagttctgtttagtgagagaactttagtaaatatttttagaagtagtaatcagccattaggacaaatgagaaaaaaaatcactacaaataaatgtggacatggcaggagatccaaatgaacttcactggaagaaaagtgccactctactggtggggtagggcatttcaaaaaacaaacacaatgttagccttaacatttcatgtttaagtttcttttattttgtaccattaaatatgtatagtatgtagatttgttgttgacaatagcagccgccagccatatgtaactgttaaggactcaaaatctggctagtatgatttgaaatgtgctgtaaatataaaatgcacagtagattttgagactttaagaatttaaaatattttataatggttacatgttaaaatattttggatattaataagttaaatatagttttgttttgtttgagacaaagttttccacttgtcgcccaggctggagtgcaatggcatgatcttggctcactgcagtatccgcctcctgggtgcaagcaattatcctgcctcaggatagctgggattacgagcgcctacctcaggatagctgaggcaggcctatcctgcctcaggatagctgcctcccaagtagctgggattacaagcacctaccaccacacccagctaattttgtgtatttttagtagagatggggtttcaccatgtaggccaggctggtctcaaacccctgacctcaggtgatccacccgccttggccttccaaagtgctgggcttgcaggcatgagccagcatgcctggccggttatttctttttaccttttaaaaatgtggctgctagataaattacttaggcagtttgcattacatttctatggactacactggaggagagatttctaggtttttttctagaacacacattacatctaatcatttgccactcgatttttaaacagatgcagcctcatttccaccttttgttgagaaaagccaggtattgcagttcttttcttctgatatttgcaggtaagacagatactgaagtataagtatgtctgagtcagaccccaggtgacaaaatgcagaccaagaaacttaaacacagcataggaaattcatcatgtttattaactaactctttgcaaaatgttcttctgcatcttccaatttttaatagtacaaattttttttttttttgccatttctatctaagcaagaaccattttgccttttaaaaactaaactagtagtctattaacgatcaagtccagaagggcgtgcccaatctttctaaagacatacagagaagatgatgcaaatgtaacagaactgtgttaatgtgctctgctcagatttgtggggcccagtagataacacacaagcactggagcctttaccactacccttgagcccaagctctgtccctaaagactgtatgcttgtgggtaggcatttaacatctctgaatttttttcttatctgtacaatttaagacagcagtatttcttcatatacgtgtatctggggataagaaaaatatgtgtattgaaccctatgatagacacttggtaaacgatggaaatgtaccaggtatatatccagcatgtatatgcatacactccagtgagtggtctttctttccaggattaattaagccgtgaaagaaactatttcatttaaactgatcacaaataaagtatttgaaggaagtcctataaatatttactctattggataaattgcctgtgagaagtaacttgagtataaataaacatggtacttcacaaacaagaatagttcatgcttggctattgagttttagtatgtgttaaaatttcccaatcactttttttctaagaatgaaacaagaatttaaaagagtatatgatgtttctaagttaaaacaagaataagaaaaaatgaatctccagaatgtaagttcaggttcctggaatgcagctcttttttctctgtatttaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaaggtgagtaaataacctcagtagcacagtccataccataatttgtgatattctttaagatgagaactttaccataatcctttagcaaccaaaatttaaaatatatcataatttgtgatattctttaaaatgagaactttaccataatcctttagcaaccaaaatttaaaattaaagtaagaaagtaattagggcagaagaaagaatggtggcagaaaattttagtgctgattttgtattttgggaagatcccacttgtgtttcagtattacaaaatttagttaaaaccacaccagtatttccttgtggctgcttttagatttagggtgaaatgaaaataattccgagaacacattaaacatcctgttattcatctgtcctaacttttttcactagaaaatggtacaggtaaatgtattttcagtatgtatctaaagctagagttaaacataaaatttggagactagcttatcctgtacatatttatcatactaacgtgggtgtggaagaagaaagaaaaaactagtgttaaataaattcttagtccatagacatattactgcctgaaagctttacatattgaaaattaatactgaaggagtttatagtagaaatcaactgacataattcttccccacccatgttaaaaaccatgtattttttaatgcaagaagctttagttttgtggaaatattttttgagttatatgtgaaatgaaggaagttattaattccaattgactcttaaaacttgtcttcagggagacctgtgtacatttcacttcctcattttctgtatgcaagtcctgatgtttcagaacctattgatggattaaacccaaatgaagaagaacataggacatacttggatattgaacctgtaagaaaacaccttattgatctgatttggttgatatttttaaaaatacaattgaaataaaaataatcttgtcgatgattatttattcaataaataatcatatttattgaatcacattcttgaaagttactgaaacttaggtcgatttcttcctatggtttatgaagtgattctaattggcttaaaataattttatataaatatttatgtttagatgaggagttattgtatattatgcaaaagtcaaagagtatatgtgagtttgactatacttattgtcaaaatctataaaattgttgtagcgcaacagttttaatcatctttatttttgtattttccttttcaaaaagtaaatgaaattctaggattttagtagttatgttttagtttaaacaatgacacatggattctaactgaatatatatttgaccaggaattatctgagatcttatattttgttgctgatttttgattttttaaaaaccatttcaagtaactcacaaatctaactaactaaaaccttgacattcgattgggcaaataaattgtgtgtatctatatggatgcatgtgtatataaatataactatatatgcagttttaaaagtttcaattagtcctgtttaaccttaagttactaccttctcttctgctgtaagaaaaataagttttgaatagtataaaataatgtttttaaaagttggtaattatttagttgttctctttttagataactggattcactttacaatttgcaaaacggctgcaggtcaacctattggtcaagccatcagaaaaaattcagtgagtctcttgaaaatggttattttgatatgatctgtagtatcgtagtatcttcttgtaagaacatgagtaaatctatgtaagtaagtggaaataacatctgatatcaacttatctttagcttaatgtcaccaatcattattaaatgcttatgactaatttcacagattttggaatggttttatggttttatttgagcatttgatagcatctcttattttgttagctgcccaaatatttctatgacaataattaatttttggaattcatatttcagttccccgagaatttattgaaaggaaaaatccacacttgtgaaaaaaaatcaatgtgattagaagacatataagagcaaaggaagtcaaaaacaactatattaaaatttaaatgagtcattacaggaacaaaatcaaattagcaacagcaactaatttatgaacatttattttaaagtttgttatatataaatattagtttatatgttcataattattttcaacgtatattacagagtattaaagaatctgaagaggaactatattgtgcctattctttggcttaatgaggtttgtatttgcagctgttagtcattaaaaacaaccttctttgtatataaacaagctcttgatgtttcaaaagaatgtatagtatttaaagctatatgtatttccattacccatatggatgagtatacatttatttaacctatttgagatgatccaattgaacaaaaacatttcctatcatttaagattttcttcaaaaatgcatctattaaacacattttcttgttgtaacatttgtcttctattgcctgacaaggtatttttactataaatccatgcattgatagctataaaaataggaaaaacattgaataagtctttggagcaaatgaaactgttgaccctttgatagttctgaagagcaaatgaatcctagtacattgaagagtaccgtactctatctggcacttaattgcctttcttgacttgcaaaaggaattccattaacttgccttatagatactgatgactaacaccaatagaggtgttagaaaaaagggtgataggcaattgaagggtttattttgttttactaacgtacccaaataatgttgattattaacttgattacagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtccaaaattgactggttcatttctcaattatatagctagttatatattatctgatacttaaaaataattgactaggaaatggtttcataagaccaggattgctgcatgtagacatgctggccgtgcattttccaaatccagaaaagtcctgaacaaaaatttgaatataatagtatcaggaaataggggaaaatagtgttcaacatagtagaaccaagtactcagagtggtgtacaagagtttaggcctctatgctttagatattagtgtccatgcactcttaaagatgaatgaatgcctgacctttcctaaaggaaaacctttttttagttatcacaggtaacattggtgttgcctgtgggggagaattttttactttctccctatttttcttcagcccacctcaaggcaatgtaaataaaagcagtatgtgtgttataataacttatttagttgtttactgtgtgccagtaccatgctaaagaaagattctttatctcacatgatccctaatacaatttcatgattttccaatagcctggattcatcagcatccattctatcttctagagatgttccatgaaatcatacattttaattgtttgtgaccaaagcataaatcagtgaaagtggaatttggggaccaataatttccttttgtgagatggagagcttgtgtttgaaaaggcaacctaatttttggttctaatcacttctaccactatttagtcaccaaaaagacaataattctgcatccaaactatttggacagaatggcttcaaaatgctagcctaaaatgttcacattataaaaagttaaatattaccttcaatacctgtcagtagcctactgacaaattatgactaaacaaaggtatttgtatgactatgtaatagatcatccgctgaaaagtaaaacaaaataacaaaaaaacttgtcctaatgggaaagcatgcttaataaaaggaaatgcagaagttataaacatgttttgtaagtaagtattcagaattaaaattatgtgatacatttttatgattgcttaatgatccttggatgtcagattccttgggtctatttatagctaaattataatgaaaaattcaaggcttgctggagcaactttgtcaacaaatatattagttttgcttatatatttgatttttatgtggaaaaattactacccttttttacaagcagagaataaactgttgattacttgatttactagatttagaagaatcacaaaagatatgtagattttcttaagcaaaattcagctcttaatatcataaaaattatatctttgggcagatttgtaaacaataggaacaagtaagaagacaggtatgtaagaagtagcaaagtgtaagacggtggagctttaatgtgtggttttactcagggggtcacaagaaaataacccaatggtccttttgaaagtagtacatacacctttaaatggaacttggtctgaagggtgtggaaatgctggtccagggcagatgcacttcagctaccgttccttgcctggtgtgtgcttgtcttgaagcacccttcttatgtgcctttctggaatgggaatgtgttttgccctattggtgaagtccgttagagaacttctctctgcagctagagaaactgaactgattaataaaaagtatgatatctaagatatactgccactctacaggtagtaaatgattcttcacatttgtgcgccagctacatca

SEQ ID NO: 17360 - DNA, 12225 bp, Human
  misc_feature (1)...(12225): n = A,T,C or G
acggagagatgggaaaagnnnnnnnnnnnnnnnnnnnncgctagatatttgtgacatggagctccttgactgtgtttgaagtccttgggagggtggtctacagccagatatttttcctgctcaagcccacacagagtgaccaacttccttgatgcttctgtaatttttgtttgttttgtgggttcatgtgtagccttaatgtgagggtctgcatcatttctttgggtccagggtctccccagctgtataggcagctgggtttttgtttgtttcttttaagagacagggtgtccctgtgctgcccaggcctggtctggaattcctgggctcacgcaatcctcctgcctcagcctcccaaaaagtggggattacaggtgtgcacccccatgcccagacggtagccggggtgtgagctgaggctccaggcgcaggcaggtgttcaggagagtcgtgctgtgtctccatcccccgtagccaggtgggagctgcagctccaggggcaggcaggcctgggaggcaggtgttcaggagagtcatgtttccatccctacccgacttgatttctggaaggttccctttgctgggaggtgcagcccccttcagacctctttaatatggaatcccaggttcagttctgcctcacagggaccatggcattgtgtctcgaggtttcccagagcggcctggggctcattccctcgcctcccatccatgcacgtgttttagtcttgtgaggattccctgagttccttgcggagcctgtgtgtggtgaggtgtctgagtcctagtgtgggtgtagctgggggcttttccagatgactgtgccctgctggtcgtgcatatgttgctacgtcacactgatggagggagagaaaacttggaagtgtagtagtggcagggctcagcctttagtgctagaaaaggtgttgatacatggggagctacctccccaccggagaggaatggcctgggagccactcctctgcggagcccttaccctggggtgcagctcacccagcatccttccctgctggtgtgtggtgcgcagtgggtcctgcacgcaacagcatcgtccacacacactgcacacatcgtggaatggtcgtatgaaaaacagcccctggtccacacaccacacacgtcgtggaacggtgcacgtcgtggaacggttgtgtgaaaaacagccactggttgcacacagggttgtggactgttgggaagaaacatcgatgctgtttctcacatgatttttcatcctgtggattttcatttaattgtaacatatttctgatcaaaccaggagtagtcttattgcagtcctgtattaacctctgttcttgaaaagagaccacgtgatttatcattttctctgcagcagtaattcacactgaatttttctatgttttttagccatattgcaactacatataaaggtagttatagattcttttgtatttggacctggagttagactgaaagcaaataggacataggcgagggtctgtttctaattaaagcaggttttcctgacagggctgttccaagactccaccagtgctgtgggccctggagagtcagagggtcagctctgggaattagattcgcgttctaggccgagacccaggagccaggggagctggggccacttaccttccccgtgcctcggaagctgagtgtgaagctctgctcttctttctgtcgtggctgcggctggatttcctcacacatcccattgcacggcctgcctcacagctgcaagtgcaccttctcctgggacttagggggtcagggctgggggacaatcccccacacccccacccagggcgaaggtgacaagactttaagggatttcaccccattcacagacaggcatgcattgcccagtccctggttagtggtcagcagtggggccccgccaggctctgagggctgaggtctggtgggaagcctcaagtgagtttgctgcaactgatcttttgctgcttgaccgttcctctctgtctcagccatgtttgaccgtgagaacaaggccggcgtgaacttcagcgagttcacgggtgtgtggaagtacatcacggactggcagaacgtcttccgcacgtacgaccgggacaactccgggatgatcgataagaacgagctgaagcaggccctctcaggtttcggtaactcactcactctggcttgtgtagcgtgtttcattttggaaccttggagccgttgaagttctttaaaccttgttggacttaactgattgtctaaccaggctacgtaaagtttttgttgacgtcatgcaggttcatatttgatattgctcatgtcggaaggcgatcctcgacatggatacgtttattcaggtttttatccaaaatgagataagggctatgcaagccgttcatcttttctgaagtggaatgatgtcgtgagcaaaactgagaatgtggcttttgaaatcatttaaaagtggatccatgaaaataccgtggggcagggcagcttatatttcatgatagatcaaagcacgttgaaaaggcaacagtcacctaagaaacagctgtcagtcaccaggtccaaaccgtgcgcctcagaaggggcgttaggcagaacgcgtgcccattctcaggtgtgctcggcgtgtgtgtgctcggcgtgtgtgtgctcggcgtgtgtgtgcacacgtgtgccgtgcgcctcagaaggggcgttaggcagaacgcgtgcccattctcaggtgcgctcagcgtgtgtgtgcttgacgcgtgtgcacacacacatgtgacggtgtgccgtgggtctaggagtgttcacagtgcctgtccagagtgcgtccatagggcctgtccacggggcttcccgtgctgctctcagggctgagaggaagcaggggttttatttacagaggaacaacgggcatgtttggggccagcctgaggctgttggtggctgcaccgagattctaatccatgcggatctcatctggcccctgttgtgaagccgcttccgtgatttgcttaaaaggctccttagaaacagtgaggaaaattcgattctacttgagtacctccgagatccctggagtctcacttatctaagcacgtcgcctctcctcgtgtttcctcccagcatgcactttgtggctgcctttctttctcttttctttctcaccttacgagcttgtccacagggccgggggtggacactgggtctcctcaagaagcagttctgagctgaccagctgcgagccaggatttgggctggatggctctgaattggtacttggaatgcagctgaccttgctgtgcccttgggtgggggaactggagggaacgctggccggctcctcttccctggggcaggtacggaagggctgggagggaaggatgccaccctccacagagagtggtcctgggggccagggaggccagtgctgccgattgcggccagggccacgtggacttcaggaccggcctgaagttatttttagataagcgacctctggcgccacggacatcttttcctaaccttgtcaggccctggagctccctttgtccatgccagtgaccatcggtcctcagaatgtgcagtggaagttgctgtggacagtgctccctggtctctgaggccctcttcgtcctggtctggccaaggacttcccagaaaactgtgcttagctgtggcgggaggcacggccggtcacgcagccttcctcccgccctggagtgggcaggcctgcttgtgttgtgcagcggcagaacccttcctgacttccaggtttttcctggggtgcggcatcccatcgcagcattttctctggttaccctcacgagtttcctcctgcgtttggttcttgatctccagggccatctcccacgtcttccttggaaaggggcattgtcatcctttttgtattttgatgattttgaaagatttcccatagtaactgttaggaagttggcctcagaagcaaaaattcttcttttgtcttggcccctgtgaacaagtgttctgctctcagatgaagcagggaggctgcactggagcttggtggccagcaggagggaatcaccagggtggtgaagcctgcgagatttctccccgggtgtctctgatggggccacatggtggatttcataatccaccgattcgtttttttaagcctttattgttaacatcaactgtgtgccatgctcagagacctgaagtgaaaaggtgaggaaggcgtgctcacattccagcactcaccacccggcaccgggacagctgactcagcacgtgccgtttaggttgctgtaaacagccggtgagattctcccctctggtgggcagtgcgtgtctgacaaaggcagtcgggcggagaacagttcctccgctgtggtcctttgccactgtaccaggcccccaagagctggggggagccccagggagcctcagcctgttgagtgggggcagctggtttgtcctccgaggtggaagaggtgatttctgaggaggtcatgctccgcttggctcgttcacagcatttcagagagtccgaaagaggagaaagaccttggcaaggggtgtgtcaggggtgggcccagggacgctggtggcctcatgtggactgactttcatgaacagaaactcagaaacagttgcttctggattttggcttctcagataaacattctttttgtagttcgtttgttcatccctcattttgctgtctgactttgcctttcttttcccttcactattactgatgaccaaggaaactggaagttaattccagaggcagtggggttgctcctgttgtctgtgcagactggagttcctctgcctctgtcagcatctcctctgtccttccccagccttggcaggagaccagtaatgacctctgtccccgtgcaccccagtgatggccgccgtccccgtgcaccccagtgatggccgccgtccccgtgcaccccagtgatggccgccgtccccgtgcaccccagtgatggccgccgtccccgtgcaccccagtgatggccgccgtccccgtgcaccccagtgatggccgccgtccccgtgcaccccagtgagggccgccgtccccgtgcaccccagtgagggccgccgtccccgtgcaccccagtgatggccgccgtccccgtgcaccccagtgatggccgccgtccccgtgcaccccagtgagggccgccgtccccgtgcacaccagtgatggccgccgtccccgtgcacaccagtgagggccgccgtccccgtgcaccccagtgatggccgccgtccccgtgcaccccagtgatggccgccgtccccgtgcaccccagtgatggccgccgtccccgtgcaccccagtgatggccgccgtccccgtgcaccccagtgatggccgccgtccccgtgcacaccagtgatggccgccgtgcccgtgcaccccagtgatggccgccgtccccgtgcacaccagtgatggcctctgtcccccatgcactcccagacaggcaatgtccctgtgggcctgtcccaggctctgttctcagcaggctgggctcagccctggtgcagggagtgaggaggtgggagtagtagggaccagaaaaagtggcagctgttgacaactctgccatctctttctgaatgtaatgggaggtcctgtcttttcagcttgcaaggaaggagggtccgaggcaactccgctgttgcacatttagggacccctgaacttaaatgacagaatgccctgaccactctggaaggcactgtgttcatgtttgtgtgcttgactcttgatccgtaaaatggctgtttgtgcaggtcattaactgtgagattcagagagtaggtgcacacgtccctgcagagattccagcaggactgaaaaccagtagaaatatatcagcacctggatcttgcctcctgagtcagtaaggatatgccacagtcacgaaggcagtgggatttcgagggagggaagggaaggcggcaggcggggcatgccctccggggtgcccgaacacacctgctgcatccacatgtcttcagagccctctccctgtgggaggcctttttcaggacagccttggtgaactggaaacggaatcccagcccttggtggccctgcagtgacttggacctttccgaggtcaccctgccactgcgtgcccttcagtccctcctggcaggtgggggcacatcccccagccactcccatttcctgacattgtcactttgtataactggaagccttctgtgaaattttagttttcaaagcattatctggtgatgggcaacccagggcagcgaatcattcagaattttcttatctaggctaataaacataataaaatcaataaggactttgaaagtaactccactgggttcaggaaactgagtgtggccgccctgtggggtggtgtttggtgagtgcttcccggaggtgagtagttaattcacaggagtgactaatggcagcgtcccactcactcctccttccggggtcatggtctcaaggggtcactccatgcactggggatgtcagctcattacagaatgatatattcgggaagtgtctcagttctgagtgcctttgagggaatttgcacttccgttcccacacagccttgcattgtgtgtgttagaggctgtgggccttgggcaggaggggtgagtgttggcacatacctcccgtctctcccagccttctctgactctgactttccctcttgaaggctaccggctctctgaccagttccacgacatcctcattcgaaagtttgacaggcagggacgggggcagattgccttcgacgacttcatccagggctgcatcgtcctgcaggtgacggaatggcttcacgtgggtttgtggtggtggtgggaggggcttgcttgccagcgtgatgcacctgaccttcaatctaaggagctgggcatgtgtagaattagtttttggagcttataaaagtgagtctcatctttggagaagtagccggttagtgaagtgtggacaaacatgttttcctccccttggaaatggcacagagcagcccatctgcaagacgtggtttttcagtatccggtgggttatttacatgtatgttctggtgttgtggttttttttgttttttgttttgttttgttttgttttgagaccgagtctcgctctgtcacccagacgggagtgcagtggcacgatcccggctcactcccacctctgcgtcccgggtttaagcaattctcctgcctcagcctccccagtagctgggattacaggtgacacccagctaatttttgtatttttagtagagacgggattttgccatgttggccaggctgatctcaaactcctgacctcaagtaatccgcccaccttagcctcccaaagtgctaggattacagacatgagccaccatgcctggccaactatggtgtatttttacaaaaacttttattctgagaaaatgggcacgttttctgttgtggtcatcactgtgtcctgccgtctgtgtgtgaggtcagctgtggagcctgtggtcgctcaggccgccctcagtggggtctccgagctcttcccgtgcactccagtgtctgcaggagctggtaatgcaccctgacctgcaaggcaagctccttggtggtgtctctcctgctgggctctctttgagacccacgggagatggagagcagggctcaggggacccgcctgggagctccacacagacctctgctgctgtttgcaggtggtgatccaggtctctacccaggttcctcaaggtcctgtcttgttggccttggaattcagtgagagataggaacagcatggggtttttagaaataatgtggaaatttggaaaacgttcccaaattgtttattctgtataataattaagatgctagatctgtaaaagtgagtttcctctgatttggcatggatgcatcagtccctgttcttcagggatttgttggagaaccaggtctgtgaacatggaagcttcaaaactctacggttggggaccctttcctgcccctgcctctcggggttcctgccaggttggatgacatttttacaatgttctctgaacactttcaaaaaagtgtaggctgggcctggtgtcgcatgcctgtagtcccagctactcaggaggctgaggcaggagaatcacttgaacccgggaggtggaggtttcagtgagccgagatcacaccactgcactccagcctgggtgacagagccagaccctgtcttaaaaaagaaagaaaagaaaaagggaaaagatgccgtgtaaaatctcgttctgtgtctgaattgccgtagggctcagatcttcatttgaggttctgtgtctgaattgccgtagggctcagatcttcatttgaggttatgttctataagttaacgttgatcttgtgtgagctttcggtagctggagtaacacaggcggcctcacagcgacctctccagcgccttccaaggcacatctgcagccagcgtagctcctcctgggagatgcctcctcaaggccctgctccagaccacgtggggagggcctgacagccaattcccaggctgtccccacccttggagagtgaccctaaacgctagacagatggggaatgggaaagaaaagaaagctgcagacctcaagttaaaattccctcaaaaacgtttttatttatctgctttttctgaaaggataaaggctttttgaaaattattttctaacaaataacatgaacacttctagaaaccctagaaaaacacaaagtattcaaaatagaaagaaaaattacccattactctttaagccagcattatccattgcggtgcttttggagttgggtgaggccgtagcctctgccaagtcaaggagcccggtggtggctgtggcattcctgcagggttgtttttttttctttgagatggagtctcactcttgtcaccccagctggaatgtggtggtgtaaacagctcactgcagccttgaccctgaggctcaagcgatccttctgccttggcctcctgagtagctgggatcccaggcgagagtcaccacaccctgtccatgttcctgcaggtcttgatgtgcgaggacgctgtgtcttccctgccacattttcttcttctttcttgagacagacccttgctccatcacccaggccagagtgtggtggtgcgaacacggctcactgcagcctcgaccctcaggctcaagcgatcctcacgcctcggacccccaaagtgctgggatcacaggcgagagtcaccatgctggcctgaatcttcagggtattttacggttgaagtgtcacttacttaaccatccctgtttcaggagtgtaggtggtcaccctgtctctgccgctgacctggcctggaccctcggctgtgagagggaggggtgggctgggctggaggaacctgaagccctcgtgatgtcacaagcccatctggctgggcatcccctgcgctgcacatgccccaggtggcccccacagcagaggcgagccactggagggtggagggcttccacgggacggtcttcagggggagaaggaagggcccaggcccccaggagactcaggagaccagagcctggggtcaggggctcagccaggggctcagccagggctggatgtccggagccagccccgcagccctgtgttcttcgttcttcgcactcccaccgtccgtgtgaacagctccagccccacctgcgcctccctgtgctgggctccatcagggagcccagaagacgtgtgtgcttctgaaattgggtccctacatgcctttgtcccagtgcaccttgctccttccatttactatcgagatttaaatgcctgttttctccccagaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggttctatagtgcaaatgcttttattagccaataggaattttaaaataacatggaacttacacaaaaggcttttcatgtgccttacttttttaaaaaggagtttattgtattcattggaatatgtgacgtaagcaataaagggaatgttagacgtgtggtctgccttcagcttttcaaatcaaataggtccaagaaccaggccccgtgccctggtcctccagacagtcagtgtcagatgttctggcttgcctgggacctcccagggtaccgggcaccttctggaacattgtccagcccagcgtgcacagctctgcttgtgaaaatccagagggactgtctcaccctctgttcaggaggttaaatttcataagactgctccttttggatgaagaaatccaatttggtatagcaggttgtgcatttccatcattaatgatttagccatgctgtgccctgcagtctctgcacgtggcctgcagcgtttgtccacccagcgcatcctgctcacctcggtccactgccagcgctgcccggtccgcctccctgcctcactgtgcagcgccggccctcctgggttgacactcccgaggcccagcctcattctccagacgcttcccttccacagtgatgcgtctggttttggggctgcagcctctggtctcagaaagcctgctccttccacccagttgtgcacgacttttctctgttcgttttggtctcttgggatctgttcaaacctctgctcggtgtgttgaggggtgaggggcagggagcatggtttcctggaaaaagcccccagtctcttaagctgggcaggtgtgctgtggggggtggggactggggctgcttctgtgctccagatgagacctcccccactgcccaactgcacttggcctggggccctctggatacgaatccctctggagcaggcactccaggctccctggggatgggagggggagggatgtgggcttgggggtctggctgctccctcatgacctcagtcatggggatcccagggcagtctctgaggatccccagcaatccacgccgggtgcctccctagaccttgacacccccatgactctgcagcagatgaccccaagttctactccatgaggtcaacttccttgtccaggccgcaagctcccaattccatgaggccttcctcacccaggcctccacggccaggcgcccagcgacttctccctcgcctcatgggcacctggactcagtgtccagtagctgcacccaccccaccctgggagctgccctcactcctccttcagccttaggcctgtgaggtctctgtgcttggggtgagggcagctgctgcggccaccctgcagccctcccagccacgtctccaggcccttgcccgtgctgtcccctgtgcagtgggcaacccccaccccacacctgcagcttctctggcctctggattcctacctgggtcagggaagcctgctactctggaggagctgtcagccctggtgagacacctgcccccaggcacatgtctccatggatgatacgggccaacagttgataccaaggccgatgtgctcatcctgtggatcagctgccggggaaggaatgttgtgtgtggcggttagctccatactcctagaaagcaggcgaaggccaggtgagacggagactttcatagagaaaaggtcagattgtggatgattttccttccttccttttcacagcaatgagaggttcctctgatggagataaagtgtgtttctcaggtctctggtatgctcaggtgtggcaggttcacaggtgtgaggtacactcaggtgtgtggtgcaggtaccctcaggtactctgcacgtggctgccatgggggctcctgtttgcaggcagctcggggaggctgccttggagaggggcctccatgaagactcacaagaacaaaagccgctgaaaattccagagcagaagttcttcagcagagggtgaggagggcggtgg

SEQ ID NO: 17361 - DNA, 767677 bp, Human; identical to SEQ ID NO: 12147
  misc_feature (1)...(767677): n = A,T,C or G

SEQ ID NO: 17362 - DNA, 134434 bp, Human
ccaggctggagtgcagtggcgcgagtggcgcgatctcggctcactgcaagctccgcctcccgggttcacgccattctcctgcctcagcctcccaagtagctgggactacaggcgcctgccactatgcctggctaatttttttggtatttttagtagagacggggtttcactgtgttagccaggatggtctcgatctcctgacctcgtgatctgcccgcctcggcctcccaaagtgctgggattacaggcgtgagccaccgcgcccggcctgtttatttttattttttgagacagagtctcactctgtcacccaggctggagtacagtggcacgatctcagctcattgcaacctccgcctcgcagacacaagcgagtctcttgtctcagcctcccaagcagctagaagtttaagaactttaagtgggggaccacctatacataaacatgccaccatgctcagctaatttttgtacttttagtagagacggggtttccccatgttggcgaggctggtctcaaactcctgacctgaggtgatccacccaccttagcctcccaaagtgctgggattacaggcggcgccaggactgtatttctttttttttttttttttttgagacggagtctctgtgtcgcccaggccggagtgcaataacacgatctcagctcactgcaacctctgcctcctgggttcaagcaattctcctgccttagcctccagagtagcttggactacaggcgtgcaccaccacaccggcctaagttttgtattttattagagatggggtttcaccatgttggccaggctggtctcgaacttttcacttcaggtgatccgcccgccttggcctcccagagtgctgggattaccggcgtgagcgaccgtgctcggccgcaggacgactgtagatgatatcgtattgtgtgttgaaattttgctaagagagtagattttatgtactcttaccacacacacacaaagagggtagtcatttcacaatgtctctatgaaatcatcatgttgcacaccttgtatacaaccaaaaatcaatttttagaaattggtttcaatcgtgtatgatatatatgtatatgcacatgtatatgagatattatgtatacgtatgtgtggatataagacacatgtttatgtataggtggtccccaacttaaaatggctcaacttacaattttttgactttgtgatgggtttattgtagcattaaatacattttcaacttacaatattttcatcttacgatgggtttatcaggacaaagccccatggtaagtccaggagcaaatatttttgcatacacaggtatgtgtacatgatacatatttatatgtattgatgctgtatctatagatgcatatgtgtgctatgtatgaggcaaatctgcgcatgtctgtgtacatggtaaatatttacgtccgtctgtgcgtgtcatagacatagaacaggtgggatgtaaacagacgggctgggcctagctgctcctttcccgcctcactcgagtctggcaccagattggccgctcccagcccgctccgggtgccggcccctgcaccccaccctgcaccccgcaccctgccctgcaccccatcccggcccgtgcctcgcactccacctttcccgcaccctgccccgcacccaacacctcccgcgcccctcgccgcgctcccccagcacgcaccaggccccgcccactccgccgcgtgcccagcccgcgtcaccgccgtcctccccaggctccagcgcgccttgcggggccgcgcacgctagcggaaccgccgggaagagcgccgtgccgtcaatggcggaggcgcgcacgtctgcagggccgcgcacgtctgcagggccgcgcacgtctgcagggccgcgcacgtctgcagggccgcgcacgtctgcagggccgcgcacgtctgcagggccgcgcacgtctgagggccgcgcacgcactgacggctgaccgccatcttccctcccgaggcggcagttccaggtgcaagcgccgggtttgctgcccgctgggcgcccctgcagcggcccgagctgtggccggcgtggatgaggggcaggcgaggcagggccgcccctccagtattgccgcccctcccgccccagggcagggctgggagggtacagcccgggggcgggctcgggtcgcctcccggccgccgcgtcctcgctgccccgggccgggcgggcgggcgccgagagcctcccagcccgccccgtgccccgcccgcccggctgcttccgcggcggcgctgcccgcacatgggctaggctgccaggatgttcagcttcgaaggcgacttcaagacgcggcccaaggtgtcccttggcggcgcgagcaggaaggtgagggccgggctggcggggcgccctcggctcggggcctgcgcggccggggctcggggctgggactcggggttggactcggggctggactcggggctggactcggggccgagacttggggctggattcggggcctccctggcggggactcggggcttcctcgccggatctcggggccgctccggccgggactcggggttggactcggagccgagacttggggccaggactctggctggggcttaggactggactcggggcctccctggctggaactcgaggccgcgcccgtgggggccttgcctgtccactgcgcttcgggacccgggcgcgctggccgtggctcccttccatgcaggaggccggtgaaccctggcacgctttgtgccacccaaggtgaacttaccctttctgggtgtttcctttcagaaatgcgctttccatgctcgctcccgcatggcatcagggagtggctgcttttcgaatgccacctgaagggcgttttcggttgtagaaggtgaacggcacgcatttgctgatgtcgataatctctaaagtagaggcagaacgtctcatgaatagccacgtgtttgaatccaagacgagggcaattatttgccaccagcctcctggaaactgtggagagactccggacttacatctgttgtgatcgacattaagttgttcgcatggtaattgtttaggataagggtaggcaaaccatgacgcctctgttctagtctagaatttctagctgtctgtccctgaagacgggcatcagttggttcactggaaccgctaagtcgttgaacactgtgtggtcttgttcccgcccctcccttcccaccccttcccatcatttctgaaatgttctttaaaatgcttcacctagtttttcttgtctatcagtatattctgtatatcacaaccaccaggtaggcacataacgcagagtgggtgctggcaggccaaggaggaactgctgttattaagattgtgctgtggggctgtgtttggtggtttctgaggttagaagggaacctgggtaaagagttgggagagaagtgtgctgataatttttcagctttgaggttcgtgtgatggtgattgcttggaagtcacttgtgctccagaactaagtactgtgcagttaagggtggtcgtggtagcacttagggtcttccacgttaatgaaaatgttttatgagatcaaaggatttctacagttaggagagacttcagagaatctcagggccaaatcgccttgcttacaagttcggaaggtgagctgcagaacatttgaaggagtgcccattcacacagcaagctagtggcagaccatctgagactccatgccatttacacagcgccgcgcggcctctgttgcaggcaggaacaccccacgggccacggatgttggtcccttttcaccaaggagtgcatctctgctctgagggagtgagatttcttaactgttgatcagaatctcaagggaagatagcacgagctgtgtaaaagaatcacccctttaaaaacaaaactctttttattgaggtataacttaagatacagtcaggttcacaaacactaaagagatccttgtgcaagtgaaattgaggaggaagggcgagagggaagctgggtagggaaggaaaaggcgtctcagctggaggctagcgttaaccccatctcaccaggagcatgctacaattggccctaattgcggcagaggggttggtggctgcaggctgctgcccctccgggatgagggtgggagtgtggcactgctaaccctgagccgagggccattcttctgggagagagtggcagtaaagagcccttagtaggaactggcagcagctggggcatgggtgccctggcctggttaaggaatctgggtggggagccagctgtatgtacagcttgaaggatttttgcatatggacactctcctgtagatggaacaccactcacatcaaaggaagaccatccccagcattccagaggctcccctgcactctcacccattcattacagtcatatgtgacttaaagagggggacgctgtcactagtccagttggttgttgtgggaccgtcctagagtgcacttaacagaaacctatagccagtgttgcccactgcacacctagctgcttggtacagcccgttgcccctatgctacacacctggacagcgtgtttctgtgctgaatactgtaggcagctcttcatgcaatggtgagtgtctgtgcatccaaacgtagatacagtaaaaatacaaattataatcttatgggaccacggtgtatatgtggtctgttgtcgacagactgagaggtcattatgccatgtatgtctgtagccccacaaaggtgactgtccttctgacctccattactgtagatgagcgttacctgttgaacttcaggggcatggagccactcaccacttgtcgtttgtgcccggctgctttggcttggcttctgtctgagaggtggactccatccgcctcggtgcacggcattgccctttgtgtgaacgcaccgtggctgattctgttttcttacagacctttgctgtgtgtgccttttggtgcacataatactcttgtgctgggtcctagatgatacgcatgttcagctgttgtgcacaccgctgccacagtttccccgtgtcgcacgcccacagcatctgaaggtatccaggtttccacatccttgccaacacttgatattgcaagtcctttaattttagtgaggatgtagtttctttgtggttttaattttgtttcctgacaactaattatgttgagcacctacatatgcttgttttcctgaattctctttgactgccgcataagtcccttcccttgttggaaaaatgaagttatagtgacccttttctcatgtcttaaattattatttgaaatcttccctttctggagcttagtggaaaatggagtggttaccacctttgaataagctttttcttttttcaaattaaatacttttagtatttattatttgtatagatctgtgtacgacaagtctgacttgaagaagttgataatcttgttgggcagataagacttaagcaattaaaaattaaataacaatagagtaattgctacattctaaatttcccttggtcctgattcagaaaaagtagaattgtttggagcttagtcctgaaggatgggtgtaattaggatgggtggaagacgagaaggcattccaggttcgtggagcggggtgtgtggagtacatgtagattggattacattgattcaaagtcactttggggagctaaacattgattacacatggacataaagatgggatgatagacaccagggactactagagggggaaagagagggacggggacaagggctgggaagctacctgttggtaactgtgctcactccccgggtaatgggatcattcacaccccaaacctccgcgtcctgcagtatattcttgtaacaaacgtgcataggtaccccctaactctaaaataaaagttgaattttttttttttttttgagatggagtttcgctcacgctggagtgcagtgttgcccaggctggagtgcaatggtgcgatctcagctcaccacaaacctccacctcccgggttcaagcgattctcctgcctcagcttcccgggtagctgggattacaggcctgcaccaccacgtctggctaattttgtatttttagtagagatggggtttctccatgtcggtcgggcgggtctcgaactcccgacctcaggtgatccgcctgcctcagcctcccaaagtgctgggattacaggtatgagccactgcgctcagcctgaaatttttttttaagtcacactgatttctatctttaaatatttctgacatcgggatacacactgatagcatgatgcagtttaattgggggtatgtttttcttggtagtgtatagaagaatatcacggggtcatctgatttcaagtacagaaatggactaaaactagcttagtaggcaaaacaaaaagaaacaaaaacaagtttatgaaaggataggcgtgtctgacagaatagaaaggtcagaaacacccagatagcaggtatcaccaccacaggagttgcttgtctttctccaggagctgggtgcactcccttcttcctgtctccttcattcctggctctgcagactggctttctccatttctcacacatggtttcctagcttaagcgtcaagaaagtttgatcataattaccagttttcaggagaggaaagtctgattggcctgggtcatgtttccacctgataacctcagtctgaggagggcttggaggcttggttcagatggaacagtctaggtgcacctgagggctggggtagattcttcaagaagcggggagtggtcgttgactgaatgcctgagttcctgtgggacaggcacaggaaggagtctaggctagagatgcagatttgggggttatcaacagaatggtggcttcgaacacaggtccttaagaggacttggagtttgggacagggtgggactcgtgaggtactgcaacatttaatatgtgtgggagttggggatacttacaaaagagtcacacctccgggagtggaggagagtggtgtccagggagtgaatctcagggagggaggagtgacaggcaatgccaagtgctgcacagacacagtgagtccactgactgcggagctgggaagaattgggtgatttgagcatattctgtagggtagtcagagttggaagtcaagagcatagcacattggagagtgaatgggaagtcacaaacagggccgaacacaggccggatgctgtggcgcacgcctacaatctgccacaccgaagactgaggcgggaggatcgctggatcccgggagttcaaggctgcagtgagctgtgatcatgccatagcactccagcctaggcgacacagcatgaccccatctcttaaaaaataaggcaggggcaaggcaacagtgtagaccttttttgaaaagcaccggaagattggatgatagagggaaattcggtgtctcggaaatagttttgtctgttttgggagacgggggaaacttaagtttatagactgggaaggacgggggttaaaaatgtggggaagacaggagtggcataactttcagagtcttcgagaatacccgagaggggagaactgagtgggagcaggcaatgggaaatattttgagacttaaagaagctagggatgaatatggatatagaaaagtttgtagaccggaggaactgaaattttttaagtttttgtagatctgacaatagtgggagtagaattaagatcactttaatgtttgtccagtgctttttttaaaaaaaaatagactttattttttagagcagtttcaggtttacaatcaagcagagggtagggttcccatatgcctagtctccctcacctcacttttctctattactagcatctggcattaatgtggatcatcagttacaattgataaaccaatgtcgatgtgttattattaattgaagtccatagtgtacattcaggttcacactgtgtgttgtgcattgtgtaggttttgacgaatatatgatgacatgtatctacccttacagcgttatacagaagagtgtcattgccctagaaatcctcattgctggccaggtgtggtggctaatgcctgtaatcccagcactttaggaggccgaggtaggcagtcaggagtttgagaccagcctggccaacgtggtgaaaccccgtcactactaaaaatacaaaaaattagctgggcgtgggaggctgaggcaggagaattacttgagccctggaggtggaggttgcagtgagcctggattgtgccagcgcattccagcctgggtgacagagcatgactctgtctccaaaaaaaagaaaaaaggaggaggcccggcactttggaaggccaaggagggtgtatcacctggagtcaagagttcgagaccagcctggtcaacatggtgatactctatctctactaaaaatacaaaagttagccaggcgtggtgacaggtgcctgtaattgcagctactcaggaggctgaggcaggagaattgcttgaacccgagaggcagagattgcagttagctgagatcacgccattgcactccagcctaggtgacgagagtgatactcttttaaaaaagaaaaaaggaagaaatcctcattgcatattcatccatccctcccatccctgtaacacctggcaaccactgatctttttactgtttctactctagccttttccagaatgtcatatagttggaatcatatactatgtaatcttttcagattggtttctttcacttagtactatgcatttaaggctcttttcatggcttgacagttcatttctttttactttattttttatcaattaataagctttttttttagagtggtttacggtttacagaataattgatgggaaactataatagagtcctcaaaacctcctctccgctgcacgctgtttcctttgttatttacatcttgtatctgtgtggtacatttgtgacattggagaactattgaattttaatgaagtccagctcaccagtgtttttttcatggatcttgcttctcgcgttgtgtctaaaaagtcattaccaaagccaaggtaacctagattttctcgtattttctagtagttttataattttgtattttacatttaggtctctgatccattttgagttaatttatgtgaaggatataaaatctgtgtctagatttttaatttttgaagtttttttgtttgtggatgtccagttagcaccatttctgaaaagacattccccaactccattgaatgcctgcctttgctcctttgtcaaagatcagttggctatatttttatggatctatttcttttttttttttgagacgaagtctcgctctgtctcccaggctggagtgcagtggcgcaatctcggctcactgcaacctctgtcaagcagttctccggcctcagcctaccgagtagctaggattacaggtgtgcaccaccacacctggctactctagtacagacgggggtttcaccatgttggtcaggctggtctcgaactcctgacctcgtgatctgcccgcctgggcgtcccaaagtgctgcgattacaggcatgagcccctgcgtccggcctttacgatctgtttctaagctctgttatggctttattctctcctccattgatctctctcccttttgtcaataccataccatcttgattactgtaacagatctgtagtaaactgtactacttagtatatatattaaactaaacttttttttaatttgagagggagcctcctgttgcccaggctggagtgcagtgttgtgacctcagctcactgcaaactctgccttctgggttcaagtggttcttctgcctcagcatcctgagtagctgggtgggcatgtgccaccacacctggttaatttttgtatttttagtagaaactggatttcaccatgttggccaggctggtcttgaactcctgacctgaagtgatccgcctgcctcagcctcccaaagtgctggggttacgggagtgagacaccgcgcccaaccatagtaagcattgaagtctggtagtgtgagtccttcgacttccttcttctttagtattgtgttggctattgtggatcttttgcctctccataagagtcagtttgttgatattcacaaaaaaaacctgtggaattttgattgggattgtgctgaattggtagatcaagttgggaaaaactaaaatcttgacagtgttgagccttcctatccatgaatatggaatatctcttaatttgtttagttcttttatttctttcattggttatataattttccttatatataccttatacctattttgttagatttatacctaagcgtttatttttaaggggtgctaatgtgaatggtattgtgtttcagtttcaaattccagttcattgcttatttgtagagaagcaattgactttcatgtactaaccttatgtcctgaaatcttgctataatcacttcttagttccaggagtggttttttggttgatacttggaatttcctgcacagataatcatttcatttgcaaccaaagacagttttatttcttccttcctgatctgtatgccttttttttcttttttcttttctaagaccatcagaaagcaatgtgttttattgtcttactgcattaggtaggattatagttgaaaaggagtggtgagaacttgccttgttcttaatcttagtgggaaagctttgagtttctcatcatgaagtatgatgtttggtgggttttttggtagatattctttatcaaattggggaaattcccctctattcctagtttgcagaattttatcatgaatgaaggttgggttttgtcagatgctttttctgtatctgttaatgttatgtgattttccttctgcagcttgtggatatgatggatcacattaagtcattttagaatattgagcccgtcttgcgtatctggaataaatcccacttgactgtgatgcataattctttgtatacgatgttagattgagcttgttgatattttgttcaggatttttgcatctcttttgatgagggacatcaatttagggtgtttttgtgatgtctttgtctggtttggtattagggtgatactggccttatggaatgaggatactctagggcctaccaaaaccaattactatagtttttttgttttattttgtttttttgagacagagtctccctctgtcgcctaggctggagtgcctggagtacagtggtgcgatctcactgccacctccatctcccgaattcaagtgattctcctgtctcagcctcccaagtagctgggcttacaggcgcccaccaccaggcctggctaatttttttgtatttttagtagagatggggtttcgccatgttgtccatactggccttgaactcctggcctcaagtgatctgcccacctcagcttcccaatgtgctgggattacaggtgtgagccaccatgcttggcctcaattactctagttttaattcctcccctatgataggtctagactgttaagatggtaagaacttgattgcttagttttgtaaaactgccctctattatataattgaagggattacctagttttgtaaaactgccctctattatataattgaagggattacctagaatattttaacttaaaatgttttgtgctattttgttttaaaaagcagaggtgtaatggatgtgatagtataatgctccatatacattgtagtggaacataaaaactttttcttacagatctggcatcaaataaagtcaaaatattttctaagatcaaattagttcttttttttttttttttttcctttaagagacagggcctcactgtgtcgcccaggctggagtgcagtagctattcacaggcatgatcatagtgcacagcagcctcaaactcctgatctccagcgattctcctgcctcagcctcctgaggagctggaactccaggcttgccactacccaaccccagcctggctctgaaaatgttaattgactgtcaggactggtattatttagcaacactgcatttgttccttcgaatacagttatgctgtatcctttacatgtaggagcaaaagactgtagttccctgctatagataaggttaagaattctttttttgttttttgagatagagttttgctcttgtcgcccaggctggagtgcaatggctcaatctcggctcactgcaacctccgcctgccaggttcaagcaattctcctgcctctgcctccggagtagctgggattacaggtgcctgccaccacacccagctaatttttctatttttagtagagatgggtttcaccatcttggtcaggctggtctcgaattcctgacctcaggtgatccacccacctcagcctcccaaagtgctgggattacaggcgtgagccactatgcctggccaggaattcaaccgatttttaaaaatagaaaccaagcggaatggaaggagtgagacttgagactaattgtctcattgtctcattttctttggacattaaatctgggcctacagggaggtgagtaaagcaccatacagtatttaaggaggcacttactctcaggttcatgcacaggcggaccctgcactggcacatccctgagagtgagtgcctccttaaatttgtgccttaagcatctggcttgcctcatgatatcccctacttggctttaaccacttgaatgtgtgctgattttcttgagttacagtgtgaattgccagctagggtccttaaaaggttgaaaaaatagatggtctcataagaccatagaatagcctcaaaagaagttcttgcaaaagctgtaaggagcttcactctgtgacttttctttaattcttctattatagaatgtaggcacctaggaatttggaagtggggcatcttattctttgactgtgacccctgttttttactgcctttaaagcagctgctttctgcatgtccttgttctcctgtctcaggcctccaaatgccgccctttaccatttgtcagcatgaaggagaagccatgctttccatagcccatcaccttcgatggtggtcaaattacaggctgtaatacctgctgttgctgagggcatacagacactgggcacaacctacctagggttggttataacagatttatcaagagtctaacaaggccaggcatggtggctcacacctgtaatcctagcacttttggaggtggaggctggcagatcacttgaggtcaggagttccagaccagcctggccaacgtggtgaaaccccatctctactaaaaatacaaaaaattagctgagtgtggtggcacccgcctgtaatcccagctacttgggaggcagaggcgggagaatcgcttgaacccaggaggcagaggttgcagtgagctgagatcataccactgtcctccagcctgggtgacagggcaagactctgtctcaaaaaaaaaaaagagtctaacaagatatgtcccctctaatccagcagaacaaatttctacatttagaaacgtaaaaatttattctagtgaactaatatgcataagagaagatgcatgggaaaggtgatttatggcattacttataatactgaaaaatactgaaacagcctacatgtctaaatacaggacatttgttaaataaccgttaatataacaatgcagtgaaatactgtgcagccatttaaaatggtcatgatgcgtattaatgtctgtcattaatttattaacatacttgtatttatgaacatgatttattgttaatggaaataagtagattacaaaacaggattgcagtctgcatttaaattatgtttatctgaacagtaaagatagctagtttcccagtttcttaatttccattgaataaaagaaagatactagttgcttattgctgtgtaatagagcttaaagcaatacgtttttgttaccttggtcagttctgtggggcaggcatctggatctacttctgcgctggcctgttcacaagcctggaagttagtgctggccgttggcaggagagtcagttctcggccgcttgcggggcttcttagggataccgtgtcctcatggcagctggcctcccgctaagctgctgagcagacagagcagggaggaagggcaaagcctgtggtgactttggtcatggtgtatttgtccagcccactctcggggtgaggggagtcgggctccaccccctaaagggcagcagtagcaaagcgtctgtggacataatcctgaagccaccgtagaagggagcttcaggtttagcttagtcgtaaacgctggcgctgcaaaacaaatacgctgtgttttctgcctcagcctattaggagttaaaaattgtggttttccttcttacctcttaccttctgtatcagtagttattggctacataaataacaacacagtgagttaaaaagcaagcattgtcaacatacattttggtgaatgtgagttcactcggagaagattgtatagctctttggaaatgtaacaaagaaattggcaaactaggagcagcttaaaaaacaagtaaatagagacctgacttaaaatgctatttttctagatgtgccctcctgatcatgtgctggcttttcttgtgaactgttaccttctcccgtatgctgcttggaaatgcttaggttcctgcattatcctgccggaaatactatctattaagccgtttaagtgtcttcctcaaaaaagcccagtagaaccataaggagtaattttttgtaacaatgcaaattcactgatttagatcatttagctttttaatccatttgcccttggagagaagagggggctatgcaattggaccaagaggagtcaatgattttgaagtcagtcagcccttggtttgtcaccatgacaaccgtggagcaggaggtagccacatcatgacagggaggagaggtgagtgaagtgagaagcaggggagcatcacagtaaagtggccgtcatctgagaactcttctgcacagcctcgtacccagaagtttgttccccttctgttctagtaccatgtgtgtatcctatttccagaaccccaagcaagcatcagtttttgtgtgctggactgggtaggattcttaggactatttacatattaacattactgtcaccagttagagggacagcatgggcaaagctgtccaaccatggagacgtggtgttcagctacaggttgtggccagaatgggggtgggcaaagggtgtagggaaagtggaagagaaggctgggaggaaggtagtcagggacagagctgggaggaaggtagtcagggagagagctgggggaaaggtaattagggacagagctggggagcattgtaggccacactaaggcatattcagggaggactggaaagccgctaaagagttttaagcacattaatgagacttaggttttagagatgcgtggggggcagtttgggtgtttgaatctagggaggcaaagcctgaagccagggaaatcaagggagaagcacccacacttgtgcctgaagagcaatgagggcctaaaacctgcagtgggcattttcttttaaggatgtttgtgtttctctccttgtttgtcacatgcagatccttgcgctcctcactatttgttctcctgcagggcacttttcgtttatgagctcattgatctcgacttctgatatgtgaggcagaggtgttagtgtcctgtggaggaagaaatcaaggcctggagtccaaataatttagcaaaacccccaacactgccctgtggtttgtttatccggatgctgtacggcctctccctcgtgtctgggcaggttgtcttgccggcacatcttgcttctgtctcctgctttacttgtgcattcctgtaactgcttgggaagttgaggaccacatcctgcaggcactgagaaggtggttccaacagtcctacatcttttggaactaatttttcttacagtgcagctttaacgttgtttaattttttgccaggtgtggtgatgcacgcctgtaatcctagcactttgggaggctgaggggggtggattgcctgaggtcaggagtttgagaccagcctagccaacatggcgaaaccctgtctctactaaaaatactgaaattagccaggcatggtggtgggcgcctgtaatctcagctacttgggaggctgaggccggagaatggcttgaaccccaggggagcagaggttgcagtgagcagagatcgcaccacttcacttcagcctggatgaaagagtgggactccctctcaaaaacaaaacaaaacaaaattgttcagttttgtacatattattttagagctgtgtgagcagacgctagattgttggcagttagtatggttcacatcacatcttgccactgtgaaacccctttactgcaaaagacgaaattttagaaagtgtaaccttgaaaaaaaaatagttaactctggaaccaactgtctgtgacttagctgttcatcttttctgggcttttctttgttgtattgcgtaatgggagagtcacaattctctttctaatttgtttttaacagagtccaggtctcacggcgttgcccaggctggtcttgaaccgagctcaattgatcctcccaccttggcttccccaggtaatcccaagtgttgggattacaggtgtgagccacacgcccagccagaaagtcataattcttgataaggataaaaccaaactagattatcacgaatcttccttgctctaagaatggttgcgtttctactctgcagtcagtggcctttttaaaaagttaacttttcctcccggcactctgggaggctaaggcaggcagatgccttgagcccaggagttccagatcagcctgggcaacatggcgagatcccgtctatactaaaaatacaaaacaaacaaacaaacaaaaaaacgggcatggtggtatatgtacctgtggtttcagttactcgggaggctgaggtgggaggacggcttggtggggcgggggcgaggttgcagtgagtgagccaagaccgcgccactgcactccagcttgggtgacagagcgaggccctgtctggggggggaaaagttaactttttctgtttaaaaaaaatgataggccgggcacggtggctcacacctgtaatcccagcaccttgggagggaggccgaggtgggtggatcacgaggtcaggagttcagaccagtctggccaagatggtgaaatcccgtctctactaaaaatgcaaaaattagccaggtgtggtggcaggcggctgtaatcccagcaacttgggagactgaggcggagaattgcttgaacctgggaggtggaggttgcagtgagccaagatcacaccactgcactccagcctggtgacagttcgagattctgtctaaaaaaaaaagataaaaggtcagaccttctaaagagtatccatgaaatcatcttctcactgaatcccctaacttcccaccattattttctcagtatcctctcagaacaagtctaaacataaacatgtcctcccctctcattttcagttaaaatgagagatcatattgctttttcacctcaacaaaatatcttagtgattccatatcggcatctttatatttgttatttttcatggtatataatactccatagcatagtttgatacttaatataaccactttcctatcaatggatacatataaattgtctttagagttttgctattaaaatagtgccttatttaccacacaattctgaggtaagaaaagaaagtctcttggcgtatattgtgatatttaaatgattgcgttttgcattggatacttcattttttctctagtcaagtgaagcagaaggagtggagaaggaacaaagaaatctataactggttgtagtcagactttatttttaaaaatgagctcttgtgattgtaaaataatatttataattggaaatgtaggctatactgaaatgtatttaataattacctattggaaccctacccatcccttagaaatgaaatgctgttaatgcatagtcagtttttttccccatctttgtgatggtaaatggtcaaatattttcctagcattttaaaaactttcttttgaacttgcatcatcttgtgcattatgttttataaatatgatttttagtggctgatgatgatgcacctgtaagtatgttttgcatttgtgaaattggcggttctcatattttcatagagattcttatttcatgtaggtctgcaaaaaagaatcccaccccctccacacgcacacacacacattgtagcttatgcattactcacaaatgttaacttttaacattttcctttactcaaaggcaatgttctttgaagtgtataaaatggctagcattatgttagtgcctgagagccagaaaatactgaactgaaacagatgtgaagctgataattctgtgtaaatggagtaaattgttaatggaagataagccaaataggtgaaacaaaaacctcacagttttttggggttttttttaaatcaagatatttacaaacatgctaacaatcgttctgtaaatggttagcagttaatttgggcatgtggtcttttggaagttacttaaatttactttgacattcactctagttttttaacataaaaattttattctgagggtttaatgaaatctgatttaaactgtgtacgctttactatttcaaataaagaataaactttgttaccactaaatttatttagtgaagaaagcattttccccccatttgaaatcatcttggtaagacaaaacgaaaagaaaatcaccttggtaaatggcatttgtaagatttggtcatatttaatgttcagagaagataacgatagtacctaaagctccacaggcacccagagcagttggctgtgctcactgtggatttcacattggtgggtagttacagcagggagcgtgcacgctgtcaggacgatggcctcggtcgtttcagagaccctttgggtgtttgatggaccttgtctgtaactgctactaggcatccctacgggttctacatctgcataatttgaaagataaggatgttttcaactatgagtacaataaattgaaaccaaaaacttgttaatcaataggaagttcagtcctttttcaaaatcaaactgctttctcctggtaccttatttgcccctttcctcccagccactcagtggtgaacttgttcctcattatattgagctgtttttagaacttgttctcatattgctttgttactactttgtttaaaagtgagaaaatattataagtacatgggtgatcattcagatgggaatgtaaacagtcaaataaaatactagagcctttcacctccactcctcacacccccagttcttttttttttttttttttttttttgagacagagtcctgctctgtcacctgggctggagtgcagtggcatgatctcggctcactgcagcctccacctcccaggttcaagtgattcttgtgcctcagcctttcaagtagctgggactacaggcgcacgtcaccacccccggctaatttttgtatttttcatagagacagggtttcactacgttggctgggctggtcttgaactcctaacctcaagtgatccactaccctggcctccaaaactgctagcgttacaggcatgagcaccgcatccggccccaattctttaatccttacattcacactctattttgggatttttacacatcctgtcagagctgttctctacatacataatcatataggtgtgtaaattcccttctttttaaaaaaaaaaaaaaaaacacaagctagagcatattaaacagattgctgtacttctcctgtcccccttaataatactctcggagacagttcctgatcagtagatagatctaccacattcctttaaagagctatatgatattccatgtagtgaatgccctataattttcagcagccaaaaaaataaagctgactccagtgagttattaatgtggtccttattatatgtgaagacagccttatttatagttaatgtcttcagttataagagtcttcatcattagactttttaaattacccttttaaaaactcatgtccggcccaggcggtaggaggaaaaaataaaggtgtaggcatgatcctaattcacaattatgaatatcagcatgtggctcacactagtaagtgtcagcttctgaaagtgaaatttcagcatactattaaaaataaacctgcaacaatgaattaaaaaattcaatatacagaaatccatgctagtgatgtggacggtaatagtccatgctgtgcatataatcctaagctgcagctactgaattcttaagcgagaaatttgactacattaagaattaaaactttgtacacataaaaatatcataaccaaggttaaagagtaacaaagggaatatttgtagcatcatgaaaatgattatttgtagaacaagatgaaaagataatcaaatgaaaaaattaaatgattcaaactgtggaaacataaaaagttagacgctgcactgtgcaggtgaagacaagggacagcagtcacttttcatacattgacatgatctccttggagggcaatttggaaatattcattaaaattcaaatgcacatagcctttgacctacaaagaaatttaacctgcagacattactgacacatttgcaaggatatccactgcagttttatttgaattagccaaaaactgaaaacaacctaaatgaccattaaaatataacatggtggctgggcgtggtagctcatgcctgtaattctagcactttgggaggccaaggtgggtggatcacctgaggtcaacagtttgagaccagcctggccaacgtggtgaaacctggtctctactttgaaaaacagcacaaaaattagccaggcatggtggtggaagcctgtaatcccagctacttggaggccgaggcaggagaattgcttgaacctgggaggcggaggttgcagtgagccaagatcgtgccactgcactccagcctgggcaacagatatatatagatatatatatatagagagagagagagagagagatacatataaacatggtgagacccaatctgtacactcttttttccttttttttttttttttttttttcctgtaaagggagccttgtttcatggcccaggctggtctcaaactcttggcttccagtgatctcctgcctcagcctcccaaagtgatggaattacaagtgtgagccactgtgcctggccctagagtcagctttaacttggaggctgcgaagaaaattcaaaggaaacacaaatataatgaagccttttgaaaaccagtttttcatggactggccgagagagggaacctattctattacatgccaaattccagtgtgaaaccatgcactcatactttattttgaaaccgtaagccatagcacccaaaacctgttaaacttttgggaacaaacaggttgaaagtagatgcacagagtggcaggaccggtgtagagaacactgcatctgtgcgttgtatttaatcacaaaggctagagctgctaattggccaagtgggaagctgctgccaaagctgtgattaaaagtgatgattagtcacaaagcaaataaaataatggacaagattcctttgtctaatgatttagctcattgtccatttttagatagggacaaatacattgagcagctgttattttcctggggaagacaaacttggttctgttcactagagactgatgagcccactgatactctgaactcagctaatcctttgctttgtcaggcatgagctgaatagacaagcccatggggacgttttttttctagctcgtcaattagaagaaatgctttaaaatctattgttgattttatgacaaatgacaacatagactccaagtgtgttgaatggtaaaagcagagatggtgtcttgggttaatatgagaatttggtccattgtgctccagcaccagaaactaccagaactaaagtctgctccctttttgtattgaaaacacagtcctactagtctcatgtatgcggggatattaagtccgttatcaatagagtgtgaaataatcactcctgtgaaaggcggagacttaattctctagccttgtgaagtcatgggcggtaactaccagcacccacttctccttcatcctgaaagcttgtaggtaggaaagtctctctctccttgactgttatctcaagaagagtgtcacatctttgtggagtcaaactttcaccatggcatacacaccatgattgtggaggaaagaattgtggaaaacttgaaaaaagtattttgaatatggcatttacaaagttaggagtatttgacacagcaggcatgtggggaaaaaaagaaaagattaaaaaaaaaaaacagaattaggattaaaggtctccatgaatgttttcctaaaccagttggtggcggtgaatggataaagacagtctccccctaccctgttttattaatatgtgaatattaccaagtaaaaggacacattcaaaagatcagactgtggatggtttcttgaagcaaaagtttgttaaagcaaaatggcattttggttaggaattccttttcagaatccagttgtatcagagaacgtgattaaataccatttgcagctgggtgcgatggctcatgcctgtaataccagcactttgggaggctgagacgggtggatcacttgaggtcaggagtttgagaccagcctgaccaacatggtgaaaccttgtctctactaaaaatacagaaacagccgagcgtggtggcacatggtaatcccggcggcggaggttgcagtgagccaagatagccccactgcactccagcctgggccagagcgagactctgtctccaaaaaaataaataccatttgcttgcctgatctaattacagacatgtaaatcagaattctttggttaatatcaaaatttaaaaataaaactgtctaatagagcctaatcttcctcttaaactaagcagcgtagcgtctcgtattcttttgttgtgattataaacagtttcttttaccttgaggaatcaagtttcagataggactttttataaataaacttgttagatttttatgtaattccgtagttacttttttttttcttttttttttctgagatggagtctcgttctatcacccaggctggagtgcagtggcatgatttcggctcactgcaacttctgcctcccaggttcaagtgattctcctgcctcaggcctccaagtagctgagactacaggtgcgcgccaccacgcccagctgatttttgtatttttagtagagacggggttccaccatgtaggtcaggctggtctcgaactcctgacctcaggcgatctgccggccttggcctcccaaagtactgggattacaggtgtgagcccctgcagcagccactttcaaatttaactttaaaaatacagttttcattgtatttaatttggggggatgccttctgtttgtgaccagtgatgctgtttttctgtttagtgatgaaagatttccccttaagataaatatatttaggttaaaaagagtctttttggcaagactaacacaatagttgattgtatcatttgtatggtaccaagtagtagttcattatgccgttatgttttattactgagccagttgatgtcttagttggtgtctgcaaaatttctcccctttaaattttctgtctttcccttgttaattgatctatatcttgagagatactttgagactaggcaaatcctgtttctcctcaaacttttgcccactaattttagcatacattagtagatcttgtctgcagtgtttttctgttttctgcttttctctttccttctacatttttaaactggattctgtgaggaaaagagttttcttttccttgtttattgatttggttatttatgtaagtattgagtccatgatgcgtgtttgtgcgtataatcctatggattaaaatctaatgctatccttatttcgtaaccttactgtaatcatgagagtattggaaaaacccaaattgagggacagcatccaggacatgaaagatgaagataagaactctataagattggaggaagattaagaagaaatagtacctaaatataatgtggggtcctggataggattctagaacagataaacagcatcagtgggaaaattggtggatttctaattaagtttgtagattagttaatgttattgtatcagtgttaatttcctgtggataattgtatctgcttaatgtagaagtgagtaagacatatgggataagggaaattgtaccatttttgtagcttttctttgtctaaaattagtttctaaaagtttaaaaaattaaagaatattaagtaaacaatcatgaatcattttaattaagtttaaaacaatattttttctgctgttggacatgtgatgaaggttttttatgtgaaattttctttgatagaaagtatctggaggattaatttctttgattttactttttttttttttttgagacagggtctcgctttgtgactccagcaagagtgcagtggcacaatctcggctcactgcagcctcagcctccccagttcaagtgatctttctgcctcaacccccaagtagctgggactgcaggcatgcaccaccatgccttgctaatttgttttgtattttttgtggagatagggtttcaccatgtagcccaggctggtctcatactcctgagctcaagtgatctgccctccatggccttccaaagtgctcggattatagccatgagccattgcgccaagtctggctttacattttggcaattagaaacttgattctaggccaagcatggtgtctcatgtctgtaatcccagcagttcgggaggccaaggcgggcagatcacttgaggccaggagttcgagaccagcctggccaatgtggcgaaaacccgtctctactaaaaatacaagttagccaggtgtgatggtatgcacccgtagtcccagttactcggtaggctgtggcacgagaattgcttgaaaccgggaggcagaggttgcagtgagccaagatcgccactacactccagccctgggtgacagagcacgactctgtctcaatttagaaaaaaaggatagaaactttgattctgaatattgttagttcatgtatcagtgtataattttaagttggcttaactactctctgacactgttctgataaagtatatctcttaagatatttaatttttttttcttttttgagacggagtcttgctgtgttgcccaggctggagtgcagtggcgtgatcttggctctctgcaagctccactgcctgggttcaagcgattcttctccctcagcctctcgagtagctgggactactggtatgtgccaccatgcccggctaatttttgtatttttagtagagacggggtttcactgtgttggccaggctggtctcgaactcctgacctcatgatctgcccgcctcggcctcccaaagtgctgggattacaggcgtgagccaccgtgcccagcctaaatttatttttttgtaatgattcatatatagtgtctccaatcttgaactttttttttttttttgagacaggatcttgctttgtcactcaggctggagagtggtagctcaatcctggctcactgcagccttgacctcctgggcctaagtgatcctcccacctcagccccctgagtagctgggactacgggcacatactgctgcacccaactatttttaaaaagtttttgtagaggcagggtctcaaactcctgtgctcaagtgattctcctgccttggcttcccaaagtgcagggattacaggcatgagccaccttgcccagcctggacctttaattttattttggatgaaatttacaaaaataaaatgtccatacactaaagactggaacagtctttgggggagaagagggttctgtttaagtatttttcatttatttgaagttttccttttattctttcacttccttctacaaaccaagtcattttgttcaaaacttagttttatttatgaaaaaaaattttcatcaaagaaattgatttcttcattgaaatttttattgagataattgtagattcatatgcagctgttagaaatgatacccagagatggccgggcgcggtggttcacgcctgtaatcccagcactttgggaggccgaggcgggtggatcaggaggtcaggagatcgagaccatcctggctaacacagtgaaaccccgtctctactaaaaaaatacaaaaaattagccgggcgtggtggcgggcgcctgtagtcccagctacttgggaggctgaggcaggagaatggcgtgaacccgggaggcggagcttgcagtgagccgagatcacaccactgcactccagcctgggcgacagagagagagactccatctcaaaaaaaaaaaaaaaaaggaaagaaatgatacccagagacccctgtccacatcacccagtttcctctggggtaatattttacaaagctagtaagatgtcacagctagaactctgacattggtacggagcaccagtcttactcaacatttccccagttttacctgtactcatttgtatatgtgaagaaatcagattttatgcttaaaaaactactgaagtactaacttgtattatatctagtgacctctgggaaaccatttaacttcttgtgcctcagattctctcatctgattaagtcaagacagcttgtttggatgatctttaggatctttttttgggtgaaaacattctgtaatttttgtatgggagttttaaaattgaaattataaccttacctccttttttctctgtttgggtgtaggaggaaaaggcttctcttttacatcgtactcaggaagaaagaagaaagagagaggtaaaaacagttttgtaatactctgtagataagcattttttctacagcatttaaacatgccttggttttactgtatatatgtatgtgtgtatgtattttttatatatgacagaatgtgtgtgtatgtgtgtttagctttagaaacatttattctggagccggtgtagaaagagatggactaaaagggcagtttccagactggagaaggaacatgggcttttggttgacttacataatgatatggtttccagaagatctagaaagccgtattataaatataatgttcatatttctttttcttctcttttttttaagatactgagtcttgctctgtgacccaggctggagtgcagtggcaagatcatagctcactgtagccttgacctcctgggctcggtgatcttcctgctctagcctcctgtagctgggactacaggtgcatgccaccatgcccagctaatttttaagatttttacatagatagggtcttgctttgctgccgaggctgatttcaaactatggcctcatgcaatcgcctccctcattttcccaaagtgttgggattacaggcgtgaactgcctcgtctggctgatgatgttgatgtttcatgaagcataaggagaaagctcactgttaagacatgtgtcttaactgtttgtgaagaaggtaaaagaaagacactaatgacatttttattgtttatcctacgttatatcttgtgatagtttctttaaatagctttattttgttgattaatcagcaattgtactatcttatgacctgcttttttaggtagagttttttgttttgttattttaacaattcatttaggcccctgacaaatatttattgagaacttactatgtatgtactaggtattgctctgcttgctgggtatacagatagtgaataagacagacaaggttcctgccgtgaaccaggatgctgaggtggtgacaaaacctgtgagggccacagagtaatgtgattacagctggaagggcctatattagagatggtgtttaggggaagggctctctgaggtggttacagtgaaaagagtttaggcaggattttccaaccttggtgctgacatttttgaacagataattctttgttggggggaactgctctgtacattggaggatgtttagcaacacccatggcctctacccactaaatgccagtagcactccgttacctcagttgtgacaaccaaaaatgtcaccagaaactaccaaatgtcccagggagggcactgctcaaccaagaaagatatttgttggttggtgtttttaatcttgttttatggaaaattctcggccattatctcttccattagtgcttttgcttcattcttctcctcctctcctacttggacgcaaactgtaaatgtttttgacctttgcgtcgtttcccatatttccctcatgtgcttttctctgtgtttatccttttgaatatctctgcttcagtttggatattttcacctgacctaatttctgatttacagctgatctctttagcattgactttttttttttttttttgaggtggagtctcactttgtcaaccgggctggactgcagtggcacgatctcagctcactgcaacctccgccttccaggttcaagcgattctcctgcctcagcctcccgagtagctgggactacaggtgcacgccaccgcacccagctaattttttgtatttttagtagagatggggttttgccatgttgggcaggctagtcttgaactcctaacctcaagtgatctgcctgtctcagcttcccaaagtgctgggattacaggcgtgagccaccctgctgcctaattgttaaatacatccattgacttcgtaatttcagtttttgttatttcagttctagaattttctttcattcttttatatagtctttagttctcttttaatttcttgaacataattatagattttttaagacaatgtttaaactccagtaattggatcttccgtggggtttgtttctattgtttgtcttcttgatttttaatctgatggggtttcctttataggtgactagctgcttttcttttgatgcttttagaattcagtctttatctttgactttagatagtctgattatttgcttggagatcgttgagtctgctgtatgtaggtgtctaaatctcttgtgagacaggaagttttcatctattatttcattaaataggtttcctaatcctttctttgactctttgaccttggtgttaccaatactttgaatattttattgctttatgttatcccaaatgtcatgaatgctttgctcattcttttttctgtatttttgtctggctggattatttcaaaagacctgtcttcaagttctgagatgctttcttttgcctgattagtctgtcttgaagctttcaaatgtattttgtatttctttaaatgaattcttcacttccagaatttctagttgattctttttaaaaatacttactctttggtaagttgctcacttatatcctgaattatttttctgacttctttgtatttttcagaattcccttgtatctcactgagctttaaaatcaatattttgagggctgggcgcgatggctcacgcctgtattctcagcactttgggaggccgaggcaggccgatcacctgaggttgggagttcgagaccagcctgaccaacatgaagaaaccccatctctactaaaaatacaaaattacccaggcatgctggcgcatgcctgtaatcccagctcctcgggagcctgaggcaggagaattgcttgaactcgggaggcggaggttgtggtgagctgagatcacgctgttgcactccagcctggagtgaaactccgtctcaaaaaaaaaaaaaaaatcaatattttgaattatttgagattttcaaaatttctatttgattaaaatctattgttggagaattattgtattcctttggagatgtcgtatttccttgttttttcatgtttccagcatccttacattgccatgtgcatctggtgaaagttgctttttcctgttggtggtggtggtggtggtggtggtggtggttgtttttgagacaaagtcttgctctgtcacccaggctggagtgcagtgacatgatctcagctcactgcaacctccacctcctggcttcaagtgattctcctgcctcagcctcccaagtagctgggattacaggcgtgcaccaccatgcccagctaattttttgtatttttagtagagatggagtttcaccatgttggccaggctggtctgggactcctgacctcaagtgatctgcccacctcagcctcccacagtgctgggtttacaggcatgagccaccatgcccgacctcacaggatttttttataaccatttcaagcccaggaactacatctacatgacctgatggtgttcttgaatcccacagtgtgtgtgttagtctcagctttgtagatggcattcatagaagacatgaaacaaggtagtatggtgagatggagtacaggctttattatcatacctgagtttgaattctgctttacatctttgggtgttgcttaatttttatagcagtctcagtttctgcatctttaaactggaagtgatgctcacctgtaagatgactgtgcatttgtatataaaatgcctctctctctctcttttctttttttttttgagacggagtctcactctgtcacccaggctggaatgcagtggcgcgatctcggctcactgcaagctccacctcccgggttcacgccattctcctgcctctgcctcctggtagctgggactataggcacccgccaccatgcccggctaattttttgtatttttagaagaggtatggtttcaccattttaaccaggatggtctcgatctcctgaccttgtgatcctcctgcctcggcctcccaaagtgctgggattacaggcatgagccaccatgcctggcctaaagtgcctctcatagggctggcacatagtagtaggctgtccaacagcagtagcactggtcataacaatgatgaagaacgcatatttttgccaggtcgctgaacattttaaagatactctcaagtcaatgaaaattggaattttctcttgaaacaagaaagtgacctttaaaatagatgctggtgttgtctgcttgtattcctttaatatttaaaactttaaaaagtcctgctagccgggcacggtggctcatgcctgtaatctcagcattttgggaggccagggctggaggatcatgaggtcaggagatcgagaccatcctggctaacatggtgaaaccccgtctctactaaatatacaaaaaattagccaggtgtggtggcgggtacctgtagtcccagctactcgggaggctgaggcaggagaatggtgtgaacccaggaggcggagcttgcagtgagctgagatcaagtgggcgacagagcaagactctgtctcaaaaaaaaaaaaaaaaggtcctactatgctggtgagattgtaaaatggtattgccattttggaaaacagtgtggcaattcctcaatgataactctacttctaggtttatgctcaagagaaatgaaaacctgtatccacaacaaaacttatatatgaatgttcatagcagccttaattcataatagaccaaagtgggagcagcccagatgtccatcagtagatgaatggaggaattcaacgtggtccatccatacaatggaacattactcttacttagccttaaaaaggaatgaagttctcacatatgctgtaacataggtggatcttgaaaacatcatgctaagtgaagaaaaccagacacagcatattgtatgattccattatatgaagtgtccagaataagcacatccataagatagaagtagatgagtgattgccaggggcaagagaagggacggcaggaaacggggggtgactgcgaatggagacggggcttctggttgtggtgatgaaggtattctaagatcagtggtgatggttgcatagctcttaatatattaaatgcatatttagtgggtgttaccttttaaagaatgaattttatggtatgtgaattacatagctgttagtgtttttaaagtctttactagcaaaatgtcattttcactggattctgaccaattgctccctcactcctccttttattgtttaggaagaaaggcgaaggttgaaaaatgcaataattatccagtcatttattcgaggctatagagacagaaaacagcaagtaagtttgttttaaaatgaggagattagtagggcatgggagagcttattttaaatatggtatctttgtacaccttgttaattgaagtcaatgctgacagtagtattcttcccaataaataattttatttgttctaattattgtgaagatttatagataggtgagtttttaggtaatttttaaataataaaatacaaacatgggcctcaccacagttgaaaatcaaaatagaaggaagtcatgagagatcctttttttttttttttaaattgagactgagtctcactctgttgcccaggccagagtgcagtggcatgatctcggctcactgcaacctctacctcctgggttcaagcaattctactgcctcagcctcccgagtagctgggattacaggcatgtgccaccacgtgcagctgatttttgtattgttagtagagtcggtgttttgccacgttgaccaggctggtctggaactcatgacctcaaatgattcgcctgccttggcctcccaaagtgctgggattacaagcataagccactgcgcctggcctgtttttgttttgttttttgttttttgagagagtcttgctctgtcacacaggctggagtgcagttgcacgatcttggctcactgcaagctctgcccccaggttcaagctattctcctgccccagcctcctgagtagctgggactacaggtgcataccaccacagctggctaaatgtttttgtatttttagtagagatggcgtttcaccatgttgcccaggctgatctcgaactcccgacctcaggtgatccacccacctcggcctctcaaagtgctgggattacaggtgtgagccatcgtgccctgcctagcttttgtatttttagtagagatggggtttcgccatgttgggcaggctggtcttgaactcctgacctcaggtgatccacctgccttggccccctgaagtgctgggattaaagggccaccatgcctggtttttttttttttttttctttttaaccattttttttctacaattcaactgtgagcaaggaccaataatggtgttttcgttgtcaatttccaccattcctgtaaacacagcaacgtatatttacatcataagaattgtgtgtccaaatactatatttatgggtcattttgttttgtttttcttccagtattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttggtgagtgttaactacattttcacttgtcctcgtttacacgtgttctgcttttttgtttaaagtggaaatggcttctcatcagaaagttaaacagctctccactgcatccaggctttgcaaacttctcagctagctgtgagaggttacctatgtggtgatgtgttttacctcttaaaatttgatacacataaaaatgtgtatccaaaaataggctttttcgtattttttgcagtggaaaaccttaagcatttaaaaagcagaatattttgcccacctatcatgtaccctgacacagccttagcagttgccagcacgcctaggtcagtgggacgtgcaccctgaataccacatcatgattacttgcaaactctaaaatacagggtctcagtgtttacattttattattattatattagagatggggtcttactcagttgtcttgaattcccaggcttaagcagtcctcccacctcagcctcccaggtagctgggactacaggtgtgtgtacaccttgttaatgttaaggctaatttttttttttgtagagatgaggtcttgctatgttgcccaggctggtcgtgaactcctagcctcaagtgatttttccctccctggcctctcaaagtgctggaattataggcgtgagccactgtacatgatttagggtctctttttgtggggagggcactgagggagtagagccttgctcttgtcacctaggctggagtgcagtggtgcattcttggctcactgcaaccttcccctcccgggctcaagcaatcggtggtgtctcagccacctaagtagctggaattacaggcgtgttaccaacatgcctggctaatttttgtatttttagtagagacagggtttcaccatgttggccaggctagcctccaactcctggcctcaagtgatcctcccacctcatcctcccaaagtggtagaattataagcataagccaccatgcccagccttagggtctcatgtttttaaaaaaaatcccaaatgtaatcgtagttctctaaaattttgtaggctgttgatcttatcagtgctgaggaacagtgtgtattaatggtggaaaatacaaccagatgcatagaagaataatttttttaaaaaatggaatttgttactgtccattttctcaaggaatattaagagatttgtatataattgttgggttatatacatttttaaatattttatatatatatatatatatatatatattttttttttttttttttttttttttttttttttttttgagacagagtcttgctctgtcacccaggctggaatgcagtggcatcatctcggctcactgtaacctccgcctcacgggttcaagcgattctcctgcctcagcatcccaagtagctgggattacagacgtgtaccaccacgcccagctaatttttgtatttttagtggagatgggatgtcgccatgttgggcaggctggtctcgaactcctggcctcaggtgatccacctgcctcggccacccatagtgctgggattacaggcatgagcactgcacctggcctaggttaaatatgctatttatcttttttttttttcctttttgagacggagtcttgctcactctgtcgcccaggctggagtgtagtggtgcgatctcagctcaccgcaacctcgcctcctgggttcaagcgattctcctacctgagcgccctgagtaactggggttacaagcttatgccaccacccctagcttaaatttttttgtatttttagtagagtcaggtttcaccatgttggccaggctggtctgtactcctgacatcaagtgatccacttgctttgacatcccaaagtgctgggattacagacatgaaccaccacacccagccaggttaaatatataatttatttttggaaatttttgtttatctgtgttaaaaatttcaaattgcatgaaaggggagtatacagtgaaaaataagtcttcctcgctacaaaccatccctactagaatgatcctacttgaattaattacagcggacaaaggaatacatgattattcctctagtgtttggctttaaaacccagcattgcctccggagttgagctaaggtggaacatggtgaagactttctgtaaaccgagaacgtgcagagaaggaactgagagccagtctagagaggcagtgaaagccgttgaatctacccattctggacttcagttaagtgcaggctctttccaggcttgctttctgaagttgttgaaaaaaagaatcagaatagtacaacggcagataatcgggcttgctttctggaacaggatgtcctggcctcacatactctaatcttgtagattgcaagatcaccaaggagcacagacaggcaggtgctgtgagatgtcgattggtgtctctccagagcacctattgcctttgagtgaggtcctcaatcttagtcatcagtcacgacatggtgtagctacacagtcttgcttcagaagccatctgtgaaaagcttggaggtaaatgaacatatttgactttcggcctcgagcaaatatcaagcaaattgctcatgtgcagattctgaaacctgaaatagaattaaatgtcataagaccagtccaggaaaaggataaaagaaaagtgggctggacacagtggctcaggcctgtaataccaacactttgtggggctgaggtgggaggatcccttcaggccaggagtttgagaccagcctggccaaaataccagaccccacctgtaaaacaaagcaaaaaataaattagctggctgcggtagcttgctgctgtagtccagctacttaggaggctgaggcaggaggatcgtttgagcccaggtattcaaggctgcagtgagctatgatcctgcgactgcactccagcctgggcggttgaatgttgattcagttctcaagcatagatgcgatagcaataaattaatcttaacgtaggggaaaatgtctcctgccccagtcttcacattgtttgccttctactctaggagtaagcataatgccacttttgatgggttttcaaagttattctatgcaaaaatcaacatatatggctatttcttcctcacctcctttttaaaaaatttttcttacgactttaagtcaaatatggtactaagattatattttatgtatagtttaattctggaattaattgcctcactttttagttgcttaattttctttgaatcttttgataaagtcttcttccaacagtcctattatataatgtatagttattttacatcttatttgttaactgataatagaaattttaggacgaactacatgtcagatggtgaagggagtattcataccttattcattcctgagaaaatgtgggcaaggtggctccaaacacctcaagagaaagcctgtgtgtaggcaaattaactaatattcggagtagttcagaattatttcatcccagtttaagacatgcgctaatttattatgcagagtgcttttgtgttggtaatttcattgtttaataacgttttatggcaaagaaatgttaatgtcgaagaaactacttaaaaatataggcaaagacaaggctatgtggcgtatttatgactagctacacttaagaggctatctttgccgagggtggtggctcacgtgtataatcccagcgctttgggaggctgaggttggtggatcactcgaggccaggagttcgagaccagcctggccaacatggcaaaccccgcccctactaaaaatataaaaattagctgggcgtggtggcgggcacccgtaatccgagctacttgggaggctaaggcatgagacttatgcctaatatatgagaaataccgtatttctcatatatttttattacagatttctgatatttgcaagtgaactatttttgtttcagattgacatgagctttaagtgtactttgttttagttactaatttagtaatttaatactgatgtgttattttaagattgaaaatgcaaatacttttgtttttttggagacagggtctctctctctctcgcccaggcagtgcagtggcttgatgttggctcactgcaacctccacccacaccccgcaagttcaagtgatcctcccatctcagcctctcgaatagctgggactaccgatgtgtgccaccacgctcggctaatttttgtatttttttgtagagacagggtttcaccatgttggccaggctggtcttgaactggacctcaggtgatctgcctgcctcagcctcccaaagttacagacgtgaaccactgtgcctggctggaaaatgcacatacctctaaataaaaccgacttagaatatttacttcttaaccatcttttgattaggtttgattaaatgtgcattgccactaaaggaaatttggggtattatgtaaattagcaaactattaaattttcattgagagttgtatattttatgttttgctgtttcagatatggctgtatcagaacttaattaaacacagctctctgtttgtcaagcagttggatggatctgagagacttacatgcttatttcagataaaaagattgatgagcctctgttgcaggtaaaattctattgtaagtcagtaacgtatataatgtattgatcaccttgtctaggggaacaccttttgacttttattttcagagacagtggcttttccatactttttttttttttttttttttttttgaggtcatggacttctgtatatattacaatttttactgtaggtgattcaggccggcatgaggtataaatgaagacacatattcagtatctttcagatgactttttctttcacggatgcctttgaattatcttgtgaatgatggccatcctggttactggagaatggaaggccagccaaaagaggactcctgatgtgtgagaatgattccattccataggggtctccaccaaaatgcagtttgaaagccccatctttagaatacacctttcatcaggctttttattatttatgtaggaacgcagcataagccactgccgtgactttcttgcattcagtgtccgaaagaacacgtgtaagtgatgtgagttacattacctgaatataacacctttaccagcttttaataaattgcttatatctcaactgtagtaaaattttcaaatgatcctgagccttccatataatttcacttaattttctggacactgtctgtaatatttgtttaggattactgtcagaactagtctttattaactgatttttccaaaatacttagctggaccaaaggtaggaataaagaacctattagaagagagaaccaagaggatcctagatgccagtaattcatattttttctaacttatttctttaataaacttttagtttgaaaaacacattgtatacattctttttgtgaagcaggagtttgcaaactttttatgtaaatggcgagatagcaaatattttagggtttgtggtccacatatggtctctattatgtatttttcttgccttttgcttacaactctttaaaaataaaggaatcatgcttcactcaacagccgtacaaaaaacagccctagggctggtttggcctgtgggttgtagtttgcaaaacacctttaacgtaacttttgaatgtatttgtataagcaaataattttgatacatgatatatgtaaatataattattcttttcccaacttttatttttaaaaatttctaataccagaaacacctgaagcccaggagttcgaggctgcagtgagctgtgattgtgctactgaactccagtttgggcagcagagcaagaccatgtttctttttttattatttatttatttttatttttgagataagagtcttgctctgtcacccaggctggaatgcagtggcgtgatctcggctcactgcaaccactgcctcctgggttcaagcagttctcctgcttcagcctctcaagtagctgggaccacaggcacgtgccaccacgcccagctaatttttgtatttttagtagagatggggttttgccatgttggccaggctggtctcaaactcctgacctcaggtcatccgcctgccttggcctcccaaagtgctgggattacaggcgtgagccaccgtgcccagccaaacccatgtttctttaacaacaagaaaacactcctcctcatctttcctctttaatctcagtaaggtctcatgtattttttaaaatacagtgtgtgacagatgacttttaatggtctgcttataggtagagagcaccctgtaagcagcccgtttttcttggcttggcctcatttgtattttgagagatctttgttttctgtgaggtcacaaagccttaagtgctctctctgccccaggcctggggctgttttctctaaggagcactgattctttttgatgagaaatggaattttaacaaaatgtaaatgttagaaattgtacttcaagtgtatgttagtaagtcgacagtcttatctgccacgtgccagaacattgaatttttctttttctgtaaatgtggccttccagaaccacctgcagctccttttatgactaatcacatacatattttttaatgccgttgaacatttctgaagtcatggaatcactgggtcacatagtagttatatatttcactttagaagaaactaccaaacttaggacagcagcataggagaggcgcagttcctccatatcctgaacccttggtattgacatttgtcaaaacccagccattctgatgggtgtgtagctgtattttattgtgattggaatttgtatttcctggattactaatgatgacgggtgtttctcaggagcatactggtcactcagatggctctttttcaagagtctgttcaaatcttttacttcattttttaaggtgggttgtctcttgacaatatggatatccttttcccgtccaaggctgtcccgataaacctggagctacatcctatgttgtctctcacacgaggcaccgttccagcacttctctctgttgcattatcaggtttacctctcacatgggattatcagcacacatgctgctgacttttccaggttgacaagaggctctcccaccgcccgccgctgccctttgcgtcccagcggcttgttatgtgtagccccgctcctcctgcactcgtacacccctcgagagacaccagtgtggtgctgaggggaaagttgtgaaaagggcaaagacaaaacaaggtctggctgggtgtcctgcccagcctgcccgctgggtcctcaccccctgtctctcctgggctttgcggctgttgagacagaaggcagcctgcagtaagcggataagccgtgtagacacaccccacccagaaccctgcacgttattcccctcctggcagggcagaaggcttttgtcacatagagaagttagtttcagtgaggcattgaaacagcctcctgggtccctcattaaaggtgatgtgtggtcagatggattctgtttttttttttttttaagaaaaaggaaaaacagctgtaaaataccttgtgaaagcaacaggagaaatctaaaaataagttcggtgttagacaaagtttttgatagaaaaaaggattggggtggggggaaagagggaggagtggactagagacagccaagaagaaactttcgggagtggcagatgtgctctgtgtcttgattggtgcggcctgcccgactgcttgtgctgccctctctaaacggatagttaacctgcagttcttctcatagtaagaagggaagcctcagtcaaaatgagagttgacttaggaccagaaatatatcattgttctatttgggggatattgcaggcgtggaaagtctcaaaagcatctttaaggagatgagatgcactgttaaagagattcgtatctgagtttaattaaatgcagcttcttggtacaattcatggattataatacttcttacagtgttttgtaatctttaatttttcgtgttcatttctccactgtccatttttcttgtctgtgaacttagtgccagcataccgtttggcacataacgagaattcttttaaaaactgtctgaatgactgaatgttagttggatgatttccctgtctatctgtaagatgtccctattttcagagataatcttgtactggaatagtttcttaaccattgtcactgagagtaacttggggaaactggtgacattttgccatcctgtaagtgtgtgaatacttttttcatttttacaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatggtaagtagtaggcaggatcagaactgtggctcagcatcccgatggggagtgagcagaggccagcctgctgctgtgagcctgtgccctcagtctcaatgtcagagcggtactggtgtcccagacgccttgtgctccatccacaggtgcccaccagagtcccagattccaaaatctgtccttggctccacccactctgaaaattcagaaacatgctactctctttgcctttttcttttgcttggaagtgaaccaaaattgacatatgctttcatcagttgtcccgtcatccaagattggtgtctgcagtgcagctgccggtccttcacctgaccaggaagggctcttaccacctcctggtcattctgagtgaatgggaaaggtaatgccaccaatgtatgagttgaacatcactccaagagccttatgaaaaagtaaattttgttaaatgatttttcttccaagagtgaggtcctttcacattagttcagtagaagagaataggatatttagtttgaattttctaactcagtgctaaagttttaatacattgataatgctcctaaaatgactgcatcgtagaagctatactgaactgcatctgaaacccttgaggacacattagtgacactttctggagaaaaaggatgaaataaacatgatttttaaaaattttatgaagtgagcagtataaatcctaacacaaaagaacctttggtctcgacatcctcataggtagaaacccaagcacttcaggactcctgggctcgagaagtatttgtcagcattaaaaatgtgcgtgagactagttgtgaagggaggtctggagagccgtggctgcagacagaattataagcagctgtgctttccttcacctgaagtcatagtctgggttacatctaacggacttgaagtctggaccacttggtcctcttggtcctctgtcaaaactacagaaattaaacgcatactcatttcagccttgctgcttggcgtgttactattttttagactccttagtttgttgaaaacttagggaaacagtattccgagttaattaaaagtaaactgaaagttgtggaatttgatctttttaaaaactaataattaaaagtggttcattgtgttagttgacatatatactgttttaagactaagcgtttgagaatttgtatttgttttctaaaattgtaaggaagatatttaagaaatatgcattatttgaaatgtgtcccaatatacgaaatgcttaaaaatcttacacagaaactgccgcttctagcatcttctgtggtacagcagttgtttactttctaacagtcgataaaattttagccttttaaattatagtattaccattatttgtattgttattgcacattctgtgccatgaagctttttaacatttgcaacagaacctttgtcatgttgtcagtctattcagtaagtacattgttagttatgttagtcacttttttaaaaaagtctctgtgtattttttaaaattcttgatgtatttttatctttttagtttcatagcaaaagagctttcaagctttcatatgagtttcactagttatcagtatacactaggttagacttggggtagttacaaagtaggtctaatgataaagtactgagtatgcattgtttggtgatcttcactcaaatacgaagctgtgtaggactgtttcaaaaactagcccatgcagatggattgtttttaatgtgctaccaaatacgcttgtatatgatgagatactcaaaaattgcacctgaaccttcttattctataaaaatggagtaaatgattctgaaagaatatatgatttggatcattcttgatacccagagttatgttcactgcctcccacccagagttcctatcagaagcgtaggctggatattttaagaggttctgaaagttgtttcagtttacgtataagctgcctttaaacagttaacttcttcagttcccagattgtggtctccaaatacatcatctcctctaaaaggagcttaagagtttctggagaaaaggctgattgtagggcgggatgcaggactgccagtgaccctggggctcaggagcctcctaaagcccaccccggggccccaggtggagcagcatgaggtcaggactacagtggaatgaaacctaccaatatgttcaactctatgaattcaacacggtgtttaaaaaatgcacaaatcagagacaaattataagatcacaatatgtggtccttattgagctccttcctgatgcaagcaaactagttaaatagaatttctaacatgagacagttggagacttgaatactgactagatatttgtgatgttaaggaactactcttcatttattttagctgtgataatgtttttaaaaatagtctcttaatgatacactaaaataattatatcttagacttccttccaaatgagtggtatacaggtgaaatgagattggctgtagttgacagttgttggtacatgaggtttgtataccgttcggctgcctatatatttgtttagttttccttgctagcatgttaaagaactaacttaagtttggacctgtagagatggttaaaagcatttaaaaattggcaagttttttcccttattacaggaaaaggcactaaattttaaatatgtgtttttccttttagggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggtgagactggaatggatttattgattttgtcctttcacaagatctatatctgatggtaacttttacataggatgtgattttaaatatagacttgaaattcaggtttttactttattagtgttgatttagtttataggaaagtgtactttttctttctggcctgtagcctaatacaaatttgtgattctgataacatggttattttcctgcttttctaagtaactgtcaaaaattaacgaaaacatggtagttatcttaatagagaagacattaagtttactttaggttgatctagttgatattaaaatggttaacttggctaatttagaagagtagattatccttttagaaggatattttgaaaggtgattttaatcagtgattggatggacagtataatttgattttataaaaagcttctgtttttctttttcaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggtatgaaatacaagatcttttttacctgaacacacatatgggtagcattggcagatgagtcaagagaaggccatgcagtggcaggtgttatggaaaggtgggcctctcctggaggagtgtatttgctggagggatgtggtctgggcagtgtgttcctggggacagtttccagatacagtggaaaagactgacatatatatgtgtcttatgaggccacacagattattttaatagagttaacagagttaaatgggaaagctcttctgtgagtcaggcctgtttccctccctctgctaaatttccagtgtgcctcttctagaataacatcttcctgtagtatgtttgaaaacatacatacatacatacatgcatgaattattcatgaaagaaatataggaaaatgtgaaaaccaaacttttgggggttgggtgcgggggggtatatagagtctcgctctgtcactaggctggagtgcagtggctccatctcagctcactgcaacctccgcctcccgggttcaagtgattctcctgcctcagcctcctgagtagctgggactacaggtgcacgccaccacacccagctaatttttgtatttttagtagagacggggtttcactatgttggccaggatggtctcaatctcttgacctcgtgatccacccgcctcggcttcccacagtgctgggattacaggcttgagcccctgtgcccagcccaaactgtttttcttactctctcactcaacactgaaaaattctgtgagcagaaatgtggggttttttttcccacacaccaagcaattcttcagtggacaccaactaggtattctacaattcagttcaattctgatgccgtccacccggagataatgtcagatcccatcatctgagggcttagtcctgcaagactacacccacttcagaggccgattacaagtagtaggttgtcacctatacttctgaccaacctgcaaaaatgggggttcctcagcccctccttgggattggtaattgactaagacagttcacagaactcgggaagtcgaggtgtgcgggaatggggagcttccatgccttctccaggcactccacactctcggcacctccctgtgttgagctcattgtgtcttcctgttgagttttatggtgcttcttctccagtgtccctcccacagacagccccttggaagttggtgcgtggggctgaaagttccaaccctctgatcacttggtttttctggtgaaaagccccattctgagtcccctagatggcctcaccataagtcacctcaagtatgatcacaaagggctggctatgaataacaagagactctttatctttcaagaaattacaagagttgtaggtgctttctgacatgaacggggacaaaatctaaatatgtttcctattataacacagttagaattttaaaaataagatctggtcagaaatgcctctctgcgtgtgaggaaaaatggcgtcttcgttttccattttaaaaaataatgtttaactaaaatacgttttaactgattgttttgcaaaggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggtaagccccgtgccctgcatctggggggctgcgatgcaggcagccccgtcggatcttctagctttctgtccacccgtagtttcagttacacaagtcagaccctcaagcagcctttgcagagaagccccgtcagccccactaccacagtttctagtgatgggaaagtctctcccaccgctttgttagcacgttcatggaagtgtaaatggagacacatagctttgtgtttggttttttaggcaaaataggatcatactgtatgttaacttagttattaggaaatattttctggaagtgaaattgttgggtcaaaaagatcctttttaccctatcctgtgaacaccgggtagtgtcttccattaattcctgctgattttatagaggataaatgttatttacttaaaaattactttcaagttcttatctcttttcttccttactattgagtttacagtatattttcagggaataaaaaactttaaaattatatatacatgcatacataatttgtgttttacttaaagaatttaaccgccaatgactttttttggtcttaagcaattgaaatggcttgaggtatggctatcataagttgttattttttcattaaggagttttatattgattactactaagtgtaatcacagaatatacttgagagggtctcagggcttccaggtgaagtaaatttttagaatattgtgaagtgggtgtgtcagtgcagtgctgcaccttcctggacaaagagcttcactagtatcgaatgaaagagatcacagcaataagaaaaggatcgataagtcagctcagggcttgattttttttaaaaaataagagaagacaaagaaaggaacagaagatattcactgccagggctcatggctgaggggtgggctgatgacaaaggagtgaagccgtttttatagtggacagtggatgctggaactgttgcatctgtccaaactgtacaccaacaagtattcatttttttgtatgtttataaaaaagagtgggttctgtagatggaatgtagataaatttttgtttttggaagaaagttattaaatagtcacctcccatagaatttgtgaaattaaacccttatttatatgcagtgtattttgtattcatgtgaagatgaggctgtgggctttctcagcgagagagaggacaggtttttcctcgctgtgggtgtgcaaacacgatgaaagcagaacatgcggacccgtgaaccgggaaatcacctgcaggctctcactcgtgctcacactttgaacatttaagaagtgggatcagtttcttgatttttaaaattatttacaaccatagaaaatattactctatattcttttttaatacataagggtttcaaggtctgtgtattatttaactttatactttaattttcctttttttgtttattctcttcattcttcctttgtcttgggtattgtccacatttgggctgagaactaaagaccccattttgagccaggcactcataggtttcactgcaagtcattctttctttgccatgtctcttacctgtatgtttctgtgttgccttttctttcccctggcacttaattatataaaacctaatgtgattgtatgagatttttccaaggtcaaagttcacccttgataagctcttttgcctttaggtttctgtataatctgttcacttatagcttatgtacaatttattttaaaattgtacactacaaaaatagtagtgctaggattcctttctcattctgacgtacttttgttagtcttaatgttaaagattcaggtttgacagatgaatttactgcttttatctataaagcagtgttttgtttggtaagttattataaattatataaattgtattcatccaagtttccagacaatacagtcagcaatacccaatgttatatatattcacattcatatatatatattcatatatacacatacatatgaaaaaagtatatatctttggttactgccccaaatgagtaaattgcatagattggcttgggttatattcagtgaatcaaatcttctggagagattaaggtataaaatagatttgtgtagcctttgattttaaaaaattcgttaataggctgggagcagtggctcatacctgtaatctcagcacttgggaaggctgaggcagctggatcatttgaggttaggagttcgagaccagcctgaccaacatggtgaaaccctgtctctactaaaaatacaaaaattagctgggtgtggaggcgggcaagtcccagctacttgggaagctgaggtgggagaattgcttgaacctgggaggcggaggttgcagtgagccgagattgtgccactcagtccagtctgggtgacagagcaagactgtctcaaaaaaaaaaaaaaatttatgtaatactctcacttattttgcttaaactgtgatctcaaattaaaatgaaaatgccattagatgatgatagtttcactatgtatggttgtcttagtgcagcttgatgtaaaaaaaaaaagtaggaaatgaagtttttttgaaatgtaaatactgaagctactgttatatcataggcaaaaaccgggtattcagagtttactgtgttaggcaaaatggatgcctactgttgactggatccctagaggatttcacactaagtgtactgtgatgtagataattttgagatgatgcctagctttctttgcccgaagaaaaatgtgatttcgtatatgtttgtagtgtagaggacgttccagttgagcacatttatggagactggttgttctggtatgttctaggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcaggcaagtgtccgtgggcgtctgtgccagggggtgccagccagagaacataccttcctccctgggaattgctctcctcttaagttttgtctgctcttttctggtagagattgatgtaggatattctactgtccaagcgtttcataaaaaataatttgtgtttttcttttctaaaccaacaaatactgagaccttttcctggcccgtgaggctctcaagtaccctatctgtaatattttctgtagtaccttatgaatgtgagtttattcacccatctgaaaggctggactcatacctgcattagtgaaacactatgttacatatctttttaggcttttttcatagtactcgtgttttatggggttttttttttttttcttcttcttcagacagcatctcactctgttgcccagagtgcagtggtgtgatcatagctcactgcagccttcacttcctgggctcaagcgatcctttcaccccaaccttctgagtagctgggaccacaggtgtgcaccaccacacctggctaattttttgtttttgtgtgtgtgtgtgtttgttttttgtttttttttttgagatggagtcttgctgttgcccaggctggagtgcagtggcgcgatctcggctcactgtaggctctgcccccctgggttcatgccattctcctgcctcagcctcccgagtagctgggactacaggcgcccgccacctcgcccggctaattttttgtatttttagtaaagacggggtttcaccatgttagccaggatggtcttgatctcctgaccttgtgatccgcctgcctcggcctcccaaagtgctgggattacagacatgagccaccacacccagccttcatagtacccttttaattagattgtccttgacaatttatccctaaaagtaaatttttgtttttcagcctttgaaataaacttttggttcagacaaaacaaaacctgcaagttaaaaatatggcctgtttgtgcttaaataattgtgacaataatcttgaactgttttctctccctccaatttgagtgatatgttagtggtttcttgagaatttaacagaaaagtattcaattggatacagagtaaaatatatgtagtagttctgctaggacccaagggactgatgttgcataggcaaaagctgtcagtaagtaagcaggtctgacgttaattcacgttaccctacagaattctctttgtttttataaaatgccatcccatcatatgaaaagagtgatttctgttggctaagaaagcattctttgaaatgaactgtaagtaaggaacccatcggttgaaatggccttgtaaacactaatgtggccaactaatgaggtgctgtcttcactcactggtgtttattaccatcggaggaagtagatgtcagtgaaactgtggctcctagattaggtccttagctctttgccggctaattgcatgagagcaggatgtgagatctgaggatcgcagcagctgaaccaggacacttgcttttattgtcgcacaacccattgctgtggatggtaattgctggatttcaatgcatcactgccctgggctgaggtttactagagaaccgcttccaaaaggtgtttaatgggtgaaggaactttctgtgtaggcttgattttatgagtacagcacctatttcctctaagaaactactctaggaattttatttatggcttaaacatattaggttctagtatttagaaagagcaagtaggcttactctaactgttacagattttaactgctttcaattttgatttttttaaaaaagtatttgaaagatgattagtatattcccaggctgataactcattcacaggccctcactgattaatattagtcccttttattttcagagttaggatttgccatttaatttctgtttaacactgattgtcagggtgtacaaatgaatgtggagacctttgtaccctgacatggaaagatttccgagacagatgcgtacatgaaaaccgggaagacacaggacagtatgtagaagaaccggcttttcctataagaaggatggaaaaaataggaatatatattcatattgcataaagaaacttggaagcatatacaagaaactcatgaaagtgaacactcgtgtctgaatatgccgaggaagctggggctggagcagaagtgctcttctgagtacactatttttatatcacttttaagttttggattaggtgaatgacttaatattttaaaattggttaagtaataaatgaattgccagctccttttctgagaggaaattttagatatattaccattggacgtggaaatttggatttaacatttttaatatccactattttaaaatatgattaaatattcactggctatattttaagggggcaaaaaataaaggctctactgcagtatcagacaactaaaataagaaagtaggctaccaaagatagcctgttagaaaagtgcttggctttcatctggcatacgtggggtttttagtgggtactgtttcagagtttcattgactgcatttgtgaccctacttacatgtagatgaggcctgcggtgcccactcagccccgcggcattcctggcctttgtgtgtatttcacattcctcgtccttccttttcctgactctttcaccggcttctttcatagataccatattcatgtgatttttcctttacttgggcttctcagtttcctttgtgggttcttttttcccctctttctcactctttcctaaacttctttttgtattcagttttttagggttgttagtttgtgacggagtcttgccttgtcgcccaggctggagtgcagtggtgtgaactcggctcactgcaacctccacctccagggttcaagcgatcctcctacttcagcctcccgagtagctgagattacgggcacccatcaccatgcccagctaatttttgtatttttagtagagatggggtttcaccatgtaggccaggctggtctcgaactcctgacctcaggtgatctcccgcctcagctttccaaagtgctgggattacaggcgtgagccactgcgccctgcttagttttttagttctttatttggtcctctgggtaatctctttcatacaagtggcttcagctacattctagtgactctcacatttgtgtctttagtttaagtaactttctggagctccagacacaagtgtacctgcttaataggagatgtccctggggacctctcctctgtcccctcccagggtctgaagttgagtccagcatctctccctcttaagagcctcctctttctgtccctgttttggtgaacaggcccgtcatctacttggttgtctgtacctgcagcctgaaactgcagtgtcctgcatggtagccaccagtgacgtgtgttttaaagtaaattaaatacaagcacagactcaggtcctcggctaccaaagccacatttcaagtgcccagtagccacatgtggccaggggctaccttattggacatcacagattagaacacacccaccctcacggaaggtgctggtgggcggtgctgcccagggttttggctcagtattcccaccatggtgctcgagagctgtattctctatgtcatggtttgccagcctgacttgtggaaaatacaaccctgattattgcattctcttgaacagtgtagactccctttgcttttaggaaaaaattcacattccttggattattgatttgtgcagtatccccttgttatcaagcatttgtttacctctcaactttatttctagcacaaaatactttttctccaaccataaatgaggcaaaaaggcatatcttgcattttcttgatcccattgcgcttttttatgcctccatggtgtttcgtgcccctttccttttgcgtatgccagtctcttccagttaatgtctgggctggcatgttctcaggggcttggctcttttaccccattgatggatctaaaagttttgaagcagaattttgaagatagtgttttaggggtcgaagaggttgatgttataatttgcccgtagtttcatttaaatacataaatcataagacacctagttttatttcaacatatgcttgatttttccaccaaaaagtagtacagtgaagcagcttaattatgtcttgtgttgttaatcattgtgatttagataaacagcggtgcgcctcgaagcgcagtgcttcttttctgtgcacgcgcgtgtgtatgtgtgtgtgtagtgtttgttggttttgtctttatttttgtttttgttttctgaaacaaggtctcactttgtcacccaggctggagtgccgtggcgtgatctcagctcactgaaaccccgcctcccaggctcaggtgatcctcctacctcagcacccttgagtagctgggacgataggcgtgccaccacacctggctaattttttgtaatttttgtagaaacggggttttgccatgttgcctaggctggtctcgaacacctgggcccaagtaatctgcttgtctcagccctcagcctcccagagtgctgggattgcaggtgcaagtcactgcgcccagcccctcgtgtgttttctaaccatttctttgccatgtgttttctaagaactgtggtgtatgtggtggggatgaatgctctttagctctgagagatttatagcttcatatcttatactttaataatttgggataaaatgattacacagatgacttcaaagcagaaaaatacagatttgtttttcattgtatgtgtagaattaaatatatataccgtccatgtgtttgtaaacaagtttttataatattttggaaaaaatattgaggatgtgcctggagagagaagtaaattttgtctataatttcatagctgcttttattatcagtgatattttcattataatcaatagaattaataagctattgattcatgttaaaaattgcattctctttcatgaagttcaaataacattgatgagcttttaaacatttcagcacatagtgatcttaaaattaaatgtattttgaaatcctatctagattataaactaatttccactagctgttgttagacacatcaaataaataaaatagacttgccttcgtcagcttcagcaatatcattcatagttctgaatcttctaagaattcttagaacatttgtgaatgataattgtttcccgggaaatatgagtacacttggaagaagcatattccaccaaagtgattctaaatccctaccacgtttttaaagttttcttttaagcttgttaagaaatagtaagagaaggggcttccttttcgatccgccatctgcggtggagccgccaccaaaatgcagatttccataaaaacccttacggggaagaccatcaccctcaaggttgaacccttggatatgatagaaaatgtaaaggccaagatccaggataaggaaggaattcctcctgatcagcaaagactgatctttgctggcaagcaactggaagatggatgtactgtctgactacaacattcaaaaggagcttactcttcatcttgtgttgagacttcgtggtggtgctaagaaaaggaaggagtcttaccccactcccaagaagaataagcgcaagagaaagaaggggaagctggctgtcctgaagtattagaaggtggatgagaatgacaaaatgagctgccttcgtcgagagtgcccttctgatgaatgtggtgctggagtgtttatggcaagtcactttgacagacattattgtggcaaatgttgtctgactactgcttcaacaaaccagaagacaagtaactgcgtatgagttaataaaagacatgaacttaaaaaaaaaaaaaagaagggattatcaaagaagacatttgaggtagtgaatgccactttcccccattttaatttaaactgtagcatgagggaaagtatgttttttgaatctgtaaatcttttaattaaagaaaatcagttgccagtaagaagggctggctgtttaaattggttctggtgtcaatgctggaatgctagcgcgcctgagtgtctaaggcttacctcctactcttagctcctagtttgtgaagagcaatttttagcagcttgtctccagacgaaatacaccttaaaatttttattagtaaggacattggaatttattttgaatcttgcattatctgatgcaaattattatatatctgttttattgctttttatggcattagaagtgtccagtaatatttttttaaaaagaaaaatttcagagaagaacaaattattgcctttgtacttgtgtgctataagagttcgacagatcattgggtgtctcgctgtttcttttacctgtggcacctggacttagaggggaattctcagaggatgccatgctgtggtggccttgactccttgtgtgggagccagtgtcttccattgtgttctctttcataactcaagagagtccccgtggaaaactggcctgaatttatgacccggcttactgattaactcataggattgttacagctaaataaagcttaatgagtaatttttaatctatcccactatgtgggagaagaatatcacttctttacattttagaagtagagccccagactaaataaccttcagaaatttgtctttttttttttttttttggtgaaaacattctttattagtaagcagacatttgaaactttttgattacatgcatcatgcaaaatgactgacctcacacatggttgtctgttcattgtgacatcttttttgagatgattacaaatttaagatgactgcagtagtaaaaataattcatgaaaatgactctcaatgaagcaaaacactacatagcacacatgaaatactgttcatccctcctggatgtttaattctctcctaacgtaaatctctattttggaagactattatttacaaaaatggcagttgtttttgtatgtgcatctataggcactgaactgatatgaacaaaatttcaaataattttacaaggtttggttgttttttcctgttttgttaatccaaaacaggacaatgccctttgatttacaatgttcagttcttttaagaaatcattttctttggaagatgattttgacccatgaaaaagttgttttacccctggtaatctttttgaaatggggctggctgttatacattatacaggttgttttcagttaagtgaaaaggagttgggcttgtcttgagaagaattcctctaaattatggcactgagaaaacttctctgcagtggtgggctcaccacttccatcctgtggtagttctggtagcactcctggtatgaaaaccctagcacaggtaatttcacctctttgaaataagcagtgatcctggagaaaggtgaatattccaaatctagtagcatattcaggtcatctggcagagaagtaggcataaaagacttttctaggtacttagaatgctgctgtaacaaatatctaaaaatggaaaagtggctctggaattaggcagtaggtcgaggctggaagaattctgaggcgcatgccagaaagaagccaaattgccttaaacagactgttagtagaaatgtggaatgttaatgctagggaggccttgaaggaagaaaggagtatagcagagaatacctcgattgcggtaaaatatctaaatcatcatgaatagactgttggtagaaaatgaggaatatgttattggaaaactggaggaaaaggggtccttgttacatagtggcaaaaagctaagctgaattgtgtcctgcagttatgtgtaaagcagaatttttaagtgatgacttcagtattagctgaggatatttccaagcaagctgtggaaggtacagcctgctgtcttcttgctgattatggtaaaatatggaaggaggtagataaattgagggaagaactgttgaatataaagaaactaggacttgatttgggaaattcgtggcctattcaaggcaaaagccactaaaactaagagattcactgtcaggacagccttctctagagaaagtgatgaaggtatggctgtataaccttctgctaatacttcagaaacatcaaaaggtctgagtatcaagtcacacaaaaggctctttgaggagattaagagtgtgaatcatagatcctcccagctatttcagaaaaagccaaaattagagacgggattttccaggaaagatatgtgaggagcctcctgtgtaaatgagtgaatccccatgacatatgtaagagacccacaagtttctcgacaatgttatagcagcagaaacaccactatttttaacagaatgctttagagaatataaaagaagaaacaaactgataagctgatactcagctgcaaacatgtgctaccttttgtgaaaaagtaaagatgattgagacagtcacaagcccagagaactgagcagtgagctgaagattactcccaggccttgaaactgaaaggagggtgcctggctggttttgtaaattgatggtgctgatggctccttttttcatcccaatttctgctttttgaacaggaatgtgtatagctgttactgtatgcctgtcacaccatcatacatgggagcagataacttgttttctaggttcgcaagtgcacagatggaggagaattatgccccagaaatcacacccagatcctctcccaaatttagatggctttagtgtgagatttgagacttttgagttggtgagactcagataagattttggatttagagttgatgctgtaataatgggttgtgacttttgagcacctatgagtgacgtaaatttatttgtgatggatctgaatcttttaacacaggggtggagtggtggcggggcgggggttgcactgtagtaggcaagaagaataatgttccatgtaaaacgttaatgtcctaatctccaaacctgtatgtaaccttaaatggtaaaagagattttgcagatgtaattaaggttactatggatttcaagacgaggcgataagcccagattatgcaatgggactaatttaatcatgagtcctgcagagaacctctccagggtggtgtcagagagatgtggtaacagaagggtcatagagatgaaacagtgctggtttttaagatagaaggccgcaagccaaggaatgcggatgttctctagaaggtggaatgacaaggaaataaataattctcctatgcaacgctgccgacaaactgatgttaaaagcaccgcgaaacccgtttggactcctaacctatagaattgttaagataataaatttgtgctattttaagccacattttgtaacttgttatggtggcaatgggaaactaaccagaagtgataactaaggatgaagtggtgtctgggaagaagggaaaccttctgacttcagaaatacaaacatttatgctggtagttctttagatctagtctgtccgacagaatatacattcctgtatttctacactagtcttgttctggagaagacgttctaggttgagcacatagaagagtgtttagtgtatatagtgagtttcctagaaaaatgtgttgaatgaataaatgaatgtgatcaaggcaagctctgggaggaactgtaattacttgattttaaaatgctgttgctgtttatcatatcttcttaagaattgctgacctttaggccaggtgcagtggctcacgcctataatcccagcactttgggagtctgaggtgggtggatcacctgaggtcgggagtttgagaccagcctgaccaacaaggagaaaccccgtctctactaaaaatacaaaaatgagctgggcgtggtggtgcatgcctgtaatcccagctactcgggaggctgaggcaggagaatctcttgaacctgggaggtggaggttgtggtgagcggagatagcgccattgcactccaggctgggcaacaagagcaaaactccatctcaaaaaaaagaattgctgaactttatgtgtttctgtttaagttcacagcagtcataattctgcaaaatacaaggcaaaactgtcgtttctgatactagtaatatatctaaatcagtaagtaaaaaggatgtgtaacatcttaataggagaaataattattgtatgatcaaacaatttcaaaatcaaactagacacttttcagtatttactacagacaaattttcaacttatttgatcaaaagatttcttaatggctgttagtcaatgctgcatcaagaaactttagtgcaaattttaccaaatgcatttatcaaaaaggggttttcatttttttctgcaaacaaaacattaacactaagtatgtaacaaactgatttgcctacaaatccaaaaactatcaacataagccagtccttcaactaaaaactcaaacatacttatcttaaggtctattcctaatccagatttgtctatattcaggttggaagacagaataacaataaaaccaaaatttatctgtaaaaataataaaaataatttgtttttttttttttttaatgctggaggtattgtccttattaatacgacacatcatctgttcccacatggtactgcatggataggaacaatattattttagttgatggagtaacacagtgttaagaatatctgcttctagcagtgtcaggctttcatctgttagctctttattcggaaatgaagtcacaagaataaagtcaagagctgcaaattcaggacaagactgtacaataaagttccggacatccaggatcctgtgtgtactattgaatctttgtatcaaacgactcccatctgctaacctgatttgaatttttgttgttggcactgaatcatcaataagaacaaccgcgttaagtattgatttatcctcctcttctggagaggaaggtgtactgactatttcaggtgtaagccttccaagtttttgcccttctccactaaaagccttgaacctcaatctaggttttatgtattcttgatcctgatggtcctccatatcccaattcacttggccaccatgaacaaggcactgaagctccagggggatctctcctcttttaacaaactccagaaattgagcatttgttggttcattgtaaggtctcaattctccatcatctaaactgaaaccattgctccacagtttaagcaaaatctgaacatcttgtagctgattttctccatgcatatattcagaccgcttacaaaaggaattacccaatctgtatcctccacctgtaaatgacattgaggtggtgtccgtgggctcttgaagactgcagctttaggtctgtcagacttggaagatttgcgcttcacttcatcttcatacagttcttccaaggccagtttatttcttgatatgtcatccctttggctgttttcaagtttctttgcaggttcttcacattaagttctgcaaatcctgtgcgctcggaggccacagcctggaagatctcctctcctgctcaccgagctcagggccgccgccctccgccatcttccgctggctgtatttgtctttttttttttatttttttcgacagggagtcttgttctgtcacccaggctgaagtgcagtggcgccatctcggctcactgcaacctccacctccaaggttcaagcgattctcctgcctcagcctcctgagcagctgggattacaggcatgcgccaccacacctagcaaatttttgtatttttagtagagacggggtttcaccatgttgaccaggctggtctcgaacccctgacctcaggtggttacccaccttggcctcccaaagtgctaggattacaggcgtgagcacctggcccagaaatttatttttaaaagtttaatagtttgttttattattgcttattgagtgatttagtaaatattctgtcagggttagcttgaaatacaaattttaaaatgtgtattttaaatgtgtatttctgaaaatggtatttcagaaatatgtatacattcacatggaaagatgttaattataatcttagtgacaaactcttagaacctgtaggaagaactcatttttgtttctatgtctacacacaagggtctggatggatttatagcagggtattaactgatgatttctgggtagataagatgccatgtggctaacattcttttgccttgttttgttttaataacattttttaaaaactcaatttctcaactgaagagaaaataagcaaataataccttttcaaattattttgaaagttcgtatttttcgtagcttttttcttactcttttttccgtatgactgttgcgtattcttagcaaataaaactccacaaaggcaagaaaaaacgttaacactcttatcaggcatatggtaaggattttaaatatctcagagatagggtatctattatcattttctaatacagcttcccttttcaacagtatagtctttttcagagtgaattttttttatttttattttattttattttatttttttgagtctgagtcttgttctgtcacccaggctggagtgtaatggtgtgatctcggctcactgcaacctcagcctctcaggttcaggcaattctcctgcctcagcctcctgaatagctgggattacaggcgcctgccaccacgcccagctaatttttctatttttagtagagacggggtttcaccatgttggccagtctggtctcgaactcctgacctcaagtgatccacccgcctcagcctcccaaagtgctgggattacaggcgtgatccaccaggtccagccatatttcagagtgaattttaagtggaaatttgctcgaacattaatgacagacagcatacttagttacctgtcttaattggtctcctttaacttgtattattaccattttttcgtttttccaatattattaaatatttattattaagtaatattttccaataatattaaataatatttgttggagaccccgtttgagattctgctcttactggaatgaatgcagtgtgcccccactttgtcatggcgtgtgactgataaacatcatgcatgttttcataaaatcataatacttctgagctggaaggaccttagaacagatgtatcactgccccttcattttcttatgcaaacattgcttttagcctacatgacattggaaagatggctgggctgaatgatctaatagattctttctagcttaaggtttcctgattctaggaaatttcacatgctctttcatgcttttactgttttttcagtgatgtacccttattgccatctggatatctcaaaatgcattacattaaaataagaatggagtttagttgttgtttatttttaatcagtacttcatgattcctatggtgtactcagaaagtgccaatatggaacaatgcatttgatgttttggattgagtgcaggaaattactcgaccaatcaaatatgagatttttttattggattttgaaagacctcatctcttaaaaaaatatttatgctagctgattacacaattgtggctagaatgtttatcctgtcacaaacatgcagtataaaacagagctaatttaaatgctcatgcattcttcacaaagttcatcttttttaaatctaatattatagaggaaaagtttttaatttttatttatttttattgttttgagataggatctcactttgtcacacaggctggagtgtagtggtgcaatcttggctcactgcagccttgaactcctgggctctatcgattctcctacctcaacctcatgagtagctgggactacagccaccacacccaacttttcatagagatgaggtctcaccacattgcccaggctggtctcaaactcctaggctgaagcaatctgcctcctttggcctcccaaagtgctgggattacaggcatgagccaccgtgcctggcctaaaaatctttaagatacatttttttagatttatttttgagatgttaacagcacattttttgtatttcaagaaaagtgacttgagtccgtcactaaatattttacaaattttaaacgtgttaagtaggccaggtgcagtggcacacacctgtaatcccagcactttgggatgctgaggcgggtggatcacttgaggtcaggagttcaagaccagcctggccaacgttgtgaaacctcatctctactaaaaatacaaaaattagccaggcgtggtggcgggcacctgtaatcccaggtactcaggatgctgagacaggagaaccccttgaacccaggaggtggaggttgcagtgagccaagatcgtggcactgcactccagcctgggcaacagagcaagaccctgtctcaaaaaaaataaaaagaaaagtataagcagtaataacaatagtaattataatattgtgatatattaatacgatatgtagcagagggggagcaggttcaacttgtgcatgaaaacagcttatatctttatcttttggggtaggtctcacagccacaggggagggagggcgggctttcctagcttggtaacagcacagatttacacctttgggagccgtgtctcggtgtctcatcaaatggctggttgtctgaggcagctttttgtggtattagtacagagatttgctaaattgtacgttgatcttcagtgtatcgctttttttttttttttttttttaagaaatgttttgaataagtaattgctttactgttctgtgtttttctcctattcctttttaggcttctctacagtttagcctttaatgccaggtttctgagacatctttggtttctaatatcttccatgtcaacacggatgatcacagggtatgtattatacagacttataaattgagctcaagggcacaggaagtggcagcctaatcaaaaatgttgccagaacctgtttttaagtcctgtttatactgggcttatttcatattagaaggtaagttccagatggtctcagttgcacaaaaagaaaaatcagtgtctaatcttaacagttacttatctgtatatattatagagagtatggttttatctgaaggtaagtttcctttaaacatcctagccatgtttttaaaaaagcagacatttggaaattgctttgctccatatgactttactcctcttttcacagtgaaaatacagatttgaagtaaattaaagactgctgcaaacattagaacagtgtagaagtttttaaacatttgttgaaataatttgatttttcttatttgaatcgtgtaatttaaaaaatatcatctttgacttaacatattttaactgagtatgtaataggtaggaatttcatacttaaaatccttcatggtaaactgacttagcctagtactctgttgttgaatttttcctctgccagaagtctaagccggccgggcgcggtggctcacgcctgtaattccagcactttgggaggccgaggccagcggatcacctgaggtcaggagttcaaaaccagcctggccaacatggtgaaaccccatctctactaaaaatacaaaaattagtcgggcatggtggtgcgtgcctgtaatcccagctacttgggaggctgaggcaggagaatcgcttaaacctggaaggcggaggttgcagtgagtcgagatcatgccactgcagtccagcctgggtgagagcaagacttcctctcaaaaaaaaagaaaaaaagaagtctatgccaatccccctgtgctgtaatcggaaaagatgaagtgtgtaattcagttaattggagactaaacttacaagatgcaactgtgtgtcatgctcatggtagtagtgataatagcagtcactgttactgactccatgctgtgaaccagctcattcggtggtgggaagacacatctcagttgtagggcaagagtgtagaaagtggtcttgttttctttttaggaacaagaagttagaagaaagaatttttggtgggttggggtggtatatctaaaatataaacacactcatctgcaatctaacttgctgtgtgcagtcataatgaaaactcttgttgagatttctggattttgagctttttcatgcaatatgtagagcaaaagatattcatatgttgttcagccaggcacagtcagcccctttatgatgggactggtgttcaaatcatctggacaaaacagttcatactaatgaaaggggaatgtcagtttctcaatattattacttcaaatttttcatttttttaattgaatcttaagtgaggaaaggggagttttactgctgccgctgtgactggtgaaactcataaaggttaagtgagttatcttgcatcaacagtgggtggctaaagcagagacaaaagactcctagaatgatttactgtcttgagaaattcttttctttcatttccaaaccaaaatacaagattttaagtatgttttgttgtgttttttttggtgcatttcagccacttctgactacgccagctttggttttcattagtgacaggtttgttttgggcagaagggaattgagaatcattaggacaggaaattatcgtttacccataagtgccccagcttagcaacagaaacactgtcatagttctgcctgataattgcttatttgtttatggcatttgtctcttgctaaggaaatggagtcatggtgtgtgaaagaaaagtgggatattgttaattatattaaattattaatactattttatgatagggtagttttacaaatcttattaaaagacagtttgataatttgaatgtctttttacttgtttattagaatgaagtccctcaagaaactgacagtgtattaatgcgttcccaatacagatactccttgaggtacaatggggctttgtcctgataaacccattgtaagttgaaaatatcataagttgaaatgcattcaagacacccagcttactgaggcctcacagcttagcctagcctacctaaaacgtgctcaaaatatgtgcattagcctacagctaggcaaaatcatcaaacactaggccaattttataataaagtgttgaatgtccatgtaatttattgaatattgtactgaaagcgtaaaaacagaatggtttatggatactcgaagtatggtttctactgaatgggaatcacctttgaccatcttgaagttgcaaaatcctaaactgaaccattgtaagtcaggcaccatctgtaaatgtctcatatttcctactgggaataaagtttaaaatgaaataactgattttctgaaactggcactcaatttaagtcaaaaatagtttaacagtaaggcttgcattgctaggacttacagctttagtgggcagaagtatcatcaggggagcgtgttaaaatgcatattctcctgagacgagattgcgccattgcactccagcctgggtaacaagagggaaactttgtttcaaaaaaaaaaaaaaaaaaaatttcagcttctctgttcctgccctaagacttgggttagaaaccctggagactgcaacctcacaagcttatcaggtaatcgaggtacagatggtttgggggccaaccgagaagcactattcttcaccccagtctagcagaccacatttaaacaatctccagatggatagtgaattttgacacatcagacattttgcaaataacatctttattcatttacctcattttcagtacttgctattgaaatcagccagtttagtttccttcttcttgaagatgagggaacccatagccagctggtactgttttccattaggcatcccttgactacaacataacatagagatgctttgcccagatgtcttcagtgtgggcagtaggtgctggtgttggctgtttgataaataatctcaaaacagtctacagtagtattctgaaaacctgttaaagcaagaatccgttcttaaaagctctttgcaagggtgggggacattggacgaggaggaggagtggttcccacaggcacgcaatttgaaaacccttgttctcaagatctagacagaggttagggattgcctcgggtctcactgatggtcagtaattcacctagctcccctgagttatgtgtgaatcagtgtcttttccattacagtaagttgcagactttatttgcacataagtctttgagactgacctgttttcagaggaatatttgagtcagtgtttatagcagaaagaatggtcagcagagaactaagagacctgtgtctcgtttgtgccctgtctgcagggcagcattggcacatatccttgccaatcccagtttttgtcattaaagtaaaaatgatgcattccttttgcttgtttcacagggggtttgaagaggacaaataagtttttgttggttaattaccctgtcccttttttttttggacccaatataagaattttatgcatcctgcaatatgtgtgcataactgatgatgtgttggtggtgatgattcttgtcagggataacagtacaagtacaaggattcttgtcggggataacagtggaaagcaggctcatcaagacgcaggagtgggctccagctgtcataggcagggctgttgaaagaagccacccctgtccagttaaggcagccctgtgccttttttatcctccatataaacaacctttttgtgtcatcctggctttggcaatgaggtaggacaattgtgctttgtccctttttgaatgtcccacaatgtttaaattttggaagaatggcattcattcattgatgaatctgttcagcatagtgctaaatgcagagtatcacaactgcaaacatggatcatgtatgctcaggttgtgtagcatgtggacatagtgtatcttctctgtgggaacacagtttcaggtgcacatatgggttccttttctcaaagcggttgatgatggcagtgccctcccctgaaccatgcaccatggagactcagaagctccaggtggctcagccaagctccttacggccccgctaattagaacaagtggccttaccttctgctttgctttcatacatgatttgtagatcctgactcctggttacatctcatctaatatatacctgtagttttgtggaaatggatatttggggagataagagagtgatcttgctcacagtgtctgttaacctgtgattgatttgacttggtagaggggaccatggactttatagaaagagcttgcaggtgagcctattagctaaaagttccataagacaaggaaccagacttaaaaacgagagaaaaggaagaagttctaggtgaaataagtcaatttaatatatcgtagctcttttttatttatttattttttttggaaacggagtctcgccctgttgcccaggctggagtgcaatggcacgatctcggctcactgcaacctccgctgctcgggttcaagtgattcccctgcctcagcctcccaagtagctgggattacaggcacgtgccaccacacccagctaattttttgtatctttagtagagatggggtttcaccatgttggccaggctggtctcgaactcttgaccttgtgatccacccacctcggcctcccagagtgctgggattacaggcgtgagccaccatacccagccttttttcttttctttttttttttccttaatattttaaacttctttgaaacagagtctggctctgttccccaggctggagtgcagtggcgcaatctcagctcatggcaacctctgcctcctgggctcaagccattctcctgcctcagcctcctatgtaactaggaaggactacaggcacctatcaccacacctggctaattaatttaatatatcatagctcttgatgggtgaaaggctgctgagtaaagaccaccttagctgctgtgaaagcaggagcaggatgggagctggtgaataaagtggacagtgggagcaaggccaccatagagaactggaaactttgtttcttgaggttccagtttggcttcaatattgaatagctttcaacgttaccaaaagttaagtcgctggataaatttttcctgagaccagaatgatttgcctttattaaatatgttgagtagaagggaagggggatggtttcctcataagagtaaagtacatgtgtgtcttgaatagtggccttattagagctcttcttagggccttagtctgggaacgactggcttactcttagtaacttcattatctagttggtacaggtagcagaaaccttagtgaagattaatgggttggtatgctattttttgtattaatctatgctgtttattaacctgcattgccatggtgactttaccttgcctttaaatagtttaattcctaatgcaaatgttactttccctgattatatttgtttgatgttatgttttaattagttcccaaactaagactaattttaaagtgactggtttttttcttcttttctttaattcaaggtctatggtaccgttgcttcaggtgatatccaggggttctcctatgtcttttgaagattctagtcgaatcatcccactcttttatctttttagctccttgtttagtcattcactaatttccatacatgataacgaattcttcggtgatcccatagaaggtaaggattttgagaaaccagtttgctgctggccacttggcccatcagttttcatagacagtagaaaagttttaagctttttaagtctttcagtgtgtgttaaaagatggaaaaagaaacaatagaaaactggattgtgttttttagttgtaggtcaaagacaatcatcaatgatgccttttactttagaagagctgataatgttgtctcgatgccttcgagatgcatgcctggggatcatcaagttggcttatccagaaaccaagccagaagttcgagaagaatatattacagcatttcagagtattggagttactactagctctgaaatgcaacaatgcatacagatggaacagaaaagatggattcagttatttaaggtatagagtatatgtatttttttgtttactgacattgaaaaatgtacaaacttttgtcttgactcgttgcagaggaataaaaatgcaggtttgtttcagacatgttttaatttgcaagactttttttttttttttttttttttttttttttttttttgatacatggacttgatgtgtctcccaggctggagtgcaatgacaccatcatactccactgcagccttgaactcctgggatcaagcaatcctctcacctcagcctcctgagtagctggggctactggcacatgccaccacacccagctaatttattagtttttttgtagagacagagtctcactgtgttacccaggctggtctcaaattcctggcctcatggattcctcctgcttctgcctcccatagtgctgggattataggcgtgagccactgcagctggcctatatacctttttaattaagaaaagtaattttagtacttttgattaattaaggtaatttaattaactaaaattactttcattttaatttacatttgcctcacttaaaaccatgtttttaaaccttgttacatgcatcttttctatgtggccctaactacttaactgtgacacgatgaaatataaatacagtttttaaaatgtttttatttttcactaaatatttcttagattttattgttttttcaaacctttcaaaaattgattaacaacgtaaagtaggtcattaatttttaatgctagttgtatataaattattttaacatatcttcgttcttaaccagaaagtgaagttttgagttactgtggctggaatgttggcaggaaaccaccaccagtgagaatgtaactgttgggatggaaaaaaagaaaaggaaaagggtgcttgacttcccatgaaatttctgcagcaaacacatctagtcagctaaaattgctcattaaaggagtgagagcagaagaaatgcattttccaaattgaatgctagatttacagtccgtttaataccagcgacctctcgcacactaatgttcagttcgagtcatcagctgtccctttgggtcttttatcactgcttttgtcaagctatctatttaattgaaagaagttaattgaatgaaaatgatcaactaagcttgtattaatattgctaatggaactttcttcttggccatgtttggagaaagatgtcaagctagactttaggaagggcccattaatgcttgcacttaacctgatgggctaattaaggaatgcttattcatcctccaagtccacgagagtctctctccagcccgttctgcctggttttacaacacatttctcttaggagcatgagcattagcagcagcagccgtaactgataatgttttgattgcactgaatacagtcctaatgcatcgttgaatttataatttgggcagattgatgtaatatatgtttgcacaatttattttaattacctatttctgtattcctaagtaaactgggacggtcacatggtaagcctttactatatcctttcttaaagattgacaaatttgcaatttttctatgttaaaaaataagcagtctcacctatttaaaacttataattcttacataagcttttcctggatgtgggtgttaacggtagcatatttgttttcctttcaatatttgattaaaccctggggtctttgttaataaagctttccatgatgtgcaatatcaggtgttgtgtatgatatcagataatttcactgttttatggcacctgttgagagtttcataatttccgtgacaggcttatctttagtatgtagaaatctctgaacttaataatgccatataagatattttccaccctggccttattttgttttggttaagcgttaaatgaaaagtttgtacagaatttttttatgcctcaaaatgactccctgccactttattcatcattgaaagttttaagagttagggcaaggccgggtgtggtggctcacgcctataatcccagcactttgggaggccaaggcgggtggatcacgaggtcaggagtttgagaccagcctggccaagatggtgaaaccccatctctactaaagatacaaaaaattagctgggcgtgatgcacgcctgtaatcccagctactagggaggctggggcaggagaattgctagaacccgggaggcagaggttgcagtcagccgagatagcgccactgcactccagcctgggcgatagggtgactctctctccaaaaaaaaagagggtgaaaatttaccttttttttgttggtggtggtgattgttttaggtttgaaatcaagttgttgtaagaccttttgagtttagaattgtttaaagacctttttttttttaaaggatttctgttctttggtcacctgtcccccaaaccattttatgctacctgctattgagctgagcccccaaaataaaaatcactgcataatttttgagtaatcagctgctgttagctgttcttttaagaaaatactatctctattatgaagttgtatgaacttacacctctgtagttaactgtgttttaggcagtattctaagagttttgcatatattcatttaatacaatagttctgtgagaaagatactataatttgttttacagatgaggtcatgtatatgatggtagaaccagctgctattctacactccccttctgaaaagaatacaaattgtatcagcatttttcatattattgttgtgccaaatttgagttgaagaattcgaggtagaatcaaccaaagaacgcagaagcgtttagcccatgatctcctgccttccattgattttgacagaattgcaaacgatgagacctgactccttcaacaccgaccattttcatttttcagtcctatcatggtcctcccaaagtcatttgtgtgagaggctctgctggctggtcacagagcatagaattttaagtggatagagtcatctttctttgtcactgtaagaattgaggtcactttctaagccctgtcttgacactgctaaaacagtttatgcatttatcaaatttataaactcctcttgaagtgtaatttagagctataattactttagcttgatgagataggaaatcctgttttgagatgtctgtgtgcatccaccaaacttaacaggagtttcctcctgtgatagggaaacaggaggaagtggcagggaatgaggaggaaggttcccatgccctcattatccatatgtctggagagagagagagagagagagagagagagagagccatactatgagtgatttttttacttccttagtggttaagttgtattttttcagttccaaaaagctatttttaaaaagtaataaagcaacagcagtgccctgttaatataatcctaacatgcgaccatttgactatgttacaaccaagagatccaaagcttgtagcgctgtgccttatccttttctgttattgaagattttgattgattttgtttttgttttttgactactaaagtggatgctatatgcagtaattttatagtgttttaaatatgtgctgaagaatactgtttttcaaaatactccagtttttaacccgtttgtgccagaggttgcgaattttttgtgtgaaaaatcaggccttggcaatgaccttgagcagtagaatataaatcccacaagcttagcgttccagtaatggaacactaggcataaatgggttaacaagtggtaactaagggctatataaaatttggttaacccttgacagcagcagtgcataccagatacttcatgactttcataggttagagtgttttattctcagttatttgaacactcacagtattcatcccacccatagtgacacagctctatgctaagggatcataaatgaattcacacagggtgcctgttcctgcagtatcaccacgtagtgaaggagacatgcattcagctaatgacagtgggaaacagcaaaccacagaggccggtcctgtggaagcacacaggagagaagcaccagctgctgcgtcatctggcacttgactcacttgaggaaaacggttgttttccaacgaggtcatgttcttagagctttttctgacatgttacttttatatattcttcttatgaagtcaaattgtaaaaatccattctcatttgatgtatttcccacattgcacatttattgcacttcagaacctggaaattgtatgctaagtatgctttgtattttgctttttaaagaactaactcatctggtttcaggactagatctactgtagaaagaaaaaaaaaaattaactcagttgtttggttttagttaccagattttacatatcacatttaagataaaaaagatacttttattttatgttatgatgcaatttagtctttcagttgcccttcaaaacttggactatatgtacttaattttttggttgcaatactatatctaaatatccgtcatctccatacagaaatgtcacaatttaggattaatagccttgtcatctaatttatatatacatttgtgataatatagctagtgcgtaagaatatttccccaaggtcagttaagcaagattttcttatgatcatcattgccatgaactctcaaacatagcgatcttgtgaaaacagtgcctgttaatttacaatgtttaccttgaacagttgtcaagtgtgatttttataaggagttggtatgtttctaagcagttatctacttgatctttttaatattggggttaagggaaacctgcttacagcatcacctatttttcattcaaatggcacataatagagcatgtgtaacagttgtgtacctttgtggggtttttttgttttttgtttttctttttgagacagggtttcgttctgttgcccaagctggagtacagtggctcgatctcactgcaacctccaccccccaggctcaagtgattctttcacctcggcctcctgagtagctgggactacaggcatgtgccaccacacccggctaatttttgtattttttgtagagatagggtttcaccatgttacccaggctggtcttgaactcctaggctcgagtgatctgcctgcctcggcctcccaaaatgctaggattacaggtgtgagccaccacgcccggcagtgtgtgcatttctgaataaatttattagtacttgaataatgtattagtttctgcatttatttaatgtaacgttttgatctggcgtggaagaacatgagaggaggcacaagagttaacacatcagatggacataatgctattgtatttcagaacttaaaatccactaaaatttgtatattcagctagatacagctagttgttccagtgtttgctatcttacttcatataacttaccacactggttctcaagtcgtaactacctatcagagtcatctgggggagcagttgaaaactcgactggctccacctcagactaattgaattggagtcagtgatggcggcacgcctgtggtgggcttgtcttagtgctccaggtgattctaaaatgcagcaaaggttaagagccacaggcctaaccctgcagataactcactttgagcacatttagtcactttatgtgatttggcatggttgcctctacaaactttccctttttggtgctagatacttgtagagcagttgagtttgtgattctgaaagtgaatgtggaaaaaaggaatgtgttaaggtgtttcgagatcacaaaatggatccagtcaaattttcatgtttatatttttcattaaaacttaggagaaaaatagttgatatgaaggagggaaaaatgttctcagttgaattttaaggtttggtatttgatattctaaataagtattttgggaattggtccgggactagtcatgccatatttagcaaataaaaagacaggtcacctagttaaaattgaattacggataaatcacaattactttaaaaaatgtagttatgtcccatgcaatattgtggacatactttaaagaaagcaatattttggacatacttctactaaaaatgtattatttgatataaataaatataaacatattatttgatgtttattaaaccatccattaccacagtgccgtctatcttgatatcccatccttaacataactcccttggctggactcacttttttaccttctcctttcctcctcctttctccccatctccctccaccgcctttttttgattgaccaaggatccatggtactggcatgttatattggtaacatgtgattacttcttttttcatatttaggataggaaatatgaaagaggatacactatattgaaatttttttaacatttaattgtataataatttagtagaagaatgtaaatgagaacttaattgtctcatataatttgataatgtttgtaatctgtagaaaatatatgttcttatgaacagagattgaatagaaatagatatctaggagttaggcagacctgatctttccgttgcctgacctggagcaagttaccccctcaataaagctaagtttccttggggatgataaattcatggggaccccaggattccatgggatgatgcaattaaatatgtaaatatgtcagaaaggatgacctttgttaacggttggggtgattatgaaagggctaatttcagcatggtaactattaaatctggatttatttaaagtatcaatttaattggtcacaaaaatggaaagaccagacacgaacatcttcatacaaaaagattgtacttctgttccttttagaagggtgtgtgctctgtgtggactacctgaatttatcccatacaaggatagcacatgtaattagcatagctcattgagatttcatctttgcttttgaagagtaaaatgaatgactttcaagaattagtgtattaggtcaatgacagtactttgtttcagccaaacagttaaccagacagaactaataatgaggctctccccaggctgcctaggctgcataagaaaccattaattgtaagatgttgtatgtgcagctaagcccctgagcaacaccatagagtcaagggtcaaggaatagctgactccagtttaccctgattagttcactaaacatttccactcgttgaagaaggacggtatttccatagcgttgtgataggttttaaaatgccacaagagaatcgccacttctaaattggcacgaaatacccaccacttataaaggtgcatctttgatcttgagtgggtttttactatgcagttttatctgcatgaccaaattgctcgaataacactttttctctgtccacgggtaggtcattcaaggggtgtccacattgtagtggcctgagatatcaacccaagtacccttccccttttttcttgggcacacagaatttctggtatccctgcatgccttggatttgcatttcataaaataagcatttgtatttcattgtatgtaaatgctaaattatggaattttaaagggaaatctcaacaattgattgtgtgatctttataatgtataatatatccagtatagattagatatattataaatttatatattatatatactagatacatagtatatattatacaatttataactataatataaattatataaattagtatatatataatagatatatattagaaatgttatttctaatctagccggtgggtatattataaatcagattgtcctgattttgttttttctgtggtgatttccgttgtctttaattagaggcagcatgcatacaggcctggccgactttttcagaaaacgccgtcttgagctctgtagtagttatatgatccaatcctggttgtagacatttaaaatgttggatttacaattttggtttatctttgtttattacaaaatgcatttctattcggtagagaacttcaggtctttttaaagtaatgctattatatctctttaatcatgtattataaaatttacaattattgatctcaagtcagtcatttagtacctgctaggttccaaggtggctagttggattctatttgtgaggaactcactgcacaacaaccagagaggaactgttctgaaagaatattgtaattttttaaaaccataataaaatactaagctgtgatgacatagtgaagtgtgtccaggccagcctgtttggaaaggttatcaaggagatcagactcgatttttctggagttaagatcacagatctgactccatttgcttacgtgaggcaagtgctgcaattgttttctctttgggagatgtgacagtgatatctggggtgctgcttttttcccctagtgccgttagtacattatttctcagaaaactcagaaatactctttcaggaaaaagttgtacaaaattgcaccacttagaggtatctttcattagaactcagatgagctaagacatttccaaattcgtgggtttttttttttttaatattttaggtttgggggtacatgtgaagttttgttacatagataaacatgtcatcggagtttgttgtacgcatccttagatcactcaggtattaagctcggtccccagtagtcatcttctctgccctctccctcctcccaccctcccccttcaagtagatcccagtgtctgttctttccttctttgtgttcatgggttcttatcatgtagctcccgccaaatttgtgtttcaaagcttaatcgccacctccgttgtaacttaaaaattatcatgtacatgtgtttgtgttgttctgcacatatttgttggcagataactgctttgtatacattattgtgatggcaaaaagaagcccttttctgtgagcgggtttggtgtccggctcgacctgggttcctgcaccaccgctgtgtgctcctcctcgagtgaatgtatggctcactgtgcattgtgctgccgagctcacgtgtgtgacgcggatatgttctttcttttcaggttatcaccaatctagtgaaaatgttgaagtccagagacacgaggagaaatttttgtcctccaaaccactggctgtcagaacaagaagatattaaagcagataaggtgttattgaaagatctttttaatatttatcattaaaaaatacattcagcttgtgtctttctggagagaagaattaagcactttaaaattatttattttatgactcatatgactaaatagtaatgataaaccttattactaactcttacgccaacttcttaatggaacatatagcagtatcattgacttaaaatgatattctgagttattaatcctcaattttcctttttaacctgagattatattaaagccttaatgattctttgtgaggttgaaaaatattttgcttttattagtattaatatatgtctagtatttaaaagagatagatcttatacctaatttttgtgattttttttttttgagacggaatcttgctatgtttgcccgtggtggtctcaaactcccagcctgaagtgatcttcctaccttggcctcccaaagtgctgggattacagacgtaagccaccacaccagtcctttatccttgattttctaaaagaacagagacaaatttgaatattactaatacctacatctaaagcagattcagtagtatgatacgttagtaaaaaatttaagtggccaggcgcggtggctcacgcctgtaatcccagcacttggggaagccgacgggcagatcacttaaagccaggagtttgagaccagcctggccaacatggcgaaaccctgtatctctattgaaaatacaaaaatcagccgggcgtggtggcagacgcctgtaatcccagctactcgggaggctaaggcaggagaatcacttgaacctgggagacagaggttgcagtgagctgagactgtgccattgcactccagcctgggtgataagagcgaaattccgtctcaaaaaaagaaagaaaaatgaaagaaaatacaaatattagccgggcatggtaagtgtccccctgtagtcccagctactcaggaggctaaggtatgagaatcccttgtgccctggaggcggaggttgcagtgagccaagatcgtgccactgcactgcagcctgggtgacagagcgagattctgtctccagaaaaaacaaaaaatataagtgatgttaacagagggacataaggtattttcagttcttgagaaaaagtcgtaactggattcatttcagaatcttgggagtaggagatggagtggtggagggtataaaagaaaccatgtcggctgggcgcggtggctcatgcctgtaatcccagcactttgggaggccaaggcaagtggattgcctgagcttaggagtttgcgaccagcctgggcaacatggtcaaacccagtctctactaaaataaaaaaattagccaggcacggtggtgtgcgcctatagtcccagctacttgggactgaggctgaggcaggagaatcgcttgaacctgggatgcggaggttgcagtaagctgagatcacgccactgcactccagcctgggcgacagagcaagattccgtctcaaaaaataaaaaaaaaaaaccatgtcacagaaatattcgaggagagaaaacaggagtgtttcagaacaattttataagcatgactatgtcctcataagatatttgtgagttaagcctgttgcatctaactctgcccactgacaaggtagagcaatggtggcagatcccccagcagtgaacagttctggggcccaggctggggttgcttcacagcaaaagaagcagtcctggcagggtgcttggctccaggtctggggaagaccctgcaagatgggtgtggagtgctctgtcatgctggagagcgaggaagctattgcagggtggctggggctgggagacagggttaggagcctgtctctagctggtcatgggcagaaacttgaagcattcatgaaaacagctaactctgagttcgcaagggtgctaacaaaacccttcgtcatcatatttgtaggatgcaaaggaaccatctcattattttgaatgctgttttgaaaaaaagaagtactcaagcatttaacccacctttcatttataaactgtacctcaggcaaaacagatagtgtgtgatcttttgcatagaagtattccagccaatactacatgaaaaggatttttgcaaactagaatcagcctgttgcaggctctggtgaaggagatgaccagggcggtgccactccaggtgcagcgcatgtctagggtctgctggtctgagatggtgtgttggcctcccaggagaggagggtctggtcccagaatgcaaatagctgcacctcttccttactccagaaagttgtgcgatgggaaaatgtcagctgaacccagcagtgtgcttagtgatttaattgatttatattttggcacaagtcccttatctcatcaccagctggtagtacggtgcacacacccacacttgaagtaggtttcacttctgcagtgaaaagcagagatggggcctctcagtgatcgagcatcccacaccacctaggaaacgttctcgccagaaagttaaatctaaatgtggtggaacctctacatctaactacaaaattacaggaaacataggggttagaagtacatctttaacaacaccatgagggtgcaattagcaaaatctagattatgggaaattttacaggatgaaagtttcttcattaaaaattgcaagggtggctgggcacggaggctcacatctgtaatcccagcactttgggagaccgaagtatgtggatcacctgaggtcagttcgagaccaccctggccaacatggtgaaaccccatctctgctaaaaatacaaaagttagccaggcatagtggcatgtgcctgtaatcccagctacttgggagcctgaggcaggagaatcccttgaacctgggaggcagaggttgcagtgagccaagatcaggccactgcactttatcctgggtaacagagtgaatgagactccatctaaaaaaaaaaaaaaaattgcaagggccagccgggtgtggtggctcacgcctgtgacccgggcactttgggatgctgaggcaggtggcttgcttaagctcaggagttcaagaccagtctgggcaagatagcaaaaccccatctctacaaaaagtacaaaaattaaccaggcgtgatggtatacacctgtagtcccagctactcaggaggctgaggtgggaggatcgcttgaaaccagaaggtggaggtcgcagtgggctgaggtcgcaccactgcattccagcctgggtgacagagtgagaccgtgtatcaaaaaataaaaaattgtaaggaccaaaaataagggatgagaggaactgacagatgaaaaataacttgagaaaatatactgtgtctgttttatttgaatactgcctcaaccaaattgaaaaaaaaactagaaagtgaatttttgataataataacttaatttttaaagtgatctattttgcttcataaagcaattatattattttactatgtttagatattatgcaccatcaaataaaacaattagagatttctttggggcatattagaaaacatagttaactgtaaaagtatgaaaggacagctagcatgagagaggacctgaaaaggtaaagcaaaaggggacatgaaggtatgaggtcagagagagggcccagcccacggtagagaaatgtccagcaccaattctgttcaagtgtgatcaggtcaaagtgtgtgctagagcacaggggagttctgaaccaggattgcccccgacaggtcactcagctctatgtgccagcatccagacatgtgtggaggttccggcggatggggaggataggcccgctgcagtccaccctggacggtgagttctctaggacacagggttactgaggtatgaattacatgctgtcaaattcactcctttaatctacagatctgttatttttcataaacttatacagccatgtcactcccagcaggagctaccatgtagaaaagtttcatcacccacaaaattgcctctagctccattgcggccacctcttcagcagccacccatttctgttttgtcctgtcactttgccttttgcaaaaggcctccaaagggaaccatgctgtgtagtctgctcctggctccttttggtcagcacgctgcatttgagggtgctgtgtgggttgattgttccctctgttgctcagcagtattccagtgtggggatgcaccacagtttgtgaatccattcattggttgaaagacatttggttattttttctgtctctgggaatacgagtacagctgctataaacatctatgtacaggtttttctgtgaacatacattttgtttgacatggagtaagtttcactgggagtaagaatcctgagacatttggcaagtttatgtttaacttgatgagaagctgcagaactgtgttccagggtggctgcacggctttgcattcagaccagcaatgaatgagagcctctgttgttcccagtcctcatcagcacttacagttgtcatttaaaaaaaaaaaattctatgggccaggcgtggtggctcacgcctgtaatccccagcactttaggaggccgaggtgggcggatcatcaggtcaggagttcaagaccagcctgaccaacatagtgaaaccccgtctctactaaaaatacaaaaaactagctgagcgtagtggcgggcacctgtaatctcagctacttgggaggctgaggcaggagaatcgcttgaacccaggaggtggaggttgcagtgaaccaagatcacaccactgcactccagcctgggtgacagtataagactgtctaaaaaaaaaaaatttggccattgtaaaaggtgggaaatggtatcttcttgtggttttaatttgtgtctaccagccgactaatgatattcagcatctttttcatgaatttgtttttttgttgtgttttcttggttgttttttgtttttttggagacagggtctcactgtgtgctcaggctggagtgcagaggcgcaatcacggctcactgcagccttgacttcctgggcttcagcgatcttcctgccgtagcttccaaagtagttgtgaccacaggcgtgtgccaccacacctggccaattttttaatttttttgtagagatggaatctccatgtgttgcccaggctggcctttaactcctgggctcaagggatcttcccaccttggcctcccaaagtactacgattacaggtgtgagccactgcacactgcctgtgaacatgttttttagttattgaattttgagagttataaagctattctggatatagtttatcagatatgtgatttgcaaatattttgtcccaatctgtggcttgtctttttcttttcttagcagtgtctttcaaggaggagaagttttaaattttgatagaatcccatttaccatttttttctttaatgaaattgtgcttttgatatgatgtctaagataccttcacctaacactttactttttttttttctttctttcttttttgaggcagggtctcagtgtgtcaccaggctggagtgcaatggtgcaatcacagctcactgcagccttgaactctgcagtctcaggcagttctcccacctcagcctcctgagtagctgggactataggcgcgtgccaccatgcccagctaatttttaaaaaaattttcttcgtagaggcaaggtctctctgtgatgctcagtttctcaaactcctgagctcaagggatgctctcgcctcagcctgggattacaggcataagctgccatccccagctccttgaaatgagttttaagaggccaagttacgatttattgttggaaaggaatgggatatgtgtttattcatgaaatactgcctggggcctactgtgtatacagccttctcccaggcaccatctcatgcacacacgcctggtctgggaggaactttgttgccatagtaggagggaaagggcacgaaggtggtcgggggtggccagggcaccgcccactgctggatctggctgcattcgggcctcaccgccagtgctagggctagctgtgcacttgagacgtgctagacagctggagtggaagtgtagtccttgattaggacatctttaatattcgatcaagttatgtgttcggggagctactgtgctgatcctgcactgtgcatggctcatgggtctgcctgaggcggggatgtgttcatggaactggatttagataaatgagttaatcaggatgatttcaagaatcttcaccttaagaattgtcagtgggaatgcaggggaaagtacaagtgaactaattaaggttttaaaatgtgttttagtgggtttggagtccccgccgctgtctgtgtctgaggaaagacagcttgctgtcctgacagagttgccttttgtggttccatttgaggaacgagtaaaggtatgcaatttggcttctttattgtcactacgtatcatattagtgttaagaaattaacacacacccaccagagaaatctctaaaggtgcctagtgcctggctgattacataacatacttttctcattaggctgaaatagctaagaatgatttataaaacccaaccagatacctctttttacaaactgaaagtattttcttagttacaactgattgaaagccagtaacactatagatttcttataatgagggtctaacgtcatttttctctattaaattttgcattatttggccaggtacagtggctcatgcctgtaatcccagcactttgggaggccgaggcaggtggatcgagcccatgagtttaagaccagcctgggaaacatagtgaaaccctgtctctacaaagaatacaaaagttagttgggcgtggtggcatgtacctgtagtcccagctacttgggatgctgaggtaggaggatcatttgagcctaggaggcagaggttgcagtgagccaagatcgtgccagtacactccagcctgggcaacaaagccagaacctatctcaaaggggggaagaaactttgcattgtttttgaaaaagcaaattttttgtgaagatatgcttctgtacattcacgtttatttatcagaaacgatgtttttttttttctgagacaggatctcactctgtcacctgggctagaaagcagtgctgtgatcatagctcacagcagcctcaaactcctgggcgcaagccaccatctcaccttgacctgctaaagtgctgggattacaggcatcagccactacacctggcctggaaacactactttattttttttgttttttattttttttgagatggagtgtcctctgtcgcccaggctggagtgcagaggcgcgatcttggctcactgcaacctccgcctcccggattcaagcgattctcctgcttcagcctcccaagtagctaggactacaggcacgtgccaccatgcctggctaattttttgtattttcagtagagacggggtttcgccgtgttagccaggatggtctcgatctcctgacctcgtgatctgcctgccccagcctcccaaagtgctgaaattacaggcatgagccaccgcgcccagccactttactttttataaaaaaagaaatggacaaatatcttaattccttgtctggtgtctttgatgtacaaaactttgtttatatatgtttccaaattttaaaatgttttgtttttatttgtcaactatttttaccaaatttctaaagattacttggttccgttcttcagtaatggcttcaagagtgtattttttaggcctatacactctatttgcatggtgaacaaaagagtttcttttgaagctgttcatgtccctttactaaaccctccctgcacgtgcgtacacacacacacacacacactctctctctctctctctctcccactcactcactcactcactcacataattcctgagctccctctactggatttttaacatcaaaaaattatttgaattttgtcagagatatttctactagtgttagtatacagctttttacaaagctgttctttcctcactacctaagtttttataaaggatttataaatgaaaatattctatcgcaaggggtttaaattttaattttattttatttttgagacagagattcactctgtcacccaggcctgagtgcagtggcgcctgcaacctctgcctcccgggttcacaagattctcgtgcctcagcctcccaagtagctgggattacaggcatgagccaatgtgcctggccggatttttaaaatttattttaaactgggcaaaggagcagctttagaaatacttaaatatgatatacattatatattatctatacatttattgataaaaatcaagatttgataccttgactattagcatttatttcagaatttatgaagatacaaaagataagatttagcagtttattctttggtaggttgtaagaggtcttttgtttctaataaccttacagctttccttgtttgttagatctttcagaggttgatttatgcagataagcaagaagttcaaggagatggtccatttctggatggaattaatgtcacaataagaagaaattacatttatgaagatgcttatgacaaactttctccagaaaatggtatatataattctttctgtgtattatttggcaggtggaggctagggaattgttttagaaaatggtggttctttaaaaattagtgtccatcatcttgttccataatgacttaaaaactgaaatgtgaggctgggcatggcagctcacacctataatcccagcactttgggaggctgaggtgagaggattgcttgtgctcaggagttagaggccagcctgggcaacatactgagaccctgcctcaacaacaaaaaaagtgagcttatctggatgtgttagcgtgcccctgttgtccctgctctgcaaaaggctgaggcgggaggatggcttgagcctgggaagtgaaggctgcagtcgaactctgattgtgctactgctcaggccttggcagtagagccagacccagtctccaaaaaaaagtgtagcaagtcagatttgggagacatgttatcaagtaatatttctaaaattgacagttactacaacagaagcctttaaaaaatattaattatttttaaagggcaagaaagtaaccagttccccacctcctgttgtctgcccctaaaatttagtttgcaagctgttgttctaaaaatctcgatggtagccatttatattctgcgtttttgtataaatatttatatgaaatcacaaattgtaagccaaattaaacatattaaaataagtgccattgcaatccaagtttcttatgaaaagataagtgtgctccaatgacactgccgttagtaaaggagaattatactgtgatagcatttggagctcactggcacgtttcgtcgtatgttcatatttgatactcagtcttgaaagttcgtgtgctattaacctctaatatattagcagttttaacttccaaatattgtgcttatggtaatacattaattccatgttggtcagtgccgaggggattaaaatgaaagtttaggctggatctaaaattaaaaatgaaatcatcttacccagcttttggaaggtgatgagttgtccaatgtgaaatgacaattgccttttcctctaggggagcaacttaattttcttctaaggaaatgaaacctgatttctaataatttttattgcttacataaagaactaattttatcataatgttggaacagtggaggaaagctgacatcagttgtttccttactctatttcaagctttttttttttttttacacaatttaccgttgccattgaatccttgccatggccctctgatgccgagtgtcatcagctgagaccgagtaaacttaggtctgcatgcaggctgtggcctctccgcagggccaggtttgtcttgcctagcagattgtgttttcagagtatttggtgtgaatgagatgagactaggtactttgactcctaatctaactaatcgtctaattgagagatgttttggggtcccacagtaccttataaatcaattctaatagttcttacattgtatttttattagcagatttcacgttcatctctcccacttgaccctggaggtctttacagcttgggatggaattgtttatttggtgtacacagctgatgctcagtagatgcttattcaatttgtgattgaatcccaggggaaaaaaatagatgtgacaaaacaatgagtttgccaatgatcgtgtagtgtttagagaagagtgagatgtttaaccttgaagggccttccaagaggcagttctggagcagcacctgtaggggaggagctgagtttgtgggtgaggggagctccgagggcacgggtgctgtggtcaggggtacttgcaagtgggggggctgtaagctcttcagccagagtagaatgcgtttcttacttaccagcaatttaaaattaactttaaaactactccctgggcgtggcgcagtggctcacgcctgtaatcccagcactttgggaggccgaggcaggcagatcacaaggtcaggagatcgagaccagcctggccagcatggtgcaaccctgtctctactaaaaatacaaaaaaaaatagctgggcgtggtggtaggcacctgtagtcccacctactcaggaggctgaggcaggagaatggcatgaacccgggaggcggaggttgcagtgagccgagatcgcaccactgcactccagcctggcaacagagtgagacttcatctcagaaaaaaaaaagaaaaaactactccctgtagatgattttttgatgttactgtccaattataacaagcctcaaatttcctaatgaatccttaagctttaaaaattgttaaaaaactgatcacacccacctccctaggggcatgctaataattgcattcaagttaaaagatttggaagaatcttctcatattgtttatactgtaatgcttgaaatctttataaatgttctcaactcaaatactgtaagcatgattaagccatgtgttaaaatgtggtgttttgctacgcaaattagtaaagtcagatatcatctcagaataattaatttacttgtgagagaatggtttgaggtgcatttttgactaaaaatttacatataatcaactaatgtgattattccacgtgtcatctagtcattgaagtgaatccatgctttacgatgctcgttgtcttatctccgaacgattctctgcagtgtgcatgttagcccctgttacccataagttgactgagtggaatgcagagattgatggctgttcctgcagttggtgctcagagagcaaagatgggctggggttccacagggatgcccacgcactcccagcctgcactgcactaccttgttgcagtgtggaatattgggagaaaccgtcacattccctcatgggattgctgtaagaattgtaaagtgggtaacaaagttccctcggggcctggagctcactctgtcattgactcttgggtgagagtgaggcacagctggctctgcactctgctgtcatcagttctggagagcctcacttgtctgcttttgttggttggttacttttattttatttcatttaatgggcagaattaccatttcttcctgaagcagaggaaatttattccagaagcaggaaagcaagctggagccaaatggcttagatgtgtttacctgattcccaagggtgacacggacactgacccagaggtggcgggcacggcagggcagcactgcatccctgctgctgtgcagagtgaccccatcttgtccattcagtcagcgaccactgctcagtgaatgggaacttggtatttctgtgtggtggctgtaagcctcagtcagtccagtaaattgtatttgccctatttgacacatatcatagactatttacactccaggtacggtaacttcaaaattactgacacgtgtacatagcaatctagggatagacagggttttgaggagattgcatggaggctctatcaaacattctgctaaaccccttttccagaatgcttctagaggttacatgtcccttgagatgctccagggcagatatgtttgggtgactatgcaccaaagccaacagagggcagcagcgcatggggcctgtgaaagtgtcgaatgtacactacgtgcggttgctttcccctgacttcatgcagcagcctgtccccaactctcgtcccctctccttccccctatcttttctgcaaagcacctgtagaacattcttagggaaagataaaggacatttcacttacttccccaaagctgttctctgattcagcctgtttatcagagcacatcttaacttggtccaccttgtgttttttttggttttggatttttgtttgtttgttttttgaaatggaacttctctcttgttgcccaggctggagtgcaatggcacaatcttgactcactgcaacctccacctcctgggttcaagcgattctcctgcctcagcctcctgagtagctgggattacaggcatgcaccaccacgcccggctaatttttttttgtatttagtagagacggggtttcaccatgttagtcaggctggtctcaaactcctgccctcaggtgacccacctgccttggcctcccaaagtgctgggattacaggcatgtgccactgcacccggcctgtttttggggtttttaaatttttattttagagatgggggtctcactttcagccaggctggagtgcagtggtgcaatcatagctcactgcagcctcaaactcctgggctcaagtgatcctcttgagtagctggaattacaggcacataccaccatgcccagcttttcttatattttgtagagacagggtcttgctagtgttgcccaggctggtcttggactcctggcctcaggcagtccttctgccttggcttcccaaagtgctgggattacagaagtgagcctctgtgcaatgttttaatttatttatttatttttttttttgagactgtcacgcaggttgggatgcagtggcacgatcttggcttactgcaacctctgtctcccagattcaagtgattctccggcctcagccacccaagtagctgggattacagacatgtgccaccttgcctggctagtttttatatttttagtagggatggggtttcaccatgttggccaggctggtctcgaactcctgacctcaaggcgatccgcccacctcagcgtcccaaagtgctgggattacagacatgagccactgcacctggccttaatttactcttcgtagcaaattatataaccagtaattttccccccttttcagccaaatacagcttttaaaagatcacgtagatcagggttgtccaatcctttggcttccctgaaccacattggaagaggaataattgtcttgggccacagacaaaatacactaacagtagctgataagcttttgaaaaaaaaaaaaaattacaggccgggcacggtggctcacgcctgtaatcccagcactttgggaagccaaggcgggcagatcacaaggtcaggagttcgagaccagcctggccaatatggtgaaaccccatctctactaaaaatagaaaaattagccaggtgtggtggcacacgcctgtagtcttagctacttgggaggctgaggcagaagaatcacttgaacccgggaggcggaggttgcagtgagctgagatggcaccactgcactccagcctggatgacagaggcagaccccgtctcaaaaaaaaaaaaaaaaagaaacctcctaatgttttaagaatttaggtatctgtattgggccgcattcaaagccatcccgagccacatcggcctgtgggctgcaggttgaggacaagcttgctgtagattctggaggaccaattccctgagagtttgtgggggcggaggttgcagtgagccgagatcgtgccactgcactccagcctgggtgacggagcaagactctgtctcaaaaaataatgataatatcattgctgttttgagtcctatgttaaaatgtccctaagatcctcacaccccttccttaagccttcctgtaaggctagttgatgttattgcttgcttgtaacatctttcctcctcaccctcccatttttttttaacagagcctgatttgaaaaagcggatccgtgtgcacttgctcaatgcccatggcctggatgaagctggcattgatggtggtggtattttcagagagtttttaaatgaactactgaagtcaggatttaaccccaaccaggggttctttaagactactaatgaagggcttctgtaccccaacccggctgctcagatgcttgtgggagattcttttgccagacattactacttcctaggcagaatgcttggaaaggtaaagtaaccttcatataaaaatagacctcggaccaaaagatgttgacattttatgtttatgtgtggttgttatccaggtttaccataaaatactgtttgttttaaatttggatgctaaatgttgcaaaagcactgcacgaaacaaatttgtatggttgtaagtaggtgctatggtttgaatgtcccctccaaactcatgttgaaacttgatccccagtgtgccagtattcagaggtggaatctttaagaggtgattagatcatgtgagctcggccgtcatgaatggatgagtggtttattgtgggaagggccctggtgactttttacaggagggagcccctagctttgtgatgccctgtgccgcctccggactctgcagagtccccaccaatgagaagacctcaccaggggctgcctctggaccatgggctcctggccttccagctataagaaatggatttcagtttttattaattactcagtttcgggtcttctgttataagcagtcaaaacggactaagacagtaagttactgcctagtgactattagtttaataggactgccgcaacaaattaccacactctttgggggggagggaggcttagaaaaactgaaatttattatttgacagttctggaggctggaagtccaaactcagggtgtcagcagcagcatagattcctttttagaggctctagaagaatccattcttctggttttgccagtagcccttgaccttttttggcttgtagattcatcattttgatctctgcctctgtggacttctccctgagtgtctctgtccaacattgccttattttttttaataaggacacctgtcattgtattggggtcttccctgatccagtgtaacttcatcttaatttggttatctgcaaatacctcatttccaaagaaggttatattcacagattaggatttgaatttgtcttttggggggacacagctctacctgttagggtgacatttataaagttgagtattcaggaattgttattagtttgtttgtttgtttgtttgagacggagtctctccttgctctgttgcccaggctggagtgctgtggcgccatctctgctcactgcaaactccacctctcaggttcaagggattgtcctgcatcagcctcctgaacaacaggtgtgcaccaccacgcccagctaatttttctatttttagaagagatgggggtttccaccatgttgtccagaatggtctttaactcctgacctcaagtggtccacctgccttgtcctaccaaagtgctgggattacaagcgtgagccactgcacctggcctgttattcgcattcttaaataaattagaaattaatgttgctattgtgattaatttctgtaagaatcagagctataatcattttcaactttgtaataaaatttctttgtctcattggtggttctgttttccgagaagcatagtgcatggagtcgcctgttttgagaagcagcttaattgaaaaatcagtgcctgcaaaacaggtggtgcttttaggacttcttttacataacagttttattaaaatataactcacattatggaaaattgaaccttttaaagtgtacagttcagtggtttttaatatattcactgtgttatgtgaccatcaccaatatcaaacttggaagcaatgtcatcatcccaaaaaggaaacgctaggtagtcactccctatcctgcccttcctcccccagccctggccaaccactagtctactttcagtctgtatggatttttttttttctagacatttcatataagtggaatcatttgttatatcaactataaatttgtgaccttttgtgattggcttctttgatttagcatgttttcaggtttcattcatgtcgtagtatgtcagagcttcactcatttgaagggccaaatcttatttcattgtatggatataccacactttggggtttgtttttttcattttgaaacaggtctttctctgccacctaggctggagtgcactgctacaaacgcggctcagtcctgcgcttaaggaggcctcctgctttcagcctcccgagtagctgggaccaccgttgcttgctaccacacctggctaattatttcattttatcgtagaggcagggtcttgccatgttgcccaggctggtcttgaactcctggcgtcaagcaatcctcctgcctcaacctctcaaaaggctagaattacaggtgtgagccaccacacccagtcaccgcattttgtttacttactcatcccaggctggagtgcagtggtgcatttgcattgggaatttgcattgtttccaccttttagctattgtgaataatgttactgcaaacatttgtatacaagctgttatttggacataggttttttgtttttcttgggcatatacctagacatggaagtgttaggtcatacagtactccacgtcaaagtgtctgcaaccttttacaatcccaccaacaatttgtgaaggtttcagtgactccacatcgttgtcagcacttacttagtgttgtctttttcattacagccattctagtgggtgggaattggtatctcattgtggttttaatttccctggtgactaataatgttgaccatcttttcatgtgcttcatgacttctgttgagaaatgtctattcaagtccattgcctatttttttattggattgtcttttattattaagtccctgcaatgcaatgaattatgaaatttatattctctgaggaagctgaaacattgtcagataaatgatttgcaagtattttcttctctggattgtctcttcactttcatgatgatttcctttgaagaacgaacatttttaattttgaagtctaacgtgtttttttcttttattgcttgtttttgatgtcttatccattccctgacctaaaatcacaaagatttacacctgtatgttcttctgacggtgttgtagttttagctcttacattttggtctttgatcctttttgagttaatttttgtagattgtatgagttaggcatcctcatattcttggcacccttgttgaaaattagttgaccgtacacgtaacactctgggtctgcccttatgcagtatggtcttgattactgtagctttgcagtatggggtgtgtggatttattaatagcagatgggagtagaaccgcagccttgttaagcagggataatgggaaggaatcagtctatcctggatatagaataattcccctttatttgtgtctctttgaaatgcattgtcgtagccccagttatttctttgttcagactcccagtgattttaagtgctcttcaggtttgagaaagggctccaacctgacttcactaccgtaacggtatgtgttatatcatcatcttcaggctcaccgtatttcaggtggcagatttcaggtgttgatttgatgttgatttgtgagttggctttggtggcagttttcagatagcatctctctctttgttgatggtcacacagcctacttctcagtttcagcttcccctggaggatgtacatttcataattcattgtatgaaaatctttacaatgggccaggcatggtggatcacacctgtaatcccagcactttgggaggcctaggcaggcggatcacctgaggtcgggagctcgagaccagcctgaccaacatggagaaaccccgtctctactaaaaatacaaaattagctgggcgtggtggtgcatgcctttaatcccagctactccagaggctgaggcaggataatggcttgaacctggaggcggaggttgtggtgagccaaggccttaccattgcactccagcctggcaacaagagcaaaactctgtctcaaattaaaaaaaagaaaagaaaagaaaatctttacaatgaaatcccttagttctttctgttaaagtgagcccaagaaccttctaacttaatatatatgtgaaaataaaggtgagtgttctgctagactaacctgaaatactctaaacttggtggtttttacacagtacagtcacagaagatagagcaataattttacctgcatgaattaaatcttaagattatatattactttttcttcctgaatgtataaatcatccagtcttgattaatgtagaagctaatagttatgtaagtctggtgaggataaactcatttctcctctgtttattgacatattgcttataattgaaattattctgaagatgatgtcattgtacagttctgtactttggaatatgtatatatttacagaagatccagggaagagaatttgtgattttaaacctttctcccacaaatgaagtttatgtaagttatatcttattaaggctgtttaaaataataaagtttagaccaataacaaaactaagagtaatttgaggatggtagttaacttagtttcacatatttaagacttcccttacattactctctgtgtggaaattcctaaggggttactaacttccaaaacatatctgatgaccatctgattacagagttaaactttgtgctaatgtgctaaccattgctcggatctaagtaagtgtcatagtacagcagctgatagtgtggcacctgaacattacatcttcaagagaagaaaactgtatattgattgattgtgatatttattgggtcataatgtatttaaattttctttaatgcatatgttagtgattgtttactgtgataaagtgcaaagaggtcttcaagagtgatcctgcagaggaagaattacctcatgtcactggtcacttctcaattaaaagttccattagcaaatgattcttgcttctggtgtgggtcatgattgcattttgtcgcctgtaagtcaggctgcagacagggaataaataaacagcccaaggatgtggtaatgtcatcttgaacttttttttacagatagaagcacctaggtccatttaagccaattaagttcagaatatttattgaggttaatcctttatcatatttgaattctatttgaaaatggctttttttcttgctttaggatattgatttaattgggatggcatgcctataaatcagattatttgatatgatcttggttatatatttgaaaatttcaattagattgtataactttggcgtggtttataattttttatcgcggtagaattcagtgtgcatttaatgtattctgtagtgtaatattggcacttaacagtttatcttgagattttcaaaagttggaaagtttctttttctccatcattagcatccttttgtaaaatgctcactgaatttgctgaggctttaaacatctaaattgaggtgaatactagtcattttggttgccttagtccttaaaggggcagagcttctcttgtataataccttgttttgaaccctaaactcttttttttttctctttttttgagatggagtctcactctgttgcccaggctggagtgcagtggtgcgatcttggctcactgcaacctccacctcccgggttcaagcgattctcctgcctcagcctcccgagtagctgggattacaggtatccaccaccatgcccggctaatttttgtatttttagtagagacggggtttcatcatgttggccaagctggtctcgaaatcctgacctcaggtgatctgcccatctcagccttccaaagtgctgacattacaggcgtgagccagcgcacccggcaagacagttttctatgtaagtttatttcttcagaattaaccatgaaatacaagtggtttagattctacagttaaaatgggagatgtattcctgaattcagttgattgctgcacctaaataagatttctcggctgggtgcagtggctcatgcctgtaatcccaacactttgggaggccgaggtgggcagatcaccaggtcaggagatcgagaccatcctggctaacacggtgaaaccccatctctactaaaaatacaaaaaattagccgggcgtggtggcgggcgcctgtagtcccagctactcaggaggctgaggcaggagaatggcgtgaacccgggaggcggagcttgcagtgagccgagattgcgccactgcactccagcctgggcgacagagcgagactccgtctcaaaaaaaaagaaaagatttctcactgtaggtttagcaccacaaggtaaattctttctgcccttggattaagtaggtcttgcttactattgagttattccttcctttttatttttctcatcacgcccaagcaatagttaaacatctgaaattcatgagaagaatggatcagtatggtattgagaccattctgttttttctgggccatgttaatttgtcaccatgaagattagaagcacacactcttgctggccccacttaaagtctgctgtttatctttggctcttatttgtgcaataaagacaacaaataatctaaaaaatagtgttgggtgcagtagctcatacctgtagtcccagcactttgggaggccgaggtgggaagaacacttaagcccaggagttcaagaccatcctaggcatacatagggagacctggtctctaccactaaaaaaaaaaaaaaagtagccaggcatggtggtgtgtgtctgtagtcccagctacttgggaggctgaggtgggaggattgcttgagcctgaaatgtagaggctgcagtgagcagtgatggcaccaccacactccagcctgggtgacagagaccctgtctcaaaataataataaaatagggcccatgtaaatccttttaaacatttaaatattcaatttaatttagatttagatttagcaaatgtaactttatgaaataaaagccaaatgaaggtatatggtgttaattttattgtttctaaacttaaaatcagctttgagaggcggcagtaagtagagtggtggaggtcacgctctggagtaagacaggccagtggggactcctggcgtcaccaacagagggcagcagaatccggcctgtgttgtcgtgggcctccttggctttggtgtaagtagctagcattggtcaagcactcaagctgggagaccggatggagtgtcacatcgttcaggtggagtgatgctgctgcccatgtcccggtggtagtgctggtaagaagtcatcatattcaaggagatttgctgatgaatgagatgttgggatgtgtgaggacaggagaaggtaagggaaccacctgggttctgttatgagaactagaaggatggaggtcatgctgactaagctggggaaggtgcgggcaggagcaggtgtggagagggaggcattcttatggaggcttagtgaggggcagttgaggataggggcctcaagttagaggcagtatctgggctgagccatcagcattcccagggtccttaaggtcatgagcctgaattagatcacccagggtgtaggtgtcactggagaagagaagagatgaagaactgagccccagggctctccaaggtttagagtccagagagtagagaattgactaatagaagttcaggagatgaagctggaaaggaagggagaaaaccagagaagtgggatttcaggtgccaaataaagacagtgtttgaaaggaagagaaaggtgggtattgtgtgatggtactgttagaccaagtaaggtttagcactgagaagtggccatgtcatttagcactctggacaagtgatttctgtggcgtggtgaaggcaaaaacctcagcagatgggctgaaaagaatgtcaggattatcttcctaaagcatcatattaaagctgaaaatatccacatcatatcacaagagaaatgtgtacctattcattagaatacatgtgaaagaatgtttatggtaacactgtatagcccctaaactggaaactacaaaaatgtccttcgaaagcataatgataataaataaattgtaggatattcacaagacttactgaatgaacagactacagctactcaaaatggtatgagtgaacggcacagacctaacattgagttgaagaatccagacacacaaaagtacattttgtcagatttcatttatggaagttcagaaacaagcaaagctccttgcagtttttggaaggcaggatcctgatgctcctgggagggtaacactggaagggggtgcagggggcttccaaggtgctaggcattttctgcgctgtggactaagtgcttttccataagtgtgttcactgggtaaaaatggatggaaccacaggcttgtgattagggcactctgcagcagtagacttcagagcagttacaagaggaaggatcggagaagaattgggggactggttatcaagaaaacttgagcagccgcttaagggatatggggctaggaaagctgtgttctaaagatgggagaaataacagcatgtgtatttgctgctggaaataagtcagtggaattgctgagggagagaggaaccacaccctgcaaagtgagggtgtggggtctggtgctgaagcagggggcgccacaggctgcgtgtccaagaagaggtagaggaacactgggtgcagctgcatgagctggggagcaggagctcattctgactgcatcccactgttgctgctttctgggtgatgcagcagagagcaaggatgggaagagcagtgttcccagaccagccacatctgcatcaccgggggatctattaaaaatgcaaattcttgggctccaccccagaccttctgaatctggaactctagggctagggctcagcaagctgtgtgttttggtttttggttttttggggttttttgagacagagtcttgctcttggcatggctcactgcaacctctgcctcctggttcaagcaattctcgtgcctcagcctcccaagtaactgggactacggacacccaccaccacgcccggctaatttttgtggtttttgtagagatggggtttcgccatgttggccaggctggtctcgaattcctggcctcaagtgatccgcccacctcagcctcccaaagtgctgggattatgggtgtgagccatagcacccggccagcaagctgtgaataggcttcaattaataagtgtgactctgatgcatgctgaaatttgagaattactggacaatggaaatacaataggattgccagttagtgtagggcccacttgacgttaatatcataaagtgaagtgagaccagccgtgtgggttactttttctacacccgtaaacggctgtgtgggtctgactaggatgtagagtcagatttaaccaggggtggggttttttgccaagtgactataataaagggtgaattggttgcaagttcagagtggttacaagagcctgcctttgaatctaggctgtttagagaggaaattaatccgtgaatggagatttgagggcaagggaagctggacaggagaggagacctgtggagtcgaggtccttcagggagtcagtgtagcggtggttagagctaagatcagaggggcttagttaccggtaatgccacttggaggacagagctgaaggaactggtagctaaggtggagttgagggacagccaggatggtagaatgacagtcaactgtgtgctacagatgtcaccaaaaattatcaccagagtgtgttggactctcaggagctaaaatcttgaattaaggggcagtgactgaacccgggagaggtaatggatgcgcaagcccagtgcatgagattgaaagccagggattttagcgggagggaagggaaggatggtctggaagtggcagtaaggagcacagggggcctacctcccttctgtgcccggtggttcaagggtgcaaaagagaccacagctactcacgcagagtgctctgaggatcacagagcgctgcagggcatgtgggaaaatggactgctgagtgtcgcagcatagtcaggaaaaaatcccgtcttagctgtgagaccaggagcacaaaaaacaaaaggaaaaatgaactggacttaaaaatgtttatgcttcaaaagacaccatcaagaaactgaaaatacaacacactgaaagagaagatacttgtggcatatatatgaaggactccatgataaaaatgggcgaaggatccaattggacatctctccagggactggcagcaagcaaatgggccattggttcgtgcaaagatggccagcatcactagtcatcaaggaagggcaaagcatagccacaggctgccgcgcacacccgcgagtacggcgggaatcaaaccaggaaccgcagggttggtgaggatgtggaggaatcagtcctcatgcattgccaatgggaagataaaatggtgcagccactttggaaaagtttagcagttcctcaaaaggttaattacctttggacccagcaaacatatttacccaaaaacttgcacacaaattctcacaacagcattattcctaatagctaaaagatggaaatgactcaaaggcccatcagctgacaaacgggtaaacagaatacggttcatccatacagtggactattactgggccgtaaaaaggggtaaagcactgacacatggcacacatggatgtgccttgagaatgttctgcccggtgagagcagatgcagagatcaccaaagacatggttccatttatatgaaatgtccaaaacaggaaaatctagagacagaaggtgggtgagtgatcgccagggctgggaggaaccaggagtggcagctgagggatgtggagtttctttttagaataatgaaaatcttcagaaattgattgtggcgatggtcatacaactttacgaatataataaaacctttgaatgtaagttatgtgggtgatatcccagtaaagctgttacaaaggaatcgtgcggtaggtaacgtggtgactgagagagccagtgtcacagaagttagagaaagcagcagtcagtatcaatcggagttcatggatgctttcgttctaaagctggaaggagtatagtgattagagcatgagctgttgttagggaaacatagtacctgatggtaacgaaatctgttatcatcgaaggcatcattgtcctcaaatttctcaagaggtggctcgacagatttctagtctgatattttattctcctatatggcaaaagtagaattttgaaacttgaaagatgttttcttctaattgttgaaaatagttcttggttatgtggggtaccttgagactgagcctgagttgtttttttttttttttttttttttaaattcctactgtctttcagaagcaggagtgtaaaactgtcctcagatgctcagatgtttgcttcttgtcagtggaagtgggaatatgggtttgctactttagcgaacttccttgttcatgaagatgttttttatcttctagaaatattttggtgagcagggtcaggggtttctgtgttttggagcctgaacctggaagccatagaactagaagtcgaggaaaaaaaggaagggtcgagccaggtctggtggctcaagcctgtaatcccagcactttgggaggccaaggcgggagaatcacgaggtcaggagttctagaccagcctgaccaacatggtgaaaccccgtctctactcaaaatacaaaaataagctgggcgtggtggtggttgcctctaattccagctacttgggaggctgaggtaggaaaatcgcttgaaaccagaaggcagagattatggtgagccaagattgtgccactgctctccagcctgggtgaaagagggaaactccatctcaaaaaaaaaaggaagcgtcaactccaagctgctcaaaatgtatcatattgtggctcgatcgctggaagccactatgaggaaaataggacaggagatgtgcacgtgtcctccacggtccccatcccccatcctctgtgccctgcagggcttccgaagtgaaagccgagttggagatgagaagggcaatctgtgcaggctttccttgtctttatggagtgccagggtctcaaggaagaaaaggtacgagcactgtgaggcctcggcagctctgcatgctggggatttgggcagcctctgtagagaagtaagagtgcagcacccgtgtcctggtgtggtggttcaggatttgcaaggcagagttgctctttttctctgagtaacagctagtgggctctgctcagttatccgtggtagacatctgctgaatgaggagtgagttcacctcagctcatgtttagagattggctttagggcacctgccagtggagtattagagtgaggcccacggcctggcccctcccagggagcttggtgtcctcctgctgctgttcctgcatgtgaggcgcaggggacactgggacaacacggattttttagtgccagggtagctgtgtagaccaagtgttgcgggagttgatggtgtagaaagctctctggaataggattgtgaagatctaggacttgaaatgggtgttgacgtatacataacctgaaacccacaatccgaaaactcttaacacaagaatgaaagggtttttttgcaaacagattcatgaatgcagaattccagtatgtaatgtggtccctgacatatagttggcacttaataaatgtttgttacatgaatgggcaccatatgttgtatttggactcttgcattaaagatgaggtatgttgccaggcgcggtggctcacacctgtaatcccagcactttgggaggccgaggcgggtgatcacctgaggtcaggagttcaagacaatcctggccaacgtggggaaaccctgtctctactaaaaatacaaaaatttgctgggcatggtatgcgcacttgtaatcccagctgctcgcgaggctgaggcaggagaatcgcttgaacccaggaggcggaggttgcagtgagctgagatcgtgccattcattgcgctccagcctgggcgatagagtgaaactccgtctcgaaaaaaaagaaagaaagatgaggtatatctcctgccccctaggagtttagagttagttacacaagcccctagtggtcccagtgactgaagggactttgtttttcaattccaacttactaattctgaagcacaattattaaatagcgtgttgctattagtatacattcttattttatgtttcttttttgttttttaaattatatggttaatatgatatgaaataattaaaattatctgcttgctcagttaggatggctttaaagcaagacatcatctcttatatagtttttagattaagttataaatgttcactttagagctgcctgaagattgatagagatgcatttgaaaagcattatttttttattgattcttaatgtagtaaattactgaagttatttggcggcaaacagaaatggtctgtgatgtggttcacatttattctgatagagccacaatttgcattaattgcgtcgcgactgcactcacttatattaaaaggcttctactataattaatcctttttatttcaaatcattttggcacaatttctagctataaacattcataaaagacagacagttgaaaaattcgttacaggtcttttccatatacctattgctatttttttcatgacaagtagttattgatatgcttctaggaacaagcgtggtacagctggctgagaaggccagtgtgaaaaatgctaagtggattattttgcataaaaaataggcagtttttgaagttgtataattaacctgtgtttagaaaataccttgatttatgcttacatttgtatctcagttgcatacattatggaaatttaatttataatccatttagctgatgcaatcatagtttttagtgccatcatttattagtgcttgtatattaaatgctctgaaggtttaaacctgcctcatgtaaaaaatggtacctatgcatttacattttatgagtcacagtgggatttctgtttaaaattcaggtagttctgatatatttaactagtttcactggtttattgttactaatgcagaaatggcaaacagtgaccttatatattgaacatcaaatgatttacacttccagtttacttttaaagtccactgtacaaatgagggcttttcttcagcacctggaatcaatcatgtagttgtatgcagaatgttccccttggctttgaactcgtcattcatttcgaagtgatgccgtttatcagtgctccaggttaatagtattaaccatccttaactttaaacaaactgtgacttttcaacacaactttctttacattatcaggagatgatgactatgtgcctgttgccattttattcattctctcattaagaaacccttttttgctatcttttcaaaattaattgggtaatcattagtcctcaaatcagaaataaaagcacaaggacataatacttcggtttacctggcagaggccagccgcagtcttcctggaggggatgttatgccggctctagttatcagacatgtgcctgagctacttaaaaaacagcattcttcagtcaggagttcgagaccagcctggccaatatggtgaaactccatctctactaaaaatacaaaaattagctgggcctggtggtgcacacctgtagtcccagctactcaggaaactgagacaggagaatcgcttgaactcgggaggcggaggctgcagtgagccgagatcgtgccactgcacactccagcccgggcaacagagggagactccgtctcaaaaaaaaaaaaaaaaaaaaaaaacagtgttcttcacaatgtctgtcattttctgaaacaaaaagccagtggtactctagatgtttgcttttgggaaaacctcaacagctattttctcgttttctccagtcgtatcagtggacgagtccttaaaatgtgaatctcaaggggtgtctgagcatgccctgttggagtgtataagttctggaatacttatttaaggatgcgcattttatagactacacatacgaagtagattattactaaatacggtaactggttggaagctgtgactaagcaaaggactcactccccacaggagcagtggctcacagttgaaacgtttctcctttgctggaagcttgcagaagcacagtcccggctctctggaagctacttactcccatgttattaattcacacagatcgctctaatatttacagtgcatgatatggttgggtgatggcctctaggttggaagggtgacttctgagttgactgtctcatggatgaatgactaccccataaagttttgttttgattttggtattccctgggtagcaccatagcacttgaatcttaaaacagtaggataaagagggtctgggtctatcacagcatctcctgcagcacagctcatagtagtcatttgcaaggtatggttagtccagccttcaccttccctctctctgtccttcctgccgtccctcattctcgggcaaaaattccagtgctgcacctccagacagtaggaaggcccgtgactgcctctgttgagagggtttctttctctaaaattgttctccacctgttctccacacccccgggggtaattagactacctctgtttgacctgggaaaataggatcactgtaaatacacatctctctgaagactggatgttttctctttttttgagacggagtttttgctcttgttgcccagactggagtgcagtggcacaatctcggctcactgcaacctccacctcccgggttcaagcgattctcctgcctcagcctcccaagtagctgggattataggcatatgccaccacacgtagctaatttttttttatttagtagagacggggtttcaccatgtcggttggtctggaactcctgacctcaggtgatccagccgcctcagcctcccaaagtgctgggattacaggcgtgagccaccgcacctggcctgactagatatattctaacacgaatggcttttgtagaggaaattgagatttcttgtttacttccattcctttaccttaagttaaaaaattgtccagatggaccacatggaaacaagataattaatgtctaactgcatgtctagcacagtgcctggcacctagtacctagtaagtgctcaaggaatggtaactgttgtctctattgtctttattagaaaacttttggccgggcaggatggctcacacctataatcccagcactctgggaggccgaagtgggtggatcacctgagctcaggagtttgagaaaagcctggccaatatggcaaaaccccgtctctactaaatatacaaaaattagctgggcatggtggtggatgcctgtaatcccagctactggggaggctgaggcaggagaatcgcttgaacctgggaggcggaggttgcagtgagctgagatcgcacggctgcactccagcctgggcaacagagcaagactccgtctccaaaaaaaaaaagagcataagtaatatttcttgacatgtgaaaatcacatgaaacccaaatttggaacatagccaccctcactcattgacacattgtccatggctgcttttgtgctgcagggcagagtggcatatgcggttatgaactgggaccccccaaaactgtgctcaaatcctaataccccatcctgtgggcatggccttgtttggaaatagggtccaatagctgcgaggccttgtttggaaatagggtccagtagctgcgaggcgtgagttcatgtggttttcagtctcgcagtgtgtgatcatttgccgtagccaccttgggagactaacaaacctgcagttcctgaaggattcaccatccttctgttgaggaggagcatttgttggcttctgtctcacaagaaggatctgtctcttcataattccacgatttcgctcctaggtggtctgttccagagttctctgcatgcttagtgcgtgcattgaatgcctgcacgggatcctggagcacagtacctgcccactgaatatcagcttccatcttcggtactatgaggagaaaatacctgctctcttaggattgggtttaatatcaagttgagcatatggctctttgtttgtagaaggcttgtatattcgatgctaacgttgtcactgttctcttttgaaggctctctatgagaacatgctggtggagctgccctttgcaggcttctttctttccaagttgcttggaaccagtgccgacgtggacattcaccacctcgcctccctagaccctgaggtgtataagaatttgctctttctgaagagctacgaagacgatgtggaggagcttgggctgaacttcactgtggtgaacaatgacctgggagaggcgcaggtgaggggtcaggaggaggattcacatacctgtatagcaagtagcagcatctccttgtgtgtggaagtccatttgtgttacagcgtttgacttccgcacattttagttagaatgactgtggctgtgagttagacgtcgaagcatatagctccaaagcaccttagccctggcgtctgagctgagtgcagttcctgctcccacgcatgaagcctgttcctgcccggcagcccctcctgcggagctccactctcgaggctgcggcccaggcttgctgcttgtctggctcttcccggtgctgggggtggccgttcagcagcttcccggcaggaccccttgcttagtcctcactccttgcccgctcagagccacctcagctgctccagcactgtctagggggtgtgttcattacccatctggttacttttgttacttatatcctttttaaaaaagaaaaaagaaaggtctatattagagattcaaactgattttcttaataacagctttatcaacatgtaactcacataccataaaatctgccctttttagtacatgattgagtggtttttagtatattcgtagaggtgtgcagccatcatcaccctagccaatgttagcacattttcctcggtctacagagcaaccgtgcacccattagcaggctcccccacctcccgcaggcagccaccagtccactctgtctctgcatgggcctgctgtggacacttcacatcgatagagtcttttttttttttgagatggagtttcactcttgttgcccaggctggagtgcagtggcgcaatctcggctcaccacaacctccacctcccgggttcaagtgattctcctgccccagcttcccgagtagctgggattacaatgcgccaccacgcccagctaatttttgtatttttagtagagatggggtttctccatgttggtcaggctggtctcgaactcccgacctcaggtgatctgcctgccttggcctcctgaagtgctgggattacaggcgtgagccaccgtggccggcacgacagagccttttacgtggtcttccttcacttgtagttgcatggatcaggacttcattccttttctggccaaatgatattccattatatggatataccacaaggtctttactggttgatggacatttgggttgttcctatgtttgggctaataagaatattactgttataaacatccacatacagcatactaaaataattattaatgagttagtaacatctgggatttgcttcaaatacactctgagcatccataatctgaaaatccaaaatgttccaaaatccaaaactttctgagtgccaacatgaagctcaaaggaaatgctgattggaccatttcaggtttttggattaaggactcttactgataagtataatgcaaatattccaaaatttggggggaaaaaatacaaatccaaacacttctggcccaagtatttcactcagataagggatactgaccctgtgtggtgagaacaggggcaggaagtggggctatcagttccagagactggccgggaggtgtgatgcctgatgaactggctgtgtggggttgggagctcatacactgttctgtctactttagcatatggggctttgttgttgttgttgtattgttttgagacggggtctcactctgtcacccaggctggaggagtctagtgatggcatctcggttcactgcaccctcagcctcctgagtagctgggattacaggcgtacaccaccaaacctggctaatttttgtgttttttgtagagatagtgttgccctgtgttacccaggttgatctcaaattcctgagctcaagcgatcctcctgcctcaacctcccaaagtgctgggattacaggcatgagccaccattcctggctaatttttgtgttttttatagacatgggtgtctccctatgttgtccaggctggtctcaaagtcctgggctcaagtgatcctcctgcctcagcctcccaaagtgctgggattacagatgcaagccaccatgcctgtccaagagccatatttatttggttacaacttatttagttgcttttgtttctgcatatttttccataccatagagctgaattttcaccaatgcaaaatttagataatttggcgggggggctgttactgtcattaggaagtactcgacatccagtgatgtcacttgctgctaggtcttgcaccacctagtggcctgatttctaaatggcataaaagccttcggacggtgagtgttgtggtgacctgcctgaggcctttgctaatgcgagtatttcccatttttccttctgaaataaatgttaatagtgaaacgtcgcatatgcaagaattccattaaagcactgccgataatactggaatctgttaaaagcaaaagtgtgaagttaagatgttccagttattcatagagattcccactgagttaaaaaattatagataatgtatgagaataattatactaaagagcctaatgagaaaaattaagaaattcactagtgaagcacctaatttagagggagatcttaaggatttctgtagaaataaataggtagtcctccttacaagtttttaagtttataaagtatgatttaaagacttgtaatatgcaaatactttattgtgtcagcaggttatgttaattaatcatcccttttaaaatatggtgctgctctcaaatttgtttttttcagtgtaatcaatttggctgttaatctgtttaatagtgaccatgaaattttagacgactaatttacatagaactctttctagcagaaaatgctaagggtttaagaaggacccacaaataatcatctgttaggtagaaaagattggacttgagtcacgacaccttggttcaggtcctggtttggccgcttttctgtgaggcttaaggaagtcacaagaccccttcctcatctcagacgggtgtgagtgccggaggatgaaatgagctaatggaagtaggtcatgtatggtggtgtcttgtggggctttatggattccaagtgaaaatagactttctggaggagcagaaaggacagctcttggtatcttgctgtcctgagaactgctccagttaaatatatttgtatttagaggaaattttaaatatgtccctcagatctgaaatttagcacttatgtgacatgatttttaagtacacatagttgtttaggcttagcctgagagagaattttaaattaaaagtagtgtaaccgtttaaaagttattagaggggctgggcgcagtggctcacggctgtaatcccagcactttgggaggccaaggcaggcagatcatttgaggtcaggagttcagaccagcctggccaacatggtgaaaccctgtctctactaaaaatacaaaaaactgagccgggcgtggtgatgtgcacctgtaatcccagctactcgggaggctgaagcacaagaatctcttgaacccagatggtggaggttgcactgagccaagattgctccactgcactccagtgtgggtgacagagtgagaccttgtctcaaaaaaaaaaaaagttatagaaatgtcagttttctctgatcaggcaaggtaattgggagccttggaagttcctttaactgataacttcactggtcctttgtcttccaaatcatacaagtacatcatcatttattacctgcctctaatccatttaaaggaaggggtggtattttatacattgaaatataatagctagcctcctgaggcttggttaacagatggactgtcagctgagtacaagcaaaggaattaagataatgaacacaatctttaatcagaatgaagacaatggaattgaaagcccattcttaggcttgatggttccaaaccttaggaagtgaattattgagaataattgtatcatcctttaaaatgtgaaacgttaaaagaagcagatctggtaagttgaacgttcaagttcaatttgaacattctatataaaatgagaaccagcaaacgagtctcctataaccatcagctgtaggatgacttaagtcaggctctctagcacatttgtgaaacaatctttctgtaaatggtaagagactgggacatcagtgccattgcccagaggcagcagtcttgtctgttactctgggaatattaaagctaccaggaaaactgaaggctgtgaaaagaaaagaatggaaaggtagggaagttgaaatgtctttgttcatttattttgggcttattttatattttcattgtccacagtataggttgctctcatctaaccccaggaatgcagttggggtgtttttgttgtttttttgttttgttttagaaatacaggtgggggtcttgctttatctcaaactcctgggcttaagggatcctcttgccttggcctcccacagtgctgggattagaggcgtgagccactatacccggcctgtttttttggttttcttaataaatactttttaaaaatttttttatttaaaatacactctttataaattatgattacatgtttatattgtattttgctcgtgtactgttttgtatttatgaattcatataatcatgtaatcacagcaattccaagtcagacaaacaaatatcaccattttattaatggccaaaagtttcaaggtgtaaagtgacttgtctgtcatacaagtgggggacagtaagacccaggtctgtgtttccgctgtgttgcttttctcatgagcactcttgtggtgtttatgggagctccacgttatacctgcaaattctgtgagtatagccacgtactaataaaaagtgttcttactcactctgtttatatacataagaaattggctgatctattatcactgatcgttaccaccaccctttgtatcgtaattaaagtgctttatagtaatggcattgtggaagcacacaggtaagtgtgtgctgcttatatggatgaaaatgagaaatcactttactacagcctttgcgtttcctccagaatgagtcgctttttctcttctgacttaacggtgattgtttgcttcatgtctttgccctctgtgatttctcatttttgtttaagtaaaattgccatggtgacattgctgcacaattccctagtgcttcggaggaaacatggatggttagtgatcttaaagacagagtaaggtgctgggcttcggagactcttcctggaggtgcatcttggcatctgcacaatgctgtgcatactcgggtactatttcgtatttagattcttgttcacaaagcatcaagtcctatttccttaaaacatttgtttcttgcttttttttttaacctattatcatactttgaggattttgagatccttacgttttgtattcccaggtagttgaactaaaattcggtgggaaagacatccctgtcaccagcgccaaccggattgcgtacatccacttggtggcagactacaggctgaacaggcagatccgccagcactgcctggctttccgccagggccttgccaatgtcgtcagcctcgagtggctccgaatgtttgatcagcaagaaattcaggtaccctacctgctgactttctgggacacgcttgtcacaggaaatgaacaggctttcttaaaatttacctcaaatgttattatttgaacttttttccttaggtattaatttctggtgcacaagttcccataagcctagaggacctaaaatcctttacaaactattcaggtatgttatcactgctagttattgtttctgaaaatgttgcaggtggtcatatttccaaagtaatttttattttattttaattaatttattaatttatttttttttttcagactgagtttcactcttgtcgcccaggctggagtgcagtggcgcgatcccagctcactgaaacctttgcctcccgggttcaagcaattctcctgcctcagcctcccgaatagctgggattacaggcacctgccatccaggcccaactaatttttgtactttgagtagagacagggttttgccatgttggccaggctggtttcaaactcctgagctcaagtgatccacccccctcagcctccccaaagtgccaggattatgggcgtgagcacaccatgcctggcctcaaagtaatttttattgtactcttttgtaggggtaatgtacatggttcaaaaaccagatggctgagtgcagtggctcacgcctgtaatcccagcctttgggaggccggggcaggtggatcacttgagctcaggagtttgaaaccagcctgggcaatgtggcgaaatcccatctctactaaaaattagctgggcgtggtggcatacacctgcagtcccagcgtggtggcgtacacctgcagtcccggcgtggtggcgtacacctgcagtcccggcgtggtggcgtacacctgcagtcccatctacgtcgggtgctgaggcaggagaatcactggaggtgggagacggaggtcgtgagatctcagtgagccgagatcatgccactgcactccagcctgggcgacaggagtgaaaccctgtctctaaatagataaatatatacatacacaacgtacatgggcaaaaaaaaccagatgtttaacatagaagatagataaatggccagtaagcaaataagcacacaataacgatgttcagcatcattagtcattatagaaaaatgccacttacatccaaatgagataaccccacatacccactagctgtctactggtgcaagtgagagctttttgaggaaatggaaatgttctaaaactggattgtgctgatggttgcaaaactctaaacttacaaaaaatcatttttacatataacctgtgtgtatccatgcgtatgtatctcttatctgtagtttgcattgtcctacatctgaagtctaatctttatgtaaaagcaaataatgcctaaggtcacgttgtccccatgatcgggtcataagtttaaggaaatgaaatcagtctgacctttcctttgccaagagattgtcttcggttgttttcattacccatctgcactgagggcttgcacctttaataatctcagctatgccagtaaataggtttaaaatattatattcattttggtgccaattaatgcacttaagacattttattggtgttatttctgtagtatattaacaatgagggaacaatatacagcaattattttaggtttagggagcactttactagattaaaagctgtaagtggcagacattacatttcagaatagtggtctcatcatatagtgagattggttgttagccatggtattaatatcagaatgataataagttagaaggaaagatgataaaattaatttagccaccaaatcatgctgggaaaacacccagctgtgttagtactagacacccattgtctgtcatgttagatctgtggccacgtgcaagccccttctctgccgtctgttcagcggcggctttgaactgcagcacggttcttcaaaataaggctcctctgcagtagttcttggtgcctgcattcatctttatagttacagggtgatccttattctagctttttatgtatttatttatttattttgagggcgaatctcaccctgtcacccaggctggagtgcagtgatgcaatctcagctcactgcagcctctgccttctgggttcaagcaattctcccacctcagcctcccaagaagctgagattatgggtgcgcgccacaacatccagcgaatttttgtacatttggtagagacagggtttcaccatgttggccaggctgctctcgaactcccgacctcaagtgatccgccagcccgggcctcccaaagtgctgggattacaggtgtgagccactgtgcctggccctgctttgaccctccttaagttgctctccccttctcgtactttgcccatcgcctccacataattggcggtgggtggggtgggggcggggggaggcagagaattccgcttttgcatttacaatcggtccttcatatctgtgggttctgtccacatccatggcttcaaccaattgcagattttaaatatttgaggaaaaagcaatggttgtgtctgcactgaatgtgtgctaagcaatatagtgtcacagccatttacacagcctcggcatgagatgggattgtaccagtgctctagagatcatggaagtgcacagcacgtacacaggtgatacacacatgccacgccgttttagagaagggacttgaggatccatggactttagtttccgtgggggtctggaccaatccctgtgggtcctgaagggtgggtgtgctttgcatttcataaagcatgtgttcattttgccataggaggctattctgcagaccatcctgttattaaggtcttctggagagttgtggaagggttcactgatgaagaaaagcgcaaactgctgaagtttgtaacaagctgctctcgaccccctctcttggggtttaaggtacacaactttcatgacatttgctttaaagaccacttcataataagaaaggcagcagaacattcagtagggttaaatgaagtccttttacatacacttttgtttttatcttcagctagatttttaattaagtactggttatgatgtatatattttggtgctagttttatttggggttgctttttttgtttgttcacaataacctagtcatatgatagttacacattgtggttatgattgcctgtgaacaaaccgtacatttggagggactatttgcaatattaataatgtctcataaatctgtaacacatcttgggctttttgctactgaactgaagcaggtacaacgtagagatgttgatggagtgtatatgctactgagccttattttaccacttctggaaattaatgttgatcttacgtaatttggcttatttttagcaattaaaattgcctcaggcagatggatcatttgaagtcaggagttcgagaccagcctggtcaacatgatgaaaccctgtctttgctaaaaatacagaaaaatgagccaggcatggtgccctgtgcctgtaatcccagttacttgggaggctgaggcacgagaattgcttgaacccaggaggtggaggttgcagtgagccgagatcgcgccactgcactgcactccagcctgggtgacagagtgagaccctgtctccaaaaaaaaaaaaaaaaaaaaaattgcctcaggaacgtctaatcataattcctgtattcactgtaaattaaaataaagccatattaacatttaaaaatgcacacagtggtatatatattatagaataatatataattagataagtactgtatgtgatttgtgcttatgaaacttcataggcattcactttcttttttccttttttctttttttttttttttaagtaagatgagcactcgctgtatcacccaggctggagtgcagtggtgtgatcacggctcactgcagccgcagccacccaggctgaagcaatctgcccacctcagcctcccaagtagctgtgactacaggcatgtaccaccatgcctggctgacattttgattttttgtagagaagggtttcactgtattccccaggctggcctccaactcctgggcccaagaaatcctctcacttcagcctcccaaggtgctgggatgacaggtgtgagccaccacaccatgcccagctggcattcaccttcaaataaccttcaatcagaaagagttcctgcacactcatgtagtcccagctactcttgaggctgaggtaggaggattagttgagcccaggagtttaagaccaacctgggcaatgtagtagcgagatcctgtctcaagggggaaaaagtaatgttaaggttttttgctttgttgttgttgttgctgttttgtttgtttctttgtttttgagacggagttttactctgtcgcccaggctggagtgcagagggcaatggcgtgatctccgctcactgcaacctctgcctcacagggtcaagcaattctcctgcctcagcctcctgaatagctgtgattacaggcgtgcgcctccatgcccggctaatttttgtatttttagtagagacggggtttcaccatgttggccaggctggtctcaaactcctgacctcaggtgatccacccacctcagcctcacaaagtgctgggattacaggtatgagccatcatgcccggccccccaagtatttttttatatttctgagtgaagctattctttaactttttacttcgaaactattttaaatgtatagaaaagttgtgagaattgaccaaataacttctaaacccgcactgaccaattgttaacattttgctacatttactttatcattcttttcatgcatttctttcctgaatcatttgagaataggttgaagacatgaggtcttccctaaatatctcagcacatacttcctaagaacagagacagttttgaaacggccacaattaaattattacaagtcaggaaattgaactctgacatacggcacttaccttatcgaatccactggctgcacagtgtggtcctgggaccagcagctgcagcatcacttgagcacatgttaaaaatgaacattttcaggccccactcagacctgagtcagcgctcagtgggagcggagccccgcagtcacgttgtgaccagctcttcaggtgttaggccggttgtcccttcgcgtccttcatagaatctgatccaggaccacacgttgcatttaattggcgtgctctttagtttcctttcttctgtacccccattttcaaggggtgcaggcaagttatcttgagaatgttcgtcaatgtgatgtcgcagccccaccgttgggagtgtacagatggcaacatattttcacacagtgtgtttatgaatgttcagagcaagccttcataatggccaaaaacgaaataattcacagtacatgaactgctagtaaatactatagattaagagatatttagaatttaaaaggaataaatgatatctactacactgtgtatgaacattgaaaacactgtgctaagtgaacgaagcaagacacaagactacgtattattatatgtaattccactcggataaactgtcctttgaaaggcacatttagagacacagagcgggtcaggggctgcacagggctggaggtggcagcgggagcttcggagaagtggagcgacccaaaaccggattgtgggggtcgctgcggaactctgtaaatttgctaaaatcattggattgtacatttaaagggataatcttatagtaagtcaagtacacctcaattaagctgttcttaaaaattgactataaactaacacagcatctcagttagtgccctcagaactggagttgggacccagtagagaggtggaaagaagtgaggcctaagtgcagtgagtttgtttcaaataggtcaatcatcgacgccgttatgttctggaagtaatgaataataaagacgtataaacttaaacgtgttagtgaataccatcactcaatgatatcagtagaaatgataatcttccaaattgttggagagaaaaaataaccatgcaaataaaacaggacaaacagaaccaactctgtttaccagatatggggggtgggggtgggaagtaacattcagaatcgtaaaatagaaaacatagaatgagagaagcctgaatgttacaacagtgagtgcggagaaactgacgtaatgaaagaaaaagactttgagacagggccaggaaaacgctgccgcctacaagcaacacacctaaacggagtgacccagaagggtttagtggcacgtccaggttcgtgtgtgaagaaatagatgggtccccttcagagtttgaagcatgacccatgtgaccagataggagaatctctcgagcgcagggaaagctgggtgctgcctgtgtggtggcagagtctggagggcttgctgtgctggggactaaagagcaggaggactgcaggtgaggcgtgcagacgactttttatcggtaaagattttaatgccatttggtaattttgtcattaacatttattatgatagacaaggcttctagtatctttgtttcaaaactggtttgttccaaagctagagataagaaaattatgcatctcatctagtttcataaaaggaagtttggaggacctgctcccatcaaaacactggaagatgcagagacttttgtcagctcctggctaattagataatgctaatcatgtgagtagcaataaaaattcgaagtcctgccagacgtaggttctagacattctgacagccaactaaagagccagcaataacgtgtgcctaggagtgcgagagccttctccacctccgtgatgcctccgggttcgtgcatggccacttgtgctgcgtgagcgtcgtaggtttaggggaacagaagtagagggatttacatgagcttttaaaatcccaaatagactggccaggtgcggtggctcacacctgtaatcccagcactttgggaggccaaggcgggtggatcccctgaggccaggagttcaagacgaacctgaccaacatgatgaaaccccgcctctactaaatacaaaaaaaaaatcagccgggcatggtggtgcatgcctgtagtcccagctacttgggaggctgaggcaggagaatggcttgaacccggaaggtggaggttgcagtgaaccaagattgcaccattgcactccagcctgggcaacaagagcaaaactctgtctgaaaaaaaaaaaaaaaaaaaaaaaaaaaaaaaaatcccaaatagactaaaagggaaaatcctaccccagtcaagaccccgcacaatcataattgagttataccgtggaaaacactttgagcatccatgagacggtcttactgttttttttatttttctcaatgttctaacatatgtgaaatttaattgatttttccatgataagtgtttttgaagttgttatatgttagacatccagtttggaaaaatcatcttaatatttaggctttccggttagcttagtatgcctggatttgccagggctgcagaattaatgtagacttaaaggaagagaatgtctttcagttgaagtactataaatagcaaaggcaggcaggcataattttaaagttatgaaactccttagtgccagattattggagaagaataacatctgctaaagctaattaaagtttaatatgtttaataaatgtgattgttacagacaaaaaatcattaaagtgctgtagaaaattgttaagttaccatcaggccacataataaattaatgatttttctcactctgaattaatgcaaattcccgttgtactgtatttaattatgcacaaaatggtgcccttgactcagatttcagtgaagaacttcatttttttacttttaagtctccaagtaggaaattcaattagcgttatgaaagaaacactaaaatgtggcatttaattgcaaaatatattttaagcttttcatttatccagtgactttgccagcagtcactgaccccttcattcagagatccttttctgtttcaaaaatgcaatgcttcctttttagtatattcaagcatttgtgaaaattattgccctcatgtactcagaatgctgaataataagtgtaataaatgttatttctggttctcctttggttctcattctaacatttttatgagagatttaaaggagcaaataaactataattagaaaaaaaaagacaatggattttagcacatattatatgccacatatatattttttaatgaagtttacatttaacagtaaagagacctacaaagatcagtaataagaatcatgtaagtctcttcataggctttttttttttttttttttttttttttttttgagatagagtttcgctcctgttgcccaggctggagtacaatggcccatctcagctcgctgcaacctctgcctcctgggttcaagtgattctcctgccgcagcctcccgagtaggtgggattacaggcacctaccaccacccccagctaatttttttgcatttttagtagaggcaggatttcaccatgttggccaggctagtctcgaactcctgacctccggtgatccacccacctcagcctcccaaagtgctgggattacaggcatgagccaccgcgcccatcctcttcatagcattttgtgggctgtgctcttactagttttacccttaacataaattatatgctaaactcaacatataattgaaacaaaatccaactgaaatgtgggtgtggccagttgggtgcctgttgtgctttgtgacagcttcagtgcttccaaaggttcctgcagaatgggacattgctctagtttgattcacatttgactacaatggttagaaggtaattaccttttctattttttaaatttttttgaacataaactcaagattgtattgtcttcataataaaacaaaagatgacacttagaattggatgtcttggcccttcctcctcttctgtcctcccagttcagaatgctcacatctctttatatccagcatcctcttacatctgcacctatgctcaacgcactcaagcctcagcacaagcttcttcgtagttctagccttttcccggaaaatcagcttagtctgcccaccgtagccgctatgcttcgtgtcctaacaccaccttccccgggcacctgtcctaacgccaccttcccaggcacctgtcgtaacgccaccttccccgggcgcctgtcctaacgccaccttcccgggcatacagagaatccgtgcccttttgtgccgtgtcgctttgtgggcttgccacacttacagaaagtcgaacgggggccgggtgtggtggctcacgcactttgggaggctgaggcgggcggatcacctgagttcaggagttctcgaccagcctggccaacatggcgaaaccccatctctactaaaaatacaaaaattagctaggtgtgatgatgggcacatatagtcccagctactcgggaggttgaggcaagagaattgcttgaacctgggaggcagaggttgcagtgagccgagattgtgccattgtacaccagccttgttgagagagcaagacgccaactcaaaaaaaaaaaaaaaagtctagcaagtattaggaacattcactttgtgggagcgctgttggcaccgaaagcactttttttatattggattttttttttttttttttacctttcagtaaaagtaatgttttcattatagaaaattggaaattgtgatcaagtataagaaacctatatttcctcccattctaaccattatttttttatgtttccttcctttaattagtatgtgttttatctacctacatgagtgtgtgttaatgtagatatgcataattttttctgtttttggtagaggtagggtcttgctctgttgcccaggctgtcagaaactcctggccttgagtgatctcccacaccagcctcccaaagcactggtactacaggtgtgagccaacatgctcggcctgttacacacacacacacctggtattacaggtgtgagccaacatgctcagcctgttacgtgcacacacacacacctggtattacaggtgtgagccaacatgttcggcctgttaagcacagagacacacacctggtattacaggggtgcgccaacatgctcggcctgttacacacacacacacacacacctggtactacaggtgtaagccaacatgcttggcctgttacacacacacacacacacacacctggtattacaggtgtgagccaacatgctcggcctgttacacacacacacctggtactacaggtgtgagtcaacatgctcggcctgttacacacacacacacacacctggtactacaggtgtgagccaacatgctcggcctgttacacacacacacacacctggtactacaggtgtgcgccaacatgctcggcctgttacacacacacacacacacctggtattacaggtgtgagccaacatgctcagcctgttacacacacacaaacatatatatttttaagacagagtttcactcttattgcccaggctggagtgcaatgcgtgatctcgtctcactgcagcctgcaacctctgcctcctgcctcagcctcccgagtaattggaattattacaggcatgcaccactacagccggctaattttttatttttagtagagatggggtttcgccatgttggtcaggctggtctcagaaatcctgacctcaggtgatccacccgttgtggcctcccaaaatgctgggattacagtcatgagccactgctcctggtcacgtaatttttaaatataattttagctgtatcttgtgttcagttttctaggctacctttttcactcaacattacatcaggatcatttttcctcatgttattctttgagatatttttaatgggcttgtagtgtcccatcatgtgatttaccagtttactttctgttttttagttgtttacagctcttccttcgttgtgatgctgtgaacctcttgtgcataaattatcatgtgcatctctaattatttcttagagtacagtcccaggagttgtgaatgtgggtgaagcccctgctcctgctgccaggcccacctctcagagagtttcgtgtacacgtgtgcagggaagggctgacctagctaggtctctgaaacccgtgccagatactaaatctgcacaggctgcgacagtgagcagactgagggcgatctgtgccttattgtcttcctgttggaagagaacacataaatcacgtatctcaaatgtgaggcaaatagctaatggtgtttgtgtatacgaggaaggtggagtcaccggttcttcgtggccatcagaggaccgacacgcccataggtctcatgcattaagtctgcgttgagcaatccctaacacggtttttgcctacagatacatttgcacaactgtgaaaaccaggtacgtattcattgcatcattttttgtaaaaagctgagagaagtgcccagcaacacgtcgtgccgcgcgtgtgcatggaacaccatatagcctcaccattaataggcaagatgagcgagacccattatcagatgagaaaagcacggcacggaatactgtgtccaatgtgctcaccgtctcaattttaaacctaaaggagggagaacattttctcatgcgtgcatttcatctctgggagcacttaagacgctgaagcgttggttgccagtgggaatgggaactgggtatctgtgatacagggatgagaattttcacactgtacctttaaataccagaacatcatgaacacatctgaaaaacaatattcaaatttccctgatcatctttcttttttgttaacaattatttaaattctggcacaagcaagccacttttcatcatgcatttggtctatagatgttctacctccctcaatttcgtcttgtaatttaatgaataggggaactggggccgggcacggtggctcacgcctgtaatcccagcactttgggaggctgaggcgggtggatcacgaggtcaggagatcgagatcatcctggctaacatggtgaaaccccgtctctactaaaaatacaaaaaattagccgggcgtggtggcgggagcctgtagtccaagctatgcgggaggctgaggcaggagaatggcgtgaacccgggaggcggatgttgcagtaagccgagattgcaccactgcactccagcctgggtgacagagcaagactccgtctcaaaaaaataaataaataaaaataatagggtaactgggttgcttctttgtatctcttgaaaactgatagaggtctcatcagattctaaatttgaatttttctttttttggcaataacatcacataggtaatgtcgtatgcttcccattcccttaatcatcgtggagatccacttctcgtgagtcatctccccacaatgctgggatcgatctctgcgtcagaattcctcttgattttagtggtcacttatcactgcctagatccattgtttaatgtgcttctaaaacagccgtgttctaattacataattgtataatttattagctggaattttctatttaaaaacagctttgtttcttctcaccaatgatttggttaacccgagtaatagcttgtacaggaaagatagaataaatcttgatcctttttaaaaaatttttatagacagggtctcactgtgtgttgcccaggctggagtgcagtggtgtgatcatacctcactaacctcgacctcctgggctcaagacatcttttcacctcagcctcccaagtagctgggagtataggggcagaccaccacacctggctaattgttttgatttttatttttagtggaaatgaggtctcgttatgttgcccaggctggtctcgaactcctaagctcaagccatcccccagctaggcctcccaaagtgctgggactacaggtgtgagctatgcgcctggcctggaatgttatttatccctttttatgcctgaagcacagtgcataatcttttatgtaagttagaactaagccatcaatgtaattttttaaaaaagcaaatgtgggccaggcacggtggctcacgcctgtaatcccagcactttgggaggcagaggtgggcagatcacaaagtcaggagttcaagaccatcctggccaacgtggtgaaaccccttatctaggaaaaatccaaaaattagccaggcgtggtggcaggcacctgtaatcccagctacttgggagactgaggcaggagaatcgcttgaacctgggaggcagaggttgcagtgagctgagatggcgccattgccctccagcctgggcgacagagctagactccatctcaaagaaaacaaacaacaacaacaaagcaaatgtggtttcgggaaaatgtgactgcaatggtaactttactgattggagcaggcacattttgtgtactttgtattaaaactcatgtaatgccatgcttgttacagtgacatcttgcacacatgctgtttttcaggagttgtatcccgcattttgtattcacaacggaggctccgaccttgagcggctccccacagccagcacctgcatgaacctgctgaagctccccgagttctatgacgagacacttttgcgaagtaaacttctctatgcgattgaatgtgccgctggctttgagctgagctgaagctgatgctggggtcagacccctacagagaaccagtgcttccttcgtcagcagcgcctccccagacccacgaggatactcacactgcacgcctgaggctctcctaagctccttctttcattctgccattcctccctcccttccttttttaaatgatttttattacggtgtggtcacttatttagatggacattgcttttcaaataacttaaaataacacgttatgtgccatgtggctactttagtaatattgccaagaagagcacagtttttacactagtggcatctcagtgaaattaaccaaagatgaagctttggctttgctggtgagatcagagccctcctgagcaggcagcgccactccagggttcagacagggctgcacaggcggcagagatacagggtctgagggctgagacgccatggggccgctgctgcttatgtggttggattgtttacaagcctcattattaaaactgaaggcattttttttttctgctgcctttcccaaagtggttaggtttggaaaagagatgatgatggtaatattttatttgtgctttttaagccatttccccaaatgggactagcatgcttgttttcagtataccgtggcctgcctcatgatggtttggagatactgtctgtggatgtgaggtggggacttcattcattgtcctatttctatctccactttgtgcctggagagctttcaggggaggtggaggaggagggtctgccaagctactgcaacatctgtcacccactatacccagttacttgggggaggacagacactgtggtgtcattaaagttgtttgaaccaaagtggcggctgcatctttgtcccgatgctagccgtgccggtctcccatcatccgctcgccctcctttcccctgggctgcgcccacttgtcttcctggatatttgggggtgactcgccatgcttggcaccctctgcttcctggtgctgctctgactcgaagacgggacagtccctggtgcacatccagggaagaggagcgtcggtagttcttgcagtaggcactttatcaggacctgacctgttgctgggtgattttagtctctacaaacagaaagcgtttcaaagcgtcagctgtgggagcagagtgaccctttgctgatgctggggggaggggatctaaatcctcatttatctcttctatgtctagtattttactgtcactggaggctctgtgggctgtcatagttaattgaccataattagcaatatacttttaaagtgggaaagctgaatgacacttttaagacaatgaacattatcaaaacaaaatgtataatttcttaatttgaataataaattaagcgtttaaatgctatttgtagtcttgatatacagaaataaaataattagggttggtcttttttattttaggttgttttatgttgaatgttctatatcttattagttaatttgtatattttattagtattttggaaatagcatatctgagactgaagagaaattgacaattcacttatttgtggtttttttctcagctattctgagcttatttatttatttgtatgttctaatggctaaacatttacattaaatgttttttttcccaagattgtgttggagtcctaccccaaatcattgtgattagcacagcttctgaatgttactagttttatcacaggtgtttgcatgtcaccagctaatggagtatagtaagatggcctacactcactgagaatcagaggtcctcgggaggatgcctgtcatcaggggtgggccgagcgtggctcccaggccggcggccggtgtgctcctatccgaccagccacgggtgttggcttcccgagtctcccattgggtctggcattagttcttgaaaaatttctggaggaagattctttgttctttgttttgtttgcccttttctacgttctgtcctactttctgctttctggtaattttgtacacaaacctaaatgttgacttggggttattgcagatacttctcatgaggtgttatctgcagagagatctttgttttggtatcctgagctcgttaaggcagctttatcgattgcagtggtttacaggatggtgtgtgcttttgcggagtgtgggaaaccagatactgcatccctgcccatcgtgagcctgcagtctacactctatgtatccctgccgttgacatgcaggcctccagtggtggaactgggagcacgggaaaggctgtggtggggttaatgactccttccaggaacttcctgaggaggtgagtggtgaacctgaaataattgaatacgtaagctttctcatacttgaaagaaataaacagccaaaggcatatggtaactcaaatagaaattcagggcatgctcagctctttcagatccacctgctccgggtcagcaagcatcacaactagcagggtagtctaggaagtgacgcagccaccctgtgcatccctcacagaacagcaggttcacctggaggtttttctaatgagaaattacctagacttcccaaacacgggctgaatgctggagtgctacactgtggcatgctgggatcaacccagagggcttttcctggtgcttggatggtggtcaaagttggtgacctgaagagactggtgaccagcatgtccaggtgggaaaaggcactgactacacaaaggtctctgcttccagaaaattctgagggtaagttcttgagcccaagtgctttgtgcctcgactgatttatctgtgaaacagggacagtctggaggcttgggtttcacaggagcattctggagatgccatgagcattgtagacaggcttttgactttcacatactgtaaaccacgttttaatttgtctccctaggcggttggtgtcacaggttgcaaacatcacatcttcaaaagtctgccctaacagcctacaaggttacaatagttttggccaaggtcttaacaataaaaatattgctgtataaaggcaacgttactactactttttcttctgcagaggtaggcagaaaacggtaatctctttaaatgctgttctctttttatgtgcatttttctttttttgagacagagtctcgctcatttgccctggccagagtgcagtagtactatctgggctcactgcaagctccgcctcccgggttcaagcgatcgtcctgcctcagcctcccgagtagctgggattacaggcgtgagccaccgcgcccggccccacttttgctttaagaggatggttcacgttctgattactgagatggattgctgtggtttggattcatcgattgcgcacttctaaatgttgacaggaggcagtgtccgtcattagcttataactgagggccttatttatgttcaaaatactgagctgaagattcttgacaccaattttaccgttcagataggagctcccaccaccagcctcgtcttccctgaccctggagtgggcaaaagcaaacatagaggctcgaagggtgtcacaggagggaaccatagccagccaactggggctgcctagagaggcaaatacggcagaagtcactgggtttttctttctgcacgatccagaataaagaaaggcacacctgttgtgctcattaag

SEQ ID NO: 17363 - DNA, 23995 bp, Human
aacttggctcacatatctgaatctttggaggcaggttgggctcagaccttccagtcagaggtgaccagagctccggttacttctctgaccttctctcggctctgcactctccctgcagcttcccttgttgctgttccacttccgcgttccacttacgagtccagattcctgcagctcgctcagaaggggctttgtgcgctggatcatcagctgaagtcctgggctttgctttgattgggtcatcttaggtcacaagtgcagcaggacagggaacaccgtgagctgatttagaccactcagggccacttggggtcattccctgggcatctacaaagcggcagaagagtaggatggaagccagggaagcagcaacagggtcacctcagttaccctacacttgtccctgtgggaagagggctgccggtacagaccccttgaagctttgtatctgcttgaactaaaaccaccgcctgtgtttgctgaggttgccgacatctgtctgagaaaatacgcaggagcagcaaggttgggggggctcagaaaagttcgagcacttccgtgtgcacactgtatgacccgattcacacacctggacacatttaatcctcccaactaccctagggggtcgaattcagtggaaaagagagcggcggctaagggcacctccaatggggagggtgtcggggcaaagcgacctgagacccccagccacatactgcaggacaaaccaatgtcggcaggtgaggacagggtgggaatagtgttccaggcagaaggaacagcgagtgtcaaagcctctaagcctgacagggtgggagtctggcctcggatctccagagatccaggaagaccctgcacaaatactagagagaggggtctgaaggagagaagaggagggaaggtttttgttgttgtttgagaggaagtctcgctctgtcgcccaggctggagtgtaatggcgcgatctcggctcactgcagcctctgcccccggggttcaagcgattcttctacctcagcctcccgagtagctgggattacaggcatgcgccaccacgcctggctaatttttgtattgtttagtagagacgaggtttcaccgtgatagccaggatggtctcgatctgagctcgtgatcctcccgcctcggcctcccaaagtgctgagattacaggcgtgagccaccgcgaccgtgccgaggtaaggttttcactggggtctcttccatctgcctggccgccaggccacgtatccactgaagaggcagagggtcaggatgggaagactccggggaccacctagcccaagacccgcaatcaggcggctgcaaggctaaccgggtaacttaaagaagtgaagccgattgacgtaaaacagaaaggaaagaagttaactggccggccagcgtcagcaggggcggccagtgtcagccctgcccggggacagcacccctgtttcgtggcgaggacacggagggccaagggggcggggccgggctgccctggccacgcccggaccgcctgctccccgcccagggcctgcacagttggcgcccaccggcatcagcgtgaagggagctcctcgctggctgccgacggggctgcagggctcgctagccgctcacctgcgtgtgagcgcggagcccgcagtacccgccgtccgggctcagaggacgtgactccccgaccctgcgcccggcagtccccgggggccgtgcgcccggcccaggctcggaggtccagcccagcggcggctcaggctgcgcgcctggctcccagcctcagtttccccattggtaaagcattgacggtggttgcggacggcttctgcggacagagccttgggctccgacgtctgcgcgggtaccggcagcacccccaccccgaagggagggcgggacctggatctcgcgaccgctgccccaggtccccgcccccgggccctaccgggctgaggtcggcaggccccgccccccgcccacgaggaagtggctgctgctccggcgcggagcccagagccggttcggcgcgtcgactgcccagagtccgcggccggggcgcgggaggtgagggccgtgggggcgcccggaggtgggggtcaggggagccacctggaggtgggggggcgcgtagatgtggggcgccgcctgggagtgagcgggactggagggatgagagggggtgcaaggaggggaccggggggcgcctggaagtgaggacgcatagatgtggggcgccgcccaataggggcacggggatgagtgggggcacatggagaggagggggcgcggggacgaggggctcacggaaaggagagggagccctgggattggagggggcgcgggggtggccgcagggccagactgtggaaacgcgggctcccagcgcaccgggcgccctcggggcgtccccagcccccggccccaagcttccgcctcgtgccttccgcccctgctccccggcccccatccccagccttgccccgcggtcggtcggtgtagccccgttacttcgggccggcggggccccacacccagtcacttcccctccatccccggagccttccgggttgcagccgccgggaaatgagctggcgtctcctgccgccccgcccctgccctcctggccgctcccgctgctcccacccgcctcccccgggccaggtccgaggggtcccgtacggggcgggcctggctggcggggtcccggaacgcaccccctcagctgcagggctccgcggccagggcagatccgagcagcccctccctttccggaggcgctgggagagcagccaggccgcctagggcggggcggggccgggctgcacccgcgggcagtgaagggatcaggagtgcaagcctggggagtcagacctccccctgcctcctctgccaatgcagcccggaggctaccaccacccatcccggccgggcgcggtggctcacacatagaatcctagcattttgagaggcccaggcgggaggatcgcttgaggccaggagttggaggccagcatggacagcattgcgagaccctttctctattaaaataaataaataaaatgtagccaggcgctgtggctcatgcctgtaatcccaacactttgggagtcgaggtggacggatcacttgaggtcaggagttcgagactagcctgaccgacatggtgaaaccctgtctctactaaaaatacaaaaattacccaggcatggtggcacgcacctgtaatcccagctactcaggaggctgaggcaggagaattgcttgaacccgggaggcagaggttgcagtgagccgagatcacgccattgcactccagcctgggcaacagagcaagactccgtctcaaaaaaaaaaaaaaaagccacgtaacatgcctgtaatcccagctacttaggaggatgaggcaagagaattgcttgaacctgccttggcagtgagccaagactgtaccactgcactgcagccttggcaacagagccagactccgtctctaaataaataaataaaatcttagggacctaggtaggagtgccagcttctcccttcactggccagtgactggtaagccacccaactcctgccagcctcaactttccttatctggaaaatgggaaccttaaagactgggaggctgaaatgcaatactgcaagacacctggcagcgtgtcaggcgctgacagtataaacgtgcgtttgttgctcaccttgatcatagtgttcccccaggtgaacctaacttcctggcctccaagatttggggtcagagtcccaagctgcgtcatttagtagaagccgagtgactttgaacaaatcgttgcttttgtctgagcctgggtttcctcctgtacaaactgaaggtaaaaagcaaacaggctgggcgcggtggctcacgcctgtaattccagcactttgggaggccgaggcaggcagattacctgaggtcgggagttcgagaccagcctgaccaacgtggtgaaaccccgtcactactaaaaatacaaaattagccaggtgtggtggtgggcacctgtaatcccagctactcaggaggctgaggcaggagaatcgctagaacctgggaggcggaggttgcggtgagccaagatcatgccgttgcactccagcctggggttacaaagcgagactctgtctccaaaaaaaaaaaaaaaagcaaacaaaaaatgtctcaggcttgcttcagggggagaatggtgaaaggtctgggtaaaatcgccctgatagatgccggtaaagtttgtttcttacatatgtctgtacataatccattgataggtctttttctttttttctggagtccgggtctcattgtgttgcccaggctatagtgccatggcttgatcataactcactttagccccaaactcctgggctcaagggatcctcctgagtagctgggattacaggtatgttcctccatgcccagctaatttttaaatgtttagtagaggtagggttttgctgtgttgtccaggctggcctcaaactcctggccttaagcgatcctcctgccttggcctcccaaagtgctggggttacaggcatgagcctccacgcctgccttatacgtgctttctttttttttttttttttttgagacagtgtcttgttctgttgcccaggctggagtgtggtgacactaccttgactcactgcagcatctgcctcccgggttccagtgattctcctgcctcagcctctcaggtagctgggattacaggtacatgccaatatgcccggctaatttttatatttttagtagagacggggtttcaccatgttggccaggctggtctcgaactgctgacctcaggtgatccgcccacctcggcttcccaaagtgctaggattacaggcgtgagccaccgcgcccagcttcttcttcttcttcttcttcttttttttttttatttggaggtggcggagtttcactctgtcgcccaggctgcagtgcagtggcacaatctcagctaactgcaacctcttcctctcgagttcaagtgattctcttgcctcgaccccccgagcagctgggattacaagtgcccaccaccaagcccagataaattttgtatttttagtagagagggttttaccatgttgggcaggctggtctcaaactcctgacctcaggtgatccacctgcctccgcctcccaaagtctgggattacaggtgtgagccaccgcacccgtcggttgataggtcttttctaatattaataattacgtagcatctcaacatgttaatgtcataatttactctttccatattgtcacctgggtttttccacactgtcaccattataaagacagctattataaacatgtttgctttattttttagatgaggtttcactctgtcacccaggctggagtacagtgacgagatctcggctcactgcaacctccaccttcccagctcaaggaatcctccagcctcagcccctcagatagccaggactacaggcgtacagcatcacatcccgctaattttttttttttttttggtagtttttatagacacagggttttgccatgttgcccaggctggtctccgaactcctggactcaagtgatccacctggcttggcctcccaaaatggtgggattacaggcgtgagccatggcaccccacctgtttgcttttaaaaaagaaaaatggggccaggcgtggtggctcacacctgtaatcccagcactttgggaggccgaggcgggtggatcacaaggtcaggagttcgagaccagcctgtccaacatggtgaaaccccatctctactaaaaacaaaaacaaaaattagctgggcgtggtggtgggcacctgtagttccacctactggggaggctgagacaggagaattgcttgaacctgggaggcggaggttgcagtgagccgagaatgcaccactacactccagcctgggcgacagaatgagactacatctcaaaaataaaaaagaaaaagaaagaaaaatgtgttgctgttttcttaggaccaaatgggtgtatgtgaccaaagaatgttaattttctttttcttttttttttttttttttttgagatggagtcttgctctgtcctccaggctggagtgcagtggcgcaatctcggctcactgcaagctccgccttccgggttcacgccattctcttgcctcagcctcccgagtagctgggactacaggcgcccgccaccacgcccggcttaattttttgtatttttagtagagacggggtttcaccgttttagccaggatggtctcgatctcctgacctcgtgatccacccacctcggcctcccaaagtgctgggagtataggcgtgagccaccacacctggccagaatgctaattttcaagttcctgttagtgttattctgttctattaatatttggtcccacccacttgttgaattgagtgcccttcagaagaattaaaccaattagcaacaaatgacaatttctccacagctctgctagcattgaattttgtgtgtttttgttttgtttggatgactaaccggtgctttaatggtaccttacgattgttttcatgtgtgtttcttgacttcactctgcgtggttggtaagacttcaagagcagagctggagagggaaggataggggtaggaagggctctgacccagcataggaagttgagtaaccgcttagcacggtgcaaattagcctgctggctgctctatccaagaactgcctgagctgggtggggacttcccagagcgcctgtaatgctgagatctttcctccaggcaactcctccttggtttagcctctgatacagccaaacctctggattcagggaaacctaaggaagccaggcaagaagggtcccgcagcctgtgcctagtctagccccagcctcatctggattaagatgggagggaaatattggctgagggcacccagccagtatgaagacagctagaatgtaaacccagcacagtaagggagagagtatcaaggcccaggactttagagtgcctcaccaccaccaccccgccgctgggcagcctgaggctttctttgcctggcaccaccatgcctggctaattttttttttttttttccaagtggagacggggttttgccatgttggccaggatggtctcaaactcctgacctcaagtgatccacccacctcggcctccgaaagtgctgggattacaggcgtgagccactgtgcccggctatcccctcctctctctggtttcttaacatcaaacaggcccacagtgctggctcacagggccacagtgatagtgggttggtgtcctggatccctcccccaggagccatcactgagaccttatgctgtcaacactggtgggtgaagcagccctcgtatttttctcctgagacatccagagcagggtaattggcaggcgggggtgagcacacgctggctcacgcaggcttggtaggtgagaggttttcctgaggatgatgaagttggagtgtccccggctagaatccctgaggcaggagactggagccctgtggcagcattggctgagagaagccactccctttttgctctcccacttcctcactggtaagatgtgggggttggggagttatcgcagaggcgctttgggtttcagctgctttgcagaagttatggaaaaagggaaatgagtcttcctgtctctcgcccccttaacacttctttgccccatttaaggggtttgttcaacagactaggaagtatttctgctaattcatgctgaagtgtgattggctgataggtgtggtctcaacctccctcctctgccagtcactagtgtaccactgtggccatcttttccagcccctcctctgccccttgagtatgtctaggtcctagaaacagtggtcagggctcttcaagtcctctcggttgcccttgcccactggcacacgtgggggttgctgtcttcagcagagccagccactccgtcttgacagccagggcagagatgtggctgggcacacagcaagaatgtgaccactgatgctgggatgtcagagtctgtgcatcaacccagggttctgagtctgggctctcccaccctcatccccggaggttccttcagtctgggcctcctggggctgaaagggagggaaaaattggcctcagctggagtcctggggccaaccagagcctgggtggagtgtgaaagtgggcttctggccttcaccctgcccctgccctgctggtgaccttggaccatgggggttgtcggggtgtagatgagcaccgtgaatcagtcacaggccttgagcttctctctgcacagtgctggcatcagatgtgggtggtgatgtcccagcctgggaacacaggaaacgctcagggaaacccccatcagacctgctgacatggctgagggcgctgagatggtgcttccggggccctcaccttacacaaagaggccttataaggagagagaggctgcagaggcagccccagtgggtgccgggtgcttgttctgggtaaggctgcccacacgtgcaaagtgtgcttgtggacacagtgcgcttgcgtgtgtgcaaggctgaacatacatgtgtgcaggcctgcagtgtgcctgtgtgtgaggctcaacacgtgcatgtggggagtatggtcatgtgtgcaaggctaaacatgtgcttaaagtgtggggaggtgcagtgtgcatgtgtgtgtgcaaggcttaacatgcaaagtgtgcttgtgtgtgtgaggctgaacacgcatgtgtttgtgtgcgtggcctgaccctgcgctgcgtgtgtctacttgctcagcaaatgctgactggggacccaccggggtcctgttctaagcatggaggaaacatgaggtccctgccccgtgcatgtacacatgtgcatgtgtgtgtgtcctgtgctgctccaggaatcttccaggacatcctgatacaagtgaaagcaagcggtttggatctggagtgagcaggaggtggacagggccttccaggcagtgagcgcagggggctttgtgttgtgacctcgggcaggctggtcactgagccctgtggggccaaactgcagccccaggcaaaggtcgttctgcctttcccttgtgcctgggcccagatgcagtgcaggatgggccggcccctgggcagggcagtgacggggcagccaccggcctcctggggcattcagggttcccagtcctggttggctcccagcccaggccctgagacccaacacaaaactgccagtctggtgagggaggcagccacattatctaatggctgtcactggtgactctgggcaggtggcctcagcccccacatctgtcatctggagctgacctggagcctggcatccctccccaagtgcagccaggcctccctgaaagtccagggctggtgggagtgttgaagtcaagaatgtatacagagcacctggccaggcgcggtggctcatgcctgtaattccagcactttaggaggccgaggcgggcggatcacttgaggtcaggagttcaagaccagcctggccaacatggtgaaaccctgtctctactaaaaatataaaaattaggcatggtggtgcgcacctgtaatcccagctactcaggaggcggaggttggagtgagccaagactgcgacattgcactccaggctgggcaacagagtgagacttcatctcgaaaaaaaaaaaaaaaaaggatacttttttttctagagctggcaaggagggagtatccagaaagtgctggatggtactagttaatacattttattttagagacagggtctggctctgtcacacagtggtacaatcatagctcactgcagcctcaaactcctaggctaagcaatcctcctgcctcagcttcctgaatacctaagaatacagatgtgcaccaccacacctgcaaatttttttatttaaattttttgtagagatagggtctcactgtatcgcccatgcttgtcttgaacttctggcctgaagcaatcctcctgcctaggcctcccaaagtactggggttacaggcatgagccactgcgcctggccctatttaataaaattatttatttatttattatttttaagttattttttcacacacattcattcctaaccttttttttttttttttttttgagacagagtcttgctctgttgcccaggctggagtgcagtggtgtgattttggctcactgcgacctctgcctctcaggttcaacagattctcctgcttcagcctcccaagtagctgggactacaggtgtgcgccaccacgcccagctaatttttgtatttttagtagagacagtctttcaccatgttggccaggctggtcttgaactcctgacctcaggtgatccgcccgcctcggcctcccaaagtgctgggattacaggcatgagccaccgtgcctggcctcattcctaacctatgtaatgataatatttttgagggctgggtagggtggcgtgagcctgtagtcccagctacttgggaagcagaggcaggaggatcacttgagcctgggaagtcgaggctgcagtgagctgtgatcacaccactgcactccagcctgggcaacagagcgagaccctttctcaaatatacacacacacacacgtttctgagaacgtactctgttggtcactaatggcaatgaaaaatttgttcagcggatatttcttgagcacctactatgtgctaagcatttaagcagtggaaatagaaacgagaacaagatagaacaaaaatgtgtctctgccaagctggttctattccagcaggggaggaaggcagcgggccagatcagtgagtgcatgtctgatggtgactgctgagaaaatttaatcggaaatagggaattacgaagtgccggaccgtggaaggtgctgcagtttccagggaaggcctccccaaaagttgacatttgagtacagacttgagtggcagcaccagagcgagagccgtgtgtgccggtatctgggggaagagtgtcacaggcctagggaacagccagcacggaagcccgaggcaggtgcatgcctgtgtgccccaggattggcctctggttggctggggaggcctgctcctcaaagggctggtatatcacatccatcacaggctaagagtaaccgcctcgtggttcctcctcatagaggccaggtgcggtgtgtcatctgcttccagctctcagcatctctgctgggaggcaggattcctgttcccattttacagatgagaaaactgaggttaaaagaaggcaggtgatgtgtcccggggcatgtggctgggcaagcagtgccactgggctcctccacttccaggtccctgtgatgctgggaaactgagtcacggaggcggggagagatgtgtttgaggaattgggctgagaccgtgatctcacccccgtcaggcctggtgggctcctttgacactcagcggcaggtggaggaggctagggacaggctggcaggggctgagctgggctgacgggaggatgagtcgctgccctctgccagggttccccttcagtgctggggctagtctagagggctgcagtcaaacatctccctcgttctggccgagtgtagtggctcacacctgtaatcccaaatacttggcaggtgaggagggaagatctcttgagcctaggagcttgagaccagcctggacagcattgtgagacccccctctctacaaacaaatcaaaaattagttgggcacagtggcacatgcttgtaatcccaggagttcatggctgcagtgagccatgatcacaccactgcactccatcctgggccacagagagagaccctgtctcaagaaacaaaaatctccctccttcagttccccaaggctgggtcaccctggggcctccccaagagccatcacccaggcctcgcctagccctgtgcctcctcccagccctgggtgcagccagtggatgtctggatggagaatgggatgtatctgttaaatatctgcctttgcctcagccatgagcccctgcagaccggccacctcccttctccccgtctgagcagtgtgggggaagaccagggctctgggcacggcagggccaactgccatgtgctggacacctttctaggtggtttatgagattacttcatttcttttttttttttttttttctgagatgagtcttgctctgtcacccagcctcctgagtagtggggattacaggcaggtgccaccacacctggctaatttttttttttttttttttttttttttttgagacggagtctcactctgtcgcccaggctggagtgcagtggtgcgatctcggcttactgcaagccccgcctcccaagttcacgccattctcctgcctcaggctgggactacaggtgcccgccaccacacccgactaattttttgtagttttagtaaagacggagtttcaccatgttggccaggctggtcttgaactcctggccgcaagtgatccgcctgcctcgatctcccaaagtgttgggattacaggcatgagccaccgggcctggcctggatgacttcatcttcatcccatccttaatggggcaggggaagttgggtgggggggggggggtcgtccatcctatgaggaaaccgaggcacagatgacaagtgaggggcctgtccagcttggagtcctagcaccccaccccgccccagggagcatctcccctgtagtaccgtctcctccaccctgtccctggagcctcagagacatcctgtgaaagctgcccttttataaggagggaaactgaggccccaggaggggaagcaacatgtcaggccagttgggagccagggctggcccctgctgctcctctctgcaaactgctgcccctctaaactgaggggcctccctggtgtgaggcctgtgaggatcatctggggcctggtatgggtgaagtcaggggcaaggttggggctgacgtggattctctcttcctctctcgggcacaggagccaagccgccatggcctaccacagcttcctggtggagcccatcagctgccacgcctggaacaaggaccgcacccgtgagtgcttgctgggggccggtgggtggctgcttccacctcctgggatggggaccagccagagcacacatggggactctggagcagccaggcccccggaccatgggctccatgtggctgtcccctggcctcacccctgggtcttccagctgaccaggggcctcctgggttaaagtttaaggagggaatgggccagttgcggtagctcatgcctgtaatcccggcactttgggaggctgaggtgggtggatcacttgaggtcaggagttccagaccagcttgggcaacatggtgaaaccctgtctctactaaaaatacaaaaattacctgggcgtggtggtgggtgtctgtaatcccagctactcggggggctgaggcacgagaattgcttgaacccaggaggcggaggttgcagtgagtcgagattgcaccactgcactccagcctgggcaacaaagcgagactctgtctcaaaaaaaaaaaaagagagaaagaaagaaagaaaaagtgaccaagaaaaagcctttcggaggagatgacattttgacatttacccagagacccagagggggagaggaagggaactgtgccccagctggggaggggctggcaggtgcaggggccctgaggtgtcagcaggagcagcgaagggttcctggttggccagagcaatagggtggggagaggtcccagggttcattgctgcgagtaaaggacagccagttccaggagaagacagggtggcctagcagggcctgaaggacttcagggggcccctgcaaggcagaagaggagagactgagtcatgaaaggtgaggtgttgttgcctaggtgcactgtgtagtgtgtcctggcagagggcagtcatggagagggcccctcaatctccctccatctccccttcagagattgccatctgccccaacaaccatgaggtgcatatctatgaaaagagcggtgccaaatggaccaaggtgcacgagctcaaggagcacaacgggcaggtgacaggtatgtcagggtggctgggaccaccgtcctgaaaggaggtggtgggttgggggggtggtgcaaggcagggcatggccactcattgtggagcatctgcccactcaccgtgaaacccggattcaaactggcttcaattttaaggggactgtgttggctcatgttaccaaaaactcacagggttgagggcttcaggagaggcttgatccagcagctccacatgaccaagaacccatcttttctgcctcttggctttgccctccagcatgtttgctgatagcatggagggctctgacactccctcataagctctaggagtgccccctggtgtcactctaaataagcactggatctcagtaaaaagtgcttgctgggccgggtgcagtggctcatgcctgtaatcccagcacttcaggaggccaaggcgagtggatcgcttgaggtcaggagttcgagaccatcctggccaacatgactaaatgttgaaaaatacagaaattagccgggtgtggtggcacgcacctgtagtcccagatactctggaggctgaggcagaagaatcgcttgaacccaggaggcggaggttgaagtgagctgagattgcaccactgcactccagcctggatggcagagcgagactgtgtcgcaataaaaacaaagaaagaaagaggccgggtgcggtggcttgcgcctgtactcccagcactttgggaggcggaggcgggcggatcacctgaggtcaggagttcaagaccagcctggtcaacatggtgaaacctcatctctactaaaatacaaaaattagccaggcatgatggcgggtgcctgtaatcccagctacttgggaggctgatatgtgagaattgcttgaacccggaagatggtggttccagtgagctgagatcgtgccagtgcactccagcttgggcggctgagcgagactctgtctcaaaaaaaaaaaaaaaaaaaaaagattggtggtacacacctgtagtcccggctactcaggaggctgaggcacgaggattgcttgaacctgggaggcagaggctgcagtgagctgagatcatgccactgcactccagcctgggtgacagagcgagactctgtttcaaaaaaaaaaaaaagtgcctgctgggcagatacagcttccacctggatggtggcctttcagcctctcccatgtggccaccatacagccacctctgcctgagtgtcatcagcctcctgtgttccctccatccccccacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtacctaggcagggccagagtgggctgttagggaccgggggcaggactagagtgtccccgggaagcaccaaatgggatgtcaggacccctgttcccatcaccctgggggagtccatcctctcctctctgggcctcattcatgaggcaagggcctctctgcagcgtccggatgttctcactgccagtgacacccaccacaccagaaacacatctgggggcacctcactaagccctgcacacacattagtcctgacttccctgcagctccgtggactgggcatcggtcactgtccccactttacagattagcaaaggccctgtagcagtcactttctcaaggcaccactcacgagctcgcagccacatcttgttccttttttttttttcagatggagtctcactctgtcacccaggctggagtgcagtggcacgatcttggctcacggcagcctctgcctgccgggttcgagcagttctctgcctcagcctcccaagtagctgggattacaggcacctgctaccatgcccggataatttttatatttttagtagagatggggtttcaccatcttggccaggttggtctagaacttctgacctcatgatccacccgcctcggcctcccaaagtgttgggattacaggcgtgagccaccgtgcccagccaattttttttttttttttttttttgagacacagtcttgctctgtcgtccaggctggagtgcagtggcacaatctcagctcaccgcaacctctgcctcccaggttcaagcaattctcctgcctcagcctactgagtagctgggactacaggcacgcaccaccacgccaggctaattttgtattttttagtagagatggggtttctccatgttggtcaggctggtcttgaactcctgacctcaggtggtcctcctgcctccgcctcccaaagtgctgggattacaggcgtgaaccactgcgcccggccatatatatatttttgagacaaggtcttgctctgtcgctcaggctggagtgcagtgttgtgatcatagctcactgcagcctcagcctcctgagctcaagtaatcctaccacttcagcctcctgagtagctcggactacaggcccaaatcatttatttatttattttgtagagatagggtcttgtcacgttgtccaggctggtcttgaactcctggcctcaagcaatcttcccacctcagcctcccaaagtgctgagactacaggtgtgagccatgattgccagtccacgtcttagtttttaatctcccctgcatggctgagggcagaggccagccaggagcatctgagagacccaaatttgcatcccaccatggccagttagtagttgtgtgacctctggtgatggcatcactttgctgagcctgctctgagggtgactgtgtggcctaaaggatagagggcacagagttcccactccagaagcgacacagcacatccctgccgccccagggccctgacggccttgtgggctggcaatgcccagtcgcctctctcctgggtctttggtgggctgcagggagcagtgggagcctggagtccctggtgctgaggtccatgagtcccacctgcctgtccctctctccctgtctgcctgaccaccgttcccaggtgggtttgcaagcacatcaagaagcccatccgctccaccgtcctcagcctggactggcaccccaacaatgtgctgctggctgccggctcctgtgacttcaagtgtcggtgagacagggcgccatgggggagggcggggctgacgtcaactgactgctgacatcatagcggggagccgcacctgaaagctctacaccccagcttctagacacattccagacctgctaccagtggatgacctgggcgtcggttgaaggttctagttcctggggaacccttcatgtctcagctggatgggcctctgcccacctcttttattttttttgagctaggggcttgctctgttgcccgggctggaatgcagtagtgcaatcatagctcactgcagcctccaaatcctggactcaagcgatcctcttgcttctcagcctcccaagcaagactaccacgcccagctagacaggattttttttttttttttggagacggactctcgctctttcgcccaggctggagtgcagtggcgtgatattgactcactgcaacctccgcctgctgagttcaagcgatcaagcgattctcctgccttagcctcctgagtagctggaactacaggcgcatgccaccatgcccggctaatttttgtatttttaaatgtagagacgggttttcaccatgttggccagactggtctcgaacccctgacttcaagtgatgcatctgcctcagcctcccaaagtgctgggattacaagcttcagccaccatgcccaggcacctgttaaccctttaaaaaaaatttttttttttttttgagacagtctcactctgttgcccaaactggagcacagtagcgcaatcacagctcactgcagccttgacctcctgggttcaagcaatcctcccgcctcagcctcctgagtagctgagagtacaggtgcgcaccaccatgcctggctactttacctctactttgcctatcccggtaggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggcgtgagtcgaggccatccccaggggaggaggtgagtgcagaggagtgggacaccgtgactcacagctctctcccctcagcgtcgcgactctggcctctgaaacactaccactgctggcgctgaccttcatcacagacaacagcctggtggcagcggtgaggaatagggaggggagggagggtgtgtggtcacagcaggcctccgagagagcccagcaactctcatctcctccctcctttctcctgcctccctcctttttttcttccttgcattctctcatgtaccagaattgggcagaacaggttgggttatgctgcagtaaccaaaagtccctggctgcagttgcttaacagagtaaagatttggccaggtgcggtggctcacacttaaaatcccagcactttgcgaggttgaggtggaagtatcactggaggccacgagtttgagaccagcccgggcaacacagtgtgagacccttgtctctacaaaaagttaagaaattagctgggtgtggtggtgcacctgtaatctcataatcccagttacttgggaggctgaggcaggaggataacttaagcatgggaggtcgaggcttctgaactgagctatggtcgtacctctgcacttcagcctcggcgacacaaaacctgtctcaaaaaaaaaaaaaaaagagccaggcccggtggctcacacctgtaatcccagcaatttgggaggccaaggagggcagatcacctgaggtcaggggttcaagaccaacctggccaacatggcaaaaccccatctctactaaaaatacaaaaattagccgggtgtggtggtgggcgcccatggtcccagctgctcgggaggctgaggcaggagaattgcttgaacccagaggcagaagttgcagtgagccaagggtgagccaccgagactccatctcaaaaacagaaaaaaaaagatatttacttcttgctcacattttatgtccagtgtgggtgttgtgaggtgctctgatggaagctgtccccagcatgctgtcccagatgccacgagggagccggaacctgcggaatcatgccctgggtcttaacatttctgcccacattttattggcaggtgcaatggcaaggccacgcctaatgcaaagggcgagagttcggggtgtgcggttcctccaggtgtccaggaagggcactgctctccctcccctccgcccacatctgtcaagtcccttttcacccctctgcaaacataatgggggtgccagggccaggtcaggcttgctttttgcctagaaaagcaaacagctgcaggggtctcccctagagcaggtgtaactggctgggcaggacagaaggcgcctgagctcccagggagtcccaacgctggccttgctgggggaggtggcagcccccagcatcacccccggttttgatacacctgcaattcgggcctccctcgctgtggcccgtctgtatccttgagctggcatctgcctcccgggcggccagacgcccgcctggccttccctccggcctcggtttcccctccgcggcgctccaatggcccccgccctccgcgcagggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcaggtgagagcgggagccgggccggcgggtgggcggggcctcggctcgcccagaaacagcgtcgggtgaggaaggggcctggagtcttcctcctggggcattgtgctgggaccttgaggactggggacccggagggagggtaggcgtgccctcaactcgctgcgccggaacggcgtctgatgagcggcgggcccggacacgaggggacggggccgatttgtgggcggggccttggcgccgtactaaaaccgcgtggggcggaggccggcagaggtcgcgtagcgggcccagggtagggagtggctttgactcgctgcggaataacatcgttagttgtgggcggggcccatcttgatctcaccatagcagctcaggtgctagtggagcctgggagggacacggtgcgaccgacataagacggggtcgacctctttaggttgcataaaaatagcatcagatggggctgagcagctagcctcgctctgcatttccgggacttaggtggggactgtcgtagggctggcccctacggttctctggggtggccaggcagtgaccagcgggcttcctgggcggggtcacagctggggcgggtctattgctagcacttagcgaggtgggggcggagctgagggtctctccgcagccttctatggatctagggtgggatggggaagaggctcttcaaagcccaaaagctgccagccacacgtgtccaccccgcggcgaatcagagggagcgggagctgtatggcaagactggccaagcccttcggtctgtaaaacctcctgtgtccgccagatccgatggcttcctcagatgaaacacctttgtccagctatcagcttagtccctggctgcccccacccccatctccttttttgtcctgtccagctgcactgctggcactgtgtacactccgcagacacacgtgtctttcctgcctcccaggacttgagtgtcctgtcccatttgcctgcacctcgcatgccactgtccccaaggcagaactgacttctaagcccactacaccccctcggtacttctcactaaagcccgctccccaagaagtctgggagcgcctggtggacagggtgggcctgagcccagcgccagcacaggttgaattcataagctcctcttcctctttgcagccagatctcggtgctcagcggcggcaaggccaagtgctcgcagttctgcaccactggcatggatggcggcatgagtatctgggatgtgaaggtgaggcttgcccctcctggcttcccgccatgcctcccaggtcaaccctttccccccatccccactccctggagatgacccccatccttcactcctgcagagatggcactgcatggggatgaggggtgggggcggccccttgacatctgggccttggtgctcactggggcacccgtcttcagggccgggattccaacccagctgacagactccaaaactgcaggttctctgccctctgctgtgctggggctgagatgggtgatcaggtccctgggagtggggtgcctgcaggacagctgagaaccagcctgtccgttctgcctccctgcagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaaaatgcccccaaagcactatgctggtcatgaactgcttcaaaatgtggaggtaataaaatgcaactgtgtaaaaaaaaaaaaaaaaaaaaaagtaattatggacatgcttgcctatgtggaaggagaggttttttgttatttccttggggtcttgctaagttttccaggctgcactagaactcgtgggagcaatccttctgcctcagcctcccaagtagctgggactccagggagagattggtgtttgcacggccataggtagatagcttatttttactgcttgccaacaaaattgatcctgaagcccaacggccttatgccaaatggttccctccccactgctgtccatcctgggctgccactcccaaaactgccagtaccaggtgtcactgattgactagtcaaattcctggacaaaggggctacacactccaggctggttgtggaacttttgttttgagatggagttttgctcgtcacccaggctggagtgcagttgtgcgttctcagctcactgccacctctgccttcctgggatcaagcgattctcctgcctcagcctcccaagtagctgggattacaggcatacaccaccaagcctggttaatttttgtatttttagtagagacggagtttctccatgttggccaggctggtcttgaactcctgacctcagatgatccacccacctcacctcccaaagtgctgggattacaggcatgagccaccatgcccggcctggttgtggaacttcacgggaatttattttgtcattacaatgttggcaagatatttttttcgtgtgctgtaaactgaggttctgtcttggagtttatgtcatgtcaccaggtcctgtgctgaagggcatttgcacatcttttgtggcttctctcaggaaaatgtgggccttggcgacatccaatgctagtgctattccccttctcccctagagttacagaattataaccaccaggggacacctacaggccaggccaggccaggatcctggtgctgcttcagcctactgtggcctggaagggtccctgcctgctgaggcctaagatcctgacttggctaaaggaggggagggggcaggctgtggtatctagggtccatccccgcatcctgctcggtgccacctgacagatgtcatgccccaggtaggtatgtgccctgaaccttgccgggtgcacgtgcctgaacgtggcaccgtacccagctgggtaaaaacggctcgagcacggaagccaaaggatggattgccaaaacaaagattacgataatgtcaagtttaatctgccaaatatacaagttgaatttgtggagcatgttttgcctgggtgccacacagtaaacagaggtttcttgaaatgatcaatgggtagggctgaaaatgggcactggccctagccaggtgagtaggaaccgggcagggaagggcagagaggtgaggccctgaggtcagtcagacaggactgaccagggacaagccatgaccctcgaggacccaggggcacaggctcccagatgatagcccctctctgaatgagcacccaggcaacacagtccggggctgtgtgtagcaaacctgtcagcagctgcctcctgggacaaccacccccttacatgctatctatctaccagacaaatgaaagctcttcttaccccatctcccaggcaccccccagcaagggctctgaattctaaaaacagcaaaaacattcaaatggttacatatgaaatgctgtcctgcatctttctgtctcaaagatagcagctacccctcccccagtccccccccccatcccccaaacaatttctgtgccaagatgaagaggaggccccaggccatggggggctcctggccatgaggggctgttgcagcggcgccagggcacagggtgggcgagacacagcagaggtcctggcagcgcggcccaggtccccggcatctcctcccacgggtcgcagttacttattcagggagagtgactgcattcgt

SEQ ID NO: 17364 - DNA, 33529 bp, Human; identical to SEQ ID NO: 12865

SEQ ID NO: 17365 - DNA, 27227 bp, Human
ggtgatcagtccagagcatttcttccggaaattttcacatggagcttcagctttcttgggatcgatgatgaggcaagggatgctccacccaggtacatttgcagcaagggactctggctatggagcttagatgagagtttaagggattgggctcagggcagggccagtttctacgtgtttagcaatagggttgatcgtgttttcaagcaacctaaacagctttatcagggaatgtgcccggccccattgaactgggttcaaggctgcagggaacacgcaatggccaggtcccagagcaatcaaaggactctgtgtttctcaatcagtagagaaagaaaagggggaactggaagaccctgtgaatcccaatctcagctagggatgagcaatccaggctggcccagagcataagcaccgtgaccatgtgagggcctgagtgtgcctggctttggagggtctgcttgctcagtggcctctagactcagccgggcagtggatgcagtggatggaggaagccccctcgccccagacaggacctcagggcctcagagccctggcatctgcaccctggacacaaggaaggtgcctatgaggtggatgctctagccaggctttctccccctcctgctcctgtgttaccctggtgtgcccccctcacctgcagcaggccaggtgggggcatagggttgccggcccctaccagccctgggggtctggagggcggctggggaagcagaccccctgtccttccctatccttcgcgacatgctccctgagcagctgcagtccacttagatgaccagagaggatgtggggctgagggagccgaactcggggcagcaggggcgggggtgggagtgccgggatcatccgcaccgggagaggcgaggccggcgtctgtttttcacctgggcctccctggggggctgggggctgcctgactcttccctcctttggtttgcgcaagttttcccgcgcgggttcggatcaacacgccgggggagcccggcttacgtccctcctggacccccgccccgttcttcccgtggggaggggcgcgtcaggcggacctggcaccctccggctgctgggcttcgccgggagccacgcggggaggtccaggcagtcgggacgcaggcagcgtcctcgccgaggctgcgagtccgtggccgtccgggggaggcgcgcaggctctgccggacgcagaaggaacccgaaggaggcggggtggagggcggtgcggggccggggaggggcgaggcgagtggcgagtggacgccgggcccggcctcgggcaactccgaggggcgcccttcctcggggtcccggaggctctgcgaccccgcggccgctccagccgctcactggggacaaggcccgagccaggcgtctccgcgaggcggggtccatagcgcgcccagcaggcgcctcctgtcgcagggacgcgggggagcggcgcctgaacagcctcggtgggaaccagcgcccgaagctggtgatccggggtgcgcagggcccaaccgggcgatcccctggatctccgccagcctcgccccgactccgctcctcccacccgccagcgagtccgcaactcccggccccggcccgcgtccccagctccaggccccggccccgccccgcccctgctcaggcaccgcccactccgggctctgggccctcctctccctcgcggctccgccccctgcccgcctctgactgtaccccgcccccaggcgccagccccgcctatctgggcttctggtcccgcccaggttcttgtccctcgggccccagcctcgcccctcctcggctctgactccaccccttctccggagcctgggaggcggggctgagaaccacagagatggccgggcctccgagcggcccagggcggccggaagtttgcggggcggggcggacgcgggtggccaaggcccgtttccggcggcgtcgcgcgtttgcgagcctcgggtggtcctcagggagggtgagtcggcgcggcgggcgcggactcgggttgccctcggtccgagtgatccctggtcgcttccttagccctcccgccttcggcattggggtccccgcgtcccccgggcctccaggcgggaaagcgcgggggctttgcggggccttgagcgcctggtgtgggaggtggtcgagcccagccaccctcccccgcggcggcgcgaggtgggcttcgtttggccgagtctcgcagctccccgcagaccccgctcgtggcggccacggtgtccggggcctgagtaaggcgagctccagctgcggccttttcttcaggcctgggtctactcccggggccctgactcctcctgcgaaatcacctccttctagagccttttctctttctatttattgccccggaaggcctaggataagtgacagtggaggaaggaacggtgccttgggtggggtaggctgtttgtcttctctaaattctggttgctattccgggcattcctactgtcaggagccaggtggggggatcagcctacctgtgccggtgacctggggcttccacccacaaaccactttctgggccagaagctgccatacgaagactctttttcccattccgacctcccgggggaatgcctgggcacgtagagggtctggggtcattggcttaattgaggtgaacgatttatatcagattacatccctgtgcctggttccatcctggcgacaggtgagctggagactggaatttatgtacttgagggcaggggtttccatgtccactcttgtcttccctacagtttgtcatttttgctcctgccttctccaacctccagtcgctcactgccttccccaacctccagtcgctcactgccttcccttgctgccgggaatttacccacactggttcatccaaccccatttcttcttgcttcaggccctttcacatgctattcctgctgcctggagtgctctctccacctccattaccttggccgaggtccctggggaagtgacccattacactgaacgttctagtctaagtggctttcatagttccctgtacttgagcgctgtcgtggttgcagtgtgcttatttgtgtggttatttaactctttcctccgccagactgcttcgtgaaggcagggtcctcgtgtccactactgtatccccattactcagtgcctggcacgtggcatccacttcttacggctttgtggagtgagtcacacatgccacacacacatacactctaaagaggaacaagagttcagtgggcctccttcactcaagtgccatggctgcttcagcccagccccatgtccctgctagagaaatctggggctggaggtaaaggagcagagagcacagtacccccttgattagcctggaagttgggcttctggcaccttgacctctaatcctttcataattgccaacaggtctctcggccagaacacgtggatgcccacccaccactgagcctcatggtaggaagcttgactgcctccttcccctcgcatgtcctgtgaaggcccacctcctgctctgcccactggccctgggcccagaccctaccttggcccttgctgggcttaggaaggcccccttgcccccaaccccaaggtagtgagcaaacccctgcccaaaccagggcctaattgaggctcttgaggggggagggttgtatgaccaccatggactgggttccttcctcctccccgagactgcccctccccagaatattagaggcagaggagtcctggtgagcgtctcgcccaaccccatggggcagctgcctgagacatgtcatgaggcagcgccagaagggggctggcacccagggattcctggggtgctggtgtgtgtcctttcaggaggtggtaacatttggcgatgtggctgtgcacttctctcgggaggagtggcagtgtctggaccctggccagagggccctctacagggaagtgatgctggagaaccacagcagtgtggctggactaggtgaggctgcaccttggggccccttcccctgcatcatcagtcagcacccacccagccaggcctccatcagaggctggggtatgcaggccaaacgctcagacccttgtgggctccacagggggcttggactcatgagtggtgtgccaggctggttcctagctttgcccatgtcatggggttcagcccccagggagtgggtgggattctgggagttagtaaagcctctttttttcctaagctgttaaattgtgagaaatagaatccaaacttgaaatagcttagacaagaaaagagaaattattgggtggagaaatccaaggaaaaggttgtgcaacgagcaagaggtggcagcgacgcccacacggctgctttgcagatgccgtcatccccttgcccctcctgtcctgccgttagtctcctctctgaactccaccaccgccacaggcagccactgcggtgctctttatgtccatgcctgtgtcctcacaagctgtatactgtcgttggattgcaacttggtgagggggggtgcgtcttaacttgggccttgctgggcctcttgcctgtgactaagccctctgctgcatcacacgcccgagagagtgcctgggctgggggatcaggagtggaactgacgcgggcatcgttggttggccaggagcttcttggggtgttggaccaggcctgtccccctctgtcccggctagtctggcaaagtccagctttctgttttgccagtcagataagtgtacagtgggaggctgttgtagtttgagtttgcatttctctgatttctgctgagcttgagcctattttcacaccctcattagcttgccaggttcttctgtgaaatatctgttcagggcatttgcccatattctaggtccgctgtgtcttattgctttgaaggtgttgtttcttcattctgtctaagatgccttactttgtaaaacatgtagttatgtacacatcattattttaagaaagttggaatgctactgattacacgcattttttaatcatttaattttactttatactttttaaagagccctcttagactcatttagatgtggtttaccctgtctcactgaaataggaaaagacacatgcagtgagggtcctttttttttttttttgagattttgagatggagtcttgccctgtcacccatgccggagtgcaatggcgcgatcttggctcaccgccacctccgcctcctgggttcaagcgattctcctgcctcagcctcccgagtagctgggattacaggtgtgagccaccgtgcccagccggagtaagggtacttctaatgtttcttcacagcttttagtgaccccactctctggtttggttatctgtgtccatgctttccacgtgatggcaacctgtgggcctggccatctagaggtgctgcagcttttcgtaagtggtgttggggttttcttcatccagtgagcttggtgcttgagctttcttgcttggcatgtagcagctccatctgctgtgcctgtcctcctctctcaggccctgtgtgtacacagttgctgatgtaccagtaactggaattgcagtcattcccccagcagcagtttgcttctccaggctcaaaggtacagctgctgttctttttccatggcttctgtctatttataacgtcctgctgctgtgccaagtcacagggtaaagcttttgaagacagtgtagagagcagctgaattcagcatgtattgtatgatggtgctggtgacttacctgcagcagtgactgagcagctggggcaagctcgtgtgtgcacaggcagtgatggtgtgtcacagctgccacctggcggatgacatcaattcctagatgcgtccaagagatgggaaagggttttataaaaacactatcttagggccgggcgcggtggctcatatctgtaatcccagcactttgggaggctgaggcgggtggatcatgaggtcaggagatcgagaccatcctggccaacagggtgaaacccccgtctctactaaaaatacaaaaattagctgggtgtggtggcgcatgcctgtaatcccagctactcgggaggctgaggcacgagaatcgcttgaaccctggaggcggagcttgcagcgagctgagatcgcaccactgcaatccggcctgggcaacagagcgagactccatctaaaaaaaaaaaaaaaaaagactatcttagaatttataaaatatggtaagtaccaggttagttttgtttattataaatcactttttcagccggacatggtgttgcatgcctgtagtcccagctactggggagagcgaggagggaggattgcctgagcctggaaggtcaaggttggagtcagctatgattgtgccactgcagtccagcctaggcaacagagtgagaccctgtctaaaaaaaaaatcttctctgcttcttttgtgtttgttaactttgttaggtcagattttaatgtaattactgtgtttttgccttatggattgtctctttgaagttttatttaaaagttctgtccgggcacagtggctcacacctgtaatcccagcgctttgggaggccaaggcgggcggattgcctcaactcaggagttcaagaccagcctgggcaacacagtgaaaccctgtctctactaaaatgcaaaaaaaaaaaaaaattagctgggcatggcagtgtacacctgtagtcccagctacttgggaggctgaggcaggagaattgcttgaacctgggaggcagaggttgcagtgagccgggattgtgccactgcactccagcctgggtgacagagcgagactctatctccaaaaaaaaaaaaagttcttccctggctgggtgtggtggctcacacctgtaatcccagcactttgggaggccgaggcgggcagatcacctgaggtcagagtttgagaccagcctgaccaacatggtgacaccccgcctctactaaaaatacagacattagccaggcgtggtggcgggtggttgtaatcttggcttctcaggaggctgaggcaggagaattccttgaacccaggaggcagaggttgcactgagccgagatcacaccagtgcactccagcctgggtgacagagtgagtctgtgtctcaaaaaagtttttttctcttctccggtgtctgtgatgtggtttttattttctcctgtggattttatagtttgtatttctcatctgtatcccagctccacatttgtattggggttacgtaaaaatccctgttttattttgtccacacatagctgttttccccaacatcatctattaaacagtctccttggccaggctcggtggctcacacctgtaatcccagcactttgaagtaggccgaggtgggcggatcacctgaggtcaggagttcgagaccagccaggccaacatggtgaaacctcatctctactaaaaatacaaaaattagctgggtgtggtggctcacgcctgtaatcccagctactcagaaggctgagacaggagaatcgcttgaacctgggaggttgaggttgcagtgagctgagatcgtgccactgcacttcagtctgggcaataagcgagactttgtctcaaaaaaaaaaaaaaaaaagactatctccttttcctgttgacatgtggagccaccattttcatctatgaaatgggatgtttctgaaccctgttctcttccctgaatctctcttgtgggccagcttcctgcttttggtttgttttggtttttttttgtttgtttgttcatttgtgtttttggcttttttttgaaataaagtctcaccctgtcacctgggctggagtacagtggtgcgatctcggctcactgcaacctctgcctcccaggttcaagcaattcttgtgcctcagcctcctgagtagctgggattacagctactcaggcatgtgccaccacacccggccaattttttgtatttttactagagatggggtttcgccatgttggccaggctggtctggaactcctgacctcaggttatccacccaccttggtctcccaaagtgctgggattacaggtgtgagccaccgtacctggccagtttggctttgttttttattttggggtggtttttgttttttgctttaattttgtagtgtttcttaatactacaagaatactaaaagaattaaactcacccgtttaattcttttttttctgggacggagtttcgctcttgttgcccaggctcgagtgcaatggcgcgatctcagttcactgcaacctccggctgttgggttcaagtgattcgccgcctcagcctcctgagtagctgggattacaggcatgtgccactacacccggctaatttttatattttaagtagagatgaggtttcaccatgttggccaggctggtctcgaactaacctcaggtgatccgtctgcctcgacctcccaaagtgctgggattacaggcttgagccaccatgcccggctgcatactaattttagaataagttgagttcctaaaagccactggaatttttattgggagtgctttgaaactgttttctgtcaatgtaaaagttttgatttttttgctttgtgaatgtatttttagctgattattgctgtagtacaaaaatgctgttggttctggaggatgatcttacatctggcaactttgtggaactccctgggtaaatcagtgttgctcggtgattctgctgttttccagcaggaggattcctgcaaatgagagtttggtattttccctcccagccctcactcctcccatctctgcctttgcagtggccagcacagtgttaaacaggaccgtgtgggcatgttgtgttcctgattttaaagggaatgcatctacataaccacagaatttggctaaggagttttttttgtttttaatcataaatactgaatttcaaattctttttctgcatcatttgagacacgtgatttattttctttattaatgcaggaaattacattgttatattttcttgtattcctggaataagccttacttaaatcacgatatttatatataaattttgatatgcctttggattcaactagccaatattgtatttttgtgtttctgttcataagtgaaatggatatatatatatatgtatatatatttccttttttttttttttttgagacggagtctcgctctgttgcgcaggctggagtgcagtggcgtgatctcggctcactgcaagctccgcctcccaggttcacgccattctcctgcctcagcctcccgagtagctggcactacaggtgcctgccaccatgcttggctaaatttttttgtatttttagtagagatggggtttcactatgttagccaggatggtcttgatctcctgacctcgtgatccacctgccttgggctcccaaagtgctgggattacaggcatgagccaccacgactggcctatgtttctttttgtgtattgtccttatgtaattttgacatgtttgataaatggcatttggcatacaagtagaacttggtggagctaatctgtaaaaccatcgggaccttgagcttttggggaaggaaagtcttggattagcatttatgcatttatattttctttttttttttttttaaagagttggggttttgctctgttgtccagcctagagtacagtggtgcgattatagctcactgcagccttgaactcctgggctcaagtgattcttccacttgagtttccctagtagctgggactataggtgtgcgccaccatgctcagctgttttttctttctttgtagagttggggtctgtcatgttgccgcaggctagtcttaaacttctggcctcaagcagtcctgccttggccttccaaaatgctgggattataggcaggagacaccttgcctggcatttcctttggttttaatctgttatatttgtaattgtgtctcttattctctgttttttggcagcatcttctcactaagtggaccttgattggttttgtcatgagtcatattcatgttttcaaataactggcttttggttttgccttttttggggggttgggttggaggatgtttttatttgtctttgttctctagctctctgaatcctgccccggatttattattttcttcctttttatttatgtgagtttgatgtgtgtggtgtttgtttgttttgcttttttaattttttgagacaaagtttcactctgtttcccagggtggagtgcagtggcttactgcagcctggactgcctgggttccagcgatcctcccaccgtgttggccaggctggtctcgaactcctgaccttcaggtgatccacccgccttggcctcccaaagtgctggaattacaggtgtgagccaccacgcctggccattctcaacttcttgaacttactatttacctcatttgtgttttaaaatgatcatttctagtaaatgtatctaaaagtataaaatttttctgggtatagtggcatatgcctataatctcagttacttaggaggctgaggcaggaggattgtttgagcccaggagtttgaggccagcctgggcaacatagcgagaccacatgtctgcaaagaatttaaaaattagctgggtgtggtgtcacgcacctgtagtcctagctactcagtaggttgaggcgggaggattggcctaggctatagtgagctgtgatggtgccactgcactccggcctgagtgctagagcaagaccgtatctctaaataaataacattttatctttacatactgcttgggctgcatcctataaattctgactcataataaatacagttgccacttagtcatttattatgtagtttccaagtagctaatggcatctaagcaccattttgtggtgagtttcacactgagttgcatttgcctgggcgcgtgttctgtggtatgttctttggcatgtctgtgactcagtttgtggcttgacccaaggctgtttctttgttccacatgtacttggagaggatatgcattttctgttgaatgtggagtcctgcctgcatctgggggtttcagcttattggctataggcctttggaatctctgcctgcctctttccttccagttgggggaaccctgaaggaagcttctaaacagaggccttggctggcccatggatcaactgctcatctctgtactgaccggcacaaagagggtatgggggcaggtggccccaagaaggcagggtgccaggtgggcccccacaggtctctgccacccagtctgcagcgagggaggcaggccctgaggcatcctttgtgcagggacttgaggctggaaggacactggctgaggactggaccttggagctttctgatgcaaaatgtgcttcgtttgtgtctattcatcgttgtttgttaccttattttgtaaccacccctgcctcttggagcatctctgctctctgaactgagggacaggcccggttctgctaagtgaagcttgggcttctccttctctttcccgagttccaggggtagaggcggactgtcctttgcagactgtttggtgacagggtcgcctggagattgtgggagtcaggtatcccttgctgtccagccacaggaggtggacagatctggacagaaagggctgctgtgtccccagattctccccaccctccacccactctccctgcaggagcttggcctgtgccttgtagcccccctgcccctttccatttggaaactggggaagacttagccctgtgctgcacacttcccgtcatgctgacactgttgtcttctctgccgcacacacagcaggattcctggttttcaagcctgagctgatctctcggctggagcagggagaagagccatgggtcctcgacctgcagggagcagaggggacagaggcaccaaggacctccaagacaggtgaggcttagatcccatcgcagagaagccctggggtgaggagaaactgcaggaggggcctcacaactgtgggtagctgtgggtgagtcgcgggggctacactgggatgcctgggaatgctactggggaagcagcatccagcacctagaagggagcatagacccgttgtggggctgccttgggagaggccaaactgcagaagagccaagacacaaaaacccatgcatttccacaaaaacggagcttgtttttgaatcatgtcacattttgttctatttttaattttactcatactttcgttaagcaaagatacaaacctatggatccaagtgaagggttaggtttggcattcagtaacctctcctcgggtaagcatattccctgaggcagctcccttcagaccctctcaggctccaggagtgcattactttcctgtggctgccataacaatgaaccacagactaggaagcttaaaacaacagaaatttattgtctcacagctgtggaggccggaaatctgaaaccggggggtcagcaagcagggccgtgcccccctgtgaaggctttagggaaggatcctgtcctgcctctccgggcagctggtggttttctggcagtccttgggttccttggcttgtggatgcgtccctcactctgatctccgactccttcacacggctgccttctccctgcgtgtctgtgttcatgtggccatctccttagaaggacaccagtcatggtgggttaggggccaccccagtgacctcatggtgactaattaatctgcaacgactgtgtttccaaacaaggtcacattctgaggtgcttcaagttaggacttcagcctatcttggggtcctcagccctaaccagggcacccactgcctccggcatcagctcctgctgggcaggcgcccggcctggtgctctgctcccctgcttagccggtgtgctgcccagcatgacaagggagatgggtctgcgtgcatctcagctgcagaaaggaagcccctcacctccctttcagttgctgctgggtcatcaccgtcactcctgcagcagggcaggaccaggtcctacagaggccaccggcttgtaggggcctcgggaagcaagttggacagtccaaagttgtgaaaagtaggggccgtggagccgggcatggtggctcacgccggccattctagcgatttgggaggccgaggtgggcggatcacgaggtcaggagatcgagaccatcctggccaacacggtgaaaccctgtgtctactaaaaatacaaaaaattaaccaggcgtggtggcaggcgcctgtagtcccagctactcgggaggccgaggcaggagaatggtgtgagccgagattgcgctactgcactccagcctgggcgacagagcgagatgacgtctcaaaaaaaaaaaaaaaaaaaaagcaggggctgtgatcttacttccattcatatgcgcctaggggctgtgaccttacttccattcatatgcgcctaggggctgtgaccttacttccattcatatgcgcctaggggctgtgaccttacttccattcatatgcgcctaggggctgtgaccttacttccattcatatgcgcctaggggctgtgaccttacttccattcatatgcgcctaggggctgtgaccttacttccattcatatgcgcctaggggctgtgaccttacttccattcatatgcccctaggcagcttcaaaggacaaggagggtttctgagcctcttcacgccctgtgggccttgcagccgcccaggaagtctgcatgtgatgtgtgggaagagtggtcaggaaccctggcctcactggctctgctggctactcccatgtgatcctttctgctcagtctccctgagaaggaggttcagctataaggtggcccagttaaaacccagccgcccattaaaatgtctccaacatggacaggagcgtttaaagagggtgccatggcagaaaagccagctacagttggcagaaatagttcagtgggtttatatgtagcaggtggtcctcactgtgataaagcaacaacaaaaaaatagaatcccacagtaggtgagagctgctgttgatggacccagcacttgctcgcagacctgagagtccggggcagggatgtagcctcttagataaaacatgcagcagcacaaaaccagaatacatgaagcaaggcagaaatgcccagatatgttacttgtccccagctggtacagtcagcatcagatactgaaggatattggcccagagcagtggaggagcggccaggtcccagctgtgcacccccacgcttttgaccaccaccgtgccccctgctgggtggttcctggcatcccccaacaaagccttgctgtcagcttggccctgctctctctgccgctgctctttatttttttattttttgagatggagtctttgttgcccaggctggagtgcagtggcatgatcttggctcactgcaacctctgcctgccaggttcaagtgattcttgtgcctcagcctcccaagtagctgggattacaggcgtgagccactgcacctggccaccctgctctcttatcttcacagcaggggaaggcttgggaggagtgtcaagcaagccctgttgaaagagcaggcatgctgaggtggtgtggttgtgcagggaaagcagcacatgaggaccaggcctggagatgcctcctgtcctcacaggccttgagcatccctgctacacaatgaggttgaaagggcttcctgctctgattctccaggactgataggaagacctttggagatccctggaagccggagactcaccaccaatggttaggagtgggcaggaaccgaagcttgaagccctgtaactgggctgtgcattcatgtggggtagactcgggctggttatagctgtggctgcgtggttgtggttgtgaacgtgattgtgtcgtggtggggaccgtggttgtcatgatcatagccgtgtgttgtggttgcatcctgtcatggtttgatcacagacatcaaggagatgtctgacctcagcagaggtgccctctagggttacagagtaggacagaagcctgtgcttacttggagagtccagaaggaacgcagatgtctggaaggcctcctgggggcctccagaaacttgcagccccagggaagaagtcagtgtggtcttagaggtggccacgcacagcccagggagaagcaggggaggtggccaggtgcaagttggcagcagcagccaggaggcagctgagggggctgggtcctgctcagagaagcccaccccagggagtagccatgaacggcctaggtgcccagtgctcttctgagctcacgtagtaagtcccttggcagctcttccagccttgtttcctcatcacaatccatgctctccattcagaactcagaccctgtactgtttcctcgccagctcggatgctggagcccctgaccccgcagcccaatccgtggtagcttcccacccttctggtcttgctttgtctcctttgcctctgcatggactgtgccccacaccagtgcctgtaggatggacctctctgctcacagaacccagccctgccccagcaatgaacattcattgctatcgaatgagtgaacaaggtaaaaagtatgaaaccacttttgagaactgtcaaaggctctgccttctcttgcacgtttccacctggggcctcacagtgctcagtgcaactatcctgggagccttgagccctggcccccgcatttgtagtcttatcatttctctgagcacagggcctaaggaacgtctttgttcctgtttatttcagattctacgattaggactgaaaatgagcaggcctgtgaggacatggacatcctaaaatcagaatcctatgggacagtggtcagaatctccccacaggactttcctcagaatcctggctttggagacgtttctgattctgaggtctggttagacagtcatctgggcagtcccgggctgaaagtgacaggctttaccttccaaaataactgtttgaatgaggagactgtggttcccaagaccttcaccaaggacgcaccccagggatgtaaggagctgggaagcagcggcctggattgtcagcctcttgaaagtcagagagagagtgcggaagggatgtcccagagatgcgaggagtgtggcaaaggcatcagagccacttcagatatcgctctgcattgggaaattaatacacagaaaattagcagatgtcaagaatgccaaaaaaagttatctgactgcttgcaggggaaacatacaaataactgccatggagagaagccgtacgaatgtgcagagtgtgggaaagtcttcaggctctgctcgcagcttaatcagcatcagagaatccacacgggagagaaaccctttaaatgcactgagtgtggaaaagccttccgcctgagctcaaaacttattcagcatcaaagaatccacactggggagaagccctacagatgtgaggaatgtggaaaagcttttggtcagagctcaagcctcatccaccatcagagaatccacacaggagagaggccctatggttgtcgtgagtgtgggaaagccttcagccagcagtcgcagctggttagacaccagagaactcacactggggagaggccctacccttgcaaggagtgtgggaaggccttcagccagagctccaccctagcccagcatcaaaggatgcatactggggagaaagctcaaattctaaaagcctcagacagtccaagccttgttgcacatcagagaattcacgctgtagagaaaccatttaagtgtgatgagtgtgggaaagcttttaggtggatctctcgcctgagtcagcatcagctgattcacactggagagaagccttataaatgcaacaagtgtacaaaagcctttggttgtagttcacggcttattcgccatcagagaactcacactggagaaaaaccatttaaatgtgatgagtgtggcaaaggctttgttcagggctcacaccttattcagcatcagcgaatccacactggagagaaaccctatgtgtgtaatgactgtggaaaagccttcagtcagagttccagccttatttaccatcagagaatccataaaggagagaagccctacgaatgcctccaatgcggaaaagccttcagtatgagcacacagcttacaatacatcaaagggttcacactggagagaggccctataaatgtaatgaatgtgggaaagccttcagtcaaaactcaacccttttccaacaccagataattcatgcaggggtgaagccctatgagtgcagtgagtgtggaaaagccttcagccggagctcatatcttattgaacaccagagaatacacactagggcccagtggttttacgaatatgggaatgccctggaagggtccacctttgtgagccgtaaaaaggttaatactataaagaaactgcatcagtgtgaagactgtgagaagatatttaggtggcgttcacacctaattatacaccagagaattcacaccggggagaagccttataaatgcaatgactgtggcaaagcttttaatcgtagctcaaggcttacccagcatcaaaaaattcacatgggatagaccacttacatataaatgtgtatatatgtgaataaacctacagccttaacttacttattttatatggaatcgtttatactgacaaacatgtagaatgttggtaaaggttcagaattgctctcaagaatatccaacttcaggccgagtgtggtggctcatgcctgtcatcccagcactttgggaggccaaggcgggcacatcacgaggtcaggaggttgagaccatcctgggtaacaggtgaaaccccatctctactaaaaatacaaaaatttagctgggcgtggtggcaggcacctgtggtcccagctgctcgggaggctgaggcaggagaatggcatcagcccaggaggcggagcttgcagtgagctgagatcgcgccactgcactccagcctgggtgacagagtgagactccctctcaaaaaaaaaaaaaaaaaaaaaatccaacttcatacaaaatgtatgtttatttcctgaaatgtttgaccttaacctgttcaataaagcctgtgtccctcaaaatcagggtgcagtctgcagttttgagttgacaggtccctgtgaatgaggaagcagcacaaggagggctctacgagcgctgctagactgagtaggttaaaataatttacctaaactcttttcccttaagtatcagtggctcacactggcttcaacaatacggaaatgcattagctcatgttggaggaggtccaggagtgcctagaattccaacttcaaattaggtccttgtcttagaacttaacccagccacccaggaccagagggcccagccctatccccttcctcagagaggcaggctgggctagcaggtacacgccatcattactggtgtggttggcatttatggagcacataccagtgccaggcacagaagcaaggtgtcacagcaaggttctgaggtcacacttgtgtcccaggggcttgctgtgtgacctaggacatcattgccctccctgaaactcagagccttatttgtgtatctgaaaacatgcactgtgagagggtactgagaggaaacaatgtagagaaacatgccttactgggcctgtcagagaacgagcactcaagcaaatgcaagtaccaacccccccatccatgccagcatctccagcacacccgtgtgcgcacaggccctgaggctgatgactgtcttgtactggcctagttgccccacttttttttggtaggggggaacgcggtgaggaggaaataaagacagtggagaaaaagacgaaaatgggccgggcgtggtggctcacgcctgtaatcccagcactttgggaggtcgaggtgggtggatcatgaggtcaggagatgaagaccatcctggctaacacagtgaaaccccgtgtctactaaaaatacaaaaaattagccgggcgtggtggcgggcacctgtagtctcagctacttgggaggctaggcaggaaaatggtgtgaacctgggaggcagagcttgcagtgagccaagatcacgccactgcactccagcctgggtgacaagagtgtgactctgtatcaaaaaaaaaaaaaaaaaaaaaaaaaacgaaaatgggatggaaagaaggtggttgggaaacaaatatggggagaagaacctgagaaggggtgatgagagggagtggggaaagaagatactgggaagaaaagatggttgagtgaagaacttggggtgagagtgggttaggaagaaggtggagagggagtggggaaagaggactctggggagaacttagggagaggaagtggggaaaaacgatggtagggaaaagaacttgagctgcagtgggggtagaccagcagaccacagggtgaaaggacagatgggaggagaaacaggggcagggtcagggaggagaaccccaattgccttactttacaggggaggccacacaggtctggatgtaatttatggtgcgggacagctttccttaaaactcagcctgaaagactgccaagaactgagggtctgagatttcattctttgtagaagctcacgagaaatcctgtggccattccacctaggaggggacggcaggcagaatactcactgtggttgtcagggccctatcagttccttttgcccaccattcccatgacgcagaggcccagcaggtgcaggcacagctgagaaactcggaggtgaggagtgagcctgctctgttgggagctggggggccattacctcacccctcagttttttttttgctgctgacacaaccttgagaagtggcccaggtggagcacggtggggttcttggcacatgcaggaacatggagggaggcgtggctgatggcaggtggcttgctcaaggcctgatgcttttttgctgaaattgaattttcacgtgaatctgctgctcaaccctaatctaacaggctgggaccttgtccatttgattttctcacacagcatctaattaaggctgatattcacaggcatgaggccaactgtaagacctcaaccctgtctccacagtccttgtcattcagggggaacctggaactcctgactggtgacctcccacctgcctcttcaggggctcctcccggtgtacaagggtgatggtgctctccacagccatggagtcagtgcatccactgtaactgcctcttctccagccatgccctactcacaccggaacttctgtgcacgtggagtatgtgtgcagtgtccctgccttgggtcacgtggctgctgagaagggtcttggcaggtaatgtgcttagccaggtggtcaccttcaggtctagcacaggggttgctgttgctttttctctacttcaggctttctgggccgcccaaccatgggacaagagccaaggcacccacatgcaccgcctgcaactcctgttcctggccttccaaaacactgctcacaaagactgaccctgcctcctcctgggctctcgtcatctcctcttggccacttcctggttcatgatcaggacagaaggaggggaacgtcagccatatggatggtctgaaaattccagattctgtgctaaccataatgctgtgttcttttcactaacagcaaccagccaaaaaggggctggggtgcaagcttcattctgcttcagcacctggattctctctggattgacatggtcctaagtcaggggctggcaaaccattcgtagctttttacatttctgaatggttggggagaaaataagagacttgtgacatttgaaaactatgttaaaatcgaatttgactgtgcacagtgtccctgggcttggtgatgcccaagcgtcttcatggagcctctggcggctttcttgctgcagcagtgtttaccacaccagccaagtcaccttgaacttggaaaatgacttcatgccctccagccactgaaggattatttttcctctcagcccttagtggtttctttacctaaatgtcacggtacaactgagaataaggcagctgggtcagttcaatagaagtaaacctaaagtccaacaatccaggttagatattagccacggagggatgggaggaggagtcttctttttttttgagacggaatctcgctctgtccctcaggctgaagtgcagtggtgcggtctcggctcactgcaagctccgccacctgggttcacgccattctcctgcctcagcctcccgagtagctgggactacaggtgcctgctaccacgcccggctaatttttttgtatttttaatagagacggggtttcactgtgttagccagctggtctcgatcttctgacctcgtgatccgcccgcctcggcctccctaagtgctgggatgacaggcgtgagccaccatgccgagctgaggaggagtcctcttctagctgcacgatgtggaaatgacacatcatgtccatggggcagcttgctgagagccaagggtgtgagcacatgacttaaattcaagctactgcacagctttgagatctgagtatcacatggaagcatccaggtggcccctggcacacaggctggtggttcttttgtggagagggagaggaagaggggctgctcatggggtagtgcaggtgctagaatatcctgttaacctgttcacactgcactgcaattcgggcttcggtaagctcatctaaagagtttccaggccaggcacggtggctcacgcctgtaattccagcactttgagaggccaaggaaggatcacgtgaccccaggagttcggagaccacagtgagctgtgatcgcaccactgcactctagcctgggtgacagagtgaggccctgtctccacaatatataaataaaaacattttgggtttctgttttggagacaataaattaaatctataacctaggcctggaattgctttttatctcaactatcagaataatctttcatttatgacactgaattgaaactatctggacctttctggaagcttcacaaagtgaagcagagcaagggccgggtccaggccattttataaatcctcaagtccccagtgcatgcagcttgactcagagccccagaaatgtttgctgaatgagtgagtgatgcaggtggggaggcatccaggctttgagctcaggacagtgccacaggagagggaaatcaccagcaagtttccacagagaactaaggccaagaaaaccaagggagtaatttcccagatgcagacatccgttctctgtgcaaggccttgtgcaagccacggggacaaagatggacagggctggcctctgccctggagtccaggtctaatggagactggccactgacaaggatggacaggtgctctgtactggaggggtccagtgggctcatggggttggcgccaaccatgcctggactaagaatggtttttcaatggaaaaaaatactttgtgacacatgaaattaaaatttcatggctgggtgtggtggctcattgctgtaaaaccagcactttgggaggccgaggtgggcagatcaccagagcccaggaattcaagaccagcctgggcaacgtggcaaaaccccatctctacaaaaaatctgaaaattagccgggtgtggtgtggtgtgcctgtgagcccaggaggttgaggctacagtgagccatgatcgtgccattgcattccagactggatgatggggagaccttgtctcaaaaaaaaaggaaaatttcaatatccattaaaaaaatatcattggaggccaggctcggtggctcatgcctgtaatcccagctgcctgggaggctgagacatgagaattgcttgaacctgggaggcagaggttgcaatgagtcgagatcgtgccactgcacaccagcctgggcaacaggagtgaaactcccgtctcaaaaaaaaaaaaagatggtattggaacacagccatatacatttgtttacgtattgtgtgactgctttcaagccaccatggcagggtggacagaaacttcatggcccacaaaatctaaaatgtttactctctggccctttgtgggaagagtttgctcactgctgagtcagaggaagtggcctctaagtctgctccacgctgtagggatctcaagtccaactggatcatgtctgccctgattaaaaccccactgctcccccttgccccagtggaatgaccaaaatcctgtgtgtggccttgaggccagccgctgtccctgcacttgatcccccatccctcaatcccctatactcgggcagtgccagccccagtcccaggaatggcccactcccctgcctgtgtctcataagctgtcttttcatggctgtgtcttgatttgcctgggtccccgcttgagacaagcccaagggttcacagatgaattgaggcaaacacagattcccaatgagagacggcgagaggtcagcctgaggaccgagggcaggtccatgctctgggctccacacaggctttgctaagcagctgggagaagcagaaggatggggctgtccctaaagctgctgttcctgcagggccagggccagtgagtgagaaaggcaacatggtcccagctgccccagccccatccacatctggggacagagaatgcaggaagtggctggtcatattcctgatccgatgacagtggggggacagtgccttcggggagagagaagggctttacctggaactcagtgagggtgggacaaagctgagtgatcgaccagatggcaggacccacaagcatgcaccttagagggcacctgggctcctcccagagtctactgaccccacccccaggtactcctctgtaccctgacatgtcagaactgcccatggagggatgaggaagaaatccaggctagtggaggagacaacccaaaaactgcagacaagacaaacagccaagcaaccccaggcactcaaagacaaggggaggtttctcagcagagaacagactagacatggtccagaagtgctccacggaggcaggaacagtcagctggaagccagctgaccgaaaatggctctgcagagaccgagcaccaaggcccctcctggaacacagttatgctggaagctgcaaagctggctacaacccctgcacacacctgccctagaggcacccgggagaggtccctgccaccaactccaccctggtgacagcctctctgctgggctctagcctcctcccttgcacccctccacacagcagccaatcaccagatcacgtctctcctctgctgaaaaccctcagaagggctcctctgtcactcagaattgagccaaagtccttaaaaggctctcaggccttgacctctgtaccctccccaacgtcgcctccccacaatgatctccacctgcttggctgcagccaggcgggccttaagcacgtcaggcctccccacactggccgcctgagccccgtcctccccaccttgtgctgctcccctcagagcgctgtgcccccggctccttcaagtcctcgctcagatgtcacaccctcaaggaaggtcgccccatcagcacgcagaccccaccctacttgctgcatcacacgccatcctctgatgagctattccagttaatttttatgatttattttacaatgtttcccctcccctcagccgcactagaatgtcagctccatggggtcagggatttaaggcagaagagtgaaaatgcccaacctaaaacacaagatctacaaaagcacctggctacatggggccaggctgagcaactgtatgttgtctacaaagggcctcaacctggcctcacatggccacgtccagcaccaaagacaaatgtacagggaaggggagggtgtgaggtccaacactcacctatagaaacatgtttttagctgctttacttccaaaaagaaaaaaaggcatagctctctttttcaattaaacagaaaactacataattacgttcaaacactcactgaagagcctgcctcatgggaagggcagggctgtcgtgggaagagtcagctgcactttggcaccatctcaggtgcctgtccaagccggatctgaatgggactggtcaagtgaggggtcagtcctgcagtctgcgctcacacctcttctccagatctgccatctcctttaggaccagggccacgctgtaccgcagctcctggaacttggctgtggggacctcaaagcggtatgctgacccatctgaaagcttcagctgcatcaggacgctcggctgcagggagcgagccagggcactggtggagattgctacatccacccgccaccgaaagtcagcaacatgcggcagccaggccccctgctgctgggccacagaatcaaggaggggccgctggctcccaaataccacgctggccaagtccccgaccaggtcttgggggatgcagagctcctggagctggtccctgaaggtgtcaggcttcaggctggtggggggcagacggagggcctgctggagcagtgtgtgcatgcctgccagcagggcacccagctgctcctccggcaggttggcgctgaccccaagacgctgcacagcctctcggcagtcctccccctgcaggctgctgaccacaaacttcagcaactttctgaacgtgctcctgtctaggtcccctagtagccgggccattgctgccacctctggaggaagctgggcccccaagaaactcactcggccactgtgactatcaccaggatgatgcaggtatggagttgcagcccccacagcagacattgctgctgcttcctctttgatcagccagcccaggaggtcggtcccagatgcagatgcctagagtggggtggaggagagaagaccagtgactctcacatcctttgggccagcgagtgagggttgatatggtccccatcatcagcatgctgacagtgtgaactaccaatgacagtcagtgctgcggagatggccctggaagcaggtggcagaggggtccatgtcagtcccaggaggagcggaggcctcccagaggaagtgacatctaaggcatgaaggacaagcaggaattggcagagaagtagggggcagggaggaggaccaggaaacagcacaagttctccaagtaaattaatagatgaaagaatgaactaggggaacggtccggggaacacagggacactgcagctggcgccacagaccacactgagaccatttaactattcaatcttgaatccttcacaacagtgggcaagaagaattaccattctcacctgacagagagggagataaggctctaggccaggtgcagtggctcaagcctgaaatctcagcactttgtgaaggtgaggccagcggatcgcttgagcccaggagttggagaccaacctgggcatcatagcaagaccccgtttctacaaaaaatttaaaaaactagccaggcgtggtggtgcacgtctgtagtcccagctactcagaaggctgagaggacagaggatcccttgagcccaggaagtcgtggctgcagtgagacgaaatcgagccgctgcactccagcctggacaacagagatgctgtgaggaaggaaggaaggaacgaacgaatggagggaggggggagggaggggaggcagggaagaagaaaagaaaagtaaaaagaaatcaaagctctaaacacagctgccaaagtcaaggactgaagcctagacctgtctattcagaagtcccagctgtttccaccacagccccaacccccgggctggaagagctgagcaacggctggcaacagaggcaagtgcggcaactaaagagggttccgacgcacctgaaggagcagtgcagcagcacaagcacctgctatgccagaggaaacgcacgtgcccacctcagcacaccaggtactggagcagagctcagcggggcacagctcctgtcctcgaggcacttgtcaggccactctgcacagcgctgggggagcccaggagctccccacgggcttcacggcgccccattctccctgggagtcaacgaccacccactgccaactccttcaccgtcccgccagcaccaggagctccttcccactccaaagagccatccgggaaggcctccgagctgcccgcttccggtcgcgcggcttggaaggccgggttcgcaccctgactccgtacccgcggctctgatgggggcgcggcgtcgcccgttccggggcgcggggaccttggtgcacagagtcaaattggcactcggccgtcgccgcccccacggttcggggccaacctaccggcgggcgctcctccgcggaaaagccccgcagtatcca

SEQ ID NO: 17366 - DNA, 32798 bp, Human; identical to SEQ ID NO: 11758

SEQ ID NO: 17367 - DNA, 102520 bp, Human
ctcccaagtagctggggttacaggcacccaccaccatgcctggctaatttttgcattttttagtagggacgggatttcaccatgttagccaggctggtctcaaactcctgaccttaggtgatccacccgcttcggcctcccaaaatgcttggattacaagcatgaccgcacctggcctggcatattcttttaaaatttgttttgcaagaagtgtcctactacagttttaatcatgttcaaatcagaacttgattgctagcaaaatatgttattaggattatttcattttccttttaacatttaagcactattccacacagagacatgatcgtacaactaatttgatcatattaacaagaggttggtttttaaaccaagcagtataaatataaatacagccttgggtagatcatagtcaaactatccaaatgcaacctcagcttcaaagattgtaaagtcttttctttccccttttctcctttcctttttttttcctccaaatatttatttactacctaccatgtgccaggcactgtgatgggctatgaggatgcagtgggggataggacagatgccatccctgccctgaggagacttgcagtttattggaaaagatggacatcgtaaaatatacaatcatacaaataaaaattacataaataattcagtacttcaacttgtgggaggtacagcagtttataataataacatccctcccaccttcttgagagagtcattggttgccccacttctcttcatgaatgagaggacatgattaaacctatcatttcaggtaggagtttactgtgggatggatatcaatcttctattaatatgtttgtgctcatgctctccattttgcaatggacacttccaatatgcaaggcaggctgtattaggtgttgggagagggctacaaagatgagagagacagtcctttcctggaggagtagagagcatgtatgcaatatgtgtatacacacagtctatttattaatatatatctacctatgtatgtgatgtttacaacaaggaatttcaggaattcaggggtggtggtgaaataacttctagttcgggtgatcagctgatgtttcctggaggtgaccgtttaactgatccataagaaataaattggactttgataagaaaatatggtggataaaggcaaatgaaatagaataaacaaagacaagaaggcaggaaaatttgaggcatatcgaaggactgacacaagaaagaaaaacagaaatgcatcatcaaaccaaaaaatggttatatggaaataaaaggaaatcaggtttgtaggagaaattaagcccagatcactgagatttttaagtacttgtttaaagatacattggactttctttgagggatcacatatggctactcccaatatttaaccagaaaaggccttgtagaaaaaattaatcagcactgtgaaggagggtgactacagggaggaaggcccgaactcagagcccagctaggtttgttgctataatctaggtgggagatggggaagacctgaatagtcagtgctcatctggtaaattagtgttttggctttgaagcaaatttacaacaatcccctgaactttcccagagataatctgtagaatggagaagccattaggctacccctctaaagtcacaaagtgattgcttgctgaccagcttaaaagccaagttttcctgatctgttgggaaagacacgatagcctctgaacactcataatacaaataccatttaaaatggaaaaatcataaggatggtagacagattatgcttcatatcactactaatatctctgaactgattttagctgatttatgaataaatgattactccagttttgagagttaaatatttaaaagttaactttcttttagagttcatgtataatacacggctagttctctgtgctgcagacttccgctcttcatttccttctttttaatacattataattattattcctactctatcctttttcagttccccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatcgtaagtattaacgttttaaagctgttaggcccaggagtcaaagcctcccagcatttatcatcactctgaactgcgtgaatggagaaggtgtctgtgtgatactgaaaagctaatcaaaattaatttggcttttaccttcagcacctggtgtttataaagattcacactgtagaagtggccattgaaatggtcagactcacaattccctccctgtcattctccttcttccccctcaggtgccttttgtctgccctgctggggatggcctgagaaggattgagttgtgcaagctgcctgatcttcccaacaggcggctctttagagaagcagtcctgcaagaaaactatatgagccactttaaaatgatcatggagacctccccactcatcccttcaccactttactctttcccgtcatatgctgagggtggtctgcaaagatgaggggaggctccttctgccaactccatgcccctcggaatccctaaaccaccccagaattcatttctcttgattcagacaaggcgcatctcactttccaattttgaatcctaaatataagtctagaactaggaaaagtatcttatctagagcctaacaaatagtcttatttggtttaaacagtgtggtcaaatgccaaaatgcaactgctaaaaatacaagtaatatgcaaagcactaaaatggagcaaacaacagctactgtattagccctccattttcctagtagtaaatatatactgtgctctccctgctctgggtggcctgtttgtgaaaaataaagataatgctaggttccacccagtcacttttcctgcaaatggaaagcaaaatttcaaatctggacaattactgtacttcagaatcgatttctcctttatccctcatctgcatgacctctttgaagccattagcttcctgaatagaatatctgtttggcaagctttccaaggtgcaaggaagatagcactttcctggggctattcaattgttgggatgtcatttttatttatttattattattattattatttattattaccatagaggttgcaactgccagtgggaagacattaagaagagatgtggtttgtcccacactttgttgactttttgctgtgcttctataaagttcaataaaatgcagtgcttttcttatttaaaaaaaattcatccagtgaccttaatttcaattttcaaaaaaatatacaattgcttaagcccattggagtgggaatgcctaagtaagcatttgccctgacagatacacaggagggaaagaaaacatttgagagaaatgcttttgttctctcttatattaaatatattcccccttaatctgactgttcaatctgtcaagcagagggaaacagtcacctatggctaactcaattatcactgctaacggagaagaggcataaccatgatgaaaagaaagtcacagaaaaacccaggtgctcctatattaacctttgcaagtagtaacgacagacagcactgtggaatgatttgaattgcatgctaatgtaatttcttccctgcccctatttcttacatcgtttctctactacatgaacaagtccttggtgtgggcaccagcaacccctgagtgattgagaaattatgaagcagaaatctgctaacagtctaaaaagttcaattaatgactttggagattaaccatagaaatataaaaatctaaaattagtgttggacttggcttgcatggagcattatcactgtagcaatgtcccattgttaggtattattaccatatgcacagtgatgtctgggataatatgaccagacactacacagtatgtgacaactcaaattaattgtagatttcagctgtttttcaaattgaacataattacttgtccaacacaacatatatggaatggaattcgctattcctattcctggaagaactcgtttgcctacagcattgcttttgttcttccatatgtttatgtgggaaagctgctgcaagattaaaggaaaccgttaatgcaaatttcttcgtcttgcaacttcacaaattcaaccttcactatacaggttttcttagatcaaatcaaatagacaagatgccccctttatcttcagagttctaacgttcttattattaacatctgattttctttaatcctctttgcccacttacctgctgatattgatggggaaaaagcaaaacttcttgaagactgtaagtgtccttctataaattactaggcagtgtgaaaatgtgaccatgtctttgctttttgaattaatattgtgatttaaatgcacaatttcatgttttgtgacctttgtctttctaagcatgtgtgtttactgtagctaaacattgtatttcaataccaagaagcagttgtaaagtattatctgcatgaattctgaaaacttggctattactctttcttttaccagtgtgctgctctactaacttccaagctttattcacatctgatgtaactcaatgagaaaattctcaaaatttagagagaatgctgatctgttgtaaaggctaattaatgctttctggaacaaagataggtctttttgtgtcttttagaaggtgggtgcaggcaaaagctttacacaagatggcagctgtatgtccttttatgcttcttcagccttcgtgactatgtagactagtatttctaggtgccatcagtagactaacccagcgaatttgaatcttgtcttgaagtggacaaaagataagcagctcccactcacatggtatttgaatggcttgctctgagcaaaactttccactgcctttgacaggtggcatttatcacctagtttaaaaatagtcagttttcaggcatttgataatttcctttgatgttagattaaccaggaaaattatgtaaaatcactgtttttcttactactgaaaagcatttgttaattagcaggtgacccaagcactgtttaaggaggtatatccagacagtaaactcctggcagttaggagtgacatctgagccagctctgctgcagacctgtgaatagaagctctgcctctgaagccaccagatttgcacctgtgtcactcccagaaaagcacaaggaattgaactgagtcactcctaagaatcccctcccccactccctatggccactattccttggatgtggaattccaggcttccttccattatcccaaattctatatactcccagagcctgaaggatcattcagaggtgaatctggtccaaataaaaaatgattatgataataattttaaaatagctgatgttattgaaccattataacattggtatacactgagaattttatagtaattattttcttaatcctgctagctatcctaggtggtaatactacttttaaactttattttccctctcaggaaactaggacttatagaagttaagaaattggcttgaaatctcacagctagtaagaaacagactagtgcttaacaatcaggccaccttggaaactgacaaggctagaaaaatgaggattccatatggatgacggaggggggaagggcagctggaaagacaaggagggggatgggatattccaaagggaagggaaactgacactgcccagtaccctgcatataatagtacacaataaatgatgacagtaatgaggctagcttttgatttgtactttagctgttatttgaatatttagtaaaagatgtcttgtggatggcaataagactagaagacaagagaagaggacgcaaccgggtttatagatttataagactgaagatgtggaggtgatacatttagctctagcaacaattaaccacaagagagacaagaacagtgggcagttactgagctttgagaaatgtttggttggcaagtggaagaagtttcacaaaggaagcagaggtatgggcagagaggaaagggaagatccagaagatgaaaaacttaaatgagccagaatgtcaaatgcagcaggaaaggaaagaacagtgagaatccaagagagggccttgggggaatttcccagatgcagaggaaaggtgctgtggtatggccactgcattgcacagctccaggggtgccaagcacattgtcgtctgcctcagaacttttcagcctcagcactatggatgtttgagaccagataagtctttgttgtgtggaattgtcctgtacgttgttagatgtttagcaacatccctggcctctatctacgagataccactatcactaccaccccagtcgagaccattgaaatggcctccagatatggccaaatgtccctggaagggtggaaacaaattgcctctggtagagaaccactggtctgtgtaaacagctctccatggagttgtgcaagcagtggcttcttaccaggagccagttgagagagtttaggtctctgctttgtgccttcctagtcaagccattttgctgcactgagtaagaaaaaacaggttgtaaaaaattattctttagtcacttcctgtcataacactaattctgatctcacaagaagaaggacatggtgattttagaacaatttgaagagcattagtggtccagatacagctttcttcagattagattgttctgggtcagaacagtttccccataggatttgataataaaagatcagataacactttgaagagtaaatgggaacactgtctcctaggacagagaacttcctcaattccatttatcttctaaataagactcttttatctttgttcctcattcacttacctcctggctctgataagagatgtcacatctccagtttaacagtctgtttaatattaacttctcaaatgtatttgtccccaacatatattgatttatatgagcacacactaatgacctaagtctgttactctttcttaagaaagatgcaaatttatcataacttaaattcctttgaaaaacatcatttgaaccaaaggaatcaaaagaatttctcattgttacatcagaaaagaaactgtcttaatattaggtttgtattgataattatttccccaaacttttagtgtgagaaaatggactttgcaagtacacatagttaccgaaagaaagttaaaccttgacttcacagttttagcagacctttagcagaaaaatctactgaagtatatgctgctacactagaaattactaaaaatacttgaagcatatttagtctaaggtaagtgattttgatacaggaaaaaatggctactattatgattttaaatgatttgtttttttacatttttttttttctacaattaagtggtacagcctccaaccatcacccaacagtctccaaaagattacattattgaccctcgggagaatattgtaatccagtgtgaagccaaagggaaaccgcccccaaggtgagtgtgcattctgctttgttatagtactgagaataaatcaggaaatctctctgaatagagaaatatgtttgggaatttccatcaaacaaggcagactatgtagagcacttccttttttagttggatatttctcactgtgactcactagattgccctttggttcatctatcccagcccatttcagcccttcaaagatactgaaggtaacttcttgggtcctgcatatccctaaagtctcacctgtaggtgtattgttttgtctctctgcttaattagagcccattttttcttcttgaaaacccagattattgcatttctgtgcccatgcttttctgcaaaatgcttataaattgtgaggagttatggaaagagccttttgattctgattttgatactaatggccataaggcacaggcaaatcccttttctctgggctttaatttcctcatctataaagagattgaatttgatgacttccaagatctctgctgtctctgtaacagtttataaaatagtctaaaatggttttccaaacttggcagagttcagtcatgagaattcatgccatttggatcttgcatagcattttagatcactgcaaagcattttagagttgggagagatattagagataacccagtccaaccaatacattttatagatgggaaactgatgcctggtaatgctaagtaacttattcaaggccccacagcggatgatctgtaacatgtccagtcatatatggaagttttggagagttgggttattgttattaaaatgtaatgtggatttttaagcaataaagtagtgaaagtttccagttattttatttccaggtttgtctattacagaccttattaaattatcacaaactggcccctgagaaaaaattaactgggacagaatatgtactatgtcaaaacttccagcaaaggtttgcctcaaaataatatattcggctatgttaatggaaagcctctctcgcagaaggcctgatgtggtatcccttgatgaggtttcctttcagtttcacaattaatgccttctgtaacttgccataaaacaggatttatcctcttcagcattattgatatatggagtgtgatagataatattttgtttgggggatggaagtgtcctgtgcattgtaggatatttggcagcatccgtggcccctgcccacaatatgccagtagcatccacaccaccagttcctgccctggttgtgacaacaactgctataaagataagcagtgggaagggaaatccaagtgatcctagaaaacactgtgacgtttagagattcgtacctttgtatgagcatggccatcattgatttgtgactagttgtaaagtatttaattacatgagcactgtgacttttatataagtcaatcttttataaaaataaaatggagaaagagggatctcagttgacaattgggcatacctcccaagggattctcaaaatcatctctagaattaaaaattcccaaaatgttttatgtagagttactatttttaataagcaacatttaagacactctggaactgatgtctcttaacctcctcccaacctacacttcacaatttggtaacttgaaatttgtctgatcaattttcatcatatataaatagtacttgcagaggtcttgtcacattttagccccaagcaaatttttatagacaggttatcaactctgtgaacaatggagtttacagtaaaaatgctaataaagctctaagagagtgtacctgggagacctgctccctctattttcttagaaaaatgacaggcaatttgtgtgcatgatttctttattgagtcaaatttgggctagttctaaagaagacaggtaccttaaaatgtatagcctgcccttttttcccaggtcatgattcaatgaaacattttagatatgagggcttattgctctcttactgaatattaaaatctggtaattatttctagaaacccataaaactgctaggaatttgttaaggtaatcccatttttctggaccattaatacacttaacacttcgtgtgttgggcagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagtaagtggaaacttgtcaaccaacatgaccctttttaaagtattgctccaagactcagcttctgtgacatcatccaaatactattcaacaaagcagtggcattgcttccaatattctgactttgttttgcatgaaagttattgctcctttccaccttaccctaggaagctccttagtccaatgctttaccaatccaatatatcttttacagaagtcctgtgtaagacattggggttaaaaaaaaaaagtgtttcttccctgagttcatctaattatttatttctcatgtatctcctgtgaaagtgaaattcctacagccaaatggaaataaattcagtatgatatgggtgatcaaggtctaaatgctatttctttaaacatttttgtttcaaaattttactggaagtggagtgtcctcactaccttgatattattaaggctctttttgcaatggttagtaccaaaatcctctcaaaaaccttaagagcatgtatttaaataacagtcacatttttcagttctggtcatttaaaaaaaattacatgtataatacatgttcgttgtagaaaaactaattaaacaaaaaagaaatttaaaaactgttcatgaatccttccattcaaggaaataactactgctgaaatattctttctattttttcctaggcagatatgtatgtatgtgtttaaaaccagctcattttctgaaatactatcttacaaccttttctgacttattgacatatcgtgtatattcccatagcgatcttataaataagtgtacttatataatactctatggtattcagaggtgtagatgtgtaattctttatttagcaaatctttttacatttaaatgttttccattcttttgtgaagaacatgcttgtgtcaaaactgtttgtcttcctgatgatgtatgtagtataaattctcagctgtggaatcactgactgagaatttatactatcagtggcaatgcatgagaattgtcattttttaaatttttacttttttcttttaacattgtatttaaaaatattttctcattaatttagtgtacataaattacaaattatttctccaaaacttcagtttgcctttatttgtagggctttctttttgtacttttcaatgcagaaataactgagaagttatttttttatttaataggatcaccattgtggaccaaagaaaaacttgaaccaatcacacttcaaagtggtcagtctttagtacttccctgcagacccccaattggattaccaccacctataatattttggatggataattgtaagttttgataatatgaactttctttctttaaaagtcttaggattgtttacagtcataatacattattacctcttatgattcataaaatgttttagagatgctcaggaaaacagctgctcttcaaaataaataacatgtcatctcattcactcactcaattttattggacatttactatgtatcttgcttatattctttgcagtgggaggagataggagtggggaaggaggcagatgataaatgcaataagtacatttagaaaatctgtgtttgttggcaataagttctatgaaaaaaaaaaaagcagagttttgagcagagacctaaggaaatgagagagcaagccatgcccctaaatatctgagtagaaagggaaaactagtgctagcccctaaggaaggagcatctctgctgtgtgtaaaaataaaagcaaggaggacaaggtggccagactaatgaactaatgaaggagccgagcgggagggtgatggagaaggtgagaaaggtcacaggactcaatggaaaggactttggctttagcttggaatgaagtagggaaatgttgaaggagtgactttatctgaaataaaataagtagtaacagtatcacttcagttgatatgtagagaatatagcgggcaaaagagagagtagagagactgttggggccactgctgtaatctagatgaaatttgttggtgacttggacttgagtggtagcagtagaatgggtaagaaatggtaagattctggatatattttgagggtcaagcctccaggatttactggggtgggggtgggagcatgagagagaggaatcaaggataactacctttggagactgaacaactccaaaatgataaaatggaattgccattcccagaaacccatggcggggaggaagtcaagctgttggggatatgttatgtttctgttagtttttttaatccccagcaatagctaatagttattgggcctttaccaagtgtcaggccttttactaagggcttaacatgggttatttcattaatttttacaacaaccctatgaggcatgtccaattattttttccactttccagatgaggaaactgaggcagatataatgaagctattcattaggcaatttcaaacttgtctacccctgtttctgtcctcaagggcatgtttgttgctctgcctcttccaccttccaaaatttcctgtgccaataggtcagcgtgttaccttagagggagtacatggttctgcttggagactaagaaaccagagtttgggatgtgagaggcctgtaagatatttcatggcaagacaccagcaagagtcagagatacctgagtcagaaggaggattccaggctatgatcagcaatgtttgaaaccttagtgcgtaagtcctgcctagaggcctgggctagatgagaggatctgggaagcaggaaagcagagtctgggagactgagaccaggagccctccagaggtgaagaactcatggagaaatcagcaaagcagatgagaagaagcagtcactgaaggaaaaaaggaacaaagagagtggtgtccccagggacaaggtgaagaatgtgtgtcaaaaagatggattaaccaggcagggtggctgacactgtaatcccagctaatcgagaggctgggatgggaggattgcttcagctcaggagttcaaggctgcagtgagctacaatcacatcactgtagttcagcctcagcagcagagtgagacaccatccctaaaataatgataataattttagaaaatatttttgaaagacacaattattagctatttcaaatgctgctgagagatcagataatatgagaactaaaaaatgactactgaatttgacatcttggaggttcttggtaaccctgttaatagtcttttaggtggaatggtgggaatgaattaaaagtatctgtaggaaatacgttctattttcagtgacctgattgtctgtgcactcacaagacatatacattactaaagagaaaatttgcctctaacatttaatctgcattttaattttttaatttaatttttttttattttactttaagttctgggatgcattttggctctccttatatgaaagcactcagagaaagtaaagtaacacaaagaaataaaaaacaaatatatagctaagtaaatctagtcttttacagattttgcaaaaataagtagtaagccaaatgtaaataagtgacttatggctttaagaataatgctctccgaataccactgccaaaataaggctcaatatttggtacttggttcttattcagaaataatgacctttttgcttaataaagagacatatcacatgtaaagtctcagagtcatctgaatacataactaatttttccactcacatgcattctaggctgttggtgaagcatctgacctttcaaatggaattgcacctgcaatatgagaaaaaaatttatatagcatacttcttgcaagatgacattaagttattcctatctgcatacattttttttcaagtgcaatgcaaaatgccaccaccctcatgaagtcccatcgcctaacatttggtctgccaacacccttcaatttattattttattgctacagcaggagaaacagaggacaagaaatgtttttgtcttaaactctttgttaaacaaaatgtacctaattcttctgagggtttttttttttgttttagatggagtctcgctctgtcacccaggctggagtgcagtggcacaatctcagctcactgcagcctctgcctcccgggttcaggtgattctcctgcctcagcttcccgagtaactgagattacaggtgcaaaccaccacgcctggctaattttcgtatttttagtagagacagggttttgccatgttggccagactggtcttgaactcctcacctcaggtgatccacccaccttggcctcccaaagtgctgggattacagacatgagccaccaagcccggcttgggttattgtttaaacagtccttttcccgggaactaatggcttaaaaccataaatttgcaaccaccaaccaaacccccatcttaaccaataatttgattaacatgatgaaccgatgttctttctttgaagctctgcctccacattttcctgcctttttctgcctgagggagctccagacttttaaccataattttgcatttcatgaaatgttagatcaagcacctgctataggaggagcagacctgcttgacttacactgcaaaaaccctgtcaggagacatagtggcctgaggccactgggatgtgtgacttttttcagttctgtcacctcacagaactgaagaactctcacagttaaggctctgtggactaagtcaggagcttcaggatgtccattagctggctaagtgtgaactcacacacagatcaatcgttccacctccctgcatccttcatccacttagaaaatcttccctctaaataacttctgatactattgcacagtagggtgactgtgggtaacagtaatgcattgcatatttcaaatagctagaagagaggattttgaacgttttcacaacaaagaaatcgtaactgtctaaggtgatgggtatgctaattaccatgatttgatcattacacaatgtatatgtgtattgaaatatcacattgtaccccacaaatatgtacagtttattatgtgtccataaaagataaagaaaatcctcctacctaaggcaagatagttccttaactggacctaaggggaagtactaataaattattatgcttgacactggaaagtcagagtgctgatggttactcacttaatccttcagtgcacatttaaaggagccccgtgaagggccaggcactgttccagtggacaaaacagatgaaagtgttcaccgtcctggagcttaaattctagtgcaggaaataggcaataagtcatatgtatgatgagtagatatgtagtatgccagaaggtgataattaattcagaaaagaattgtagaggaggtggaggaactgggcttgggaggcttgtgaggggcaggttgcagcattaaataaatagtgtcatcatcacacccagttactgtcagctggccatttgctgcctgattcttcaactggatgatgagctcagacagggctgggactctggcatgcccagtgcctagcacaggacccagctcattgttagatggtctccacgtgtttagtttctgaatgttgtgtgtagatgcaacccatgttaacaattttagaagcttccttaatgattttctaagatatatgtgtatgtgtacttaacagttagggactcagatattaggaaaagtcacgccaactttttataaaacatattttgttcacttttgcttaaaaaaagatttcactgtataactctaatctcacctctgcccccaccccagagaagttactgtcagggaagtagagttagagttttagtgtgttacgtatttttttttttttttttacagttatttgcttttacccaaagagctatatagagaaaaaatatattcaaatgaagttcacagacctattagtaggtacatttatcttgctaatttggagggtagccactttatgatggaataatcttgatatctctctgcctttctccagcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcaggtaagagttcagcttcccaaatctccccttcaatgacatttacaaatatgtgcaaaatatagaaactattatatactactgactttgaagtaaacaggttcattatcaggaagccacccatgaatgctcactaaagtgttggcatatatgttataaagattgtgcatacccttaatattggattttacattttttgcttttattgtcatgactggttccatgataaccttctgaaccacctggtgttctgagcatttatgtgtgctttatgctccacagtgcctcttattggcggtcctgcagcttaagttaaatgtctgcatattcctggtgggggtggctgagtaaattaatgagttagtcatgtacaatgtaaagcactgtttttacttgataggaacagcactcggtcaggatagctgcatatgtttgcttttattgcccaatactttttgacccttctcccccacttttatgccctcttcataatattctgtttatttcagtggatgaattgaatgacactatagctgctaatttgagtgacactgagttttatggtggtgagttatggtgattgtaactgatattctctccttcattgtagaatttagttcactaacttcacctccatgactatttaaccttatttctttatgagatttctagttatatgttaaataccactagtataaatgtatgtttcttatgaaatttacctataaactttgaagcatgccactagagcattttccatgatgtatgtgtaataatgaaacctgttgtaactgtttgcgtgtaaagaaccatttcactgatttggaaaaacctttcacgtacgttcagaattatgttttccatgttttgttctgttccaaacttttcttgtgaactaagtaagagttggcagggtgcattaacttgctagaatactgactcatcaaagcttttagcaactaacattaaggggatttcatagtaaatcatcacacttgtcatctgttttcatgtgacattatcaatataattagcaatgagatttctctcttagttttgtttaaaagtaagtcaaaccaagtcactgtcttcaatggaagtaatctttttaaaagtagagcatttaccttcattattttagatagaaatgaatttgattcccttaagggaaatgttctcaagtagagtctatgaatgaaaataatgggttttggataaagggtcctcttaattatccataaggtagaatttctgctgtattaatttttcacccttgagatataagtaaaagacattaaggtctcatcagtgaccaagatagacactccacaactgctgctttctgttattttatttgaatatactcctgaaaaatatgggccccaagaccattcccaaagtgattttagaggagtaagtttccccgctacaatctctaaattcttaggaaaactaatttttctcaagtaatatatcttctggcattgaattttttcttctgagaaatgagaataattcatagtatatgaccttttcattaaatttttataagcatcaagtagataatgcattaaagagttgaaaaccttcaagggctataaaaccttaagatgatgtaatttctgctccaagtttttctaagaaaccttcagaagataaggctatgttttggaaaggcctccataaaaaagaagatggcctgtataactatccctaagatctttgacttggatcctctttatttttttattgaggaaaatgatttccatttatttaactccaccattattcttattttgtggcataatatttgcaagacctctgtcagtaactctctacttttgttttccataaacctcacagtttgaggatcttaatatgattaatcagtggtattggctataatgttgtccccactgtaaaccagaataccccttctataaccatatctttataaaaatctaacatcttccagaagatagacagttaatttttgcttcgacctaagcactaatcctaagggaaatgtagtttgataacatgattttcctctccatgtcaacatattgaaaattttctaacccacagaaaatttgtaaaaacctaacccaaattaagggagtatacaaaaggaaaacagtccttattattagtgcttatgccaccaaaattgtttctgttcctgggtaactgagtaagtgatgactacttataacgcagagagtgtgtatgtgtatgtagcttaacaaatttcacaattaatgttaaatagcttaaaaagggattggaattttagacagcttttttgacaatgaagtgtttatagaaatacatatttataagttgtaatgcatactgattttcttgtttgcagctaaatcaagtagagagaggccaccaacatttttaactccagaaggcaatgcaagtaacaaagaggaattaagaggaaatgtgctttcactggagtgcattgcagaaggactgtgagttaacactttctgtcctgaagtacatttcttataaaaatatagtaggttggtagagagaggttaataatatcataggaggagtcattgtcttctactaattctagcaagcatcaagaaaaatttggtaattatttccaaagtaggcatatgaatctcatattattgttataatttttttaatgtaatagtaatcttattgaaataagtatcagtaatcaccttatgattgttgaaatattaggtctcattgttaaaatattttgttaatatagtagtagtatcttaaaataagtatcagtaatcaccttgtgactgctatgattataattagagtatattattttgctagtttgtaaccagccacctcaaatttagtggcttaaaaataatagctattgattactgatcacttgtcaagaggtctacagagcagttgtcctctaaccagcaaggttcggctaatttcagttaagcatgctcatgtatctgttaggtggctcagcagtgctcttggggtctactggctgttaactggggcatctgagttgatggccataagttgctaacatctctcttgcagtcttgtcctggcttattctcctaacaacagacatcatgcacagggcctgcctcttaaatcctagcctcagaactagcacactgtcccttcacctacttcctattggcaggtcacaaggccaagcctagattctttgaaataacttagttgtgcacacttcaaaattgaagctaccccagaactgacgcgcctttgacaggagttgcagggaggccttgcccaaatacaaaagcaactgtgatgttagctctgtgttacaaggaatttctatatagtccctgtcttctgcctgacacagagcaaacaccattggtatgggcgcatctgctgaaaacctggaatagaatctcagaaacgtgctgccctcacatgtgatccctgctgtccttgacaggcaactcattggtttcacattccttcctgaatccaggaaaacttgacttcaggaggcacgtggaggcctccgctggccgaggcaggaaatcatactatgcattactcagctcctcaagctacggaaaactagcaaaacccccttttaaagatatgttaaaaccctatatcttctgctagaattaagaaaaaaaaatcctcccagtttccatcgttatggtgtaagagagtggcatagtctgccagcctccaacctttgggagcagaaggtatctattctcacaatttaatgacttcttttcccacaaatgacatatttcataaaaaactaaaatatggttggtatttggaaatttcacaatactcccaaaagaatttttaaaactttggagtgttgtaagaccaagattgggactctatcacttaccaaccagccatcagacttatagaatcaaaatatttccaattcctgacaatggctcaatacagtagctggcctccaaaacaattcatggctttttcataatttcaaactatgaaactatgctttcatctccatctccttcttaccttcatatcatctgagatgcagattagtctgactataaggaaatatcaatatgttatcagattccacatgtatatagattttcaaaatctacttatttttatacttacagcatgttttaattctagaagctatttcatcagatacatatgctcagtttatttcttacttaaccaaacaagccaaaccaatattataatcaattaataccacttgcatttcttttttttttttttgcttgaaccataatttattatttctcatggttccatgtgatgactgggctaagcttttttaaattattttttattttccataggttattggggtacaggtggtgtttggttacatgagtaagttatttagtggagtaagttatttagtggtgatttgtgagattttggtgcacccatcacccgaacaatatacgctgtactctatttgtagtcttttgtccctcaacactcctccacccttcccctgaagtccccaaagtccattgtgttattcttatgcctttgtgtcctcgtagcttagctcccacatatcagtgagaacatacagtgtttggttttccattcctgagttacttcacttagaataatagtctccattctcatccaggtcaccgcaaatgccattaattcattcctttttatggctgagtagtattccatcacatatatatataccacagtttctttatccacttgttgattgatgggcatttgggttggttccctgattttgcagttgcaaactgtgatgctataaacatgcgtgtgcaagtatcttttctgtataatgacttcttttcctctgggtagatacccagtggtgggattcctggatgaaatggcagttctacttttggtactttaaggaatctccacactgttttccataggggctgtactagtttacattcccaccagcactgtagaagtgttccctgataaccgcatccatgccaacatctactgtttttttgattttttggttatggccattcttgcaggagtaaggtggtattgcattgcggttttgatttgcatttccctgatcattagtgatgttgagcattttttcatgtttgttggccatttgtgtatcttcttttgaaaactgtctattcatgtccttagcccagtttttgatgggattgtctgtttttttcttgctgatttgtttgagtttgttgtagattctggatattagtcctttgtcagatgtatagattgtgaagatttcctcccactctgtgggttgtctgtttactctgctgactgttgtttttgccatgcaaaagctctttaatttaattaagtcccaggtatttatctttgtttttattgcatttgctttcaggttcttggtcatgaattccttgcctaatccaatatctagaaggggttttcctatgatattttctagaatttttataatttcaggtcttagatttaagttcttaattcatcttgagttggtttttatataaggtgagagatgaacatccagtttcattctcctacatgtggctagccagttatcccaacaccaattattgaaaagggtgtcctttccccactttatgtttttgtttgctttgtcgaagatcagttggctgtaagtatttgggtttatctctgggttctctattctgttccactggtctttgtgcgtatttttataccagtatcaagctgttttggtgaccatggccttatagtatagtttgaaatcaggtagtgtgaggcctccagatttgttctttttgcttagtcttgctttggctgtgtggggtcttctttggttccatatgaattttagaatgtttttttctaattctgtaaagaataatggtggtattttgatggggattgcattgaatttgtagattgcttttggcagtatgtcattttcacaatattgattctactcttccatgagcatgggatgtgttttcatttgtgtcgtctgtgatttctttttgtagtgttttgtagttttccttgtagaggtcttttgcctccttggttaggtatattcctaaggatttttttttttttggcagctattataaagggggttgagttcttgatttgactctctacttggttgctgttggtgtatagaagagctactgatttgtgtacattaatcttgtatctggaaactttgctgaattcttttatgagttctagggcctttctggagaagtctttaaggttttcaaggtaaatgatcatatcatcagcaaacagtgacagtttgacttcctctttacgaatttggataccctttatttctttctcttgtctgattgctctggctaggacttccagtactatgttgaagaggagtggtaagagtgggcattcttgtcttattccatttctcagagggaatgctttcaacttttccccactcagtattatgttggctgtgggtttgacatagatggcttttattacattgaggtatgttcattacatgctgattttgctgaaagttttaataataaagggatgctggattttatcagatactttttctgcatctattgagatgatcgtgcgatttttgtttttaattctgtttatgtggtgtatcacatttattgacttgtgtatgttaaaccatccctgcatccctagtatacaacccacttgatcatggtggattatctttttgatatgttgctggattcagttacctagtattttgttaaggattttagcatctatgttcctcagggatatcagtccatagtttctttttttggttatgtcctttcctggttttggtattagggtgatactggcttcatagaatgaattggggagggttctctctttctggtggaatagtgtcaaaaggattggtaccaattcttctttgaatgtctggtagaattctgctgtgaatccatgtggtcatggacttttttttggtaattttttaattactattttgatcttgctgcttattattggtctgtttaaggtatctaacttttcctgatttaagctaggagggttgtatttttccaggaatttatccatctcttttaggttttctagtttatgtgtgtaagggtgttcatagcagccttgagtgagcttttgtattttggtgatgtcagttgtaatatctcccttttcatttcttgatgaggttatttggattttctctcttcttttcttggttaatcttgctaatggtctatcaattgtatttatcttttcgaagaaccagctgtttgtttcatttatcttttgtattttttgttgtttgtttcaatttcatttagttctgctgtgatcttatctcctttcttctgctgggtttgggtttggtttgttcttgtttctctagttccttgaggtgtgaccttagaatgtcagtttgtgccctttcagtcttttcgatgtaggcgtttagagctatgaactttcctcttagcaccgcctctgctgtatcccagaggttttgataggttgtgtcactattgtcgttcagttcgaagaattttttaatttccatcttgatttcgttttctacccaatgatcattcaggagcaggttatttaatttccgtgtttttgcatggctttgaaggttccttttggagttgatttccacttttattccactgtggtctgagagagtgcttgatataatttcaattttcttaaatttattgaggctcattttgtggcctatcatatggtccatcttcaagaaagttccatgtgctgttgaatagaatgtgtattctgggtggctagaaagatggctgaataggagcagctccaatctgcagctcccagcaagatcgatgcagaaggtgggtgatttctgcattcccagctgaggtacctggttcatctcattgggactggttagacagtggaagcagcccacagagggcgagccgaagcagggtgggggtgtcacctcactcaggaagtgcaaggggtcggggaactccccccccccccagccaagggaagccgtgagggactgtgccatgaggaacaggaggaacagtgcattccggcccagatactatgctttgcccatggtctttgcaatccacagaccaggagattccctggggtgcctacaccaccagggcactgggtttcaagcaaaaaactgggcgaccatttgggcagacaccgagctagctgcaggagttttttttcataccccagtggtgcctggaacgccagtgagacagaaccattcactcccctggaaagggagctgaagccagggagccaagtgatctagctcagcggatcccacccccatgaagcccagcaagctaagatccactgatttgaaattctggctgccaacactgcagtctgaagtcgacctgggatgctctaagttggtggggtatgggcatctgccattactgaggcttgggtaggtggttttcccttcacagtgtaaacaaacccaccaggaagtttgaactgggcagagcctaccacagctcagcaaagcctctgtacccagactgcctctctagattcctcctctctgggcagggcatcactgaaagaaaggcagcagccccagtcaaaggcttatagatcaaagtcccatctctctgggacagagcacctgggggaaggggcagctgtgggcgcagcttcagcagatttaaacattcctgctgctggctctgaaaagagcagcagatctcccagcacagtgctcgagctctgctaagggagagactgcctcctcaagtgggtccctgacccccgtgcctcctgactgggagacacctcccagcaggggtcgacagacacctcatacaggagagctccggctgacatctggcaggtgcccttctgggatgaagcatccagaggagggaacaggcagcaacctttgctgttctgcagccttcgctggtgatacccaagcaaacagtgtctggagtggacctccagcaaactccagcagacctgcagcagagggccctgactgttagaacaaaaactaacaaacagaaagaaatagcatcagcatcaacaaaaagggcgtccacacaaaaaacccatatgaaggggtcaccaacatcaaagaccaaaggtagataaatccacaaagatgaggaaaaaccagtacaaaaggtctgaaagttccaaaaacgagaatgcctcttctcctccaaaggatcacaactactcaccagcaagggaacaaaactggacagaaaatgagtttgacgaattgacagaagtgggcttcagaaggtgggtaatagtaaactcctctgagctaaaggagcttattctaacccaatgcaaggaagctaagaaccttgaaaaaaggttagaggaattgctaattagaataaccagtttagagaagaacataaatgaccggatggagctgaaaaacacagcacgagaacttcgtgacgcatacacaagtattgatagctgaatcaaacaagtggaagaaaggataacagagatagaagatcaacttaatgaaataaagtgtgaagacaagattagagaaaaaagaatgaaaaagaatgaatgaagtctccaagaaatatgggactatgtgaaaagaccaaacctacgtttgattggtgtacctgaaagtgacagggagaatggaaccaagttggaaaacacttttcaggatattatccaggagaacttccccaacctagcaagagaggccaacattcaaattcaggaaatacagagaacaccacaaagatactcctcaagaagagcaaccccaagacaaataatcatcagattcaccaaggttgcaatgaaggaaaaaatgttaaggacaaccagagagaaaggttgggttctccacaaaggaaagcccatcagactaacagcggatcttttggcagaaaccctacaagccagaagaaagtgggggccaatattcaacattcttaaagaaaagaattttcaacccagaatttcatatccagccaaactaagcttcgtaagtaaaggagaaataaaaatcctttacagacaagcaaatcctgaggggttttgtcaccaccaggcctgccttacaagatctcctgaaggaagcactaaatatggaaaggaaaaaccagaaccagccactgcaaaaacataacgaattgtaaacaccatcgacactatgaagaaactgcatcaactaacgcgcagaataaccagctagcatcataatgacaggatcaaattcacacataacaatattaaccttaaatgtaaagggctaaatgcccaaattaaaagacgcaggctggcaaattggataacgaatcaagacccatcagtgtgctgtattcaggagaccagcctcatgtgcaaatacacacataggctcaaaataaagggatggaggaatatttaccaagcaaatgaaaagcaaaaaaaaaaaaaaaggcaggggttgcagttgtagtctgataaaacagactttaaaccagcaaagatcaaaaaagacaagggtattacataatggtaaagggatcaatgcaacaagaagagctaactatcccaaaaatatatggagccaatacagaagcacccagattcataaagcaagttcttagagacatacaaagacacttagactcccacacaaaaatagtgggagatggccaggcgcggtggctcatgcttgtaatcccagcactttgggaggctgaggcgggtggatcatgaggtcaggagatcgagaccatcctggctaacatggtgaaaccccatctgtactaaaaaaaatacaaaaaattagctaggcatggtggcaggcacctgtagtcccagctacttgggaggctgaggcaggagaatggcgtgaacccaggatgcggagcttgcagtgagccgagatcgcaccactgcactccagcctgggtgacagagcaagactccatctcaaaaaaaaaaaaaaaaaatagtgggacactttaacaccctgctgtcaatattagacagatcagtgagacagaaaattaacagggatatttaggacttgaactcagctctggaccaagcagacctgatagacatctacagaactctccaccccaaatcaacagaatatacattctttccagcaccacatcacacttattctaaaattgaccacataattggaagtaaaacactcctcaccaaatgcaaaagaacagaaatcataacagtctgtcagaccacactgcaatcaaattagaactcaggattgagaaactcattcaaaaccacacaactacatggaaactgatcaacctgctcctgagtgactactgggtaaataacgaaattaaggcagaaataaataagttctttgaaaccaatgagaacaaagacacaatgtaccaggatcacaatgtacagctaaagcagtgtttagagggaaatttatacactaatgtctacaggacaaagtgggaaagatctaaatttgataccctaacatcacaattaaaagaactagagaagcaaccgaaacaaattcaaaagctagcagaaaacaagaaataactaagatcagagcagaactaaaggcgatagagacatgaaaaacccttcaaaaaatcaataaatccaggagctggttttttgaaaagattaacaaaatagaccactagccagactaataaagaagaaaagagagaagagtcaaatagacacaataaaaaatgataaaagggatatcaccactgatcccacagaaatacaaactaccaccatatagagtatagagaatactataaacacctctacgcaaataaactagaaaatctagaagagatggataaattcctggacacattcaccctcccaagactaaactaggaagaagtcaaatccctgaatagaccaataagaagttctgaaattgaggcagtaattaatagcctaccaaccaaaaaaagcccaggaccagatggatttacagccaaattctaccagaggtacaaaaaggagctggtaccattccttctgaagctattccaagcaacagaaaaagagggtatcctccctaactcattttgtgaggccagcatcatcctgataccaaaacctggcagagacacaacgaaagtagaaaatttcaggccaatatccctgatgaacattgatgcaaaaatcctcaataaaatactggcaaactgaatccagcagcacatcaaaaagcttatccaccacaatcaattcggcttcatccctgggatgcaaggctggttcaacatatgcaaatcaataaacataatctatcacataaagagaaccagtgacaaaaaccacatgatcatcttaatagatgcagaaaaggccttcgacaaaattcaacagcccttcatgctaaaaactctcaggactattagtaattgttttataaatttaggagctccattgttaggtgtatatatgtttaggattgtgatattttcctgttcgacaaggccttttaccattatataatgtccttctttgtctcttttaactgctgttgctttaaagtttgttttgtctgatacaaaaatagctacccctgcttgcttttggtgtccatttgcatgaaataactttttccactcctttattttaagtttatgtgagtccttatgtgttaggtgagtctcctgaaggcagcagatagttggtggtgagttcttatccattctgcagttctgtatcttttaagtggagcactcaggccatttacattcaatgttaatattgagatgtgagatacccttgcattcattgtgctatttgttgcctgtgtaccttgggttttttattttttgtttttgctttttgaattatatttttgttttataggtcctgtgtgatttatgctttaaagaggttctgttttgatgtgtttccaggatttgttttaagatttagaactccttttagcagttcttgtagtggtggtttggtaatggcaaattctctcagcatttgtttgtctgaaaaagactgtatctttccttcaaatatgatgcttagtttcgctggatacaaaattcttgactgataattgttttgtttgtggaggctgaagatagggccccaatcccttctagcttgtaggatttctgctgagaactctgctgttaatctgataggtgttcctttataggttacctcatgcttttgtctcacagctctttagattatttccgtcatcttaactttggataacctgatgacaatgtgcctggacatctttttgagatgagttttccaggtgttctttgtgcttcctgtatttgaatgtctaggtccctagcaaggccagaaaagttttcctcgattattcctccaaatgtgttttccaaacttttagatttctcttattcctcaggaacactgagtattcttaggtttggtcatttaacataatcccagacttcttggaggctttgttcatattttcctattcttttctctttgtatttgttggattgggttcattgaaagactttgtcttcaagctcttaatttctctcttctacttgttcagttctattgctgagatttttcagagcattttgcatttctataagtgtgtccaatgtttcctgaagttttgattgttttttctttatagtgtctatttcctagactatttctccctttgcttcttgtattgttttttggatttccttacattgggctttgcctttctctggtgcctctctgataagcttaataactaaccttctgaattctttttcaggtaaatcagggatttcttcttggtttggatccattgctggtgagctagtgtgattctttggtgggtgttaaaaatccttgtttagtcatattaccagagttggttttctggttccttctcatttgggtagattctgtcagagggaaggtctagggctgaagtctgttgttcagattcttttgtcccatggggttttcccttgatgtagtactctccccgttttcctatggatgtggcttcctatgagccaagctgcagtgattgttatctctcttctgggtctagccacctggcaagtctacccatctccaggctgctattggagtttgtttgcacagagtcctgtgatgtgaaccatcggcctctccaccatagataccagcacctgttctggtggaggtggcagggggttgaaatggactctgtgagggttcttaggtttggtggtttaatgttctatttttgtgctggttggcctcctgccaggtgctttccagagagtatcagttctggtagtatggagaggaactggtggtgagtggagcactagaactcccaagattatatgccctttgtcttcagctaccagagttggtagagaaggcccctcaggtgggggtagggctaggtgtgtctgagctcagactctctttgggtcttgctgtggctgctgtgggggagggggtgaggttcccagatcaatggagttgtgtacctaggaggattaaggctgcctctgctgagtcatgcaagttgtccctctgctgagtcatgcaggttgttggggaagcgagggaaatccagcagtcacaggcctcacccagctcccacgcaaaccaaaaggccagtctcactcccacagtgcctaccctaacagccccaagtctgtttccaggcagtgggtgagcggggcttgagaacttgccccagactatccacctcccagcggcaaaagaaaagggcttagttcttccccagcctatggagtctgcatgctggattcatgccctttcccgagttctggccaggaggtttctcgtctggttcaaattgttataaagttcagctggagacttccttctccctgtggcattttccccacacctctggctgccctcctgaaggatctctgtggtgccaggcaggaatggcctgcttggggacccagcgagctcccaaggcctttcctgctgcttcctctacccctgtatttcactcagctctctaaattgactcagctccaggtaaagtcagaaacttctcccacaaaccagtttttcacttctgcagtttgggcactcacagtatttgggatatctcccgggtcctgcaggagcagtccaattccttcagagagtctgtgagtcctttcagcaggtttgttcttgcagttattctggagctaaaattcacgatgcaagcctccacatgctgctctgtccatccgcatcagagctgcaatgtagttctgcctcccatctgccatgatgatcccttctgggctgagctgttcttattcagagtcacttgcatttctattgacaaatattgttatcttcctgagggcctggaccatattttcttcatcatcttcccaacacacagctcagtgcttggtgtatagttcagtacttaggaaatttttgtgttgaatggatttttattttaccttcatgaaaactttctaaagtcattagttcaagtcaagcattattatccctattaaggcaactaaggaaactaagcctcaaaaagatcagaaatccagggacagggttggaattctaaagatcttctaactccaagcctatattctgacttttcatctgtctccatattccatgacaataaaaaacacagttgggaccaggcgcggtggctcacgcctataatcccagcactttgggaggctgaggcgggtggatcacaagatcaggagatcgagaccatactgactaaaacaatgaaaccccatctctactaaaaatacaaaaaattagctaggcatggtggcgggcacctgtagtcccagctactcgggaggctgaggcaggagaatggcgtgaacctgggaggcggagcttgcagtgagctgagatcgtgccactgcactccagcctgggtgacagagcaagactccatctcaaaaaaaaaaaaaacaaaaaacattgggtgacaaatggtatgagtaatacctaagtttgatctattcttaattagtgtaataatatttttaaatgtcactaataatgaaactaaggaaaaaaagctctttcccttattacttagttaacatcatcagatagactgctgtaaaataggaaaattattccatttgatatggaaatgtatacaaaggtttatggtcatagatatgtttatgagtttttctctgtacatgtttaatcccagctgatgaaaaattataattcagtatcattaatataatagtaattcttttgattaacatagtagcttcatgtaaaaatttccaagagttccttattagtcacaacgttgaaaaaaataattaggccccatcagtaaagcaactcatgctggcattcatactgtatcattgacatcgaagtttatggtgtgccatcaattagtatagttctgattatgtgaaaacgtaaaactgtgagcattatttataaaagtgtggtgctaattaaaatatctatgtatttcttatgattttttaataaagatttgttacaaagttgcatgaaaattcatcctcaaaagtagtcataggtggattccttttttgtaacatcattatttatttatcctatcaggcctaccccaattatttactgggcaaaggaagatggaatgctacccaaaaacaggacagtttataagaactttgagaaaaccttgcagatcattcatgtttcagaagcagactctggaaattaccaatgtatagcaaaaaatgcattaggagccatccaccataccatttctgttagagttaaaggtatattgtttaaaatccattcttcttgccttcatgagagaccctgaaactttaattaaatgtggttttcattacatttttagtaatggtaaatgtaaagttatgtcaacattcatggtaccttgactctcttctcattgctattggtagtgcatctaaatcaggttaaaaatttacttgttcaaatcttcctcacagaagaatcccagttaatgaatataggaataatgaaggaaatagaaaagtcaatattagaatcccacagtaataactagagccggcaagatcaaacaatgaatgctaaaattagtgggtgaaactttaaggagaaacaggatatttgcatagcttcaaagtgtttctatcccgcagaaattaattactggggaagttttagcgtgtccacaaatactttattactcctttctttagaagatggagcttactttccctcttcttgagtgtatgctggacactaatgaacagagtatggaatccagggaaatagtaactttggagtggagaaacctggcagacactgtcttaaccaagtgatgaatgttaacgtcaataataataagtcatgtttgatatcatatattcccccatatggtacaagtagaagggttcattacctttgggatattctcaaaagcccaaaacctcagggtaatcatgagaaaacatcagacaaacctaagccgtaagacagtctacgaaataactgaccagtactcttcaaaagtgtcaaggtcacaaaagacaaggaaagaccaagaaattgtcagattggagatgatgacaagtaaatgcaaaagacgttacaagtaaatacggtgtctaggacaggatcctgggacagaaacaagacattaatgcaaaaacggaaatcctaacagaatgtgtagtttagttaagtaccattgttaacttttcgttaggtaactagaccatggtcacataagatgttaacattagaggaagctgagggaaggaggtatggaaatgctctataatacctttgcaacttttcaaaaatgatgtttttaagttgcttcctaattatatatattctacagggctcagaatttattttatttatttatttattattttgagttggagtctcgctctgttgcccaggctggagtgtaatgggctatcttggctcactgcaacctccacctcccgggttcaagcaattctcctgcctcagcctcccaagtaggtgggattacaggtgcccaccaccacacctggctaatttttttttttttttgtatttttaatagcaacagggttttaccatgtcggccaggctggtttcgaactcctgacctcaagtgatccagccactttggcttcccaaagtgttgggattacaggcatgagccaccatgcctggtccagaatttaaatttgtgtttcttagccctacctgtacatgtaattttctctgtatgcttagataaatctgtcacctctttgatgtctgattaattttaatataaaatgagaaaatgaaatttgtatcaaacaggtctagaaataatacatatacgtcagtgagtctctttaaacattctttgaaaatcttaagtgttctttgaagcattgtttataaatctattcgctcaaaaaaaatgagactaatttagtgtgaagtacttgcttgtattattaaaatagttcaatatgttcttttgctaaaatgcttatttgattcagatttttggtcttttttcttcctcctataaagcggctccatactggatcacagcccctcaaaatcttgtgctgtccccaggagaggatgggaccttgatctgcagagctaatggcaaccccaaacccagaattagctggttaacaaatggagtcccaatagaaagtaagttgccttgagtggttctaattgcagtatattttcagagcatatatacatcccgacagtgaataaatggtgataaaaaaataactcaggttaaggaaggaagccacatgtatgttaaacacaggcaccaaattacctttgcattttattaccattagatatttattatgaatgtgaatagtttatgctgttaacataatggcatgtgatgactggtacttggcaatatttcgtctgctttttacatggataatgggaagaatgacagggtcagaaataaatatcacttcaaagtttagatgatcttctttgtgcaaaacatcaagtgatttgtagaaatgtcacaggcactagaggagataggtggggagactcggcatagagccaatggatatgacaagcataagaaacccagctgtcttaatataaagagttttcagtcataagtatagcaagtatagcccaggtgttctcactgtcttccaaggtcaccgtcccatttgatacccaaagaagaacacatcctctgaccctgatcgtatgcaggatgctttacctttgactagtgctccctccctgagagctgctgctatcatccttgagcagcacctgggcatcctggctatacttgttgccccgttcagcagcctccctgctccgatgctccactccttccacttcattagccaatatctccaagctaccactatgcttcccagcgtgtggcttcaggccctcccattaatctgctaaatcatagcaaaggccagctttacaaaacttggctaaaggcttggggagagtcaagggaattatagcaaagaaaaaatctttaaatggatgttgcacctcactgctccttaattcctaagccatggccatgaacagagaacccactagactctcctcttcctctaccccacccaccaccagctactgccgagaggagcatctttcaacattttccccttcttggagttcagacctcctcttagacaccaagacagagaaagtcagtttcagcatcaaacccagccttaggttcactctcccagtcaataacatgattacctgcaaaggtattctttactcacaataaagatagccctcaggcttatgatacaggacagattggctttgactgcctccaagtcagaatccaatattggttctacatttacataaccaaaaggtctgccgaattgactttcccaaagtaacacacacacttcccctaagatggttccaaaaacctgctggcagatttaaagtggcacaagtctctgtttcttaccatcaaggtctgacaactgcagggtgactgagtcgttgtagcctgccccatgaatatttattggaagttcacttgtgtctcgtagtacagtagctgtcagatactttgaaacaggcagactgtcttcactgtagaaggaagtgtattcctgggagaaaacagatgctagaggccagcaaatagggtttgggtatttccattcccaattttaaccaggatcaggatccagagaaatggcagagagtactttgtggttgtgtttcaggaagctcttgctactctcaggggaatatgagtgaaaactgagaggaaaaagtagaagaaagcctagaactaaaaaagttttatggtggctcatgtgagcctgtaatcccagcactttcagaggctatggcgggcggatttcttgagtacaggagttagagaccagcctgggcaacagggcaaaatcctgcttctacaaaaaaatcaacaaaaaattagctggtacaatgtatgattttctcaggaatgcatacaaaatggcaataaatgatgatacatgcttgatacttttgcaccatgttttgcagctcagagtttttgtgtccatttatggaagtttaaaagtgtccctgagatctagactcagtgaaactgacaagtggaaggaaccatccatctagcccttcagcagggaaaatggggaagctaggggataaaccctcaagcttggcagccagagtgcaatactatgcaaggaaaattgagatgtgggtggatgacataagcaggggaggattaaataatgaagctgatttttcttcttgatttgctcagcttgttgtccttccaaaccagccatcttagtccattcctgctgctataacaaaatgccttagactgggtaatttataaacaacagaaatatattgctcacagttctggaggctggaaagtccaagatcaaagaaccagcagatttcatgtctggtgatggcctgttcctcacagatgctgctatgtgtcctcacatggtagaaggagcatacgggctccctcaagacctttagaacagcaccaatctcattcatgagggggaaaccctcatttcctgatcacctcccagagaccccacctcttaaccttggagttaggtttcaacatgaattttggagggacacaaatattcagaccatagtaccagagtatgcagtgcctctgagggaaccttgtaaatccagtcatcttaacagctttgaaaatacactcataacataataacactccccttttaaattacatttttgtggggagaatcaaccataaaaggcctgctttgggggtacagagtagtaatagcagaaagagtagttcctcttgtaaccctaaattgtctgagtaggtagagaagaaagagttaggactaaatgtctcaaatcagatcagctcatctcttccatcccaaaagtcttctttaaggccccctgagacagaaaaaaggagactgagaagacaaggctggaattccatagctcctatagatccagggtcgctcaccctctggtgtgcctcagagcagtcactctagtggacgtgcagggagaggaataccacatggtgtggcagcaaagcaaggagcccggcaccaccaggccgctccgtggtgctggtagcaggtgctgcatgtttataccaaggtactgtgaagcttccctggaaggggtctttctcgacatctggtggccaagctgaaagtggattaccatttggacatctgataactaaaagatgatgagccagcggggcctctgcacagctttctgcacgatgaccctgcaaaggtacagctgtgccctgcccctggccttctgcagctggcccatctgcagcttctgctgagtggccacatgggtggatgctaagtcttcaacagctaagttcaaagtgaaccctgcatgcccccactgtgtgttgatctcccctgatccaaaataatgagagaatgaggggggtgcagaaactatccaaaacattaatagacatttaaggagccctgtgccgctctctttttcatccccttcttggtaattgtcccatgaatttagaggcccctgaagggaattgcctttgagggttagggaccatcctggaaacggagcaccagtgcttgcttcccatctggagtttgctgacttgtgcaccccacatctagcacggctgggagacgggggaaggatgacagggagatgcagagaggtgaaggtaggaactgagggcacagtctgccaccatgtgtgacagggctgaattagcacaatgaagactccttgccttcatcatggggtcctagcataggcgccagaagtgagctgggagcacaagctggcttgctgacagcactttctatccaagagactgcagaaattgcaggtggaccagctgctgcgggtgaggcacaggaaacagctgtgcttctgaactactgttgtcaggggctgtgcagtgtcccctccaggtgcctgaagtttgtctcctgtgccacacaacagagatacagtcaggggaccatactgccaggtacacagcctccccactcctgacttgcaggcgagcacctaaggacactgactgtctcctttcgcctctgcaggctctggctgccgagtgcacataaatactgtaaaaggagaagctggttcagggaggggaatggtaagaagggttcttttagcaaaatgcaatgtcattgatctgtgactgcatttaagacctgaaagctgttgttttaaaaaaaaaaaaactggaaaaattaactccaaaagtgtctgggcttttatttcattgtctcctaaagctttacccttcccccatccccaggactggccagattacttaaagctttccttgaagcaaaaattacaggctgtattaaataaatgtggaaatttcccaaaaccacctaaaatagttttaaaacaatctacagaagtcagataaaagaacacagctgcagagaactagtgctgaaagagagctttaattttattgtgtaatgggagggtgtgaaaatagaacccaggaccagaaagaaaatgaacttgctattggcaggatggggcaaagcatttccctgctctaccctaggaggttgcttttcaggacttcaaagccacactgaggggggtgtttttgagttcctttttcttcctcttggtcttccccactggagagcctgtgccattctggtggtggtgcccaaggctgtggccactgtgattcctatctctgcaggagagtctaacacttgcagatccttgatagtttccagcgtgcgttgtattaggtctgtcagactcttctgcatgaaacgtggataagatcacaccgttattgtgttaaaaggcccctgtcctctcagggatgaggagggaaaagaactaagagaatgagaatgggcagaagacctcttcctggcactgtgacatatttttctcacaatgaaagatgttgaaagccaggaatgtaagataagcaccaggagaatagaggactggtccaggatattcctgggatttcatcaaggcatcctcccttcttccttttcacaaaactaaggggctcagtggcatcctcttgtagggatggaataagtaaatgaagagggaaatttaactcttctcccagaaatgtgttctacattatgcccaaatgttcacgttccaggaaatgtttacaaagttgactaactgagaaaacctgagcagtaacctcatttgaacaaaccagtacatgctgccatttgtagtctctcatctccaaaatgcataaaatactatatgattagcctgtttcacaaagttctttttaaaatgaaattatgcagtaaatgtaaaagcattttaaagattgatcgtactctgttcatgtaagatggcatgattattattattattctcattatctatatgttgaaagtgtttatatttttacctaccaacatcaggagagttgggttataagtattttctgaaggccatcaccccagttctggaccttatctttgtggctttaagttatttgtagggattctgtgcttttaaatttctttctccagtgtttattgacagcagatgaagttggttattcctagaattaatgattattcctctggataatttggatttgcatgctagagagttactctacccactagccagcccatccaaaggctccaaatgtctctacattagtgattttactctgtgtccagctaccaaccgagcctccatatgtcaccgtgacagttcctgggtttgtttgcattttttaaacaagtacttaaggaaaactcccatggagagaggtctgcttactcattattattacctaaagggtttattttgttcctaaataccttgccaaaaataaatatttgaagactgctctatttagcatatataaggcagatacagtcagatgcctttcaggtaaaaaaataccttcccaaagagttgatagcaaagaaaagtgcaactgagagcaacagaaaagctttctgacatggtttgtttgtgactgatgagtctccacttggggaaaattgtcctactgacattgttgagctttgccctccaagttcatggtcgtgtaacattattattattattgtggtaaaaacacataacaaaatttaccatcttaaccattttaagtgtacagttcagtagtgttaagcattttcacattgtgcaacagatcttcagaactagagccctttagccattaaatatcgcgtggtggtgtaacttttaaaaactcaatacatttaaggaatttgaggaactcttatgtagtctgccacccatccagagagattcggcccagagctctgcctgggattcatcacagtctaaaatacacagccactctattccactgcctggaacatccacagagatgcggtcagggtgggcacatggtgggcaccgagagtgccctgaagagtcccagcactgagagcccaagtgctgggtccagaagtgctaagaatctttttctttttttttttttttttaccgaccttaaaaatttagtttgtttctctactttattcttgtattattttttatttccatagatttttgggcaacaggtggcatttggttacatgaataagttctgagattttggtgcaccggccacccgagcagtgtacacactgtacccaatatatagtcttttatgcctcgctgccccccacactttcctttgagaccccaaagttcaatatatcattcttatgcctttgtgtcctcatagcttagctcccacttatgagtgagaacatataatgtttggttttccattcctgagttacttcacttagaataatgatctccaattccatctaggttgctgtgaatgccattatttcatttctttgtatggctgagtagtatttcatagtgtgtgtgtgtgtgtgtgtgtgtgtgtgtgtgtgtgtgtgtgtgtatttctttatccactcattgattgatggcatttgggctggttccatatttttgcaattgcgaattgtgctgctatcaacatgtgtgtgcaagtatcttttttatataatgaccagaagtgctaagaatcactgacagagaacaagtctccagaaatgctgctttgtgttccagcaccccttgatgaggcagtaggtgagcatcactgagattgtgtgagtcaggccccagtcatacaagacttgggatctgggacacatgggctgccctaagttacactgcattttcagggtccatggctgccctaaggtacactgtgttttcagggtccatggctgccctaaggtacactgtgttttcaggatccatggctgcctgccacagctacagttccctttctaggccagtgtgtcatatccatcctctgctgtcttttatcaacgaatctatataccctgttgaaggaattatgacttgtatttgtctttgatttggaagaacatgttccttaaggcaattttgaaattattagagtcataaataggagatgtaagctaagaagtcaattcaaagtatctcgacacccccacataactagttgaacaacctggagtatctaagatgatttcataaatgagttactgatggtaatcagagtgttgaacaactgcttttttgttacatttttccttgggaatgaagacgttaatcagtccatgaggagtaacttgtaagttagagttttaataatccttggatgctaaaaacttattctgaacttaaatgtatggcgaatttttaaaatattctagtctaaaacatctaaaagacttttaggctataaatgtgatacagtatgtggtagacagaataatccctccttctaccccaccccgccacgatgtctacatcccaatccctagaaactatgaatatgtcaccttacatggcaaaagggaatttgcacatgtgattaaggttaagggccttgagatggggaggttatcctggactatctaatttgggcccaatttaattacatgagcccccaaaagcagagtgccttttccggctttggttggaaagaaaggtgactatggaagaatgatcagagagatgcaacatcgacagctttgaaaatggaggaagaggaccatgggccaaggaatgtgggcagcctccagaggctggaaaaggcaaggacatggattctcccctagaaccttcagaaagcgacgcagctctgctcacgcattggttttagagcagtgtgacccatgtcagacttctaacctacagaactgtatgacagtaaatttgtgttgttctaagccactacatttgtggtaagttgttacagcaaccgtggaaaactattacagaatgagggagccaaatacttcgagtttgggtcataaaacaaggatgtactatggtttggttgatttttattacagtgggttaataaaccacagatgaaacaaatttttttttattttaaaagtgataaaagagtctaaatacagtgatgagtgtgtcttagatgcacatccttttcctttcaccaaggaaaaagaaatggtgcttagaaagaacataaagtcttcttaaatgcttcaagttgcaggagcagtttaagagaaaaggtgctgttatttagttttgattttgatcatcgtgctgagacagagacctaaatccctcttagtgtacttctaaagcaatataagctcaaagcctaaagtgtatcattcacagaaaggaattcatctccaatctcacagaagttccaaattgctgggcatgcccgggactaaatcctcacatactgtgttacccagccagttctattccacttcagtaaggatcaagcctgttcctaacgttttaatacttgagagatttagctgaaaacattgtcttcaagaggaatttacacaatttatttatacttcagcttcaagaatatccacagcagaaaattaaatattttcacatttggttattagccccgtagtgtttatgtatttgttgatttatttatgtcaagaagaggctcctaaaaggaacaggtttgaacaagctggagtgtttctatattttttactagcttttgctatttcctcttgatcgttaactttttttctcctaaataaccacaatctcttgaacacggcaatgttttcctgaatttgtaatgcaattttcacctaaacttgtaagagttttttttctgcatctctcaaaataatacttggtgttcaacatggcacatgtatacatatgtaacaaacctgcacattgtgcacatgtaccctaaaacttaaagtataattaaaaaaaagatacaaggggcaagtgaatggaaaggtctttaaaaaaataaaaataaaaataaataatacttagtgttacagaatcaatcgacttaagactaaatgaatattgagcacatacccttgctaatatataactcaattctgagaaggaaaatgttctggtttctgcctaaattctagtcttattcttactgcatgtacttagatcagtctttatttatgtcctactgactttacaagcttaatatacatcttttaagcaaataggaataaatactttctatttttacatccaaacagttgcccctgatgaccccagcagaaaaatagatggcgataccattattttttcaaatgttcaagaaagatcaagtgcagtatatcagtgcaatgcctctaatgaatatggatatttactggcaaacgcatttgtaaatgtgctgggtaagctctcattttattaaagacatggcaaattaaattaatgactgctgttattttctgttcaatcagcaaaaatatattgagcatctactatgtgcaatgcacagtacttggagctataagggatggataagatataaaccttgccccaaagaatattgcagtcttaatgttcttccataacacagtttttacaatggcaaattcttcattgtagaactagtcaaataagctgttctacttacagatggttagactaagtgtcaaaccctcaaaaggaaaatagcatttgtctgctattagcatctgaatattattgctcttcgttgtaagacactgacaagttgaataacagtgattctgatttttaaaaactaatgcatgaatcataatgcttggcctttatccaagtcacagatgtacatttattttatttgtaaaaacatattttaaaaagtgtgatatactgaaacatattctcaaataattggcttatgtgaacattgtatttcttatattggacaaaactaccaaaataccacatttgttaaaatttttgtgagaattgttttcatggtgccagggaattatacttcagccctttaaaattagtatgcttccttttcaaacaaaattaccatcagtaagccaaccaatacttggtattttcctttcatgcttgaaatgaaggtcactaatcctatgaagagctaagcagttaagatattggtggatgttgagaaagcacttttggctgctgattcctttttcatctctacttttatgagttcagcatttttagattttacatttaagggagatcatgccaagtttgtctttctgtatctggcctgttgcacttaacacaacgtcctccaggttcatccatgtggtcatgacatgaacgacatgaaggaaatgatagaatttccttcttttttaaggctggatagtattccattgtgtgtatatgccacagtttctttattccattcattcattggtgggcacttaggttgattccatatcttggctattgtgaataatactgcaatgaacaagggagttcaaatatctcaacatactgatttcatttcctttggatatatacccattaatggcattgttggatcatatggtagttgtatttttaatgttttgagtataaacagtataaacaatctttatagtattttccataatggctgtactaacttatattccctcccacaatgtttaagtgtccccttttctctacattcttgccaacacttagatctcctctttttgataatagccattctaataagtgtgatataatatctcattgtggttttaatttacatttatctggcgattggtgataattgggcattttcccatatacctgttggccgtttgtatatcttcttttgagaactgtctagtccaatgccttgcccatttttaaccaggttattcattttcttactattgaattatttgagttctttatatattttggtattaaccccttaccagatacatggtttgcaaatgttttctccccttccataggttgtttcttcactttgttgactatctctttggctgtgcaagctttttagtctggtgtaatcccatttgtctatttttgtttttgttgctgtggttccatttattcagccatcacactcatcactctgcttttttctgccagcttatgtgttccccaccgttcctacccactagggttatgatgagtgagtcattcaacaaaaatatacttggctgttatttttgtgccagacactgtgctggggataagacaaaagtctcattccctgactgcagtggactcacagtaaatcaacaaccaaaatgatgtctgagcaagaagtagggcaggaggtagagggaggaaaaatgtatttttctgccttgagtgactggcagcattatgcctgatagagaacataaggagagagatagattgcttgtgctttaccataaactttaatgaccttaaaacaaaatacaataaataaacgatagtcctaaaatgtattctaatatttactttaccttttaaaaatatttgtagctgagccaccacgaatcctcacacctgcaaacacactctaccaggtcattgcaaacaggcctgctttactagactgtgccttctttgggtctcctctcccaaccatcgagtggtaagtagcagctctgtgtgtttttcaatacttaaaatgtttgctaaaggcttcatattctaaatatgttgggttttattcaaaaacaaacagggaaaggcaccacacaatccattacactgttaatatattttttttttcttgtgagacagagtctcacttcattacccaggctggagtgcagtggcacaatcacagctcactgcagcctctgcctcctgggttcaagcatatctcctgcctcagcctctagagtatctgggcctacagccgcctgccaccacacctggctaattttttgtatttttaatagagagagggtttcaccatgttggccaggctaatctcaaactcgtaacctcaggttatccgcccgcctcagcctcccaaagtgctgggattataggtatgagccactgtgcttggcctacactgttaattattaaattcattcattatttcacaaatatttattaactactggctctgtgttaaatactttcatgtgtataatctatttagcagcacactctatcaagcacagatctacatgtaaatgatttttttttaaatttaaggctgctgtatttcacaatgccatggacatcccctgggattttgtgagtagtggctggagggactagttaggggatattccttgataataaaatattctgtggtatagtggggggttctataagctccaaagcagaatttgttcttaccattgtttctcttgagtacttgttgcaccaggtcttcctgacttggatccagccaagctctcccatgttcttttactccccacttcagaccatcccctttcatatgccacccgaggtttaagtcctctacctcctcctagcttgtttactttagctgaaagagacaaggctaggatggatgagcaatggctcagaaggaatgaatgaaagaaaactggaacattctttactgatcatctgtcaggtcctagatgctgtgctaagttccaactactgaggtcagaatatatgcagggttaagattaaaggaaaatttcccttggcccctaccttaaccccagagaagaaaaatggatgcttatgcagatgattttcctagtgaaggtaacagattcacactcactttgtttcatccgtttcacttctcctctctgacatacatgcctttttttcttccctggttattttcctattgatactttcaaaagtacaatccttctagccttgcaactttcacattcatcatggtcatgttgaccttgaacatggcattttatgtctgacttcaaaatataatgtgtttttattctcattgtgataatttctgtaatgaaggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcaaagaatgaagttcacttagaaatcaaaggtaaggcagaggtaatgtgtttaatttttaaatgactttgaacaaattctccagctttgccaaatggataacgatgactctgcatttcagatgctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggtatttgaagacgatttctttactttctcttcattctttctttaagctattcttgaactaaaggtctactatgtagtcaattatggtgatgtttttagtttctgaagtctgctgtctccaaaatagagagataagcattttctccctactgtaaaatatatgcacccaagaaggtatcaggtgattgaaataggaccctgagaatgtttgtctatctttgcgtgctggtctcttgtgtaattcaggatgggaaaaaaccctcaggcctggacagcatccattgttttataccttgaacagcgaagtctcaacagatgttttcattacctttctacaaataagcagaaatatgacctctttaatcaccaaagactgctcaaatccttgtcagtattttaagacactcgtttttatttggatagggagtttttcttttgattttacctaaagccagtgaaaggggaaggaaaaacaaaaacaggtagagcatttaaaagagcccaagcatgctgcagatttcattaagaatggaagaaaggtcatggcattttccagatgagaccctcaatttgacatagtagtacagagtagatatgtgttagttttagcaaagtggctataggcctcactctctattagaaggaatgctgtattctggtcgaaatcatttgtgtggttcacctacagctgacctaaaattgtggtgcctaaatattgccctgttgcttgtcaatgaccctggaagaactctgtggccttctcttttatgtgcctagagtctccatctaattttatgcttgaactagtcaattttatttgttgagttgataaagatgaaaaggtgtggtggtctcacacctgtggtcccagctacctgggaggctgaggtgggagaattacctgggcccagaaggttgagactccagtgagccatgactgtaccactgcactccagcctgggtgacagagtgagaccctgtctttaagattaaaaggaaacataaagaaatgaccatcaggttaaggtggctgaagcttttacttggaaattaactgagaagacagtttatgacttaggcagtttcattaaaataatacattaattctctatacattaattttttgatctactgagcaatttttcatgcccacaagttccctctagaaaagtcttagagagattgttcatctaaatcttcctgtttctagtgataaagcaaattattattctttgcatttaatttctcctatgagagtttatacatgtaagaaaatgacatgattttctgcagtaaataataaagtatttaaaatatatactttgatagaaattgaactgaatgagtggttttccaatgtttcttggcagcaaaagccttagtaaagccctttagtaaggctaatgctggaactattcttcgcctccttcccctgggaacttaaggaagctccttcctctccctctagagcagtggtccccaacctttttggcaccagggactggtttcatggaagacagtttttccacggacagggtgggggcacaatggcttcaggatgattcaagcacattacatttactgtgcactttatttctattattattatgttgtaatatgtatatacatatatatattattacatgtaatatatacagtgacagatcatcaggcattagattgtcataggagagcacagtctagatctagatctctcacttgcacagttcacaatagggttcaccttcctgtgagaatctaatgctgccactaatctgacaggaggcggagctcagcttcactcgccccattcccctggggcctaaggaaactcctaccacaccctctagagcagcggtcccctctgcagcccagttcctaacaggacagtacccagttcttggcccagggtttggggacccgtgctctagaggcctggttgaaaaatactgtgccagaggacatatcccttctaacccaatattctaattgattctcattgtttttcaactttaatcattcttaaagtgatatgtattttgctctaacttttgaaagtgtttaccatctttctcctttatcaaatttacagtttttttcctgccagtgaagcaattatagggtacggctgcatgtccatttcagctgctctgaatgcattctatccacaggttcactgttgacaaggatcatctagtggtagctgatgtcagtgacgatgacagcgggacctacacgtgtgtggccaacaccactctggacagcgtctccgccagcgctgtgcttagcgttgttggtaagaacgaaaacaaaaatagcacaactggcttccctgcatttggttgaaaagaaaaaataagataaaaattataaatatcaaatatttgcttgttaatatgcatgggtgagttcatacccatgtttttcttctttgaaagatgccttggaggcaataatttcagtataaatagactgtgtagcagcactgggtgaaatggtggatatgcacattagtaaccttttttgtaataaaataaggagaaatgatctacttgtatctaaaattgaaggttttttttcctaaattgttactgcatgtttatcaatgctgtgtctcacagctaagcatagggcttaattttataaccttgaataatgtacagtctttgtcatcttgtgctatcttgtatctttccattactaattttgattaaaatcctttatattaatgtcctttctagctcctactccaactccagctcccgtttacggtaaactaatatgagtcttctttctctgttttctgtcaaacaatttcacatttgcagaaagtattcataactttcttttctatgtcacataattgtgtttcttaaggaaaaggtctctgtcagttgttatgttgtgtcacccatttactgacaatgaatcatttcttcatcataaccacagatttttcaccaaattcgttgccagttctttctaaatagttcatgtgctattataaaataacttcgtttgataaaagtccctctttgatgcaatttccttttaaagtagcatagtgctttttcaaaagccatcatccacattttacagaatgaaaaagctatttctaatattctacaaattaggctttcatctcaatttattaaaagttgtttgggaaaaatcttgttttgggattccattttcaagaaatgtatatggggaaaaatagatgtttagaacaacatttaacttttatatcagagaaaaccgactcaccatgtgttaacaaaagacaaatcactcaagaaagaccaaaaggaggggcacatttatgttgtgtggctttttagaatctggaaaataagtcagaaatcatttccagaaatctttttatttagagaaccttcatctttattcagtacgtcaatacaaaaatcaatttttggcatctcagctgattttgcacaatattattaatattgtatctaattatccaatataaaacctgtgctttgtagacatttactgccttatgactgataagaaaaaaaagcacatatatttgtatggtctctggtcccctaagagccagagatactcctaggagcaaggtcaaataaaggcctggggggaacagtaactctctggatctcagaagcaccattagaagaggcagacatgcttctaggacaccttcatcccaacatgtgtctgtctatacactgttgtcctctgggagtaaacacacttatgcatgctgagggctacctccatagcatctatttcagcattctttcacaaatataaatattctttcagagccccaaaatctgttattcagcattttttttagaaagaacatttgaattttctttaaacagcaccttttatttgcctgtatttcttttttcagcagttgctttctctatttcccatgtattagaaattaagcttattatttttcatgtttgtgcccattcatgtttatgagaagaaacgctgagagtgctgatgaaccacatgtgtctgcttcactgggtttggttacaaatgctttcgtttcctttgaaaaacaagtgagcagaactcattgatgggttatcttgtgtgtgttcgtgtgttcccagcagcctcagctgtgcacatttcctttcagttgcatgctcattgactatcaagtgtgctgtgtctttaagatgtcccctctgtgaatagtatcacgagtaaaggagagcctcttaaagatggatgcgtgaccatgatgtgtgtatgtttggtctacagatgtcccaaatcctccctttgacttagaactgacagatcaacttgacaaaagtgttcagctgtcatggaccccaggcgatgacaacaatagccccattacaagtatgtggtattatttgctctatttccgatcaactaaatggccatgtttgaagcactttgtaacagtcagctgaatttcctcacaaaggtatttactgggattctctgcttcattactgatagaataaaaatatttatttatgtccttcctctcttcagagctgaaactattcctggttacaccttctagaataggacaccccttaattgctgaagatgttgactaatgaaatacactgtcatttgtgtttaagatccataaaaatcactttaaatatctaccatgtaggaagatacaccttaagttagttgtttattttgcccatttcttctgggagaaaatgttaggaggagcaagtgctgaatagctctgtcttcctattaggaaactgatacttgatgagtaaagtaacttttcaaccccctgttggtaacagaactgggcgtagataacaggttctaccttaacttccaacctaggtctctttctttccattagtccctgctacaaagttgcccattcaacaatgtgagcttctcacgttggtgacataagcctagggcctaggaaataaggaaggacaatgtcataaggatactagaagagcataataaaattagactataggtaagcttcgaagttgaattgtaaaaccaaagagatacttaagaggcagacacaatcaggtcacatgcctgaaatacattattaccttcaggcatataccgcaggaagacaattcctttctgatgactacctaagatgattctgaaatgataggtgtgttgatttattgcacctcctggtaaagtagaatatttccactaaaatttatttatttatttatttattttatttttattttttttattatactctaagtattagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacatgtgcatgtgtctttatagcagcatgatttatagtcctttgggtatatacccagtaatgggatggctgggtcaaatggtatttctagttctagatccctgaggaatcgccacactgacttccacaatggttgaattagtttacagtcccaccaacagtgtaaaagtgttcctatttctccacatcctctccagcacctgttgtttcctgactttttaatgattgccattctaactggtgtgagatgatgtctcatagtggttttgatttgcatttctctgatggccagtgatgatgagcatttcttcatgtgttttttggctgcataaatgtcttcttttgagaagtgtctgttcatgtccttcgcccactttttgatggggttgtttgttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttcattgagcagtggtttgtagttctccttgaagaggtccttcacatcccttgtaagttggattcctaggtattttattctccttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacatcccatcaatacctaatgtattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcctaaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccagctcctggattcattgattttttgaagggttttttgtgtctctatttctttcagttctgctctgattttagttatttcttgccttctgctagcttttgaatgtgtttgctcttgcttttctagttcttttaattgtgatgttagggtgtcaattttggatccttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaattcgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatcggacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgtgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgagatgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaaatctgcagaggttactgctgtctttttgtttgtctgtgccctgccccccagaggtggagcctacagaggcaggcaggcctccttgagctgtggtgggctccacccagttcgagcttcccaggctgctttgtttacctaagctagcctgggcaatggtgggcgcccctcccccagcctcgctgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgacttggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctccctattccactaaaatttaacaaaagcccctcctctatcttgtgttgtttaatggtgctcttttccctacttgagtgttcaatgtccttgatcagaacacaaattcatccaggcccagtcttctagctcattgggtacattagccagagttagctggttagatggcttggagactcttttttcctatattaaaataataccattagatttcaaggcatttctactctttcattcatttactcattcattcaacagatatttttgagtgcctactgtgtgccagacattgttctaaaacaaaatagtcaaaaatctctgtggttatggagtttatattttagatgaggatataaataagataaaattaataatacattattaagcataatttcattatatctgcatgtaaacatatatatatatacacacacacacacacacagaggactcagatctaccttcaagggcgaacctgctgtaaggagtgttaacccacagcctccatctgcttctccttctctaaggctccactgcagagttcacgtgaggccatgctccttggggtgctccagtgactgggcacagcaaaggtcccagaagtcacacgtgcctaatgcagaactcctcctgtgtagactgtactctgggctcctggttgacctggctgagactatcccagagctatactatactgtagtctgaggcttcttctactcactcctccttcccttccccacttcctgttacagatgtcagaccagcattgtggtctgaaggtcttccctccttcaggcgtccttgcttcctctcccttttttcttccatggacattttcccaaatagacctcttgcacttcttttttttttgagacggagtctcgctttgttgcccaggctggagtgcagtggcgcaatctcggctcactgcaagctctgcctcccgggttcacgccattctcctgcctcagcttcccgagtagctgggactacaggcgcgcgccaccacgcccggctacttttttttttgtatttttagtagagatggggttttgccgtactagccagaatggtctcaatctcctgacctcgtgatccacccgcctcggcctcccaaagtgctggaattacaggcgtgagccactgcgcccggccacctcttgcacttctaattctgtcttagcctttgctccctagaggactcaaactcatatatatctattaatacatatgtttgtgtttatatgtgtttagggcatgcaaaaaacaaatcagcagaaagacatgtggagctaggggtataattgtgaatagtgtgaataggaaaggccacactaaaagaacatttgaatgtgtcaatcaagacaggggagggaggtcagtgagcacactatgcagttgtctaggggaagaactttccagcaagagcaaaggaaaagagcaaaggccctaagacagggcatgtctgctaggatgccagtgtggctgcagtgaaatgaaaaagggaaagtgagggcggagagaaggtcaaagagctgaagagttcggtggtgggtgtgtagagtgggaattgtgcaaggtcctgtaggccactgtgaagatgggaaagcccttggagggttttaacagaggagtgatgaatgaataactctggcttgtctattgaaaatagtgtatagaagaacaagaggggaagcagacagactgggtaagaccatggttcccaaactgtgcactgaagtgccctgtggtacttcagtgaattcacaggaccttccttggaataattttaaagttttaacttttaaattctgatattaaaaaaacacagtgacatctgtcaaacgtcacatgaaattagcttgaggcagattacaggttcaactttatatcccatgtcattttgtgataatgttatatctctgcaaagcgtttgctgtgataaaaagcaagtgccacatggaaatcagtggggaataggaaatgtggaaggtggtgtccaatctgtttacaaggtttgagaacttatataagagaagctttacaatgttaagatataaatagatttaaaattgtttaaaattaaattgcttacatttatttaagatataaatacatataaagatgtatgaacctagctacttaatacatgaaaacattaggtaattcttttggcctaagggagccatgaaaaataaattatggagacactaagtacaccatgaaccgagaaagtttgggaactactgagttaggaggttatgtgataactcacacaagagatgagggtggcctggaataggctgagaaatggtcagattttggatgtattttaatggtacaggccattgtactaccgagagtgtggaagaagtagggaaataagaaggattccagattttgacctgggctgtcactatcaattggagaggaagattagaattagttttggtactatccagtttgagatgctgtcatggacaaccaagtggaattgtcgagcagacagttggacttcctgagtctgcagttcagggaagaggtctgggctacagatgtaaacatgaaagtcatccatttataggactggagatcatccaaagatgaatgtggattgaaaggagaactccaaggacttagttttgaaccactgcaacacatataatatttttagttcatctttgtgtttatagtgcatatcatggtacctggcacatagtaggcaatcagtgaatatccaaatacctattattttacaagggtaaagtgtgtacacaccacagaattttagtggacgcagagggtatgcactgaaaaatatgtcttcctcccgcccctgtctcccagctcctctggccacaccaatgttataggtttatattctctgagaggtaatatgcatttatatgcaagtgaatatgtctgtttatttgttgtagtaatttcgttttacatttacacaagcatagtatccagcacacacgattctataccctgcttggctgcttggtttcacttaataatacactttagaaatcattccatttcagtacgtatggaacagccctattcttttttttttttttttttcctctctctctctcttttttgagacagggtttcactctgtccaggctggagtgcagtggcttgatcatggttcactgcagccttgactttctgggctcaggtgatcctcctacctcagcctcccccatagctggaactataggtgcacgccaccacacccagttaattttctgcagagacggggttttgctaggttgcccaggttgtctcagactcctggactccatccacctgggtcttccaaagtgctgagattacaggtgtgagccaccgcacttggctgacagtcatttttaacagcttcagagtattccattgtgtggacctagtgtaatttgtttagtcagtgtcctgttgatggatgtttaggttgtttgcaattaggttgtttcaattgcaaataatactacaatgtaaattatttctcatgtgtgtttgagccatttgtgtgagcccatttattcaaaataaattgccagaagtgaaatttagtatgcgccttaaatattgacagattttctaaactgtcttatatagaagttgtcccaacttacacttcctacaaagtcagagaatgcttgattccttgtatcatagtcaacgaagtgtgttaaacctttgattattgccaatatgtttagtggaaaatggcactcactatatttaatttatcctattatgaaaaaaatttgatcatcttttcatatatttaaactttttagggatatatggattaattctaaacagttttaagtaactaaattcagcatgctagagaaagcaataccagatttggtaaaatctaaaactgtttagaattaatccatatatccctaaaaagtttaaatatatgaaaaggtggtcaaattttttttgtaataggagaaattaaattaaatacagtgagatgccatttttccactaaaatgttatcatgtgtgtttatatgttgaggataatgacaactctgaaatcaaaatattttaatggcatttttcttgaaagtaaaataattcatgtttggttgcttgtgttgggttgccctgttagttattgctggcagctacccctgggttgactgaattcacggtcttgggtttggtgtgtgtgtgtcgtgaccagaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcctctgagcagtatttgacgaaagcctcaggtaaagcgggaaagcgggacttctagggtacgaaatataataaaaaagttttccactcttcgcaaaaggccaaagcttacacatgtgtggctgcttaacttccagaaccagataaaaaccccacagctgtggaaggactgggatcagagcctgataatttggtgattacgtggaaggtgagccatgatgccttcaaatttattcgctattttttagagtgaaaaaaaagttgtttgaaaataatatctacattagaatctcatttcacctatttctggggaaaaaaaatatatatatatataaagatacatatatatctttacttaagaggcagtattatatagttgctaaaagcttgagctctggagtcaaaatgatttggtgcaaatcccagctctgccactaactctgtgatcttaggccagttgtttaacatgtctgttaggcagctgtatgatgggagtaataatagaaccaatttcacagtattaaaggagctaatacatataaagcacctagaacagtgcctagcatatacacatgctcaaaaaaatgctagctagtgttatcataaagaaccacctggggccagtagctcacgcctataatcccagcactttgggaggccgaggcgggcagatcatgaggtcaggagtttgagaccagcctgaccaacatggtgaaaccccgtctctactaaaaatacaaaaattagccgggtgtagtgctgcatgcctgtaatcccagctactcaggaggctgaggcaggagaatcgcttgaacccaggaggcagaggttgcagtgagccgagattacaccactgcactccagcctgggtgacagagcaagattccatctccaaaaaaaaaaaaaaagaaccacctggaagacatgcaccaagccattcccagcagtcaacttctttagtggggaaagcttatctgtgttttctggatttggaaaattaacatatatttactcataattcaaaacctattttagatagagccatacatgcatacttagacatgtatacatatatgtacatacttatatttatacaaacatgtagaaacaacagaatgacaggctagcctttttttaataaagaggaaaacagtctgtaagtttccatctgcaaataaaatggacaatgatgtactattgcacaaacaggaatatataaaggattctatgtgaccgaaatgtctaaagaatcaccatccttgaaggtagagccagagtttgaaaggtttatgtgatatttattgcatcaagatagtagtttacaacctttgaaatgttgatcccaaacaagctttgaatctcattgcaaatgcacaattgatagaaggtccctggagaaaatggttaatagcttgtgttttagtatttcaatgatcactttctgtaggtctgggaattgaatttgctgttcctgtaaaagattgtgcagttgatttgtgttataagctctggttatttggctttccttgtagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagaccgtaagtgatgccatttcctacttttccccagcaaaacagacttaccaaggtgcaagccaaggccatttctccttgctcaggttgcaagggagggaggtggcaattattttgcacgacttctctgaatttaaacagcctgctgtgtaagaaagagaagttcagaacgttcaaggtgattgcagtatagttgtcccttggtatccacaggggattggttccaggatgccctgccttggatacccaaatctgcaaatactcaagtcccacagatagccctatggaaccctcctatatgaaatatcagccctccatgtccgtgggttttgcacccaggaatactgtgttttccatcttctttggctgtagatgcagaacctgcagatgtagagggctgactgtattttggggggaaaaaaaaatccaagtgtaagtggacccatgcagttcaaacctgtgttgttcaagggtcaattgtactttttaaaaaatcgtgttttcctacccactgatggtgggaggatcccttgagtcaaggaatttgagtctagcctgggcaacatagcaagatgccatctcttaaaaaaaaaaatctctcacaaagtcaaacagataccccaaaatctgtgttcaagccttaataatccatagaataggtctgcagtatgcttcaagccaaaattattagagagagtcatatttatggatgaaattaaaaataacattgatacttctaccacttccttgtccttttcctagtcccaatggtggctcctgggaacgtgcgtgtgaatgtggtgaacagtaccttagccgaggtgcactgggacccagtacctctgaaaagcatccgaggacacctacaaggctatcgggcaagtgaaaggggaccttttgtggctttatttagtaagggctgcagcgaatgccacttgtcatgcacaccacaggaggtggggcttatttgtttcattgctttgtgaacttgtggactgaagagttcatttcgctcattgcctcaggtagccactgccagagttgacttgaaatctcactgcatccaaaattaaaaaaaaaaaaaaagttttctccatttttcccactgatgatctaacattctaccaactaagtatgtatacaaaatggggaaaattaattttttaaagacctagaatattaccaactctagctagctttaaagcaatatggaccacatgtgttgaacacacaaaattatcctgataatcatttaggcatttttaaaataattcagaatatactttaagaccatatactcttagctaggtcattcttataaatatccattatctttgttcttgagaagtactgaaagataaatatccattatctttgttcttgagaggcactgattttatattttttactgataggcagccaagcatacagtcactactttgatttgttaagcctgacccctagaggtcactttttgtactacatcacattcaacttttttttttttccccctagcattgccagattccatgtaaatgttgacttctcctgaaaatgcctttaaattcataagaatttaagaagacttagtaaacaacaattctggatttgtgaccaaaattaatcagtactttcttatccatctctccaaaacctgtgcctgcaatcgaatacaaaaaaaagtattttaaactaagtgatacagtttgatttagtggaaaaattctagactttcagtggaggatcccctgtggctcttgatacctctgtggctgtgaaagtcacttagtagcccacacgttcatctgcaccatatgaataacagtaataaaagcctcactgtggtgtttacaatcactacatgataggttgtacgtgaacatgtattaattctggaaaaatatgtaaacattgggcagtaatttttatttttagaatattttatacaagtaaaagacttaaatcctattgtcctccatttgcctcatgttctagagaaaaccacatgggtctcgtgctgttttcattttccttagactcctacgacaaagtagtgtagcccagctttgtcatgtggctgtaatttaatttccctcatgatctatgggcttctattcctcttgcctcagaatcaatatccatcagttttgctagtaattttcttctaaaatataccaacggaattttctggaaaaacaacagtttcaattttgtgagcataaggaatcttgtttgatcctttctgcattcctgactttcgttcttgctgtttcagatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggaggtatggaatggacgtgtctctaagatctcaggaacatatggcatggcctgagaggttttgcctgacagaagggctactgatcaaagtatattctggaagccaaatgtgattgaaatttctatagatgaatacagcacacacaaagctaccaaaatgtcagatcatatgtgggcctaagtgtacatagaaggcttcagaacccaaaatgctgctctgaaatgccctctcccgtgacttaaaatttttctccacacacactgtctgaaaccttgttactttgacattaatttggatcattaactttctgacctgaaagaggttccataacttctctgaatgtcagtagcctcatctgaaaagcatgagaaccaaattagataacctaacaaaaacacctggaaaggaaaatatttctataagttatagtttacttctatagtttctttcttagtgctcttttctaatttattagaaagttgaaccgagttagaaggttgcaagtcttgaccaagtggattgggaagaggagggaaaagtcattgcagatatgggcaactgcaagggagagagtaaggaaggaccaaatatatattgatccaggagtcaggggagaaggaatttggacacagggacaagggagccttgtgggtgagggaaagaggggcccatgtagtaaaaaggatgaggatttgaaaaggaaataaaatgggttttacctattttaaattttgcaacaatatgccactatgacaatggccagatagcttctgtagcttgcttagctctttttgataaaagaagttcacagaagatggaccccaccctggctgctgattgaaagattcatgatgcaggcagctgcccagcagcctctgagaaccaccctgcatcccagctcccatctcattgtaagtttttgtcgtcaatctcactgtcccttagagagtcagggctcttcctcctcgatgttttcacaacctggggactgtagtcccttagggagacaatgaatgggtttaatgagctccatgagcctcctaaaattgtatgcaagataaatgtatatttttccagggagtgtttatggctgtcatcagattctcaaaagggtctgtgatcccctaaagtaaagaaccacttattgggttggggaagcttagaagcctagaactatgtgccaggcatggttttaggaccagacaaagacatctaggggcctaaagcagggaaatgacaaagaagatggggataggaagaaatggatatgatttagattaaggaagtggagttagtgtctgaggagagggtggaaatgaggcagatagggaagttcaggttgactctggtttttggctagagtgacaatagggagagtggttccattagttagtttccaggggcagtggtaggggaggtaaccattgtgagagagagctgccaccagccatcatcctcatgaggaagtgaataaaagatgagcagacatgtttcctctggtgatttgccagcctctgccacagagaacctgagacccctcgggccttccccagggctgggggtgtgccaaggttgggcttttgtccattcaccaccagatcctgggcagctgtcagctctcaggataagaacgtttctgcacctgggcatgctggcccaaagcccagcaggcagggcattctgactgtttggagacacctggtttgttagagaaaacagtccttaatggtccagaacacagctgcttccactcagatccagttagaatagtttcacttggtagctagtttgcttctattaagacaccattcatgcgtcagacaagtactgcctctttttaaaatattaggtttgagtccatctaaaggcaaagtcattatgtgttttgagaggatggttttattaaatataaatgtaaatgacaagagagaaaaaggaagagaataactaaatgggtgcctgtcacaggtttgtactaatgtattttcagctgaatcaggaatgagttactgaaactcaaaaccttgaatcgtgcgagcacggtgaaatgtcaatttaatacatgttgaaacattcagaaatctttgtgttgactgtaagttctcactgtaagtccccagtgctccctcgtctttgaagattgtgaatccaacactggactctctcactttggaatgggatccaccgagccacccgaatggcattttgacagagtacaccttaaagtatcagccaagtaagctgttgggaggaagagaaggggaaatatgtttttttattttatttattattttaattgacaaataattatacctcctcatggggtacgtagtgatgtttcgatacatatagtgatcagatcaggggaattcgcatattcatcttctcaaatatttatcatttatttgtgttggaaacatttaatatcctccctctagctgtgtaaggaacaccagaacttagtctttgtatctagctatcattttgtatcatatatatatatacacacgtatatatatatatacgtgtatatatatatacacgtatatatatacacgtatatacatatatatatatatatatatatatatatatatatatttgagatggagtctcgctctgtcacccaggctggagtgcagtggtgagatcttggctcactgcaagctccacctcccgagttcacaccattctcctccgtcagcctcccgagtagctgggactacagacgcccaccaccatgcccggcaaattttttgtatttttagtagagacggggtttcaccatgttagccaggatggtcttgatctcctgacctcgtgatctgcccacctcagcctcccaaagtgctgggattacaggcgtgagccactgcgcccagccttccctttaactgatatctccctatctcgtcttccctctgtccttcctttatttctgggatcctgtgttctactttttacttctgtgacatgaactttttttagctttcacctatgagtgagaacatgtggtgtttaacttaactgttatcaaaaaatacaagctagtttttctttatatctgtagaatatatacatataacttcaagtgttgtttcagaaagaacttcaaatcttactttttaaagaaaaatgatgtctatgttattaaaaattaagtaatctgtagaataatacagacctttaggagtggggtttaggtgagtcctgtcattaaatcacatatgcattttctacaaatagaaaatggttcctttggcaaaagtcctctgaagaaaaatgtttggggttatttaacaatacaactccacctgcaagaacacaggggaaaaaattctattgtgattcaaccacaacattcttctagtttattagccaatagagaacatactacccccttgtgatatatgatatgaaatgatatgatacgatatgatagaacatagcataggagctgttaaaaggttatcacttagttatgctggggaaagagtgagtgggattataaaagtcaatgtaagccaggttgaacatttttagttgacgtatttatttataatagtattcctatagcagttaatggagaatgcacttgttcattatttcttattgacagttaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaaggtaagatgggtatgtataaaatccatataattataagcatcatgaaataaaaatctttaagtttatgctttttccttcttgctatggaacgtctgtcttacctgattaacgcaaacacttatttgtaatttctcattctgatatataatcagctatttagttcatattggactgatatttttcaactccatgtgaaactttcttaaacttacattaaaatcttggtgtgggagtgagtaagcataatatttgccacacttgaatttgaagttcaggggaatgttgtttcccgtttacaactttatatattatatatattcatgcacaaacatacatatgtacacatacacataatacacacatatgcatacacagacatacacatctatatacacacaaatatatgtaattcgagttctggtcctgatttactggaaaaaattttctagttcacatatcaatttacattttctagcaaggaaatcgaaacagttattaaagagtgcatttattttgtgtttgagcaaaagattttgcattttggtatgtacaaagaaagcaaaatagcccattatggtatttagaaaaggaattaacacttcttttcatactttaaaaagttattctgaaatcttgagattcaatgaaaattatcaaaaatattataaaaggttttctagttttgcatgtctctaaattgtagagttgcttaaggattattcatttgactatctttgatagcataaaaaattgacaatttctatccaaaaattggtttgaaatatcctaagccttcatacataatcaacaagtacgaataatgcaccttaagtaatgtgtttgaatactgggtattcaaactgggtatcctgataaaatgttggtactggatttgaatactagataagtttggggacaccaacatatctttgtcccctatacctgatgtggtacacttcattcttcttgcatgctttagcattttaataagtgtttttgtatcgctatacatgctcatgggtgtgttacatctaactatatagtgtcctatttctgtttcccttcattaaagctggtattcttccacctgatgtaggtgcaggcaaaggtaaaataattcatctgcatgactttatacatgtgtgaaatttgcaatgtgaaacatggggaagtgcagcatgggtaaaacagagaaaatatgctttgaaccaccaaaagaagagaagatctcatccaatcttggctttaaaattaatttctagtcctttctttacaagtagaaagccacatattgaattctcaaaaaattttttcttgagacttatccctggtacaaatcctaatcttagcttctaatactatgattttggctggatcagacaggaccaaaactgtgtatttgtcacagatcctctatatggccatgccacattatttggggttcagaaatattagccctgtgatgaaaacagcctggtagaaatcagatcaaccaagcttcctgttctattctgatttagctgctctccttgtagacacagtgtacactcggctgccattgcacaaaaccgtccatttggaattacagcgtagcaatgccctccaactggtttgggactaagtctccccgagcttagggtcccctgcaagtgagtcttccaggtgacccatatgctcttctcaaatgtgttatcccacccatcctgtcttcacccagctgcctaagtctcttcctcctgagtaatagccaacaatccacaatggattttgttctcctttatttctgacagctctctgggtcagaaagatttgttgggagaatggtgcttgaataagttgtaatatgtcttccattagtggcaatgccaaagatgccccagtctttgacccctggctgctggttgaccagtcagctttttagagagcagtggagtacctgccactgggcactgttttcacgtggcatgcccatggtcaggggctttcgcacatcaggtgagtataaacaggaatgaagaaaaggaagaccaagagaaaaatgtgctttgccctatgttattcaactcctgtgagcttagacttgatagatttattctatttgcttagaaatttgcttatattcagagctttggtaaattacaaaatatcgatcagatagattttggagttattgaataaggactgtagccattttcagtaatcttaagagtattatatttgtgtttttagccttgacgaagttgtaaaaattcaaaatttctatatcacagagcgatgtaaacttacttctatttatttgtatacttccttcctatgataattagatatcaattaaaatcattagtagttttacaataatatattgctttataacttcaattggagcatttcactaaaagcctggccttgtttcctatgcagtggacatgtcactgtggctgtgcctagagctgatagcagagaaattgtgcttcagcaggactgtctgtgaagcaagtctgaattctcagtggacttgtcacgttagaagtagatatgcactccactggaaaaacatcacccctctgtttttaataaattaaaactaaattctatatttaaagagttttggttttaccatttgatgttactaatttgaattgtgagctacttatgattagagagacaagcaaaaatggagtgtctgaaagttcattaagcccccagtattaaaatctgatggatcttagataagaaaagaatagcgtttaaataagggggaaaaaagctaactctgaccttaattttaatatggtttattttaatagtatagcagtagttaagtatggcttacataagaggatattttgccagtaagactttaaactgctcaagcataatttgtgatcctgggttttccttccttaaaaatacttctttttttcaatctgaaaatgaattctatcctcttcactatttcccttctccatatggaatttaactgctctgtgacaggagaaaaattgaagttctccactatcctcccaaattttaattttttaaatgtatcttttacatttttatttaaatcaggacaatagggaataaataagagatgaataaagaggaaacatgtgatatccttagctatagaagcatcaatatggccgggcgtggtggctcacacctgtaatcccaacagtttgggaggctgaggcgggcagatcacatgaggtcaggagttcaagaccagcctggccagcatgatgaaaccccatctctactaaaaatataaaaattagctgggcgtgttgttgggcgcctgtaatcccagctactcaggaggctgaggcaggaaaactgtttgaactcaggaggtagaggttgcagtgagctgagattgcaccattgcactccagcctgggcaacgagcaaaactccatctcaaaaaaaaaaaaaaaaaatcaacatctcataagattttattatgaattatgatttcatgaaaagtggttttaattcatttctggtcaaagaggggaaaagaaatgcatctgagtttacatttttaaactttcttacagattttaagagatgttaatgaaacctaagttttcaaatgtataattacaaaaggattataaacctgaaggaaaacccaggataattcaattaactatatgatgccatactaacccttcttcttaccattctcctcaagataattacatacgcgagacctttgagtcatttatttttgtccttttctttgttggattaaagctctcaatatttgtgtaggaattatagttgattggcatattttttcaatttctatgtctctttaaatgaggctgggtgtggtggctcatgcctgtaatcccagcactttgggaagctgaggcaggcagatcacttgaggtcaggaattcgagaccagcctggccaacatggtgaaaccccatctctactaaaaataccaaaattagccaggcgtggtagtacacacctgtagtcctagctgcccgggaggcggaggcaggagaattgttttaacccaggaggcagaggctgcagtgagctggaggctgcactgagccaagattgcaccactgcaccccagcctgggcgacagaacgagactccatttcataaataaataaataaataaataaatgatttcagggtctggaattctaggaagtagactgtgaaggcatgtatagaaatgaaccaaaaatgtgcaggctcaaaaagatttatgttcccagtattgctgatgatccacaatgccatatccattgcatgtaatctggcgctctgaggaccaagcatcaaaatacttttatagggtaattagttggaatacagaaacagggataaactaactggcaaagcaggaatctgcattcttgacctaacttgcagcctactatggtcaaccaattaggagtgagcagagaagagcattgaggatcagctagtggtgaatcccttctgtgatctgactctcactacattattttactaaagaaccagtaaataaaaaataaaattccttttttggcctatacgaaaacaaaacaagacatctagaagcatagaagtttcaatcagttcaacagtgaatgtctctctggcacataaaatgcacccgtgtttgtttaagaagctgtgtataaagacagtaagacaaaccctggccttgacatgcttgaaatctggcaggtaagaccaacgtatagaaagagtaataaattaatgctaaactagaaattggagcaaaatgttatctgaatatagaggtgtgaaccattttttttgccaagcaggatcaggaaaagcttcacaaagaaaataatattgaactgggccttgaagcccagtttttgttttatttttgtcagatgagtcagggagttgcagtgtgtaaagtcttggtaggggtcataagcacatggcgtttgaaaacataccggatgtctgggttataccaagcggtccacttaggctgacttgtagagagtgtgtggaaaagagaagaccctgagatgggactggagcagtgggcggggccagatggtaacagctctgaagggccatgaatgctttgctaaggaatttgtatttacctgtaggcagagttttaaacagagaagtggctagataagagttgtagtttcagcagctaaaatgtaggtaactacactggcggtatctacagaggaagacttacagttgggcgaggcacaccggaagcagcccgttgggaaagcccagagaaaggggacactacagctcccttgtatggtacaacataggtgctctgtgagtgagaaggtggatgagtggggattaaaaggaaggagagttcgaattccctatggtaaaagtggctaaacagcatgccttaggaaattgtggtatcttttctgggtatctttaagaataagctaaatgcaaatttccagtgtataatactttattattaactataattagtaatataatgctgtacattagatctctagaacttgttcatcttataactgaaagtttgtaccctttgaccaacatctcccatttccccaacccccaccccacctctagcccctggcaaccactattctacactcgttctctaagtacgacttttttagattccacatgtgaaccccgaaaatctgagacaggtttcagttaatttagaaagtttatttgcccaggttgagaacatatgcccgtgacatacccatagctcaggagaccctgaagacatgtgcccaaggtggccagagcacagtttggttttatacactttagggagttatgacacatcaatcaacacatgtgagatgaacattggtttggtctggaaaggagggacaactcgaagcagggagtttctaggtcataggtaggtgagagacaaacggttgcattctttttgagtttctgatgagactctccgaaggaggcaatcagatacgcatttatctcagtgagcagagggatgactttgaaaagaatgggaggcaggtttgtcctaagcagttcccagattgacttttccctttagcttagtgattctggggcccaaagatttattttcctttcacacacatttaagtgagatcacgcaatatttgcctttctgtgtctggattattttacttagcatagtatcctccaggttcatccatgttgttgcaaatggcaggatttcctttttttttaaagtcggaataatattccattgtgtaaatatatatatatatggtaatttctttatccattcatctgtcaatggatatttaggttgttttcatgtcttgactattgtgaataatgctgcaatgaatttaggagagtcgatactcgtagagataatgatttcatttcaataaaactagaaacaaaataataataatgaacagtttagagaagaaactctgagaagggagcacccatagaaaccaatgtaaaatataagaagaaactaaatgcttttccgttagaagtattttgctcttctgttagtaaatgctcttgtgttagaagtattatgtttctgccttgaacatcttccatattactccaagattaaattcctgtttcaatattccaaaattttttaagaaaattaatgtttttcctgggttgccattgatgttttacacatgtgtgcatatttactgtcattgattgatcatattcctattattttacctataagaagaaaatctcggaaaactaaaattaattaggtccacagaaggactctgcataattcagtaatcagttttgccctctgctgtttccccatgcttagcacaaagagatacaaaatttgcatgtgttgttgaattatatttcagaagtcaaaagcattatttaactgctttaatatctttcttttcttaattctaagaaatgtaattttattacatttatttgaacaaaggtctttagcgtctacattttataaacatatcttagaatataattttagtgtcttggtaaacctattgatgctgtctgattgactatcctagtaaattttatgtgagataataaattgatcttcttttttaactacccaaattaacacatctgtaaatgtttcatttttagtttaagctattgaggtaggactgatagaattgcctgcctcaggtattcaaataacattttttaatgactttagatgttgtctttacccagtagcaaacatgtagcatcatctggtctccataatttggatttttaagaagctatttaggttgcactatgatttttcagaaaatgctttgtaacaaacagttaacaggtaagattgtcttgctctctaggaaatgttacatgaaatagtttttactccttttatttattctttcttaacttctgatagaacacatctggaaattccttttgcagcttctcttccaacatacccttaccatccatcattctctaaagcaggggtttcttacctggggtccctgagtttcccagtgatactcaaagaagtctgttttttaaaacagatcaaaaacgctgttcaaaggggcattctctgtcacaccaacacagattttttaaagacctgcattgagatgacaaataggtttgaaaagtagccacatagtattgggttttaccttggcgtctctgacattccatgatgacgtctgtccctgggattgttcagcaatccccctctccatcacactttagtaaatgaagacggtgacatttcccgggactgtatctaatggacaacagttaacattgttcagaacccatataatagaactcacaaattttaatattatgcgtcattatttctgattattaatttcctagtgctgaatttaagaaacaaaaacctttctgtaatgaaagcaaagcatgagtgaaccctaaattgtagcagtaaattctatttaattctatttgcacaatttcagagtatttaaacttattttatattcgtgtgtatggtgttgcaatatgattgtttgttttatttttctattgtatgtttagttcaagcagtaaatcccaggatcagcaatcttactgctgcagctgctgagacctatgccaatatcagttgggaatatgagggaccagagcatgtgaacttttatgttgaatatggtgtagcaggcagtaagaaacaatttcattacccgatttttaatttgggggatgcattttttaaaagattaaaaacattcttaagaatttactacggatcatcttgaaaaataacttgatccaattaaatgaatgagttatctaaaaaaattatagtgaaccatcagcctaccacatattatatgcacgactaggaattgcttttttatgttattaataacagagggcatatgttccattacgtatgttattttcatatcatagtacttgaaactagttctgtgcccacaacacataaacaagagtaagaaggaataattatatttgcaagtacaatagaaaagaagaaaaggtttttttttcaaattggatcttgaagtaacagaaatcaaactgacttgaaagtattcattttgccctgactagcccaacagaattttataagaaaccgcagaaaattaatactttgggagagcattcattatgttttaacgtttgatgtattctcaagtcaggcactcttcgtagatcctggccacatctactgggagatggggcagctttcactttcagcagtttatgaaaagccagtacccccctcctaagtgcagtgtgcttacatagaacaaatgaggtggccaataaatgtttgtgacaaaatgttgaacagagtccaactttctgtttaagcctttatcatgcaagtaaatgtttttagaaatgacgatccctttagaaaaaccggtacttgggaaaggttgaatcgattaattggatacgttggaaggcatttaagtttactaaaagattcatcttgtgaatcataaaaaaacaattcttcccatagttcacttaagctaattaatgtgtatcagttcttttgagaaacatctttagagaaactcaacagtttcataaggcaaggtgcagataaagaaccttcctttgtattaaagaggagaattaatacaatgggaatatatacaattaataaacaagctagatacccagtctatttttctttgaggatattttcctgtaggtcattttaattgatttgtttgacatgactacatttataataatctaaaatggtaaacctaagcatcctacatcttgtctttagcttataaagaattttcctttcttgaagcattaagtgacttctggtcccttaaaatattcaaatgtgttgtttttgcaaaatttccataggcaaagaagaatggagaaaagaaattgtaaatggttctcggagcttctttgggttaaagggtctaatgccaggaacagcatacaaagttcgagttggtgctgtgggggactctggttttgtgagttcagaggatgtgtttgagacaggcccaggtgaggctcacaccacacctgttctggctcccgctcagaggtggaggccgccaggtgctccagctggagatgggggctggtggagctgtgttatgggtagggcatgaatgtctttctatggggccctgttgggttgggagttttggtttttgtctttggttctttatatcaaatgaattacggaatttagcaaatcatctagccacattattaccaaaaaccatcagaaaaatagacttaaatatgattttaacttatattatttaaagaattcaattgttcatatcacatgtataaactttccctcagtgttaaactgaaattttttaagtgcttttgaagatgaaagaacttataagaaagtcacaattctggccgggcgcggtagctcacgcctgtaatcctagcacttagggaggccgaggcaggcggatcacctgaggtcaggagttcgagaccagcctggccaacatgatgaaaccccgtctctactaaaaatacaataattagctgggcatggtggtgggcgcctgtaatcccagctactcaggaggctgaggcaggagaatcacttgaacccgggaggcagaggttgcggtgagccaagattgcgccattgctctctagcctgggtgacagagtaagactccgtctcaaaaaaaaaaaaaaaaagaaaagaaagaaagtcacaattctttatttcaaaatggcctacaacccagcagaaccctgcagtcagcttagacaactgatacagatattattacatttgtatggaacaagaacttgtacaattcatatgctacattttttatcacaccaaattttactgcctgtatatatttacttatgtgaatattaacaaaatatgcaagtaaaaagtgaagtttctaaaataaagaaaaatgttcatgtgaaacatgagagcattcgtatttgctcgctagatggagaacaatccctgcttacttacatttcaacaagagttgtttgtggtacatgttcactctgtggttcatacccccatgttattttcattcactccatgcattcttaaagaaatgtgcatatcctgtagaatacattacacaatgtattttttgtgactttcattaacaaagcattatgatttttaaagtcagtttttacaatttagaaaaatataaatcataagtggtttttaaaaagaaacaacaataatgtattaaactatattttaaagatattcatttgctaaaatcataatgttttaagaaaaccacacattttattctgttctttgtatttcatatccatttatgtatatagtcctgggaaaccagtgtgttaagcttaaaaggggaatatctaatcaattcatagctagtttacaaggtttttgtttgttattgataacttttattttcaaaatactaaaagtcaagtagatattatcttcatatatagctggaatgctaataatagtaatgggactagcatttagtcagctctcctatacagcaggaagtggttttctcattcagtccttacaacaatcctatgatgtaggcaccattattactccacttacccctcaagtcagagaggtcgagtacctgccaggtcgcccagtaggaacgtgacagagctgggattagaagcttgtcgttccatctccagaagaaaggcctcactatacccccactgcagggtcacaaaggtccacaggccaaggaggacaggctgtctcagaaagggcagcttcggtcaacacttggtatatccaatcagtgattctggacccctgcaggctgcatgtggttactggctctggattatttatgaagaatctactatgtataaaaatgacctgttgttaaaattgttagaaatgtttaggaaaggaaaaagtgactttatccaaagttagattcaccctcaaaatcaagttgtagcatttgttgtccttctataggacaaaagacaactcctttagaaaattatttttcactcagcagtgtaatgcctacagttccagcagcaactgccagatagtttgaggtgaggaatcgtgataggtgggccttcttgtgtgccagtgatggagagacaggacaaggtcacaaccagttcttgtcactttttacatataaatgtattaaaaagaacaaatattgattcacctctagtgaccttagttaacacatcgcctgtaagagcaaatgctgccagcattctagaatgcctcagtttaccattacgctgcctcccttttcccagttcacaatgcttcatcctttggggctgctgggttaactccagtgtgaaagcaccgtcttccactgcccctgctcctgctcctgctcctcctctcctctcctctcctctcctctcctcccgctgggttccgcggtgtaaggatgtcaatatttggcatgaaagcctatcgttggctaatttttaaactctgcattcatgatctacttctctctctttctctgatttctgctaattttaggacactggactcaactttatctatagttatttcatcaatcttcctaccattacaccatctctcccttttataccctggatttctaaggtatatttcttaatttttttcctatggcacaaactgaaaaacagacgagataggcggtgtcctgatgctgcgcttcttccccgtactactggtatgacctctcattaccccaccccacctggtatgacctctcactaccccaccccacctggtatgacctctcattaccccaccccacccggtatgacctctcattaccgccaccccacccggtatgacctctcattaccccaccccacccggtatgacctctcactaccccaccccacctggtatgacctctcattaccgccaccccacccggtatgacctctcactaccccaccccacccggtatgacctctcattaccgccaccccacccggtatgacctctcattaccgccaccccacccggtatgacctctcattaccgccaccccacccggtatgacctctcattaccgccaccccacccggtatgacctctcattaccgccaccccacctggtatgactgctcattagcgccactccctgcccccgtttgacctctctttagtgccaccccatctggtatgaccagacgtgacctctcattaatgccatccacctccccttcctcttttacctctgtccctcaattacccagtctttcttatcatcacaaaggatttaaaacagatttgttttcacgaggcccaacagcttttttgtcagttgtctccaaactttggttaaggtcacattttgctcttcctaaacacatctaagcgtttgatgtctaagcatttgaacaggacattttcatccatagtgcattcttcataaatagtagagaacaaataaccatttccctcaccctgtctctcttctgtgttgattctatggttctgaggactcaagagcattttcctcagagacctcctaccacagagcacagatatccatgacagcaagcaacgccagagcagaagactgttgtaaagctgacttccagaaaacaaagcaaatctcattctcctgccatattttctgttttcatgttctttatatgtgtttaatttatcattttgtggattactcaaataatacatgaatataattttattgttaaaaaaaatcaagtaatgaagattctcttttactccgctacccagcccttcaatgggtgatatccacccactgaaactgattctagaaggaaaactcccataggtttaattctctctctgtggggtatatgtgtgtgtatgcgcatgtgtgtgtatgtgtgtgtgatgcatgatcatggttatggcttggatttgtatgtcccaggtgattttagattgtcctgaaaaggcttcatgcctattttaatcattctggaatttaaatcttttcttttatggatggaaagtcaatagaaatttttattccatttacacagtttctgttttatatcaatttctggtgtacttgtgtgtgtgtgaatgtgactgtgtgtgtgcacacatgcacctattaccatattgtgtctgcctattttaaataatagggcagtgaaatattcgatacttttttctttagacacagaggcagaaattcaaagtcagtgaatgtggatgtttgtgtaccacccatcaaacatccatccagtttttccatggttgcatagcagcaaactgccagtcagtagttcgattttggcagtcaccatccttgtagaacaatatctctgctagtacctgagtatcttgtttttccctttttagttgcatttaattagatgaaaaatgtaaatgctgaatgtatttatgacaaggctgtaaatcagcacactgaaaacaagaactatagtcaaatgcttaagagacttaatgccatttggtttttggttcagttttgaagaaaaagcacagaccaggcattaattgaaagaaatatgttgccaaagaggatgtaatgatggacttttaatacctttttgcctgtctcagaataggaagtgcctatagcattttattctttaacttaagatttttgcagatttggtatctggattgtttttaggaatgcattacagcagtataatataatggctagtagcatattttctggagtcagacacaggttgctccaactcttgggcaagttcttaaccttctctgggcatggatttatttctgatgcctacctcagagaattgttgtaaagattaaatgagatgtgccttcagcacagtgcctagcctatggtaagggtccaaaactgttagccatcagtgctattaccattgtcctcatcttcatcatcatgactatggtatgtgtatggaaaggggaaactgcctaaactgatgctttacttgtgtgtggctatgatacagctcaaaacttctctaataaggcacgagggcctattgggaaaaggctaccagcctttgacttgtatttcaaataaggtatttttgcttctcattttatttcttctacatatgtccatattttttttaaccttcctcttcacacttgatttttagcatttcctttttctccctaaactttgtatggagaaaaagaggcaatgagatgctatttttgcaacattagctgaacctgggatatgcgtagtcatgtttatttctgcatccagagatcacacacacctaactcaactgtgtaaaatatattcggaagaaattcagtcaaattaaaagcatgatataagcatgcttatagagtcaaaagaagaaaatgttttatcttgattatggtcaaaagagagaaaataaaggtcttttaaaaaagaatttatactagttaattaagcaaatctgcatgggcatgtctgaatagccattgatgctgcactttttcccataagattgatactttaaaataatacccgaaatgctcattattctgtggttttcttagaaattttgcatattatgactgatggaataaggggtttcacatttattaaacagaatagatgcaaactgaaaggatatgtatacacctaagtgagtactttcttttcaaactggtcatgtaggcaaataatgagttcactgactgagagatattccggtcttttgaatggatccttagcaataacgaatattgattctttgagggtggatttggtttttcagaaatttccactcagaaccaactcttgtgaatgagatgaataacaaatctaagtaatattttgggtgcaaattgagatgttatataaaacaatatggctgttttcctgatctggaaaggtttcttgtgtggaccgttttcttttttaacagatttctaaaaaatactgaaaatggcaacagccttgcaaggacagtttagcctctaaaagcagttcctttgaagagaaaatactcaattagatgtatacattctgttctgtttaaaactcagttttgtatttttctcattatacttaatgtaaaatgtatcctgttaacagtgaatactttaattggtttgggaatttgtttttattgagaatatatagtgaaaataactgtgaacacagtgttcaccaggggtttttagcatttaatgtgatgattattcagatttctctacttgaattttttaatgaatgaagatttttcaaagttaattattcatataattcctgattaataattgacagatcctaatttggggccacatgtaaaatatatgaaagctcacataacgtggcaattttttactctgagagactgcagcagttcccatctccccttaacctattgccaccaacaccattgatttgttttccagcgatggcaagccggcaggtggatattgcaactcagggctggttcattggtctgatgtgtgctgttgctctccttatcttaattttgctgattgtttgcttcatcagaagaaacaagggtggtaaatatccaggtaagaaagaaagattaaaattgctttataatgctacataataatccattaaactaaaaagatcatgggggaaatcatgtagattgtaatattttgtcttcccagagccatgagtttggactttctcttcaaatgacttttgatccctttttatataatggcaatctaaacattgtcaatgatcataaggcatttggaggagtaaatcaatcagttctctgaaaacattagtgagcctactttcttagactccacataagttatggatgctgaagtaacacctaaaaccaactggcaaggagagagttgcagggaaggttcatggagtttttcaaaggaagtaatgcatgaactaagtcttcatattgtgatgtgtaacattgctttccctataaggtaatggtttattcaatttagtgggcccattaaatttatattttctttacctgaccattttcccttcagtgacaagaaaaaaaaaatctgtgagagaatactcttacaaaaacaatttgcaaccattaatatagttaacaaatagattggtaaaatagggggaaatcttagaaacttaaaaattatttatcaggtgagaaactagtcaactttatgtgttaaaaaatgtacattctattgggttgcctcaaaaataactaaaataccaaaatatatgcatggccaccatatatatggttatacaacatctacttgtgtatggaattatttttcactgctgtatatctcaaagaatgctttcatggactttgaataagaaagaacaggatcaacagataataataccattttggcattttttagttaaagaaaaggaagatgcccatgctgaccctgaaatccagcctatgaaggaagatgatgggacatttggagaatacaggtgagcccctgcttctctgctcttcatcttctctgcccacatgaacacagtcccgagaatagaactcagccagaatatgctctgcctggcatctcatattttcctcaaatagaagtttagggatacttccatgtatcagtgtttacatgtccctcatggtcaaacattttcatttttcattgaaaaactaaattttgattttagtcataattttggagatggaatgtctcccactttgtcatattttccatgggaccatgctgtattgatcaatctagcaaagccaatatgctactatgagcattaaaacaacaaaaaagaacctccaatgcctgcattgtaaagaaagctatacttgttatcttctaaacatgctgtaataaaaccagtgtaaacacactttttcatctagaatttgaaactagttttcctaaacaatacccatacccttgccctttaatcatgaaatggtgactagattgttttacaagctgttacttattaagaaatgtcgtagccctctaggcaatgtgttactcacagaactttgataatacattcttggcttgactccatcattaagggaaaatgttaatataacctatgtgctaaattttttaaaaatcttctctttaaacaaagataaatcttttcaagagaaggaaaagattactttagatttgtttaaattaaacagaaacaaagtacgtatttatttaaataaaatgtgggcattctgttattctaaaagtatacctttttaaaataccttttgtaccttgtttttttctttttagaagccccttgcttatataaaataccttttaaatatgcattaagcccattttgagacattgtttgcaagatgaagaggcttttaggtgaaataaaatatttcactattgggattaccaggcaacatttgtagagaagatatttatgttaagttttacctgtctctagagctcatttttggtttttccatgtcactatcatgtcaatatcatagaatttcatgtgacataatcctaaggataaaaaatgtagaactgattgagaaaaagacatatattttcaataaaatcattttcatatcattttccaggcagatacctgtgtttttcctttattatctcagcccctaagtttttatattgtgatctcttaaagagagataactatggtttcaaaaagttctcagaatttctgtatctcatggtacagaaaaatgcatagtgagggttgtcttgatgtcagaagttggttctggagctgaaggtgtatgaaaacctcatgcagcgtccacacccagttcacccaagagggttttgtaacacattagagcagcctacagaagcccgtagcctagggcatctggatgagtagaactttgctgaaataattcacccttctacatgtttctcctgtaaagcaggtaagcttacaattactaaataacttcttatttctaagagttcttgtggctgtaattatctacaggatatgcataccactcccttatgtattgtgatgaagcaaaatctttaatgtggccctgaaaaaaaatgtatttgcatgaattggaaataaagcattgtccttcatacattctccacatggtgatgggttcctgttctacattatcatgcctcagtgaatctagcaacatactactcaccacctgggtctcaaacatcagcttgctcttacagcgatgtgaaaccatgatctgaggtcatgtgactttcccagataactgctgcctactccattaaaacttgactaaaatcaaggttgatatttgggtgatggtatactggaagcccaaaccccaccactatacaatgtatccacgtaacaaacttgcacatgtaccccctggatctgttctaaaaaatggaggttgagttttatgaactagcttggaatcaaaagactgttagttttactttcaactcagccattgcctgtgattcatagttctatgatttctgttttcttctatgagccatctactaacaactttaatagaattttgtgtctggagtagtacgtggcaagtatttggttactggcctcataagcactgtgtttacatctatttggtcatatgtctttgtcttagtgttaatttatatgtgctatgttggtaaagtgttttcaaatagctgtctttaggccttagtttctcaggaaagaaagactttgcatttgggcttcttgagtgcaaacccaattgacacgaagacaaaaacacttgtacatttgtcatacatgtaatgacataaacttgggaggtgctaagggaaataaggttctgatgggtgtcttcaacttgaaacataactcaatgatgtaattttttcaatgaaactaaaagttcataaggacaatcccacaagcaaaatcacttccccaaaattccaaccacattttttactttgatttacaaagatacggctttgtcctttgatttcctgacactacctcagaatgttttccctttggtttattttctatttgaagaaatccaaaaagtgtttattatcttagaggctgtaattaatgaaaacagttccaactgtttattaacagaatcttttatttttaatacatttaagtgtcattcacttcctgagatcaccaggttcctgtctctgttttgcactttctggaagttttgagctctgtattatttattgattcttattctctttcattccaaaaataaattattatgctgaccagacacatacaaaattaggactattgcctaggtgtaaattaattccatttctgatttgctcattctccagtttgatgatgaaaccgtttctacatggctggctctaagccagatgatatttcatagtgcaaagagggatagaacctcactggtggccaaatgtgattatatgctataaccctgtgcccctactctgacacccacccccaagcagttaccctctgttggaagcctgcagctttctttgtttgtttctttaattatacagacagtaggatctgcatccttactagcatatagaaaaatcagagaaacaatgcaaccaagagtgtaagtatttttttattctttagatccattttccttaaaaccagaataaacctaggtcataaaccatatgcccatgttacttgaactcataacttactacataattggtggctcttgccacatgaatcttgtcattcatgtgaacatgggcttgtggcaagcatgctaacccatgctcataaggcttgaatgatgccaagatgtgtcacattcgttatatacattagagttattttgctctcaaatgtgaactggcttgtgagtaaaataataatggacttttagcgagtgggtaggaaagagtatttgggtcatgaatgttacttgagctgcaatgtggtttggccatgggagggtggtaacaacaggaaaatcagacagaattatcacagatttacctgctgttgccgaattttactcagtaggatttaacagatgtgcacacttctgaacaaagtgctattgaaaaacaatttgaactccctaaaaatttattcttagggaaagagaaaggaaaggatatattccaatgatttgtctgctgtcataaaactgagggaatgaaatgttttatgttagaatttttaaaaaaattttctaaaatgcccactgtctcctctattattttacagtgaactcattctgccagtatttatgagtgcctactgtatgccaggccttgggaatattcaaaccaatagaatttggtcccacacagggagtttatagcctagtgatggatgcagggaagtaaaagaacaatgaccagagtgtgaaaagtgctatgaaagagatataactaaggtaccaagggaacagaagcaggaaggtaaagccaggtgggcagcataggaggaggatggtacagggagtcttcccaggggaagtcatgcagttttagcattgtgataggaacatttctttccactgcacaatgatcctgattcatgaatctaagtatcaagaatatacttgatattgtatcaatacttgtatactggatactttgtaggtgcatatatatatatgccagcactgtgaatatgatttatataatatgtatatattttattttgaaatccattcaacctttgacatccaaaactaataattaatgtctgatacacaccatccttaaactttctcattaaaatgtgaatgaatttttacctgttttgtaaagctttgaatactactgctgcctactccattaaaacttgattaaaatcaaggtctgctatatgtgtgtgtgtgtgtgtgtgtgtgtgtgtgtgtatgtatgtatatatatatatatatgacttttaaatcatcttctatgacttcttgattcatatcatttgggaaactctcctttcatatttaaacttgacatggcaacttcactgaatacaatgtcaaaaagttatttactatttcattacaaaattcatcttggaattgaaaaaggcaagccctcatactgtgcttctcatagagtcataaccactcactacacctggaaagttccgcgtgtgtgttgcacaaggtatttcttaggaaaaaaaaatctctctgaagtagggacctggagtggagagaagagatgtgatgggagatggacatgtatgcttgttgaacacaaacccagcactgtgtgtatgacttatataattttttctcatttaaccggattctaattattgaagtatatgatattatatcacaccacttattaaagactggtcttcaaaagatctcactgcctttgaatggcttttcctggaaagactctgttggaggagggagaatcccacttccttctcttctttcaagcacagcccgtgttgctgttgattctctcctccaccacagccgttaagctggcgtgaatggatgttttgggggagccccttcttggctggtcattaatgataactgttatgattttgtatgtaaaaacccacatgaatcaacaagcaaatattataataagagagtttagtaatgttgctcgacacaaaattaacataaaagtcttatatttctatgtatcagcaagcaattggaaaataagactttaaaacttattctagttatgatagcataaaaatatgacataggaataaagctaacaaaaagatcttccaccagtttcaagaccctatattccattccattggtcaatctgtctatctctgcaccaagactataatgtcttaataatataggttttaataagtcttgatatctgctaggtccagttctctaactttagttgtcttcttcaagaaccttttaaatattcttagcccttttcatttatttgtacatcatagaatcagcctgccaagatccacataaaaacctgctgagctgttactggaaataaattgcagctaaagggcaatatggggaaggttaacatatttactatatttgagtcttctatccatggatgtagaacattcctccattcattcagatcttctttaataactctgaaagttttattttcttcggaggtcttacacatatttttgttggatttgtctttatatacttcatgtttatggtctcataaatggaataatattttgaattttatttcctaattttttgcaagaacataagtagaattgacttttatgctaatcttgtatcaagcaacattattaaaatctctttatattctaacatttacctgtagattcttctggattttttatatgcacaatcatatcagttatgaataatgatagcttcctttcatctatttctttttcttatcaagttgcttaggacttttaattcagttttgattagaagtggtgatagcagccatcattattattatttctgatttcaaacaaagttttcagtgttcaccattaaggatgatgtttactttaggtttcttgttgctacccttaatcaggttaatgaagatacattctattcctaatgttaggaataaaaatacattctattcctaatgtttttatcatgaatgggtgttgagttttttcatatacctctttctaaatttactgagattatcatatttctattttcttctgctaaaataatgaattatatgaattgatgttttaatgctaaaataagcctgcattcttggaataaacccaacctggatatgaaatattatctttttcatagattgctaaatttggtttggtcatggtttgtttggggttttttcatctatgttcatgaatgagattagcctgtagtttgactttcttaaagcgttcttattggttttggatatcaatgttatactagcctcaaaaaatgattaaaggagtggttctcatgacatattcaaactttaatatctcaaaatggaaccattgattttcccctcccaacatgctccactccatagtaacagtacttccaagcttcctgttgctcaaaccaaaaatcctggcaccatctttttctctgttattccatatctaacctatcagaaaatcctgttggctctaccttcaaaatatgttcataatctgagcattttataccacctccagtgttccactctggtccaagtcacagtcatctcactcctggattattgtaatattctcccctgactctatagagcagaggttggccaactaaatattttagactttacaggccgcgcggtctctgctgcaactctgcaattctgctattgtagcgctaaagcagccatagacattatgtgataaatgggcgtggcctaattttactgtagtttaccaaccccagccctctaaggtaggctattctcaacactgatggcagagtagtgcttttaaaatataagtcagagcatgtcacttattctttgaaaaccctcccagggcttcctgtctcactcagagttaaaggcagcgtccttacaatgttccacaagccctgatttagccgtgccactccccttacttaactcctacttttctctctctctctctccctccccccagccacaccaagctccttagtgttcctagaacctgccaggcttcccctcaccccgagacatttatactgcttgttactcctgcaggaactgctctccctccaactattcaccttgctaactcaactcttttaaagttgttgaccagatattactgcttgatgaggtcttcctggacatcttattaaatgccagctctccatcccttctccaacaccttctgcagtctttactcagctctatactttgcatagtgctaatcctcttctgacataatatatatgtaattttttttattatgttgattgttaattgtattttcttccactagaaataaagccagtgaggtgagggttttagtctgttttgtttgctgctatattcccagtgccgagaacaatctatcttagagtagtcactcaataaacatttattggatgaaggcatgggtggatagatggctagaccaaagaaatgccacagatgacaaatttccagcagtgtattccttgggacactagttctacagagcagaataagactagtcattggaatccaggtgacaaattctgcctgttattgaactcttcagctgaattaactgtcacactgaaacatgaactatatttcacaagaaggatttaataattaaaccccagagatgttgtgtaggctattttcataacaggttagacactcaatgctatgtcctctgaaatgctcacaaacacagaccaccccaagatgatacctctccagttgtttattagcagtggtgaaaatatagtttattcagtttgcaataagaaattgtgtattactgaaacaggttgttttcagtggcatatgccagtgtcatattatgctagcattatttcccagtcttcagattttcttcttggagaaaaattgaaatccctagtaaaagttattgtgaaaagagccaggatacttgtgcatcttgaaatgtttgtatcttggcttgaaaaaaaaagtcactgtctgaaacagagggagcagtaaagtcttagcagaaattgctagattaaatactgcagccagtgataccttttgtatgttaaggctttttcatttttacattagtaaaaatgtatatgtttcctattttgccttgcatttttgttctttgaaagaaaacaaaatgttagatcctgtcattgcctttttctatttttttcccaaatgttacctattaaaaaataggtcaatatgcataactaggtatttgaccgtatgggtgaacattcaaaaacataatgattactctttgtcttccagaaattgtgcttacgggttcaacagagaaataagcaaaaattgtaataatggaatcttgtaaagtcgtattaaagtacactcctcagattcccatccagtatagtcaggctgcataacacacaaggaagaagggagctggggggttaacatgagtgtaggaagcatttgctattacatgtttggagtcattcacattctttagaatatattggcatgccattcatagtacaaatgtagagcttttaagttaaagtgcgtctctttccagattaataaatctttactcattaactaaaatttttaccaaaaaaacaaaaaaatactgtgtactatcagtataaggattttgcttttcttcttaggctgttttcatttgtttcttctgcatccttttaatggaattttgtaggtctcttgaaaggtaaggttgaagtttacagtctggcctgcattgataacaaaattatttgaaatgcaggattttgcttctccttctggctcagaaaaaaaaaatccacatttcacacttaaccaaaatcatggtccattcacaaccaaggaatcagagatattatgcagtttaacatactaacttctttacttgccataagcttttgcctttttgaattcaaaatagtgatgatttttctacttttctgaattctttcttatttaatgcttgtgattatttctggattgctttcaactcaggaatcagaatttgtcattgaaattaacaaacactattgggagccatccactctactgaagacttcatgattcaaccatttctgctcctgatttccattccaactcatcctcgtcattggagtcaacctgaaaattagatttggccagagaagcccaggactccaaatgctttctcataatttgcatgcatggtctttaaaaacagaaaatgttacctaaatgccaatcttgacaaaaatgttttctctttcttccagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagagtgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacatgcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaacagtcttgatctctttgtgacttttaactttttcaaacatatattgcctaatgttttaaaatggtgaaaaattttattttttactttcaaaaggctgttctatgcagagaaaattaaaacaaaatataaaacagatctaataggacatatcaaaaacatttgaatgaaaaacaggactagatattcccagccttttgagaaaagttcaagaaatcaggtggtgcctcctttcccaaagcctggctcctggtgtctgcctgggcccggcgcttctcttctgcttgcctggactctgccctcccgaatcacaggcgacttagatttcttaactctcctgtctgaagagggacactacaggtatcgaatgtatgtcaccctctcccttctctccacccccatgcttctaatcttctcaaaccctctggcaaacagccaagccctggcgtgttcccatgttccaccacctgccccttattctccagccccctagtcccagcatcacactgacaagacctcctgctggctcagagctgccctcctccatggtgatttgcatcacatgttatataagtgaaccttaaagtgctatgtagagcttggtgtttccacctggagggcatgtctgtcactcacttcagaacagcacttcagggcctctcctcccctctacaacgtccgccaaattcacagtccatagctttgtcctcatcatcagtcctggggctctttagcaaaaagggtctggagaaatgcaatcttgaccccaaaaagcattggtccattgatggtatgaactttcttgttcagatggcttacaacaggcctggtttacctctaatggctgattttgttttgttttgagacagagtctcattctctcacccaggctggagagcagaggcactcactgcagcctctgcctcctgggttggttcaagcaattctcgtgtctcagcctcccaagtaactgggattacaggtgtgtgccaccatgcccggctaatttttgtatttttagtagagacaggggttttgccatgttggccaggctggtctcaaactcttgacctcaagtgacctacccaccttggcctcccaaagtgctgggattagaggtatgagccaccgcgccccgcaattttggaaaaggcttatggaggcaagggaaaagaatatgaagaattcttacccaaattaagcaaatccctcccgctcaggaaattttcctacagattaccaccagagggctcccctgctctatgcagtgtgagagaaacctgcttgcaggaaaaagtggcctctggacacagtgcaaaccagttttgataatcagcttgtgatctgatcatgcaaaaaatgattgcctgctgcaacaggggaaaatgggatttgcagctttctctgacgagtccacagcatccagggagcaagcatgtgtccctgtgagccttgttaagcttcttcctcttaatgattgtggcccgggaggttcggtattgggagaggaaggaggagtgtgcctcctgggtcctactaagcatccctatcacggctgcaagtcggtagggatgaggagaggcacgtcattaaaatggcatctccctcttctccagagtatgctattttatctgccaatggtttgatgttttgtgatggtatagcaccccccaaaaaagcacagtttaagcacagctcttttcactaaaaaaaaaaaaaaaaagcaagagagggagagaatactacttgaatatttatactaaataaataaatagttcctaggtggaggtggaaaattcactggaccggaaagagatggggatttgtcatagcaacataaccccaattacttcaggaagcccccaaacctgtgaaattaacctgtgctcgcatctgcgcttgcttacagagaggaaggccggatgccagtaaccatgaagtagctcagcagtactgccccgacctgaattcttgcttcattaccatgctaagacctctgcccaggggccagaaatgtac

SEQ ID NO: 17368 - DNA, 9076 bp, Human
ctaattcaatttttattttgtggattacacaagaaaattttttaaaaaccctagaaataatacaacttttactaaattcacattttcagtgaaaaaaatctttacaattcacttgcattattttttccttcctaaaaagttactgtaaggtccacaaagtttagttaaaaatttcagtgtggggttataccccatctccaatatcaaaggccaaataaatctgggaaatacggggttaaatcaagttcaacatgatcttttgctacaaacattctcagagatagagccattagtacagtagtatttccctataaactgaaagtggattagattgttttcctcccccaaacatctctttgcatcttgagcctgggcttcaagggagacaatcctggaaatattgccatggattgtgaattacttggggttatcagtttttttttcttttgagacggagtttcgctcttgttgctcaggctgtggtgcaatggtgtgatctcggctcacctcaacctccacctcccaggttcaagcgattcacctgcctcagcctcccgagcagctgagatcacaggcatgcgccgccacgcgcagctaattttgtatttttagtacagacggggtttctccatgttggtcaggctggtctcagactgccgacctcaggtgatctgcccgcctcagcctcccaaagtgctgggattacaggcgtgagccaccgcgcctggtggggttatcaattttttttccattaattaaaatactggaaagcagccgaatcattaatgaataagtccttcaggtctaaagtaaaatgagcacaaaacaactgctgaaaatctgaaccaggttagatctaaatgaattgtttttaaatacaagaaaaaatggaaatgcagtattttaaatatgttgcttttcatgtgttattaatcatgtgagtactattaacatctccatgttacagatgagatatgtgagacaccaaagcttaaatactttccaagaggtcattaagctacagaatagtggaaccaggatctagcattgaagcctggacccctaattattatacgacactgcttgtctgtacttctgaataaaaatcagtgcttcagtagtttgatggaaatatatcgtggctctagtaattcagagtaacagaataaaaccttgttctccgcagagtatctacagccctaagcagaagactagtttataattctggctctgacactaaactttcaaggtcggttacctaatcattccgggcctcagtttcctcaggagaaaagtgggatgaaattatacctatgcgacctacctcgcggggggtgtaaattaactttgcgtgcacctttccacttcgcaggtttcacgtatcttaaatggtggttaatgttgttcaatgaaatgagatcacgtgaagtggggaaaagactgaaaaccacagaagcccgcgcaaactttactgttttaactgttaacacccaaacaggctcctgggcctcgccaccagccagcagtcctcgcgcaagaagggcattgctagctaaactgaactagcgccttccctccgtcttgccgcgggcgacgggccacgtacggagagctgaggactcactggcagagcggacaggagacacccaagcccaaaggccacaggtccaaggcctcacggcgaggctgacgcttctgctccagaaacaacttacggataaaaactcagcttccggtctttattgtttcgtccccggcggttcttacaacaaatcgctgcgcaatagcggggcatgactcgggtgaggcccctggagaccggggccggcgacggatgcagggcggccctcctcactgaggatgcgccacaggtccaggcctctcgagcccctgcgcctgcgctagcattctgccgggaaagccgcctcgtctgtcgactcacttccgcctcctccggtttaagcaccgccttttcgggggttgaagccggaagtggcgcacagccctagcagcaacaacagttttccacgtgcgcgtagggcgccgggatcacgtggggaggcagaagccaatggggaagcgtttcgtgtaggtcttctgaggtggtggcgccagcggctacctcctgcctgtgaggagctggctgagaggggactgggcgccggcggggaaggaggagcgctaggtcggtgtacgaccgagattagggtgcgtgccagctccgggaggccgcggtgaggggccgggcccaagctgccgacccgagccgatcgtcagggtcgccagcgcctcagctctgtggaggagcagcagtagtcggagggtgcaggtgagggacgaggccggggtcgtggggaggggagttcggagggtccccgtagcccaggcctgtctttgtgagctgacttggcctcggtgtccgccacggtcgccgcagggacaatgggctgcatgtttttggccgagagaatggaagaacggagacagccgcatcacagaatcgtgttttgggttgtggcgccggctttcacgggcgccggattagagcccgggtctcgggcagcttctgcggcggggcctgggcgggcagggaaagtgccagtcgcctttaggtgaaggttggagggtctagcccagccgcccaccgaggctggggaataaggcacgggctgctggctggcggggccgtcttggggatgagaagtctgtacaatacaaaactagtctgctaaaaaaaaatcattagatgtccaccttgagaccgtggaataacgtctgctgaaccagtgaggcgcctccctgtcagttttagatccgccctttgactagggagcaacctgcagttgacgcagcgtccatgggacacactgttgtgttccttaaaccgagaagtggttcttgattcttggtacccgtgactacgagtaactctctggaaataagtaatctacctgcctgctaattactctcaggaaaggccgctggagaggaagccaggcaatttccacaaaccgtagtgtttttcgtcagccttattatggcattataggttactaaggactctggtggtcccgtattcaaaaaacaggatccatcccttcgttttgaatctcaagtcattgaatacatattgtcaagaattctaagttaacatttctttaatggtttaaaggtaaaagaaatattttaactactgagtttgtgaaagtaagaatctgccttaaccacagtacaaactatcaaagttcatttttctggcagctttagcagaaatcttaaattctgttcatcatgagttttaaacaatatttagccatgcttcctggttaaacatttgggatcttacatttgggaaaaagacaacattctattgtattgtcagtattagtattgtgatattaagattctctatttgcagtccttggctcacctgctgaaatgaaagctgaatttttggagcgagattaataatactaatttagatatactgggctatttaccttggtgcgccaccttttttttttaatgttttttttttctgtgaagttaaatacattattactttcaggatatgaagtcttgaaaggaaagttgggatcttatattatttggttttctttttttttcttacaatgcttgcatatgatgaatcttcaatataaactggttaaaagtcagttattgataattttctatctcctctgtgtatggccagagtattagtagacagacaaagccaagaattatttttgttctcaataaggttaagccagtttgagagttataaaactaaaagtgaaattacatgtggacaggtaatagatactgtatgcttactattttgatactgcattaggtttaccttgtgttggatttcttttaaaagaaaaacgttttaagattagctccatccataacatttttttttcttttctgttttaggatattagaaatggctactccccagtcaattttcatctttgcaatctgcattttaatgataacagaattaattctggcctcaaaaagctactatgatatcttaggtgtgccaaaatcggcatcagagcgccaaatcaagaaggcctttcacaagttggccatgaagtaccaccctgacaaaaataagagcccggatgctgaagcaaaattcagagagattgcagaaggtaaataaatgacaatctctgaagtgtcatgggtattaactagtaaggagaatgatagctaagaagtgtttgtatttgaaggttttgtggagatgggaggtggagtgggatttatgtataaatattgggtgattctctgagattattttcttatcacagatgctttgattcctgaataaatatatgaaagaataatagataattttattggtatacgtatctaaaaatattgaaaatctattctatattatttataagatcactgttgcttctatgacaaaaaagaattttaggtacccaaaattcttatcaactaacttatgaaacagaatattttacattttaaacattaaagacttaaaaattaaactagactctaaagtgctttattcacttgatctgcttttcaaagccatatttgtcttcaaagaaaaaattggaacaaattttgacttcagactagctctaaaacaaattgcacctgctgagcattcagtaattattgttggatggaggtaactgagtagggagttagaattaaacagtttactttagtaaggaggtgcaaaatcttaattcctattaattggttatagttgatggtttaattttttaatacaattaatgatttcacacgaataatatgaagattaaagaactctgattgttgcccacatgtttatttgtagtaatggtaacatttaataactttattgagtattgcagatggcattgtgccaactgctgataactcagcagttaataagacagtttctgctttattttataattttgattaacttgatgcttatatttgtagtgttttgcttttatttctgatgcgaaattcttccctaaaataatagtattcagttcacttgcttgaagagatttgaatatatgtaattttgaatattttaccttcagttactaaaaatatttttgtcactttcagcatatgaaacactctcagatgctaatagacgaaaagagtatgatacacttggacacagtgcttttactagtggtaaaggacaaagaggtagtggaagttcttttgagcagtcatttaacttcaattttgatgacttatttaaagactttggcttttttggtcaaaaccaaaacactggatccaagaagcgttttgaaaatcatttccagacacgccaggatggtggttccagtagacaaaggcatcatttccaagaattttcttttggaggtggattatttgatgacatgtttgaagatatggagaaaatgttttcttttagtggttttgactctaccaatcagcatacagtacagactgaaaatagatttcatggatctagcaagcactgcaggactgtcactcaacgaagaggaaatatggttactacatacactgactgttcaggacagtagttcttattctattctcactaaatccaactggttgactcttcctcattatctttgatgctaaacaattttctgtgaactattttgacaagtgcatgatttcactttaaacaatttgatatagctattaaatatatttaagggttttttttttttgacaaattcaacattcaacgagtagacaaaatgctaattatttccctgattaggaaagtttctttaaaaaacacgtaattttgcctagtgctttttctctacctgcccttgggctcactaatatcaccagtattattaccaagaaaatattgagtttacctgattaaactttaaaagttaattgtagatttaaattgtgtgaacctaatgatttttgcagtgaaacctttactaattcaaagttgcatgttctatgacatctgtgacttgcgttgcagagtgtacatgaaactgtataattgagtcattcagtaaaggagaacagtatcttggttaattgctactgaaaggttgagaaaggaatggtttgatatttaccacagcgctgtgcctttctacagtagaactggggtaaaggaaatggttttattgcccatagtcatttaggctggaaaaaagttgaaaacttaacgaaatattgccaagagattgttatgtgtttggttccagcctaaaaatgattttgtagtgttgaaatcatagctacttacatagctttttcatatttctttcttagttgttggcactcttaggtcttagtatggatttatgtgtttgtgtgtgtgtagtttatcctctctctcatctttatctagagattgactgatacctcattctgtttgtaaaaccagccagtaatttctgtgcaaccttactatgtgcaatatttttaaatcctgagaaatgtgtgcttttgttttcggatagacttatttctttagttctgcacttttccacattatactccatatgagtattaatcctatggatacatattaaaacaagtgtctcatacaacattgtatgtgagagaaatataaatatttacaacctgatattcgttgttgttttattgttaaaagtttattatgcaactctggaggtatagagggcatataagctatgggacatatgctgatcacaggctatattcatgaagttacttttgaccaacctgaaaactgataggattttgtttgtcatttggtaatttctactgcattcttaccatccttctctcacaaattttgatagcttgaagatctttttaattataattttgttgtatttgtttcctaggagcaagtgttcctgctgccagttctttcctctttaggcgtggttgagaaaaagcagaaactttacataaagctgtatttcttaatcatctttaatttgaaacttaagaaaatgaatttattctgttatatttatgtaacttatttcctggaagttatatctactagttttgtttgataataataaaattagctataccttgaattttgggctgaggattatctgtagcctattttaaaaaaaatcaagttttgagacattccagtaatatataaagcagaagagtgtggcttgggagataaatcagaaaaaccacaatcaggatgtcctggagaagctttaaggattggatttgggtgagggtgcagaattcattcatattaatttattgaagaactgcattggaaagctctgctcttagctactccctccaggtaaacagttgttaacaaaagtaactttttcctcaggcaagggactaaacaagtcttgaaagaatggggttatttgggggaagacttacccattgagggtattagggtgtgaggtgaaggcagagtaaaggtgaagtgaattttcacttgaaggtcaagggggtgctggtgagaaatggcagcactcccagagtaaagcctccttatgttggcttggtgggaaacaatttctctgcatgcagaccacatactcacctgtgggtacctgctggttaaaaaaccctgacaatttagccgggtgtgatgacatgcacccataatcccagatactctggaagctgaggtgggaggagttgaaggctgcagtgagctatgattggccactgcctgacaatttactgagaaccatcgcttctattcaaaaaggaggtctaatgcagacacataactgctgaagaaactgcttttctcagctatctgtgcaatttgatctaatccttcataaacacatactgatgtccaaagaatgtcagacatttaaggaaaactgatagctaggaaaagaagccccaatgattagccctgacaatgtaattcagagattgaatttaagattctagtatcagatttttttaatagaatattgcatcaacagataaggacagttcttgtcttaacctgcttacttcaggatttctttaatgatggtgtcagaacagatgaagtaatgtgaacttacatttggtttacatttacatctaacaaccaaagtcaatgggaggtaacagatgtgtggtacatgtgtttcctaccatgcaggcctactttttcctttgaaattcatattcttcctcatatctcaactttgttactcaactccctcgcaaacttctctccagaggttgccctaatgtggagctacctaaatttattgtgcagttctttttactgttactcattatgatacaccgtaactggtgagcaggatggtgggggtgattacattcttatggaaaaagacaagcaataaccatatgaataaattataaactgataaagtatggaaaaaaaatgtagcacaggagaggagaattgtgagggcaggcaggttgaggatgtgttgcaatttttgacaggattgtcagtgttggcctcattgagaaggtaaatttgagcagatgcttgaagggaattgtttgtactgaaggtggaagcatatgtgggaagttgtaggaatggcaaagaagtgcgcataactggaggccagtgagcaaaccagagtagaaggagatgaattcatagataagaggggttgaaagcagccctacagatcacctagggccttgccaacctttgtaaaggatttgattttggaatgtgatatggtggctgagcttggagcagataaatgacttgatctttaaatcattttaaaagggtcactccacgtgctttgttcagaatagacagaggggcaatggtggaacaaggagagagtttggaggctatttcagtattctaggatgagaaattgttgcagcttgtgcatcgcacgagggtggcagcagtggaagtggtaggaagtggttggattccagatgtattctgcaagtacagctaccaggatttgcttatggattagatgtaggtgtgaaagacagaggagaaaactatgattctaagcttcatgttctgagtaactggaaatacagagttgcctttaagatgggagaggctgcagaaagaaatttaggaggaaaaatcagaagt

SEQ ID NO: 17369 - DNA, 61178 bp, Human
ctgtccttctgccagccttaccccactccttaatcctctgaaccagcaaaccattgccaagttctgatgcaaagtggtttataggcctgactggaccagactaaaagtgttcaaaatagcaagcaacaaggagcagaaatccatattagaatgggatatggactatatttatattggtacagaatgccttcaataaagagttgtgagttgtgtaggtgagttgccatggagctacaaatatgagttgatattctgaaatcctagacagccatctccaaggttaagaaaaatccttatgcactcacttgcaaagatatccacagcatgctcttaatggagaaaaacaaagccttagatcaaatatgtaaagtaatttttagttttttgaaaaggtatgtttgggctatagataaatctgttcaaaaaacatgagagaagataataatgattgaaaggagacacagtgcttgccctcaagaagtttttgtctagtgagggagagaggacttgtatgtaaataaaattgtgttactaaggtagatagtgagaagtaacttaagagaggatcagataaggtattaagagaatacagaaaagggtctggattaattctgaacagcatcaaagaatgttcttgcaagagatagtgttttcaccagatcttgaaggtatggatgagggtatacagagtgagtatattcagattctactttaaaacaaatactttcctctgttgtagtggagttgagctatacatccaacaataatgaaaaaatacacgcatatatacatatatggagagagatacatattttagtacatgtagcaattgattaataaatgtacagtttaagtcgcatgcaaaaccttggagtgatagcaaacttcattgtaggatgtttagcagcatctctggtctctactcactagatcccaatagcatctccctaggtgtgacaaccaaaaatgtctccaggcattgacctctggaggcaaaaaaagccctttattaagaaccagtggtatacataagtaaaacatacacaagagattcctcccctcttctctgtatgtgaataaaaattgcaaagttcatgacctggattttccttttaggtttcttctttagtggttcttaacttcattgggtgaagtaagcctttgaagatctgttgaaagctgttgactcattcacttctcaggaaaacgcacatgctgactaccatttcagagaatttgcatcagggttctctggggaggcgttctgagttctgtttccaggagctcgtagaattgtcatggtctgcatatgcaaggcaggtggattacggaaggttgatgtacagaggtctgtattttggagcctcttctgtatttacttcagaacactaacaatcaggcgagaatgttctggtttatcaaacccttccttctgcctttcatcttaaccatgcattagttttaacaaagttcatcccaacagaagacaaaacactgatgaggtaggatagctccagctcctcctccctctcttctagtcttgatttccatgtagtccagtttattccttccctgattgtccaggagaatgagaaaaagaaaaaacagagtctagtgggtaagaaagggccacctggacggcttgatttggattgtgaaataaaacacacacacatgcacacgtagaataagtggctaaaatctgagtaaatcgtgaactctctgtatcctccacccattgaatactcctaaaagactttctagaaattcaaggacttattaatatagaaacctggccattgttcctcttctcctccccatgtggtatgagagcacctgtggcaggctcccagagaccacggacctcttcctctaggcgggctctgctcttctttaaggagtcccacagggcctggcccgcccctgacctcgcaacccttgagattagtaacgggatgagtgaggatccgggtggcccctgcgtggcagccagtaagagtctcagccttcccggttcgggaaaggggaagaatgcaggaggggtaggatttctttcctgataggatcggttgggaaagaccgcagcctgtgtgtgtctttcccttcgaccaaggtgtctgttgctccgtaaataaaacgtcccactgccttctgagagcgctataaaggcagcggaagggtagtccgcggggcattccgggcggggcgcgagcagagacaggtgagttcgccctgaagatgcccacaccgcccggcccgggctccactcccggggaggcctcgagggttgcggatgggactcttaagtggtcacggatcaggtgggcagggggcagtacagctttctttctgagacgccgagagcgaacaggctgctcggaaaacaggacgaggggagagacttgctcaataagctgaaagttctgcccccgagagggctgcgacagctgctggaatgtgcctgcagcgtccgcctcttggggacccgcggagcgcgccctgacggttccacgcctggcccgggggtctgcacctctcctccagtgcgcacctggagctgcgtcccgggtcaggtgcggggagggagggaatctcagtgtccccttccagccttgcaagcgcctttggcccctgccccagcccctcggtttgggggagatttcagaacgcggacagcgccctggctgcgggccataggggactgggtggaactcgggaagcccccagagcaggggcttactcgcttcaagtttggggaaccccgggcagcgggtgcaggccacgagacccgaaggttctcaggtgcccccctgcaggctggccgtgcgcgccgtggggcgcttgtcgcgagcgccgagggctgcaggacgcggaccagactcgcggtgcaggggggcctggctgcagctaacaggtgatcccgttctttctgttcctcgctcttcccctccgatcgtcctcgcttaccgcgtgtcctccctcctcgctgtcctctggctcgcaggtcatggcagcgccaggcggcaggtcggagccgccgcagctccccgagtacagctgcagctacatggtgtcgcggccggtctacagcgagctcgctttccagcaacagcacgagcggcgcctgcaggagcgcaagacgctgcgggagagcctggccaagtgctgcaggtagcggccgcgcgggcctgcgtagagagaagcggagcggggcgtccacgccttggggagggaagggcgtccccagcgggcgagagtggggtgcgggcggcggagcccctgggcgccagctgcttctcccagaggcccgactttcggtctccggtcctccacgccgcccttctggtgggagggtggctccatcagtctcgggcccgaaatgaacttacctgggaaactcgcctttggggagagtgggttctaggagccccgtctctctttttcctctctgaaggaaacttggagtgcctcttggggtacagtgggtccctgttgccttcttgggagcttgtttaaatgaaatgaatagggaaacccagctcttgaccaggaggagtccttgaaacactcaagctaagtaggcgggctaccattcagttagagaccaggatgcaagctagaacccaggggagcgcggggtgtgccaagtacttcatcagcaggctgtgggacccctggggaaagccaccctcagtctctaaacccaaacatgccgtaactagatgtcacaaacataaagaaattagagtttctaaaacctttcattatagaacatttcaaatatatgcataagtagacgtagtagtataatgaactccccacccccaccgtttttaacccatcactcggcctcaactgtgatcaaatccaagttactcttgtttcttgtatctacacctacttgctccctccagtattatttttaagcaaatctcatatagcatactgtctttatgtattttactgcatatctttaaagactcttaaaaaatataaccacatttcatgatcacaccttaatatctaaaaataacctcctaatatcaaaaattgagtcattattaaaatgtccaatcgtcccataaatgccttaattaaaaaacaatttattcaaatcaggagttataccacctacttttgatatttttctttcatctgtaggtcactgaatttaaaaactaccaagtagcaaggtataaggtatacattcctcatgctaagatttttgtaaaaactagctccaggcttgtattgccaaaatatactcagtgtgtttatcttctttaaagaaaataataataataaggcgcctggattaggagtctgaaaagtaatctccatttagagactccacatccatcagtctctggctggaccagaaaataggtttttgtgtaggaatattttttcagaggattaaaaatgtgagcgaggggtgggacacttaatcctgtgttctctagaagagtgcatttaaaaggatagatacagttcttggcaaaagcatggtaagcacttcagggttattattttccaggaaattcttattctttttccaaatagttataaacatcagcagaatccagttcataactttgtgatttgcaaattggttgtgactgagattggattgaaaacccagttttcttgctttttgacagttgttcaagaaagagagcctttggtgtgctaaagactcttgtgcccatcttggagtggctccccaaataccgagtcaaggaatggctgcttagtgacgtcatttcgggagttagtactgggctagtggccacgctgcaaggtaagatgttggcagattgagagttctggtctccagcaggagtttaacacttctccccagctaccataggtctgtgacagatggttgcttacccttcaaggcctgtatctttcctgtagagccccttagtggagagagtcacctctcttctccccttccttagagttctcttcctgggaaactgctgccccactaggtgcagaggtccaatttagaggcatatactaggcagtggcttctcaatttttttaaattttattttatttgagacgggggctcgctctgtcacctaggctggagtgcagtggcgcaatcttggctcactgcaagctccgtctcccgggttcacgccattctcccgcctcagcctccccagtagctgggactacaggcgcccgccactacgcccggctaattttttgtatttttagtagagacggggtttcaccgggttagccaggatggtatcgacctcctgacctcgtgatccgcctgccttggcctcccaaaatgctgggattacaggcgtgagccactgcacccagccagcttctctattttcattgaccacaattcaataagaaatgtgtaaagagtttcaagtcaagatttaaaaaaaaaaaagaaatgtgttacatcctgatatatacatatatatctaaagttcctgtgaaatatttattataacaatgtgctaatctttcactttgttctattatgcttaggttttttaaatgatgattgcagtacattaaattattttatatccacacgtggatcttttttgttggtttgttttgctttgctttttagagatacagtcttgctctgtcacccaggctggtgtgcagtggcacgatcttggctcaatgcaacctctctgcctctcgggttcaagtgattcttgtgcctcagccttctgagtagctggggctacaggcatgtgccaccatgtccagctaattactgtatttttagtagagatggggtttcgccatgttggccagggtggtctggaactcctaacctcaagtgatccgccctccttggtatcccaaagtactgtgattacaggcatgagccaccatgcccagcctcccacacgtggatcttgaggtgtagtttgaaactggcttaaggaaaagtgaagggagcttcctagcctggactccacatgaatgttttgcctgcccctcatccctttttaaaaaaattcatcctcttattttaatgtgtgggaaaatgtgccaacataggtggttatttgttcttttataaactgagttcataccataatattcccataagcatcttagaaatctgttgtatagttggtgcctagcagcatggcattctcctctgtcccctatccccaccatctcgtttctgccccacccccaacaccctgaccaatttcccaaagaccctgaatcatgaaaacagaaatatcgttatttattataatttgtgaaacacctaatatgttccaggcactaggtatgctgacacgaataagatgcatcctctgcttccaaggaactcatagtccaatggagaaagagaaaacaattcaatgtgataagggctgtggcaggggagtgcaaattacttgctaagggagtgcaaatgaggttcactcaaagcggtcttaggggatcttgaatagcttcctggaagttgaatgtcaaagctgagtttccctgatggctaagtctgagtttgccaagtgatgggaagtagggtggggtggggatggcttgaaaatagactatttcagaagctagtaatgaatgttgagcaatattgtgagctaaaatttggctatggagctttcaagattgctcagatcaggccaggtagatgcccgaagagaaggaggatggcctatgaacccagggtggagcctcagcctgatcaagcatgttcttaatcacaaaggtggacgggagagagactaggatgggctgtgtggttcctaagttaaacaatgccaagtattctacactgtgctctaagggctgtgacatggtgacaccctgtgactcctgggggacaggaaccatgcctcattcatgtttgttcagcaggtgcctagcacagagacaggcacataatagatggtatatttagtgaaaaagattgaattgcattcctgataatgaatcttctttatatataaaaaatggtggttcatgctccatgtctccccagttttcatagacaagtatcttataagaattcattttgtttataagcatgagacactatgctaagtaagaatgttgccagctatctcatttaatcctcataacaatcctgctaggtaggtctattattatttcattttcagtaggtgaaaaaatctattaaatcttgcccagggtcacgtggctggtaagtggtacagctgggattttaatccggtgtctattgtgtagttccttactttatgggtaagatgcttttctagaaacattatctctataaagttttctgtgtaaggtgaatttctgggaggttaatctggctcagttacacatccatttatcattcattcacttaataaatatttataaactaattctgtagaccaggtatccagccatgtgcactcagtggttcattaacaggcacaggtgctgacttcatggagctttgtaaaattattttgaggggtagggatgggaattaaataagtagataaatagaaaaataattatagattgcaatatctattgtggtggattaaatatactgcaatagggattaatttgaaaggtggatctttatttttatatttttttgagacagggtcttgctctgttgcgcaggctggagtgcagtggtgagatcacagctcaccacagccttggcctcctgggcccaggtgatcctcccatctcagcctcgccagtagctggaactacaggcatgtgccaccatgcttggctaatttttgtattttttgtagagacaaggtttcaccatgttgcccaggctggtctggaactcctaggctcaagttatctgcctgcctcggcctcccaaagtgctgggattagaggtgtgagccattgtgcccagccaggaagggaggtctattttagatataatggtcaaggaagaacttactgagaaggtgaaatttagtaaaagacaagagaatgagaaggagacagccatgtgataagcagaaaaaaagagtgtaccaggtaaaggtgcaaaggccctgaggccagaaaacttagcattttccagggaggaagaggaagaattgtagtgtggatgagtgcagtgggggagggtgagtaaaccatgaaataaattgaggcaggactgggattaggatgaggtaagggaggcactcactctcaggatgcctctttaaatattgtaccctaggaaactcatttgcctcaccctattcctggccctgtggggatattgctgtgaattaaagggagaatgggtgtgtcagcttgaaccagatgatgcaggctatgaagagagctgcaagataggaatatattgtgcagcaagaatcactgacacataatgatgagtgtggatgaaaatcactgatgcctccaaggttgttggcttgagcaaccggatagatcattacatcatttatctaaatggcaaagacaggctgaggagcaggtttgggataggaaatcaagtttccttttggatatgctaagtttgagacacagggtgagacatctaagtggagatgccacctagagaagtgggagctactgcaagtgtgaaggttagaggagaggtctaggctagacataaaaatcaggaaagcattgctgaagaggtgatatttacaagagtgggaatgcctgtgattacctaggaagaaagggcaggtgtagaagaaaagagagccagagtacttagaagttaggaaggcaaggagaggggcagccaagaacctgagaaagcctggcgcaggaagttgaagacaaagaacaaccaaaggaatgtgggatcagaagccaagagagaaggttaaaaaaaaaaaaaaaaaaaaaaaaagcatagaggggctgagagtgttgaatttgcctgaggggtggggtatgatgaaggattacagactgcttttaagaagttttgccatgaatcagagggagataagagatgaagacagagtgaagggagaatttgtttttcttaatatgggagatactagaacgtatttgtgaaccgataggaatgacctagtagaaagaaagagatctgtggtgcaagaagtacaagagaaataactagaagcaaagtagtaaaaaggggcaaacgtggaggggtttgagaatggaactaggagaactactccttaaaggcaggagggatatttcttccattttcaaaggaagatagcccaaatggtgcagatgcagacgggtttgaaattttgatgaaaagtaacttgggagcatctcatgcattctgtgttttcgattaaatgcagaatatgtcccttaactttgagtctggtggagaagggtttgggcagattgaggtaagtaggggaggtttgaatagttgtctcaaggagaggaaaggcacaccccctgaggaaatgtaactgggtccccaggcagtgttgagtgcccatctagcacttgtggtcacacattttacatgaaattggttagcccagatgtagatgccttcagtccagtttatctagctgctcaaaggctctcatggataaggtagatgtttgaggtcagccaaattggggttttgccagacaagaaaaggaaggaaagagagagtgaaaaaagggagttaagaatatttgcaaaattccatggaatctgtgtgggcaagggtggaagtgaagacaggaaggtgtggaggatagagagaaagtggatcggttaattaattagaagcctcgtgagcacaaataaatgttgcaataaggattctgcagtagatgagctggaaggtttggaggctgtagctggagagaggctcaaaattcagattttggaggtggtggtgtggtttccagtgatgacaatgtccatgccacaaccactggctgagcagctgagtagtagaacaactccgagaagaccagctcaggttactgggaagccaggaagttgctaaggatgatgggatctttgtgatttttgttattaaaacaaattcccatcagacagcaaaagatcgatgcaacccttgtagtgctatttttattcacaactttaaggagtctgctgtctgctttctccttttgacttttatgtatttgtttgtttaaacaacagaaatttatttctgcaacatgaaggtgcctgtagattcagtttctggtgacagcccgtcaccttgctgcgtcctcacatggtggaaggctttacctttagaagaaatttaaatttaatataaatttcaactgtttattagcacctgctttgccagtatttgtcaccatgctataaatcatgactaccaacagagaaattctatcatttaaatcaatggctcagatttcttctaattttttttcttttttgagactctttctcacacaggctggagtgtagtggtatgaccttggctcactgcaaccactgcctcctgggttcaaactatccttgtgcctcagcctcctcagtagctgaaattacaggcatgtaccaacacccccagctaatttgtgtatttttagtagagacgagatttcaccatgttggccgggctggtcttgaactcctggcctcagtgatcttcccacctcagcctcccgaaatgctaggattacaatcatgagccatcacacctagccccagatttctttacaaattgtgtaattttaaaactgttgtaccaagtttctttataataaagatgattccagtatatttgagtagtagtggtccctaaatgggacactctgtatgaaaactgaaaagttccccttttccaggcatattaagaactgcagagcccagtttggggaaatggaagtttgagaaggacttgaaaaatgtccatatgaaatagacaagttgtgctttcatcccctgctccttcttttcttatcttccttctgtggagtcaccttcctattttattccatgctgttgggactactgactattgcaattcctgtttgtaatttacatattaaaacaattgtactaatagatatatttttctagaatacaaactccactagggcagagactttgttttaacagtgcctgacacatggtaggtgcataatcaactgttgttgaatgaatgaatgcttattgtagaaaactagaaaatacatataaggaacatgaaaaaatacctccactacaaactagaagtctcctctgatcctaccatacagataacccattgatatttcagtaaatatcttactaggcacataaatacttatctatataaaagtataatgaaatgtctggaaataataagcaccaaattcaggataattgttgccttctgagggtagagggaggaaagaggatgtgattgaggaagagtatactgagagtttccgctgcattggcagtaatttatttcttaagctagatgatggatacatgaaagtttattatattattcattgtgtattgtgtttcttgtatatgtaaattacttcatattttattcaaaatacctccagattttttttttttttttgagatggagtcttgctctgttgcccaggctggaatgcagtggcgcaatctcggctcactgaaacctccgcctcctgggttcaagcagttctctgcctcagcctcctgagtagctgggattacaggtgcctacccccatgcctggctaatttttgtatttttagtagagacggggtttcaccatcttggccagggtggtcttgagctcctgacctcctgatccacccacttcggcctcccaaagtgctgggattacaggtgtgactcaccgcgcccggtccctccggctttttttaatgcgtacactcccacaggctggagtgggagtgtattttttacaaaagaggaagcatacatacctatcagttttgaatcttgattttactcacttttttccctcttacttcacatctctccacgttactgaatgtacttctgagcatcacatcaatttcatttcatagaattacgaagtatgaagcataacttagttaaccacttccctgcttggggacattcatctgataagtaatattgagtgtgtgggggccagcatattcaggctgttgccatttttaataaactactataaatgtaattccttattaatgactcaagagtgaaaaggcttgattttctctcattgtgagtgagtgaagggtgaggaggtaaaacggagtaagatatgctggctacctaagtatttaaccaaggaaaagaatgtcattatcctcttctaaccctcatgtaaactagaatgttgatttctctatagccaggcattaatgggtctgggggctgctgccattgcctagtggaggagttggtcaacttcatcagggtagagttgtcttgtctgctgctgagtataattatcatattttttctttgggtctaacttttcttccccaccaaaaaaggagaaagggcagtgtaacaatgactgtgtccctcagaacgcagagaaatattgagctcagacacaactgcctctgtgcaaaactggtctgagcctttggagtgaattgaccaaaacttttttttttcttttttagacataaggtcttgctctgttgcccaggctggagtgcagtggcacgatcatagcttgctgtaacctcaaactcctgggctcaaacaatcctcctgcctcagcctccttaataactaggactacaggcgtgaaccaatatgctgggctcattcattttattgtagagatggagtcttgctatgttttccaggctggtctcaaactcctgggctcaactgatactcctgcctatggcttcccaaagcactgggattataggtgtaggacaccaggcctgaccaagtttttaatcaacatttgacttgattgttttttcccactgatctgattggtggaagactgaattactgatcaactgagtccattcatttgagcaggtgatgtttgtagatgcaatcattgttccaggtgatttggatcctgttctgcatcctagcatagccagtctgtaggcaagataaggagaccaactcaggacaggctgatctgttgaaactgtaaattgagagtatctgtgtaaaggcccttctttctgcagtagaaagacagatgctcctctacttctcatgagttacatcctaataacccattgcaagttgaacatattttaagtcaaaaatgcacttaatacacctaacctatggaacatcatcgcttaggctatcctacctgaaatgtgctcagaacacttacaataacctacagttgggcaaaataatctaacgcaagcctattttataataaagtattgaatatctcatgtagtttactgaataatgtactgaaagtgaaaaacagaatggttgtatggttacttaaagtatggtttctactgaatgcatattgcttttgcatcatcataaaggcaaagtcataagtggaaccattgtaagttgaggactttctgcatactgtaactttggtttgtgaatgtaatcactttgcatgtgctttcagggatggcatatgccctactagctgcagttcctgtcggatatggtctctactctgcttttttccctatcctgacatactttatctttggaacatcaagacatatctcagttggtaattataagtatattttacaattatatttgctcatgtttaaagtgttttggctatattaagtgcattatacctctattaggttggtgcaaaagtaattgcggttttcacaattatacttttaattgtgaaaaccgcaattacttttgcaccaacctaatatatctgtgttaatgttgtcagggaaatgggatttcagtgttttgcctgctttttctattcactgatgttaggtaacttttttaatgaagtggaaaaataaaaaaactgaaaatgacagcctactttaacattttagcatgttttgctttttaaaaacgtgatcaatttgactccatttttggagtcataatgacagggaaaaaatgacacaaggtctttgaacctaccattttactggattaacttagaaattactaagtatgttcatcaaatacatgttcatgatttaattaaagagcatacttattttaaatcactaatattagaagactggcaaaatcttaccaaaacaatttagaagctaagcttggctttctttcttggtatggcttataataagttttcctgctattcctaaaatttgaattctcgtttgttagaatgtcctagtaaatgagtgttttaatgctattttgtgactttgacatttatactagagaaaattttgctcctacatccatctgctggctagacatgtctacctcgatgatcctcttgaaataaatgcaaccatctactttatccccaacccatgtttttgtccttagttgtatttccttagaaggagatcagaaagaggttttgattgaaagaacttccacaccttggagaatcaatcagtgttgagtgcttgactagatgaggaacatggaagctggtttttctctttggtattctatacattgagatattccaggtgactggggttgggttttgagacctcaaaaccataaagccttccatgatgagagggtagaatcatcatcatcgtcatggataaaaataacagtagtgaacggagcaattgctgaaaaaaaaatattttttaaaatataaaatcttacagattgacatttgatatgaaaaaatgttttgtcttacaaaaagagaaagaaacttcatactccctttgctgtttttttaatcctaacttcgaccctgtgatattgatcaaggtactcagatccacagagatcaggacattggacactctaggaaattaatgagattatatgaaataaaagttgagcagaacaagtaaacactcaatgtatgtgctacctttgccagaaaacctttcctgacaactctcatccctgtccccaccacccatacacatgaggatcacacacagacaggttagacgaccttttgatatactcacgaagcatcctgaatgttgtattctaataactacctacgtgtctctctcgcctatttctaggtcatgaatgcctcgagatatctgcgtttttagcttctttttgttgttgttgagacagaatctggctctgtcacctaggctggagtgcggtggcgtgatctcagctcactgcagcctccacctccccagctcaagcaatccccccacctcagcctcccgagtagctgggaccataggcacgcaccaccacacccagctaatttttgtcttattttggtagagatggggttttactatgttgcttaggctggtctggaactcctgggctcaagcgatcttcccacctcagtctcccaaagtgctgcggttacagatgtgagccactgggtccggctcagcttctttcgtgaacaaacaatattttcctagtcacagctaaatcttttatacattttttaaaccctatgcagacacattgaacatttgtgattaataactgattaattgttagagactttttttccccaggaccttttccagtggtgagtttaatggtgggatctgttgttctgagcatggcccccgacgaacactttctcgtatccagcagcaatggaactgtattaaatactactatgatagacactgcagctagagatacagctagagtcctgattgccagtgccctgactctgctggttggaattatacaggtaatgaacttacaagtaaaatatagatggatgtaatttttatttgaaattaactttaaagcatatagacttaaagattctactaaaaacaaaacaaagtaatttcctggaacccaaaattattttctaaattacgttgttttaggtcaggtgctaaaatagtaagcaagaccccacttattaaggctcacttatcatcaaagtcagagacagaaaaaagcacagaagaacatgtgtgattcaattgaggatgagagaagggaaatatacgggaatccataaaggagaaaaagtgttctggtgagcggagacacaggaccgaaagccacagaaataagctctgggtttttgcttttctaagtacatgtatagaaatacttcaaggtttttattacacttagttttcaaattttagagtggtggaggaaggggagtgatagggtattaagaaattcatatttttttctaccagtatttttgtgctataggcaggctactagtgttttcattggtattaagcttgatgtaatatttccagagagtaggtttctatctcaggcaaacatttaatttttctttccttttccttatcgtagttgatatttggtggcttgcagattggattcatagtgaggtacttggcagatcctttggttggtggcttcacaacagctgctgccttccaagtgctggtctcacagctaaagattgtcctcaatgtttcaaccaaaaactacaatggagttctctctattatctatgtaagtgttgcttcttgctccagggatgggtcactgttcattccagaaacaattgtattcattctctgagtctgggccaggcgtggtggctcacacctgtaatcccagcactttggaaggccgaggtgggcagattgcttgagcccaggagtttgagacgtgagacctcatctcttaaaaaaaaaaaaaaaaaaaaagaaagaaagaaaagaaaagaaaaagaaagaaaaaatccaaaaatccgaaaatttgctgggtgtggtggtgcacacttgtagtctcagctacttgggaggctgaggtgggaagatctcctgagccctggaggttgaggctgcagtgagctgtgatcgccccactgcactccaccctgggtgacagagcaagaacctgtttcaagcaaaaacaaaatcaaaacaaaacaaaacttgagtctgggagcacccacatttctttctttctttctttttttttttttttttgagacagagtcttactctgtcacccaggctggagtgcagtggcatgatattggctcaccacaacctccacctcccgggttcaagcgattctcctgcctcagcctcctgagtagctgggattacaggcgcccgccaccacacccagctaatttttgtatatttagtagagacagggtttcaccatttgggccaggctggtcttgaactcctgaccttgtgatccacccacatcggcctcccaaagtgctgggattacaggcgtgagccaccgcgcccggcctgggagcacccacatttctctatgcatactttgggagccattgaaaacatttggttgcttctgtcagaaatactattgtacttaaaaacattaatgaaaacaaagtggtctaatgaagtaaaggctgctctggaatgtaacagacttgatttctagcctcagctttgtctctaacaggtaagtgaccctggatacatcatgtagggtgctaattgaaagctcagttttagaactggatggaccttgattcatattctggctctactgtctactagccatgtgagccaatcaccatgcctcagtttccttctctgcaaaattgggttagtaatagtatatgcctcattggattgttaaataagaatagataagcacttggcccaggggctggtacataacaagtactctaaataaaggagttattttgaaatgattatttcaagccatcttttcttttttattggtgaaatgaaatgattggagatgtatctctaaaagctttttctaaccataagagtccgtaaaatgcataatgtaaatgtctcaacaattataaatgaaaaggaacattagattcagagatgattcaccatgcaaaagaaatgcaaaagcaggatgtagatcacactaattagatttgaaaaaggttttggatctaaaaatgtgttctacataaagcatgttattgatgcttgaaaaatggtgataatagtaacatgatgtcatcctagcttggggggaatgataccatacaaaaataacgtgtcaacattaagaatggagtttgagtctttaaagacccacctattagcttctaaaacaatgtaaggccatgtacacatatctaagaattggtgagtatgtcaataattgctcaattttataacggtgccataatcccatactattacactccatccattcaacaaatattaccaagtgcttactacaggccaggtactatgctaagcagtgagaatagacagaggaggcagaataacatagtgaataagatcatgaggccaggtgtggtggctcatgcctgtaatcccagcagtttgggagactgacacaggtggatcacttgatcccatgagttcaagatcagcttgggcaacatgacaaaaccttgtccctactaataatacaaaaataattagacatgcattgtggcacgcacctgtagtcccagctacttgggaggctgaggtgagaggatcacctgagctcaggaagttgaggctgcagtgagccgagatcatgccactgccttccagcctgggtgatgggagtgagaccctgtctcaaacaacaataacagcaacaacaaacaaaaaaccaaaaacaaacaaaaaagatcatggactttgaacttcaacagacttgagttggcatcttggttctccacccactacccatgatgtttatactcaacttccctaagcctcagtgtcctcaattgtaaaatgggagtagtaatagtagctacctcttagagcagtgaggattgaaaaagaaaatacgtgtaaggcacttagcacaatatctgtcacatagtaagaattgagtttattattattattatcacagatgaatagacctcatgaagctcgccgttcatttcctcgggacccagcctattaggaaacattagcaaaagtttttgattcagcattatatgggtcattcttgatatgttttttcctgtcaaatcctcagttttctattaaaaaagaatttttttttttttttgagacagggtcttgccccattgcctgggctggagtacagtagcacagtcatagctcactgcgacctccatctccctgtgtcaagcgattcttccccctcagcctcatgagtagctggaactacaggtgtgcaccaccacacctggctaattttctttttctttgttgaattttagtagaggcaatgtcttgctatgttgcccaggttagtctcgaactcctgagttcaagtgatcctctcactttggcctcccaaagttctgggattaaaggagtgagccaccatgtccagcccatattttaaaattaaaattaaaattttaagattttattttggtagagacaggggttttgcaatgtcgcccaggctggtcttgaacccctggcctcaagcagtcatcttactgcatgcctcctaatgtgttgggattataggtgtgggccactgcacctggccaatccttagttctttttgagacctctgactgccttattttgacaggctctgtaacttttgcagctcctggcacatcttgcttttacttacttttacattttctccatcaaatgttcactcatttattccttcattctcattcattcagtttatctactcaataaacacatattgaatacttaccatgtgccaggcactgttcactccctatacaaacccagtgactcattaacctaccaagacatctcttactgagtattctcacctcactgggcaaacattgctaggccttcatctacacagatcgcaggaggtccaaactaattgttgacctgggtccatggccatttcaggacccctgcagaacaggagaaatagttcttctggtctcataggattatgtttaagaagaaactttctgcaaatgatttcactttgacagggacaaaagtgagcaggaaacactagaccaaggtcaaaaatagtttttaaaccaagtgcagtcattatgtaacttacttcctgttgaatatttttcttgaaatctcagtttagcatacagcatagaattttgcaagaaactcctcacaggccacccaagttggaaaaggtatttcagtcatccctatatggtggtgaatataagtttgctcttctgaaaaaaaaaaaaaatcagcaggtctgaaaacgattgcatagggttaaatgagccgcttagtctctgaacagagaattttgcttatgacattaccattgcaattatacatgaaagaatccttcaataaatgcagagtagtagaggattctcccagaaaagactgtaagattgttgtaaaatactttacctggagtgttaacttatctttgttctaaggttgcactttggtttgtcctgccctctcccccaaaaaggtgctgacaactagaagtaacaaatgcaaagaaataggggagaaaatattagaagaaaaagaaatcagttaatttacaaatgtcagagatactggatgtaggaggcagaagggagaatgacagggtattggcagcaatttagaattagtcaatacccttgatgctaccatgtagctactcagttatctaagtaaatcccagtccacttaggggttgatttcccaccactcaatttgaatggtttgtctcagtagacaagggtgagagctttgaaagccaccactaagcttgattagatttgttactttgtacctatttcagtatgtaaaatttatacattgtattaaagtaacactttaaggattgatctatacatgtatacacaaaagatatggaaggaaatgcctgacagcaaaaggtggtcgtgaagcatttgtgatattcgtagagataaaataaacaaaaataaattcagttccaatagtaaactgatcaattttctcatacacattattgggcataattttttcttacggtttcataaacacaggtaatcctgggcaagaacaaagaaattatctaaatgaaattgtcctaaaattttccaaacacagcaggaaatataataaaatattatctattaccaaaaagttcattatcataatttgaattatttggaatactaagctaaaatacagaattatatgtgtatccatactattaacatactttatggtattttaacagtaaactaaattagaagtactgttcagtgtttttgtagagtctaatttctatgtcgttaaatataatcttatattattatataatataatcttatattattatataatcttatattattatattatataatcttattatattatataatcttatcttatataatcttatattattatatgctcttatataatataatcttattatataatcttatcttatataatataatcttattatataatataatcttattatataatataatcttatcttattatataatataatcttattatataatataatcttatcttattatataatataatcttattatataatataatcttattttattatataatcttatcttattatataatataatcttatcttattatataatataatcttatcttattatataatataatcttatcttattatataatataatcttatcttattatataatataatcttataatataatcttaacttattatataatataatcttattatataatcttatcttattatataatataatcttatattattatataatcttatattattatataatcttatcttattatataatgttatattattatataatcttatcttattatataatgttatattattatataatcttatcttattatataatcttatattattatataagtataatcttttattatattattacataatatataagtataatcttatattattatataatattattattatacaataataatgtaaactgactattgcagtttacatggtgagttttatttctgcacagattaaactttctatcatagagctcttcttaaaagattctgaatgactactcaatatgtaggcaacttatttacatactcagataccttgcatgatgcaattctgtaatataaactgattttggtttttgaacctcgtgttacatttctaatccaccagacatactttttattcaaaggtctaattgattctcatagattaaactggaatcctgtagtgattatttttgtaaggtaaaaatgtttgtgtgattgggataatgattccaaatgttttgtttttcaagttttaatttttgcatcttgagttgaaaagtacacctttaatgaatagacaattcatcaaaatgttatacctagctcctgaattaattagggtcattcatcagaaaactgattatgtaaaggaccaaacagcaatgataaccttcaagcctctgggataggtagggctgtttgctcctgtgctaaatgccctaagttcttgttatcgtgtctgctggtggtagttatcccattttctttttcactctgctgtccctggcatcatcttgtttctgtcagtgtacctgcctttagcaattttcagtgactctgaaaaccagacaaagtgaatttgttagtactggatttcaagaaagagcaaaagtaccctctgagtgaaagttcaagagtcttcctacaagttaaatgcctgaactctagtccaggtgtttggtgggaggtattttgcatgcataatagcttctcccccatttccttactcttcttgaatgtgttccagagagctgaggttgctggcaaagtgactcctagattacttaaggttcattaagtacttaaagttcattaagctcatacataattgtcaccagattatcattataattattttaaaagtagtttatctgtgaaaataagtaaaatacattttataaatgttataaactataagatgctccattattttatcttcctataaaatatgtctataaaaaagctcatttaaagaaaagttaccttcactgtgagattgtctcaaagaaatgtctcaaagataccttcttaaatcctgccttctacaggactgaagttaatataacaaagatattagtgttcttccttgggattcttccttgctaatttccttgaaaacacccttgattcccagaagtctcctatttacaaaacaaaactagtttttcttgaattgattcatctgtctacttaaagattttttttggccagttgtggtagctcatgcctgtaaccccaacactttgagaggttgggcaggaggatttcttgaggccaggagttcaagaccagtctgggcaacaaagtgagacaccatcccctgcccccacctcctcccgccccaatctctacaaaaaataaaatagcctatttattgtactctctacaataaataaaataaatatagatgcctgcctgtagctccagctactctggagggtgatgtggaaggattgcttgagctcaggagttcgaggccactgtactccagcctgggcaagagagctaaaaaaaaaaaaaaaaaaaaaaaaaaaattttttatgttatcttagttcaagtttgagaaataaaattaagtaccaaatttattcccaaaaatgtatgcttgtcaggagatatacctaatgttaaatgacgagttaatgggtgcagtacaccaacatggcacacgtatacatatgtaacaaacctgcacgttgtgcacatgtaccctaaaacttaaagtataatttaaaaacaaaaaacagaaaaaaactacagattcaattcagctttaggaattaaaaaaaagatttgatgtaattatatcattataaaatcaaattttttaaataaaacatgaaattgttttaatttaaaaaaaagtatgcttggcctatatgtcaattcaatagcttttctttgccagaaagaatgaagtcagtctacctgtatccacatatgaagtattttaggattttttgtaattttttgttattatctatatcattcaggtttaggaaagaactttacctaaaatactggctaattgtgccccaaaaaaaagaaagctagaaagaaagaacacacacacacacacatacacacatatacacacacaaaaaaaacaaccaactgatcaactgggagtttcaggtttatcagcctgtagtctcaatgctgtatgactgtagtaaaaatcaggctacttgatagcacctagaaacccattttaaaatataaacttgtaaagcatttctgtaagtaaaagttagtatgtttataatgacattttttcttttaagacatctttattattatcataaaaaatacagagaagcaaaaataagaatgtagaaatcacccagtttttcctttccaagtaaacaatcataaaaaacttggtgtatatatatattgcagcaattgtatgtatgtaatggtctctgtatcaaccaacacatttttatcattttactgaaacttttgagtgttgtttgatgctgatatcatggtttttcatgtgggaagattcatatgagaattgattgtgtgtgtgtgcgtgtgtgtgtgctcgtgtgcgtgtagcagcaggaagtatataaaattattttctttttatagacgctggttgagatttttcaaaatattggtgataccaatcttgctgatttcactgctggattgctcaccattgtcgtctgtatggcagttaaggaattaaatgatcggtttagacacaaaatcccagtccctattcctatagaagtaattgtggtaagtagaatatgtagttagaaagttcagcattatttggttgacaaacaaggaattattaaaaccaatggagtttttaacatcttttgttttatttcagacgataattgctactgccatttcatatggagccaacctggaaaaaaattacaatgctggcattgttaaatccatcccaagggggtgagtgtggtgttcctcttagtactaatacattaagtcagtaagtcagtcttttttatttaaataaaaccttttattacaagcttcatttcactgatactccttcaatagtcctatttgtgtgtgatcttgaagaaacaaccataagacaaacagtatgtgtgtagataaacgtcaagccatttgtttaaaagcagcccgtatatgctcttttttcttcattttcttaaaacatggcagaacatgtacggttaacaccagagtcctgatttaaacttatacataacattataatataatataaatagaatcatttctcagtaacatctattgcactgtgaacaatctgcttaaggaatcagggacgtctggcctaaattctctatcatttagtttaatcaattttggataataattatatcctcgtacccataagtaaaatgcattatcttcaagggaagttttagaaacatttggtagtttggtgaattagaagagtaaaagatcaaggtccttcattcatctctgtcaccttccagttttgtgacctgaggagattctcctatataagacaaggataatgaaaacagccgaagcctcaactcaagcttattatgaaacaccagtgagatctctcatgaaatgaagagtagtcaagacaccctacaccataattttctcatatggggttacaaaggaggcctagacgtttattatatttgtaacatacactcataacatttaagactagacttgctgttaatcaagaagtactagttttccctaagactagaagagtttggtaccggtgtttctaccaggaaagggagtggaggggagggaagggcacggagccactgtttggtaccagtgtttgttttccatgctcttaatagaaacttcctcaggcaagcttattcccagagcttattctacagggaactgctgtattcccatttgatgaatcttataatttcctctaatatctgttccaaactatttgaaaaagcacagctggctacatgggacttaatttgcatgctatccattacagtgtttctcaaacttacccttttgtaagaatcacatgggatcctttttcacacagattcctggttcccaccccaaacctattgaatcaggctttccagaggtggggctcaggaattaatatttttcaaaagtgcctcaagtgattcttgccctcaaggaaactggagaaactctttaagagaggatcaacaaatctaatctaacaactagataatttcattagttagaaacaattacagaaaaagatactttacagatctcttttgtcaggcttcctaggatgtatcaagttataggtggtccacagagcaggccctgtcccatccatccgtgttccattagttggtttagggaactcatttcttctgccctaaattatccctccaggtcctctgcagagctttcctgtgctctcctcctgagaacagatttctagcctctcgcccttgagtttaatgaagctgaatcctttgacagaccacctggtcagcttggtcagctaatttaacctgcctggccccagggactttaagctactccatgagggcagtgaccccattggtgttgttcagctctgtcccagagcacagagctcatctcacagtaagctctcagaaaacacttgttgaaggaataaaatacccaagcctatgtcattataaacaagccacaacaaaggccttggttatctgatctcacttggtagcacagaagcaattctgatgatattaacaaacctgaaaaagaaagggagtggagagattggaaaaaagcaagcagagttttaaagtggccctgaggtgagcacagtgaaaggaagagggacagagagattgtgatatgcccccttttgatctcctccctgcttcaatcctccattaaggctgctgctcgtagttccctttatcctattgagggtccataagttaggatcactcctaacctaggaccatacgttaggaccataagttagtccccaataacaatgccccattggacagccaaaaacagtggctccatgcccttccctctactccctttcctggtagaaacatacaacttttccttgtccagtcaacacctaagcgccccactaggattgactcattctcccatcctgggtgctttcttaaccagcagacactatgagggccagtcatgtgcctctcttctcatgcaactggtccttatctgcaactcgtaatctgcccagttcctcactcatcctgcccaggcttctcttttacctcttctgttatagtggtgtgtgtgtgtctgtgtgtatgtgtgtgtgtgtgctcacgcacgtgtatgtgtaaacccataacaagattgacagctctgtcctctaaattttaatccctattcactctcttgcctcctgtccttgccagttccagaggtccccttgttgtcatgtttgttactctcttttttcttttcttttctttaacagagtctcactctgtcacccagcctggaatgcagtggcatgatctctgtggtgtgtgtgtgtgggtgtgtgtgtgtgtgtataaacccataacaagattgacggctctgtcctctaaattttaatccctattcactgtcttgcctcctgtcttcgtcagttccagaggtcctcttgttgtcatgtttgttactctttctttcattctctttctttcttcccttccttccctcccttccctccctttcctaccttccctcccttccctcccttccctccctttcctacctgcactccctttcctccccttcctaccttccctccctttcctccccttccttccttccttcctctctctcttttttctttctttctttctttctttctttctttctttctttctttctttcttttctttctttccttctttctttctttttcttttcctttctttccttttctgaaacagaacctcactctgtcacccagcatggaatgcagtggcatgatctcggctcactgcaacctctgcctcccaggttcaagcaattctcctgcctcagcctcctgagtagctgggacaacaggcacacactgccatgcctggctaatttttagtagagacggggtttcaccatgttggccaggctggcctcaaactcctgacctcaggcgatctgcctgcctcagccacccaaagtgctgggattacaggcactgttatagaccccttttgtcaggtttcctaggatgtatcaagttataggtggcccgcagaacatgccctgtcccatcaatctgggttccattcattggtttggggaactcaggcctactgttgtttttaaagtatgtgctttgcagttgtacttgaaagtgtggcacaggggcaaagccaacaaaaccacagggtttttttcctggctgctttctgagggctactcttctcctctagctggagtggtggtgcatttgccaagtgttcagacccagtctgaagtactctggtattctgtttggtattctgtttatgacgctggcctgtcgtttgtggaattttgggcccttcagggttcacttctcccggtcttcatcttttcagataagtgtgtgttcacatgctcactcccttgggctcttcatagtgttgtcttatgatcaggcctgacatgcttggctggggccaaacaggcccactgagcaaaaaatttggagagttatatccacagaaggagggcaagggcaagggcaaggacaaaaggcttacttacaggtcattagaagatatccagacgggacttcaattggtttggggcaaataattggcacacttagggttcagcaagacagcagacatgagtggcaggagtatgacagacttagattctcccaatatataccaagaacctactatatgtgtagacactaattacttacttacacaagtgattcctcattgaatcatatgagaagaatatatagtccccatttgacagctgaggaaactgggatgtggtgggtttaaataacatgcctaaagtcatttgagagtgattctggtcctttgacttaagtctttgcactttacactttgcacacctggataatcaaggatcaggtcatatttggagaactaggcagccaggcaggcaaagtgcattaggctgctatcaaaactaagctgtatgtgaaactggaaagttatcctgacaagtccgagtgacctgaagtagggttgactgggtctcaggagcaagtcaggagcctgttttgagaagtgtggtcccaagtcacatcccaactagcaggtgatgtcatgctgagtcacccaactgttggatcagggtttccaacatcctgtctgtctacagatggggttcattccacagtctcattgtggggtaggatgggatataaggagaaaaggagtctgaaaattaacctcactggtagggagagtaaggctacaagggcagagaaccagacagatcttgttaggtaggaaatcgtctaatatctaacatttagacctggacccactaactgacctcaagcaaatcacttcacgtttccaggtctaagttcctttatcaacaagacaagacaagagtggtggattcaacaatacctaggatgctttctctatggttttctctaagaaccttatttctattttatttttaccactgttctctaattataggggaaaatgtagtttccttattaaagaaactttaggcataagtgatgtaggtcggggagacctttcatggctgggggcctctggaattataccatatggatagtcatcaagatataggtccatctcccaaattttcatatttgagagaacctcgtggtataatgtgtaggttaatttttttatatggtttgtagggtagctctggttttgtcaaacagtagtcattggaccccacaatcactgagatattttagtcactatggagcgttgtgataattacattaatttaatcttttttgccttaagaagattttaaatgtcctggctctcaaaggattttccactgagctcttttagcttcatacattctttgtctctttaacagagctgatacctcttcaaacacagtaaatctcatattatggctagaatctcttttaaattcaaagaactttaagatggaattgtggaaggagaaacactaacatgtgaaatggcatggatggggctgtatgatattaaagaatcagtaacagcagatttattcatgtgagagatagagaagagtcagcatggctaggctcaaaaatagaggacaaagaaatcagccagtaagataacaccaacttctgattaaacattataaaagctgctactatcatgtatgtatttcgtgtgctttttgttcttttggatcaagtactttcatgtctaatatgtgactgagcagatatagcatttgatgagatggggaaaaaggatggtggtcaaatcttcacagcatttttcacttaaaaactcactaggtttttgcctcctgaacttccacctgtgagcttgttctcggagatgctggctgcatcattttccatcgctgtggtggcttatgctattgcagtgtcagtaggaaaagtatatgccaccaagtatgattacaccatcgatgggaaccaggtatgggtgcccttttgctgaactggttttatagggctggaaacaggaaaaaaacataaatggaaaagattttggtgtcagctaaagaaggggttggattctttcaccagaccttattgggttggttttcctcttgtgtttgctaattagaaattattttggaatagacacactgcatcactttgcttttttaagaaataagttgaaataacactaattttaaaagagctaattcagtcaggtcataaataacattcaaagtgaacatattaggtcagaaagagaattcttcatgtaacccagtacctcttggcaattatttttaacggcagttataatgtgacaaaacagtgcaacaaacattaataatagttgtgaccactttaaattgaggtggttcactgtgcagttaatatatacaggcaatttttgtaggcatgtgatacattgccaggtaagctgatttcacactgcttgcaaatttgcaagttctgtatctatatgtttctgaaaatacagtatagcaataacagtagttaaatggttagtaatcaagcagaataacagcactgctagtcataatatgcttcatagtgaatattcaaccacagaaaaacactttatgtgagagctgcagacattccattcactaggcagtgaaaaagcttagcaaatgatcaggtgctatttcttgtcaactttaaaaattatcgagagcaatgagacctctctcagatggtatggcgtccaaactcctgatgtcgtacaaggaccccaagtacctatcacggtaaaaattaaattggaccaccacgcagagtaggcatgggagttttcattcttaatgtacttcctgaaatactcagcgaaggtcttgcaaagattcaatttgtaggatcgttgtcatccagtctcttccttaggaattcattgcctttgggatcagcaacatcttctcaggattcttctcttgttttgtggccaccactgctctttcccgcacggccgtccaggagagcactggaggaaagacacaggtaggaacaacagccttatgatatccatctcagagaacaagtcgaggaatggcaacagaggaaggctcgcaccgagcttagcaggacaatttgcctttcagacttgtacttcctaatctgattcacctcaggcctattcctcttgttccactccctcacctgaaatctcttaaaaaacaacatgtatggttttctgatacagtgattctcaaatctatttgtcagtgcttacctgtcatgtagctacacttacctgctgtggtcaataacaactgacaaggaatcagtaatgaaggatgctgatttttgttaatttgttacctggggagacagatggcctggtaaaagcgcttcctggctttaggagctattctattttcaggaaagtgaaaagctctattcacatttcctttagaaggatcaggaacttcctccaggggcgtttggtcccacagaacaacagtttgctagccaagaatatttttgttgtaacatttttggcatttcttcctgagtaagatttatgttgttgaagttctgcatgtgggtttaatcttatcttttaaatgtggtttgcagttgttgcctttacaaggtggccaaaaagccagcatcctagttaatctctggataatccctccttcagtgttcagaaagctcaggagccatactcaaaggccactctttccagcaggacacagtcgaagagaccacaccaagcagatgggcacaagagacagactcaggaattttgcttctgtctcttatgccttgaggtccttatcttcccaacacagaaagaactattatttaggagtaagaagtgcattgagactccaaagaacaacaaacccaaactacatagtgcaatacacacacacacacacacacacacacacacacacacacacatgcacacacacatgcacagtcttcacagtcttcaaatgggttttactaaggcggggacacttaaaaaataaatataagtcgggcacagtggctcatgcttgtaatcccagcactttgggaggctgaggtgggcggatcaattgaggtcaggagttcgagactaacatggccaacatggtgaaaccccttctctactaaaaatgcaaaaattagccaggtgtggtggtagatgcctgtaatcccagctacttgggaggctgaggcaggagaatcacttgaacctgggaggtggaggttgcagtgagccaatatcgtgccactacattccagcctgggcgacaagagctagactctgtgtcaaatatatatatacacacacacacacacacacacacacacacacacaaacatatatatatatatattctcatatatatatacgagaataactgaaaaaactaatgactccaacagtgacttgcccagggagggctttaattgtccccaatatgcatgtgatgctcctttcctatttataatggatcttgtgacagacttggaagaattggcctcttccagttttttggctgcttttcaacaaaaaattttattttcagaatttttcttaattttttattttttttgcaaatatttccagctctgagggagcaggtaaaataatacagctcatatccggaggcatagccagagatctgtggtcaaggggaagaggtcagagccaatttccaaagctgtgcacatttcaggctgcagctgtcagcagcaggaacttctgctgctttcatttgagacggagcactgacaagctctccagagcacatggtcttcagcgggtgcaggcaaatctcaaactgctgatgtccattctcctgatgttacctccaggctcaaatgaggcatgggctggctgtcccagtaagtatgcccatgtaaagtgacctccttggcacagggtttgggggataatggtgctctggtaagctaataccccctgccacatactggcatgtattatatttaggaatgaaggatgccaggatttcagcattaaagaatgaaacgagtaaagaaatggcttcatgtttaattattgaaatgtatactaaattctggggttaaaagtctaagtgcctgaactgaaatccagggactgatggacaaataaactggcagggcttctcttgtgtggcttctcgtgttttctcttatgttggaacttcagtttcagcatctacaaaatggaaatgataattgcatccatttcacagggatattgtgaggattaggcaagaaaatgtaaagccttagcacatacttgtaaatgctcattgtttcactcctttaggcaagaatagcatcttagcatctatgatacatatattgtgcctggcacataagaagcacctggcatatatttgctgaatgaatgaatggaagaatgagtattggtggacacgaactgtttttagcacatctacagattgtagaagaattaaacattggaaccttttctttccctcacccccatctgacttccactgactcacagaaaagtaattctgattacaaaccactctttagctctgattaccccctcccttaacagaataattttttagtaactgaatctggttgtagatataaagtctacagagtttctcacaaacaagccttatcaagtaagtagaaataattgatcactcaccgattttaatatagtggccaaaatgagccttggcctcccataattggagactcattatgacatataattggcaagtaggtggccactctcctggcatgagtttggcagctgactgtggtccttgtccccaaatctccatatctttctccagttcacagagctccccatccacagtgagatgcaagtggctcggtaaatactggttgagtaattgcatgcaaggaaggaagggagggataagggaaggaaagaaagaagaaaatggaaggaaggacaagggagaggaagggaagggatatgaaggaaagcgaagagaagggagggaagtaggatatcagcttctctgcttagtcaggagaagggaaagagcaccagggtactgggaatctaggatggggataggaagagcatagaaaagccagccagacatacaaagcacgctttttagtacctcatacacatcatattgcctcaggctgacccaactataatctaaatataaatgatcaatttgccaggtagagcaagtgctttctaattttctgtttatatttgctgtgtctgtctcccgtaactcagaccttttgcactagacagtacttgtgctcaacaaaatcttcccagttgtttcctctctgattgctttgcttgtagttccctgtctccttttcttctttgtttcagagcttctaatcttcatcttggctctgccccagctgtctcaacagagaattcattggtcatctaatcaaacgagagagtagtccccaccccctcagcctctctcctaactagtatggatcttaggagagctatttttgccagcgaaggtaaagtttctgaagcttccttttacccctgctattgccccgttactccatagtcactgtttcaggctgccttggggcaaagctctgagcctgcctccgtggaactgtcagaggaggcaggagacacaatcccacctctcaatgtgcaaatgtggcatttcgaatttgcaataggatgagtaaatttattttctctgagactttaatgagaccatgtgctacaagtacgaagtgttatcagagttgctattatagctgcagcttcaataatgcagaaaaatcagctatgtgccatgagaatttatttcccaagaatacgacaatgatctctgttgttgggaaaggggggattggtccatgtttcctgccatggtaaataactagaagcttggcctgaatggacgccgaaaccgcaggtgtgtactatcaccaaataaaatccctgtcaaactggctttaatttcataggatcagtccccatattttctttaacttctctgccatagcatatatagatgccatttttgttcagttttgtggcttgagcaaataactatcacttttctcgacagtattgagcagaagggggagacagggaagtatgaagtgtgtctgtgaacaggctgtctcatacacacatccagtgagctggaagacacaagggagaaggacgaatccttttcataggaggtgtgtgtcttccaggttgctggcatcatctctgctgcgattgtgatgatcgccattcttgccctggggaagcttctggaacccttgcagaaggtataaccctgcttctctgcataccgattgcataatttcccttcactactctgctaccagataaataacaggagatttaacaatcatcacatggaaaaccattccctgaataacacagccttctctgtctctcttggcagtcggtcttggcagctgttgtaattgccaacctgaaagggatgtttatgcagctgtgtgacattcctcgtctgtggagacagaataagattgatgctgtaagtcacctaccacctatatttatctgaaataagatttggttcttatatgcttcctgccatatcactatattccccccatcccctaagtctcacttgtgctttgggaactccagaggagaaattagaattgtggggataaatcaaagccatgaagtcttccatgtgaactgcattttgtgaagattctgtatctctgggaaggtcaatttccagcaagaatcccatatgaggctcattcatacacctttggccttctaaacacaaaaagcaaaaaaatgtttaaacaccctagtttagaaggacaaacaacatacaaaacaatgcaaaaacaaaatacaaaatgtaaaaacccacgctgactttaactctgactaacataacctttgcaactattctgagaaactaaaaatcagaagctaaatccttcagagttcctctctaatttaaaccataaaaagaatgagaagacttcctacatattgatatggaaaattttccaagacaaatcgttaagtgaaaaagagaccagaatagaaatgctggggaaaagcacagacacaggcagaaataaaagcggatacaaggagggagggaagttgggaatgggtggagaagggggagggttgtgagcaagagttttcccctttttaatgataattcccttatgaaccatacaaatatattagctattcaaaaatttagaaataaataaaatgggacagttggtcttaattgagaagcccagtttctacagctacttaaatataaaatgaatgaagtcacaatatttttaaaaagctgtgatttggccaggcacagtggctcaggcctgtaatcccagcaatttgggaggcaggaggatcacttgagctcaggaatttgagaccagcctgcgtaacacagtgagaccttgtctctactacaaataaaagattaaaaattagccgggtttggtggtatgtacttgtgggtagtcccagctacttgggaggctgaggcgggaggatcacttgaatccagaagatggaggctgcagtgaactatcatggtgccactgcactccagcctgggcaatagagtgtgaccctatctcaaaagaaaaaaaaaaatgtaatttgtttgtggatcattgatcttatttttataggtagttatcacatgatggtacctgatacattaatataattcttttcatttctatttttttccctaggttatctgggtgtttacgtgtatagtgtccatcattctggggctggatctcggtttactagctggccttatatttggactgttgactgtggtcctgagagttcagttgtgagtaacgtaaaacccagatttcctataaacagaacaacacactctgagcttccttataccattttgataaatatagtgaagccactttctttcgttatagttactgtatattgagtgcttctatgcattaagcagacagtgttttacagacatacttaatcttcaaaaatagcctatgaatagttttgattagtctcattctacaggtgagaaaagagaaattcagaaaagctaagaagcatccctaagatcacacagctagtacgtggcagagctaagatttgaacctatgtacctactcatgtcctctactgctgtgctctccttttagttgtggtaagactaaaaagtacatagtttagccaaaggctgaagttgctttgtagtttcttctttaaatgagatgaggaatgtaaggcgctcggccccaggcttgggacaagacagctgttatatattatagttcattttcttttttaaagctagtaaccaaaagttacataacccagaacaggaggactttaaaatagctgatgacagccaaaattcattcaaatctctcatataaccaataaggcatataaccaataaaccacacaattatgtgaaggaaacaattagctcatatgcagagtgaaggcagcaaagacatgatttaaataatggaaaacagcctgtgagggaaggtgaggagcctgaaggtggttttttggttggttttgttttgattctagagaggccttagttaagtgccctcctgggcctagaggggaacagagtctttctctccctcctcaatgtgtccatcgtctttccagacttctggcccctgctctgcctgtgcttgggccgtgaaagaagaagacacctggaaaaacatcaagatagatgtcttcagcttagcatccgctcacctctcctgtcccaccagccagttctccttcctgccctccttccctaccttggcatattggtgcctacccaaaaggcttgtgttttctacctcagcatcctaaatgattgcccaagggcctgagaaggtttgcaggctcccaaagttctcaatttgcttctaggacacgtctcagaaacgctccttagaagatgctgtctctcatgctgtatatgcctcagtgtctattttttcttgtgtggatgtggttggaaaagaagggttttacagagagagattagcttataaacttttaagttaaaaatcagcacaaacctgtaagccaaggaataactggtggcacattttagctgctagtttggtatctaggcttttagccaacaaaaagcagtatcctccacagtatttaatttccagtaattatcatgctgatccagagagcacaatgctgaaagtacactaaacagatactctttcttcaggaattgtatttagcatgtctctagtcacacatgaagagtcacggaatttatctgattgcatcaggaacaagaaatcaatagtctggttgacaggaaggacttatttctggtcctccagtctcctatttctataaaaaatgactaagtcacaaagaagcgccaggcactggaagacccaggggttaaagacagaggctctgctgccctttacctccaggccttttctcacttctcttaagaagtttagttaacaataaaaatcaggataatactgatgacctttcagggttatggcagggcttaaataagatttcacatgcgtgaaagctctatgcttatcctataacgtgttgtgcacgtgcaagtatgatgctcattatttctctcagccatcagaagagaggcacagttctcccctcccctgccgattccacacaaacaccagctgttcatttcagagttagctacaggaaaatgtcatctgcaataaagacagagtccaaaacaccagaatgatgggctctttagtagctgttgtttttaactttttattccaaaatacggctgttccaaaaaatcttgaccttgatattttttcttctagtccttcttggaatggccttggaagcatccctagcacagatatctacaaaagtaccaagaattacaaaaacgtaagtacctttgtgagacatttgctggacttgggtttactagcctgaagtttcagcagctccattttacgtacaaggtagccaaagggagaaaatgcctattgggaaagtctgttagtccacagggagtgtcatgaaaacttttgatccagtgcaccttctgacacccatggcttatgtgaattttgtctatgctagctgaatgtctttttttttttttctttttagatggagtctcactcttcacccaggctggagtgcagaggcaggatctcagctcactgcaacctctgcctcctgggttcaagtgattctcttgtctcagcctccgagtggctgggattacaggcaggtgccaccacgcctggctaatttttgtatttttagtagagatggggttgcaccatgttgcccaggctggtctcaaactcctgagctcaagtgatttgcccgtcttggcctcccaaagagttgggattacaggcgtgagccactgcacctggctagctgaatgtcattttaatataaaactgttgtaagaggaatttaaaaataataggcaatttctagatgttcatccaaaattttgtttatctggtatataattcttatcttctgtaagattttctttattcagttctaacaagagattatcaagttctctatgaccaagaccttattatttgacactttgctttatccttggtattagaagaaataaaatatgacacaggaaatgaaaaacaaagaaattaaacatcccattgatggacttgtgtcacctgcaaataaaattgcttagtggtgactaggggaaacaaagataaaaaagcagagaaagtaaatcaagaaaatacaaatttagcaaataataataataataatatcaaccctaggaagttgtagtctaattttaccttaacattaaaaaaagttggaccttgaaactgggatttcagtagctgctacttaatttatttccgtgatctttctgttatgttgagccaagtgccattaagagctaaaatgatttagagatttttttggctttggggagggagctctaagctgagttagggaattctgacttctaggctccatcttggtgagactttgcccaagtcattcagcctctcaggacctcagttttctcatctgaagcagctagactaaaattgctgattcctgaagactagaaaagtctatgattctgtgattcctgggttctattttgggtgtggccattgtatgtcagggtgagaacagatgatatcataggcctcagttctgcaaatcccattgattttgctttttttctttgctacttttaaagaatgttagcaaaatcaggaggatcagtggtatgaacttcaggcaaatcatggcactgttctaagcctcagtttcttttctggaaatcagagggttgaataaattgctttctaaggccctttctaactttgaccttctatgagactgtagaggtccaagagtttttgtaacctgttgtctccctattcaagaaaagttgtagaggccgggcacggtggttcacacctgtaatcccagcactttgggaggctgaggcgggtgaatcacttgaggtcaggagtttgagaccaacctggccaatgtggcaaaactctgtctctactaaaaatggaaaaattagctgggtgtggtggcagcacctgtaatcccaactacttgggaggctgaggcaggagaatcccttgaacccaggaggtggaggttgcagtgagccgacattgtgccactgtactccagcctgcgcaacagagtgaaactccatctcaaaaaaaaaaaaagaaaagaaagaaaagttgagtgctgctacccagctcctctgagcaactgtgacttgactccttgctaagtagccagaaatgtaattaaatacttgaggcttgaaattatttaatcccagacaatttcttttaatgccagattgaagaacctcaaggagtgaagattcttagattttccagtcctattttctatggcaatgtcgatggttttaaaaaatgtatcaagtccacagtaagtattttatccctagaaatttgttttctaacctcttttgagacttcattcattctacaagtatttactggggtccaatcaggaataggccctagaccctcttccctttgtgtagggcaatgagaattaaaatataacatccttgccttcaaataatttacagtctatttggggattaaaaaaacacatatgttaaaacccaggtagtaataactatgccagacaaaaacattagagatgtttctaggcagaatttgagtaagtttcaaataagtagtatagacagttgagagttcatagaaggaagagatccaggttagttggactaacaggctttgtgcggcagttggctgaaggaaagaaatcatgtcaagtgtttgagaactatgtgagctgagagacagtggaaacatgtattggaggtagggttgcccagttgcagcaaaaagtaaaatatactagtggaataaataagtagaaaatcctggcaccaaatgccatgctatgctttgaacttggagtttgcctctaaatcagtgtttttctaagtgagttccagggcaaactgattcagaggaatgttcacagattttgcaataacaaaagggctctgtgataccaagggaatttggaaaacccagacttaaactaaagagggtattttggggtgtgtgtgtgtttctgttttgtcttttactgtcttggagcctttgatatgctactgtcttctcagagcttctgggtaggagtagggtagcctgggagtagacagagatctactccatcagaccttacaatttcttttttggcaggatagctcaaggaattataccctttgagaaatagcctttccagataacagttgccattaataagctttaggtgccaggcattttaagtaacttgacatttatttccaaaggttggatttgatgccattagagtatataataagaggctgaaagcgctgaggaaaatacagaaactaataaaaagtggacaattaagagcaacaaaggtgagatgacatctttcttttcccccttaaattatttcctttccctgatgagagcagttagagggtctaaaattaaatctatcctctttagtatccagatgtgaatgaacaaatgacatgtacgtatcaaagaacaactgagctattcttataggcaagcgggagtggaagggaatgaaataaaatcagcagcgctgcctggaaacacaggatgtgatttttttccccaccatgaacagtgtctgcattattttctatactttatttttactgaaaggaacaaaataagtgcaaattcaatgccagaaaactacccaccatagaaggcagtctaagtccataaacttttggagctgttaacttttactcagattcttctggccagtgtatttcttggcaaagttccacaatcatccagaaaacaaaagtttcctggctcctctgttctcccagttttcttcctagacaacatcaaagtttgggctgaggtgaaacccatccttaaaaattcatctccttgatgtcttgcttaccaaggaacagtgtgtaggtcttttggataatttgatatgaatggttgaaagatttcaaatctttgacaattaagttgacagtgttttcttcgtttagaatggcatcataagtgatgctgtttcaacaaataatgcttttgagcctgatgaggatattgaagatctggaggaacttgatatcccaaccaaggaaatagagattcaagtggattggaactctgagcttccagtcaaagtgaacgttcccaaagtgccaatccatagccttgtgcttgactgtggagctatatctttcctggacgttgttggagtgagatcactgcgggtggtaaggttctggttttctgaattatacatttggagctttggcaatagtaaaatgatgtgggttgtccagtattgcaacagggcaaatacatgggctttgtaatttttctaggtgaatgcttttgtaaaaaagtgtaatattttaaagcataggctctggagccagactacctgggggagatactggcttcaccacttactagcagtacgaccctgggcaagttgcttaatctgtctatatctcagtttcttcatctgtaatatggaggtaatgatggtatctaccttcacaggttgttacaaggattaaataagctaatagatataaggtgtttagaagagtgtctggttcaggctgggcatggtggctcacgcctgtaatcccagcacttcgggaggctgaggcaggtggatcatgaggtcaggagttcaagaccagcctggccaatatggtgaaaccccgtctctaccaaaaatacaaaaattagctgggcatggtggcgcacacctgtagtcccagctcctaggaggctgtggcaggagaatcgcttgaacccgggaggtggaggttgcagctgagattgtgccactgtactccagcctgggtgacagagtgagacttcatctcaaaaaaaaaaaaaaaaaagaatatctggttcaaagatactccccagcaaattaattcacatttattatgttttatctttctgagaatgtataacaagtggtatatgaaaagaaaaaaatgggcaaaagtttattaagtattacatttctatttgttatgttaacagcaacaggataaggaataccaggtgtatgttaggactggaaaagccaggcattattaagaggttagagtaggaagcaggtcagacatctggaaggtcaaagcaagagttgaggagtatgcaggatagaaacattaatgatatcagaaaccagttatgcaagctgaagttcattaattctgtcaacaaatagatgtgaaatgcctaatgtgtactgagcactctgccaggcacaagagactagtgatgaagtagacacagtttctacctacgtgggacttagcagtctggaggagaaggcaaacattaagtcatcttataaataacaattgtagtaagtgctccaaagaagatgaataggacatcacctgaagcatcaagttcagtgaagcttcaggtaggtatcaaaagggtcaggcagaaaagtaagcaggtcaagacaccaacaatcagatgtaataatataaagctgactcctaactgaggttccacttagctaaggcttctttgctacctctataaggggaggaaatgattccaggatgtgggtactaggtaggtagggtagagaagtgattgtgcttggcaaaagagtatgagaatatgctgacaggttctgttctagttctcttagcagattttgttattagctcatttgaaaacactcttgttctttgttgtacatttcactctaagcattggctgagatccattgtagactatattggccagagagttcaatgaattacttttggggacagtcttaacatatttaatgccagaatatttcccacacaacgaatatttactttcaaatattataatgacagttatgatagctaaagaagactccaaactttatacttgaacagaggtcttgatttgttttcctccataattctcaaattctcttttattattgaccatgggtcttgtgtcttgactttttaaaattaaatgtttattttgacataattgtaaattcacatgtagttgtaaggaataatatttagatcctatataccccttacccagtttctcccaatgagtaacatcttgtaaaactgtagcataaaatcacagtaggacactgacattcaaaatagaggccttgacttttaggtcaatagtaacattttgaacccgataagcatagccacacccatatctcttctccaatcagcagggcctatattaagaagcctcctgtactctcttctttccacaaatgcttatttagcacctccacgctatcaagtgctgtgctattgagcgctggatgttgccatctcttgagatataatcctaattataccattactgtagtttgaaaacctccatggttttgcaataataacctttccttaaagtcctgattaaccatgaaagtaataatgtttctcctgagcaagtaactgaatgctactgaattatgggcagataaggttgttaattgttacaaactctccttttttatttttagattgtcaaagaattccaaagaattgatgtgaatgtgtattttgcatcacttcaaggtaaatacatatatctacatatctacctgtaagactttcccgtaagccctttctcctatctgggactgtggtcacattatgtctgaaggccttttttttttttcttttaaagatctcaattgtcattatttgcagttctggaatctggcactgcttcattccataaaacagaataagtgttccaaggaactaagcaggagttcagtattatacacagaaaaggccaaagacagcaaaagcaagcaacaaagagtatattagtccattcaaagttactttcttgtaagtcagagacagtgagacagaacaataggaaaataatggattagttaacatgaggtcatgtcaggatacttttttgtatgaggattattgcagaggaagctttattattatgccaactggaaatttaaactgtcctgttttaggaaatttgctattacctctctctcctgatttcttcaagtatcagataacaatttagtttaggtttgataacttgaaactttagcatgagtgactccattttgatttttagtcttgtctgttgtcgtctagtgcgggagcttagtctaaaacaatggccttttatttttattttttattttactatgtgcctgtgccttgcatgaccccaggatgggcacagctgcttggcccctgagccaccgaaggctgctctactccttcgttctggctactaaaagctgcaaagctctgggagggcaaagctcaagaagactaaaacaatggcctttaccatttttgtttgatgattttccccgttttgatcaggctctcacctaggtaagagtgaacaaaatgtaggagatcagtgctactctgttaccatcattttgggtttctggtctcaggaggtcatgtgtagcttatggtgccctcctcattatcatgtatgtctctgagtttttgttgtttcagagagagaccattcgatgtctgacaggtggctttttggaaacatttaaaactttgagagggtataatgtaccaggaagactgctattatgactatcagggagataataccaagggtttatagtatgctccttagccaggattctcatgaatcaaaccaactaaaattgaatagcctgacaaggagactacctgttttaaccaagaagtcttctctgtagtacctgatgtatttatatatgtggaacaagaagtgtcacccaactgcacagatgcttccttgttgagttagcaggtaatctagcattccatgactggttaaattaaagcagaaagtgtaagttacccaaagaagctactcattgtgaagttttaactacagcactatcctgccaagtgaaagaggtaggcacaagtaagggaaaattaaaagggataagcatcttatgatagggagtcttgttctgacagtcttggagctgtctacagcatgaagttgacaacttcttgttttggtttgtagttttattgtctctagttgtggcatccagcattctggcgaactctctatgtggcccacagtttaagcatgagattcatctcttgaaatttacactgagttgctcagcttcagcttacagagcttcaggaactgagtagttcttggtcttcattggagtgttgtagccagatattagtgaaagctaaaagaattaagaatccagctcagtctacaggtagataataaaaactcataaatattgaacagggctacagtctaagaacagttttactatgcttttcttttgaaccatatgtttttctttctatagtcacctccatttctatcaaagacgatcatggtagaccaatttgtttacaaaataagtttggtctcaaacttggcctgattgattatttacacagtacagcaagaataactacataggtgactcctttcaaatttgctttgccaagcctggcgaggtattgcttgcctgtgagcccagctacttgggaggctgaggtgagaggattgcttgagcccaggaattcaaggctgcagtgcactatgattgtgcctgtgaatagccactgcactatagcctggacaacacagtgagaccatgtctccaaaaaataattgctttgatagaaattttgacaaggaatctcagattggactttttaaaacgtcttgatgctatgaagtcaaaccaaggcagacattaggctttgcctgatgtatctaatatcttgaagttactgggcctcccaggaaggaacgactttttattcactcattgtaaggctagcagcccttgaagccaggaattctgtgcacattttcaaatatgatattctattcaaagccttgataatataaccaatgttttccaattgtattctatttaaaagaacagattctattgaactttcatgtaaataatcatattgccataaaaataagaatactcacaaagagtttccaaattctggaaggatcaggtagagaggaaaagcaaatgtttcaatttttgtttatgaaagtatgcttaacaaggctgggtgcggtggctcacatctgtaatcccagcactttgggaagccaaggcggacaattgctttgagctcagagtttgagaccagcctggcaacatggcaaaacgccgttactacaaaaaatacaaaaaattagctgggcatggagcctgaggctgagaatcacttgagctggggaagtggaggtagcagtgagcccagatggtgccactgcactccaacctgggtgacagagtgagaccctgtctcaaaaaataaaaaaaaagtatgcttaaccaagtggctgtaaactgcagatagctttaaagaaaaattttctttagatctggaaaacaaatattaaaagaaccagcaatgtttcaaataaaaaagccataaaacctgtaattcttctccatcagttcattcagtctcatgtaattaattcttgctctgtttgatcttggctggtagtttaattccatcgaatggtatgaattcaaagttattagaaacctgtatttgtcagagttcttttcattcttcccatataactctttgaagtcacagcactttagaattataatggcttacaaagagctttcagaaaaagtatcagaacaaaacaattaactgtggacaacaagacttaaagtggctatatttaaagatctgatgtgagttacccaattgacaaggatatttggatatttctgtggcacacaacaatttaaaataaccaaaattatgactggtagcatttataccaagacctatcacatttctaggaatgttatataattttggaacatattaataacatatctataaaaatatagcacaaagaaagttaaacatcatttcttattttaacagtgcttcccatataatttaacctatcagataaggccatttggtttaacatctctcttttacagattctttaagaaattccagggtcctctggaacatcccaaagttagttcaaggtcaaaaagacttaattttgatttttgagaagtttgtcaaataccaaaggtttaaaacatttgatcaaaataggatcataggtcactatgaaataaaaccaaagtgaaaaaagagttcaaaggcaaaaagcacaagaagagttatattgatgaaacatgaaatctctgttttctaggccagttacctggaagagaaaatcctctcacaattttctattaagagtaaaccaatcctctgagaaaactctattgttccaacacataggcccacactttagccttccatcagtgtactttaatattaatgctcaatttttagaaaaacttataaataattcccttctacttttagccaactcaatcacataaaatttttcatgatatttatcttctacaaaccttctacaacttgcttaaaccttcatttggtcctatacttccttttttaaaattggcattgtaccttaggacaaagatttacttttcttttctccttatcattttgaccatataaggttatctcctatacaaaagaaaaaattactctcttttcaattttctttatctcttcatacttgtaaatttcttctcacatctttcctacctagtggttccttcctgccttgttttgatttccttcataagtccatatttagaaacaacctttaaataacctctgattgccaagctagagttaagttttaaataaataaataggccggtcatggcggctcacatctgtaatcccagcactttgggaggcaaaggtcagaggatcacttcaggccaggagtttgagaccagcctgagcaacatggtgagaccccgtctctattattttttttttaaaaaacaaaaagcataaaaactctgagaacattttgaacccagaaagatattacttccaatttgtgccacagagctggtaatgtatggaaatgtgtatcttgacagtgggtgggggtggggtgaatattgacaatgtggggatgttgttatgaggagagcaaagctggagattacttagattccttagaacaggaggactctcaagggtgtgagtctctgtgtgtttctttatgaatgtatgtgtgtaggaaagtgctaaggcttaggttgaattctttagcagcagagcccaagatggggattcttgcacaagcgatttattgagaatacatctgaggaaatttatgaagcagtgaggggagcaggatagggaaggggaagaagctgatcaaagacatggtttctgaagtccagcgtagatccctgatttcacagggagcaccaccacaggaagagtaccagaaggttatgcctccttgaggcaagaggacctgctttctcccccagtaatgagtcagtcagtggctgcaggccagccatgtgtggggatgaaacctcccagttctctttatttacttatttatttgagacagggtcttgctctgtcacccaggctggagtgcagtggtgcaactgtggctcactgcagcctcaaactcctgggctcaagtgatcctcccatctcagcctcctgagtagctgagactataggtgcacaaccacacctggctaatttttgtatttttttataaagatggggtttcaccatattgcccagaagttctgggttcaaagtgatctgccctcctcggcctctcaaagtgctggaattacagacccagtcctctttagatgacacagctcccaacgggcaagggaaagtctccagagaagggcacagctgtgaaacattggcagcctggcccacagcagcaggaggatggatacactggcttggccaaagggacgtgatcgtccacaaggttgactacgaccagttatgggataaccattctatatactactggaaaagaaactgtcatttcaaatctgggtcacattttggataagagaaaaataaataaataaaaggaggagctacaaaaacttagtataggttgatgctttaaaatttcttttcttagctgggcatggtagggtgtgccctgtagtcctagctaattgggagggtgaggtggggggatcacttgaacttgggacgcggaggttgcagtgagcaatgatgccactgcactccagcctgggcaatagaatgagactctgtctcaaaaacaaacaaaaatttcttttcctaggaactaacaaaacattgtgtctttcttttgaagattatgtgatagaaaagctggagcaatgcgggttctttgacgacaacattagaaaggacacattctttttgacggtccatgatgctatactctatctacagaaccaagtgaaatctcaagagggtcaaggttccattttagaaacggtaaatattcaacctttctacagatgtatcttttctaaactatcatgatttctataaatggcaaacattacacaagtctagtctagctgttgaattttaagctacctatataacttcatggagcctcagttttttcatcagtaaaatggaagtaaaaacattaaccttgctaggtagatatgaagactaaataagatagtttataggaaattacctggtagtacccagtactgaatagttctacaatgtgtaggtttattaataaaagtgggcattagctataatgccttttaagaatattgaatcttggatcttttgtgatctgggatttgtgtacataaattccacttaaattctcagcaatctggaaaaccttgaattataaatgtctttaaacaggatccaccaggccataagtgatctttgaaaaagaaatttaaaaatcaagccacaaagaagcccagggttaatttttccctacaaaatagaataggccctgatgggaggcctcatggcacaacagtagcgcatctggctccagaataggccctgatttcccatgggtattattttgttaatttttctgtcaaatacccagaagaggtgagcattctggtctggttcattgggcttggcctaatggtgctcctggtggtacaagaatctcatttctcatagtgaatttaggaaactaaagcaaatacctatcaagatataataacagtaatgattccagtgacatcgtggatattttaaattgcttcccatttttctaaaagtagaataagtagatccttattgtagattggcagttgattgaagaaaactaacttaggaaatgatattatattattctttttaggcactggtagtggagagattgttctatttgatgttccttggtaaaatactagtcctaactaccaagctgtggatcttaaatataaaaaaggaaaaaaaaaaaagagtaaagctacaaatctaaagaaaaaaaaactgtttatcattgaaaattcataaactttttctatccaacttaaaattctctaacccataggtgataagaaagttggatcatatgaagtatcctttaagagatccacattaaaagtaaaacagaaccaaggtatcaagttctttctcaacatgaaagcagttattttatttgtttatacccattcttactaagattttaggctatgaatgtcataaaaaccactaaccaagagtgtatctactaggttagactcactcttgtttgcaatcagagaggtattgtgagtggctgggatggatttttttggaccttaaacaaatagactaagcataacggaatgcttgtattacatacttactggtccactaaaagtgggttggacattcctggtggcctgtgagatcaagaggcttatatttctgtgtcttctcagagtctagcacaaagctttatatgtgataagtaggtgaatgatgataaactccttcaagagggagtccctctgtatcaaagatattgtgactgcaatgacacaaccttcttcctatccctttattttaccatcacaggactatctcaggacacaacttgtagttagacttatcctctacctttcccattatgtcataccatttgcacagggacttaaccctctaattcattctcatactagctaagagaattgggctatttgtgagttgaaaagtagctaagtagcatttcaaaatgttattttagcctggatatatatttggagttgctttgaaaatgtccttttccatgcaaaacacaaagccaaaattgtcgttggtttcctctgtgtagaagattaaattacatgccacctctaaacagtagagcttttctgaataaccaacttggtccatagacattggtttccatctccaatagaattaatttccacccaattccatttgtggctgttttttgtcatcagtgacaagctcttcactgtgcattcattgcacactcaacgctgtgctaagtgctcttagcttagccattgagagatgcactattgactgctgaatcatttaggcagagggggtgacttgttaagaggcatacactcaagaggttggggaagagagctgaaaaggagtttacacaatggagaactataccagttcacctttcaatgtgcaaaaaaatgatatacaaaaaattttagttgggaaatataaaagaacaatacagctgaagaggattctgaagtatgtaaagacagatgagaagcaccaggaaagcttcaaatcattttcagtggagcatcaggtgggttgatgctattctatttctaccctgtgttctctttttcaagatcactctcattcaggattgtaaagatacccttgaattaatagaaacagagctgacggaagaagaacttgatgtccaggatgaggtatgatcattttcttctgaagaaaatatttgaattacattttgaataattagagtaatacaaatagtgaatatatctgattaagaactgtcagggaacataattcccccaaatgcagaaaagatggcttcatagcagggaaaaagagaaaataagaattctcccttgaagacattaagtacttggggatcttttgtcccaggcatttggggatgatcagcaactggcaagagccaacacactgctcctgatttgatacctacacctctgcatactgctcttctagagatgtaaggccatggggtaggaaaaaaatgaatagaggaaacttctaagctaggaactttataagcctcaggaatagtatgtgaggaacagaaaccctatgaccttccttcatatgactgataaaggctttaaaaacacactctccccaccctagactgattctgtgtatttcagatgctcttgtgacatcagactattcctaggaaacttgtctgaacttgtagcatctgagtaaattttgcagcttcgccactggataagaggtgaacactgaaggaagatcacagaattgtaaaaagttgaaagatttcttagaatcaagtagtctaacattctagcccatgcagaaatccttcctacaccatccttgatgaatgttcattcagcttttatgtgaacatttccagacattggccactagcggcttctcaagggagtttgttacatggttggaagtctctaaatgttacttgtgcttacagaactcaatttggcctttctgtagtaaccacctagtgaactgagatctgccttccttagcaacacagaccttcccactgaacagcccttcaaatatttgagaatagttctcatgtctccagcagactctcttccagttgagactcttctagttccttctattccttacaaacaagcagtcagtgcttctctggtcacgatggggacacaaaaccctaaatgcggccaggccagcatggagattattcaaccatgacctaccttgatctcatcaagatattcctattactacagcttaaaaatgtgtttcctttcataatagcaacatcagaattttagcttctattgagcaggggccaactaaagactggggcattttcatacaagctatggtctagtagagttccctagttatatttatttaattgagctttgaccctaatacagaactacacctatttctgctggatttcatcttgttggttcttgtttactgacataattttgtattattattagtattattattattattattatttgtgactgagtcttactctgtcacctggactggagtgcagtggtacaatctcagctcactgcaatccctccctcccaggttcaagagattctcacgtgtgcctcagcttcccaagtagttgggattacaggcgctcgccaccacgtccagataatttttttttttgtattcttagtagagacagggttttgccatgttgtccaggctggtcttgaactcctgacctcaagtaatccacctgccttgccctcccagattgctgggattacaggcatgagccaccacattggccagttttgtgttttgaatctaacatccaggatattgtctaccccagtacccgttacctggtgtcataatcaaatctgataagcctgccttctctgcctttttctaggtcttgaaaaaatgttgcaaagaaaacattcaaccccctatagtgaaatcaggcagtaaggatgacaggcagagatttctgtggaggaaatacattgctagagtgaaaatcacagtacctgcatcttggcccaccagcttagtgagcccaggaaagtcattatcgacctgagaagtccttttagctccagtagtttatgactctatggatatagggtgccttagtttgagtaaaaactcatatgtcaacattaaaacttaagactgctatattataggatatttattggttgccacgtaaaataatcattcagggagggtttctatagatggtaaaacaatatagcacaatagtttcaagggcatggactttagaacaagacagacctgggtgctagtcctcattctgctacttactggctgtgcaccccagggcaaattacttatcctgtcttcatattagtatcttcatgtaaagtagtaataataccacagagttgtgaaaattaaaggataaatgtaaagtaacaagagcagtgccttgtacatagtaagtgctcaataaatagtaatcattgctcttaaataaatccaattaaagtgtgatgaatacaggccaggctcagtgactcaagcctgtaatcccagcactttgggaggctgaggcagggggatcacttgaggtcaggagtttgagaccagcctgactaacatggtaaccccccgaccatctctactaaaaaaaaaaaaaaaaaaattagctgggtgtggtggcaggcacctgtaatcccagctactcgggaggctgaggcaggagaattgcttgaacctgggaggcagaggttgcagtgagctgagatcacgccacagcactccagcctgggcaacagtgagtgagattcagtctccaaaaaaaaaaaaaagtataatgaatacgaaatgaagtttttaccctatttctattgtgatgatatacacctaagatgagtagcagtaagcaatcaatactataaaaacatatttataaaaaagataatgcagacttaaggagaattcagttgtatcaacactttgttttccccttgcttccacaggctatgcgtacacttgcatcctgaaagtgggttcgggaggtctctatgagcaaggaatacaagacaaaacttcctcaatgcattgactatttcttcagactcaaaacactcattcttttttctattaagccattgaaagagaagcactaagactgcttctaggctttatttataaaataaacaccttatccctaacatgggcaaaatggctagaattattcagacgatttggcagcgtccagggtaagctggtgttataatacgctgctgatctacatcacagatttgctaataatgttcacgtgggccctggcatatctctgttcagttagagtgagtgctgacccaacagcctctgtggtcaagcgagtcacgaatgattaatcataaagaaaaatcagtttttgactgacctggatatccatgagctgcactgatcaccatgtaaggtcacatttagtaaatgctgaaataaaatgattaatgcatttatcaataaaagcctttgaaaatactttggataataaattggagttttaaaaatgcaaatttgcttagtatctaataatgaagtgttattacatatagccggaattgaggatctctttgatcctggaaatggtttacctaaaagctacagaaccaggccaatatattttgaaatattgatgcagacaaatgaaataataaagagattttcatggtttataaaaatcttttttgatatgataataatcatgatcacaactgagatcaaaaaaatatatgacagattattttgtttaaaaatgcagttttaattatcttagtctatagaaatgatcattgcatggaggcatgtataggtatgatctgtgtaaaatctgacataaaaacagtgctattctgagtgaaaatttttttgatgtgcttacataaccatggtgattaaaatgagtttatattttttctcaaaaattttagcagtgtgtaaagtaagtaatctttaactgaactctgaccacttaaaaaaaaatctaaaaattgaactacctatagtagtctgtgtttaaagtgaatttttaaagacaaagcattctaaatgaactcaatataaaaacattcatttggaatgtacatactgaaaaatacaggtttttttgaccaaaagtttttatatcttttctttttatttatttttttcctaagtgccaacaattttctagatattatatacaacacaggctttgatcttggggacttttcccatatatttcacactggagtgaatgaagttgtacttcatttctagagaaaagttatacccaggtccccaattgagaatgtcttgcttgattgaaaacgacatcatcccttggtatactccagggattggtttcaggacccctgcatttaccaaaatttgtgcacactcaagtcctgcagtcacccctgcctaaagatagaatggcttctctgtttttcttctgaaatacaaccagaaacaatgtgtctatttctgaaagaataggattaatgatcatacaaatgggttaatcctgaattctggttgtaaatctggttacagcataactaggattataatgctgcctcattttcacagcactacttgcttatattgacaacaaatcatctcgctaaagagtgaatgtaggccaggcgcggtggctcatgcctgtaatcccagcactttgggaggccgaggcgggtggatcacgaggtcaggagatcgagaccatcctggctaacatggtaaaaccccgtctctactaaaaatagaaaaaaagaaattagcctagcgtggtggctggcgggcgcctgtagtcccagctatttgggaggctaaggcaggagaatggcgtgaacccgggaggcggagcttgcagtgagccgaggtcgtgccactgcactccagcctgggcgacagagcaagactccgtctcaaaaaaaaaaaaaaaaaaaaaagagtgaatgtaatagtcttgcagaaaatgaatgaatacctttgttcaataaaggaaatatgcactgctcacttttttgaaggaaatgccaaagttacgttttacaacaaggctagagtttgtaaattctgggttcatttgtgatgacataagtcagcaaactgcgggaatactgtctcttctatgtattttgtgaatagtaagcataattttagttttgtattatcaatgaaaatttcacttgaaattaaagctgccttttgttatatttttaacctataggataagattccagtattgtatatgagttttaacaaattaaaaaatcaaatcatgtacatttgaaaatatttgcacacatttaaaaataaatgtaaagttgtcttttaaactactcggatgtgtcctttctgaacaaaactattaaatataataaagaatgtgccaggagcagtggtgcatgcccttgtagtctcagctacttggaagcctgaggtggaagggtcccttgagcccaggagttagagtctcagcctgggcaacacagcaagaccctgtttctataaataaataaataaaatataataaaaatacttcattctaagtttgtcattgctcttatcagtcatcattatgaggcattctttatagcaccacttctgtttataattcctttgtgtagatttatcagtgcaataaacaacattactcacaaatatcacagttaaaccttgtgattcttatccaaatatttccagtttattttgtgcaatggttattattattttaagcaaacttttcattctggcacaacatatgtaaaaaaggatacaaatcacagtgtactgcttgaagaattttcacaaaacaagcacacaagggtggcctgtgcccagatcaagcagcagaatgccaccggcaccacataaactcttcatgctccctcttagttggttgccccaaagggcaattactgtcctgacttttaaaatctgttttttttgaattgcatagaaatggaatcaaagattatttcttttttccccctttcttttgtgtctgtcctctttcactcaacattataatcaagagattcatccatcttattcaatatagcaatcattcattcattctccctgctgtatagtattcattccattgtagaatttaccaccacttatgtattcatcctacagtttgtggatatttgtgtcgtttccagttttgggctctcatgaatagtgctactatgaacattcttgtgaggcatccttgcacattccagaaatatttggtggggtggggttcctctatctggggcttagatctgtgaggtgagaatcaatgaaattagggttattttccatttgcatcaggttaggtatctgaagaaagtttggtttcagttagagtagcatttatcatgcaaacaatttaacagtgtaacaaaaaccacacaaactttagttaaatcacatgaagttcagttctgtaagaaagtcacataatgacaaatacctagaaaaagagtggaagagagaaaaagtagaaacaatgaggggagaaggaaaggaagttcagaggggaaagtaagggagaaaaaggtaagagaaccacagagaaaaagaatgacaattagggaaggaagagaaataagaaagggaaaattaacggaagaaagaaaagacgaaggtaaaataaaaggtggaaggaagagaaagactaagaagaagaaaggaatggtggcgtagagaatttcataatgggaaaataaaatccaaatagaggattgatttcaatataatcatatccttcgagaactcagagaagtgagcaacactccctcccccacatgccacaccatctcctgaattcttggtcccccttacccagctcttttcattaatatcagcttctagtatgctgtgtaattcacttattactgtttctcttcctgccgcctcgcttatactagaacataagcttcaccaaggcagggttctttattttgttcctggacatataccaagtattcagaagagtaaagagtgtcagacacacggtagaggtgcaataaatactctcagatgaatgcattaagctaaagtcagtgatgctgagtaaggttaacataatttgagaatggcagtcattaagtacataagacattcagagtttcctgagcttgcaggcctattccaaagacttactgtgacagctcacctgcttgcctgtctgccttacctattggtctccagaaaatggcctgggaattcacttgtatgttaacagagcttcagggaattaaaggccctttaatgtctatatccattttgaatatgccaaccaagtcagcccacttcatccttttcttcaggaacatttttgggcgtgaacattgaggtgctgtttttgcataa

SEQ ID NO: 17370 - DNA, 35609 bp, Human
acacgcatttataactagcgccaaaatcaacggagagaacctcactagaaggaagcccctcttccagttgctaactggaagcccctcttctagtcgctaactccttccagtcactatcccctgcccaccaaggtaaccattatgctaactttgagcctcttagttcttctgtttttgtagtttatagaaatggacttatgccatgtgtacttttgttgtctttttatgctgggcattaggtttccccagttgattcacgttattgcctgtaattgcagatgcttttttgcgttgctgtatagtgtttcattatatgaactctgtgtaatttcattaatttattctattgttgatggtcttttgggttattctcattaaggaattattacaataaatgcagctacgaacattctgatacctgcctgtccgtgcaccctaagtattcgtttctctttgctctatatgcaggcgtggaactgcggggccatagggtatgcaccttttgcagacagtcccaaactgtttttcaaaggagttgttccagtttacattccagcagcaaagtagaagaatgcagttactctacatcctggccaacacttggtattttccatcttttttttctattctattttattttgaaatataaaaacaactgaagcaaagttgagattgcttttgcggaaccttttcgtttttggttcgcttctctgaataattaaccatctcaggcttctattttgtcctgcaggctgtgtgagtgcgttttcgactttgctcgacatttttttgctcacttggccacttaagatgtcatctggtcaagaaaataaggtaggtgtccgaagcggggcaagccctttgaggacactggaagtgtgataactctgtaggcgaaactcatgcggaccgtcattggccgatttctcttttctagagttcacgatctaggagatcctgctcgtctctgatctccccactgccctcccgggctcccttggaggcgcctggaaagctgagccgccgccagccacccgccagaacaggggcggggcagggccgcgggtccgcacagagcatgcgcagacgaagcacggcgcatgctccgcagcgcggcgggtccacagatgaggggagtcgagactcccgcgccccaccacccccggcggagctgctgctgagccactcaatctgagccctggctactaataaagttcgtttaaaaatcataatcattcttaagagagcgaaagagggtgcgaactagccgctcggccccgcagggagagctggcgcgtcgggaggagacagcggcggcagcggttgcgccgcgaccaggaggagccggtggcgccgggcggcgggtccgcggccggtgggggacggtgagtagcggctcgcgctgcggtgcagcggcgctgcactcactcgccctctccaggggctgggggttcgtccggctccactggggaagactcagcttctccccggggtcccgggttgtgccttactctccggagtgggcaggggtatcgagggcaggggcctcccggcccggctcccccatcccccggttcggaccgccgagcgccggctctcccctccctgagcaccgatcccaagttccagctagagaaggtgggcggcagcgccagcccggcgccccctcccagctcccagcggtgggtacctggaattgcctggtgggcgggaaagaggggtggagcgagggcggcgctgcgtccccagtctggccgaacgttcggctttttgcctgccccaagtcccgactggggaaggggcgacccgggctgggccagacaccagtaagggcgtgaagtgctcaggttaggtttgatggcgaagagagtcctcagctccaccctggcatttagactcctccctgcagtgcgaccactctttacccgcgaccccacccttccctagtttcttgttcatagagtgctggaatatgaatgagccaaattgtgctgttccattgacactggttgctacagaattaactttactcggagatccgaggagccatcggcagttcccaggagtaagaacctgagagcgtgtgagagtaagaacttcattatcaggagctagtgaagtggcagtagggtctgaaaagggctgttaacttctctaggtttttatgtatctcctaacatctaggtaatttcattgaccctaagaagtttttcagtatttttacaaatataacctgtacttctacttaaataaaggctgttatgagaaaacaaccttttgattagtgagttaactcaccctttgcttctctaatttattagaccgcattagcaaaatgttaaaagttttggggaaagggtatttatataaagtattattgtcgaggtttttaattgtactcagaagtatgcttatttctaggaacgtaattgttttgatctagtgctttaagtctatagtttctgaaaagcaagagtccgactgcctgttaaaatttaatttggcttttttctttaaatttattttaaggaaattaatttattattttaaaaagtgtatggtaaaattgattttttttcgatgtacagttctgcgaattttagactcatgtaaccaccactacagtaaggatgtagaacaaatctatcgctcccccgccacagaaaaaaaacctaatgtgatcccattatatcatactccttacccctggcaattactaatcttttctagaaatgaaatcataacagttagtaatctttcgatgttagctttttttcactcagcataatgcctttaagatttctccaagttgtttcatgtatggataatttctttttttattgctgagtactattttattatgtggatatgccacagtctgtttcaacatctgcccatggaaggacattgaggttgttttcagttttctgtgattatgaatcaatctgctataaataccatgtacaggtttttgcatggacatgttttcatttctctagggtattgctaggagtggattgcagggtcatatggtaaatgtatgtttaacttttaaaaaactgttaaactgttttctggagtatctgtgtcattttgcattcccacaagcaacatgtgagagttctagttgctccacatactcccagcatttgatagtgtcagtttttttaaatttagccattctaataggtgtgtagtggtatctccttgtggttttaatgtgcctttaactaatggctaaagatgtacatgttttcatgtgttcatttgccacatggagtcgttggtgaggtatctggcaaagtctcttgcccatttttaaattgggctgttttcttatgttgagttttgaaggctctttatatgttttggatacaaattatatgttagatacgtgtttttcaggtattttcttccagtctgtctttctcttcattctaacagtgtctttcagacagcaatgtttttaattttggtgaagtccagtatcagtttttccttttatgggtcatctggtgtcatgtctaaaaactctgcctaacaggtcaagattttctccttctaaaaattgttttataaaagtgttccatttagatctgtgatccatttgagttaattgtataaggtgtgaaggtttacttttttgcatatggatgtccagttgttccgtcactatttgttgaaaagactgtcttctctccattgaattgcttttgcacctttgttaaaaatcaattgtctttatttgtgagggtctattttgggcctgttttgttccactgatttacttagctttccctttgccagtattacactttgttaatttagcattataatgtcttaaaaccaggtagtataatttcctccagttttattctttttcaaaattgttttagctattctgattcttttacctttgtgtataaagtttagaatcagcttgtggatacagaaaaatttggctggtgctttgattgaaattgtattacacccgtagatcaatttagggagaattgctgtttactttgttgagtctcccaatctatgaacatgatatgtctttccatttatttaggtctttgatttgtttagtgttttgtagttttcagcatacagattgtgtacatgttttgttacatttatacctaagtatttaatgtttttggagctattgtaaatctcattctaaaaaatactggtttcaaattgtacattgtttgtacacagaaatacaattgaattttgtgtgttgtacatatgtcctctgactttgctaaactcattagttcagggtttggtttttgaatttttggtggattccatgggtttttctacagagataatcatgtcatttgtgaatagagaaagttttaattttttcctaatctgtgttttatttttgtttcctattacaatgactagaacttcatgtatgatgaataggagtagtgagaatatatatccttaccttgttcccaatgtgaggggaaagcagtctgtcttccagaattgttttatgttatagatgcttttttttccttttttttttttttggagacagaatctcactctgtcacccaggctggagtgcagtggcacacgatctcagctcactgcaacctctgcctcccgggttcaagcaattcttgtgcctctgtctcctgagtagctgggattacaggcgagcaaccccacacccagttaattttttgtatttttggtagagacacagtttcaccatgttgtccaggctggtctcgaactcctgacctcagtgatcagcctgacttggcctcccaaagtgctaggattacagatgtgtgccactgtgctcggcctatagatgccttttaccaggttgaagaagtcccattctatttctagtttgctcagagttttctcacaaatgttgaattttgtcaatatttcttctgcatcaattgatactatgttgtgtttttttccttgagtttattaatatggtggattacattgattgttttttgagtatttaactagccttgcattcccagaataaagtccacttggttgcagtgtattgtgttttaaatattgctgaattcaatttattaatactttgttgaagatttttacatctttgttcagaagagtttgtctaattttcttttttgtagtgtctttttgtggtatcaagataatgctggcttcataaaaagagttgggaagtgtttcctcgtctctattctggaggagattgtgtacattggtgttaattttttaaatgtttagtaggattcttcagtgaaactgcctgatcctgtagatttctttctgagtttttacattacaaattcaatttccttcatagttataggggtattcaaatggacctatattatattgggtgaattatggtcgtttatacttttcaaaaatttggttcattttgtctgggttgtcacatttatgtgtgtagggttgttacgttatccttttgagtctgcagagtctatgttgctatcccctattttattcccggtattaggtatttgtatcctctctcttttttgtgttagtctcactaaagttttattaaatttattgatcttctcaaaaagccagctttttgtttcatcagtttttctgtttgcaatttcattgatttctgttcttcttttttagtatcttcctttttttttgcttgctttgggtttattttgctcttcttctagttcttgaggtgagtgcttagattattgagttgaaacttttttccttttcaaagtaagcatttagcgctctaaattttcgtatcttaggctgggcacggtggctcacgcctgtagtcccagcactttgggaggccacggcgggcggatcacttgagccaggagttagagaactgcctggccaacatggtgaagtcctgtctctactaaaaatacaaaaattagcccagcatggtgatgcatgcgtgtagtcccacctactcgggaggctgaggcaggattgtttgaacatgggagggggaggttgcggtgagccgagatcaggccactgcactccagcctggactactgagtgagactttgtctcaaaaataataacaataaaataaaatatattttcccatttcagcactaatttagctgtgccccacaaagtttcacatgtattttcactttcagttaattttgtttttttttttttttgctttccttgtaactactactttgaatcctggattatttgaaaagtgtgtgcttttagtttctgtctggagatttccctgttttatctttctgttattgatttctagtttgattccattgtgatcagtgaacatattctgtatgatttccattattttaagtgtgtttgagacaggaggtcagtagatctggttccacaagatacaggtcttaaaagatccccactgacaaaacaggatgcagtaaagaagctggccaaaaccaagatggtcatgcaagtgacctctggttgtcctcactgctcattatatgctaattataatacattagcatactaaaggttactgccatcagcaccgtgacaatttataaatgccgcggcaacgtctggaagttaccttatatcatctgaaacagggaggaaccctcagttctgggaattcccccatccctttcccagaaaagtcaagaataatccaccccttgtatagcatataataaaaaaaaaaccataaaaataaccaaccaccagccctcagggccgctctgtctatggagcagccactcttttattcctttactttcttaataaacttgctttcatgtcactctgtcggctcacccttgaattccttctgcacaaagccaaaaacccacgtggcctcctgggctgaactccagttttggggtttgccctgtgacatgttgatgtttgttttatggcccagaatatgttctatctgggtacttgaaaggaggtatattgtgctgttgtatagacagttctataaatatcaattaaattctgattttattgtgtttttagaattccattttgatttatctgtgtgtttttgagagtacctgcttgtattattgttttagtggttgttcttggtattacattatatatatagtcatgcattgcttaatgatggggatgcacattatggttttgtcattgtgtgaacatactaaaatgtacttacacagacctagatggtatagcctactacacatctaggctgtatgctattagagcttattgctcctaagccacaaacctgtacgctgttactgtattgaatactgtaggtacttgtaacacattggtaaatatttgtgtatctaaacatatttaaacacagaaaaggcatagtaaacatatggcattgtaattttaaaggaccactgttatatatgcaatccatcattgaccgaaatgttgttatgtggtgcatgactgtatatgtgatttatccccataatttatcactgcagtcaatattttacaaattcaagtgaagtgtggaacccgtacctccctttatagtcctttatccttccccatttataattgtcttaaatatttttcctacatatattgaacaccacattggacagttttataatttttttttcaactatcaaacatagtttagaacactcaagagaagggaagtctgttgtatttaacaatatttttgctcttaccatgttctttcttttgttctgacactccaagttcttcttttaaaaaattatttcttttccactgagaacttccattagctgttcttttgcattggtctgctgtcaacaaatgctcttagttttccctcatcagagattaccttgatttccttttcattcctagaggatatttttgttggatatataattttgagttgacagttcttttctttcaacactcaaaaaatgatgtgccacttccttctggcctccatggtttctgaggagaaattcactgtcgttcaaattacttttccccatcctttttctctggctgctttcaaaatgttttgtctttagttttcagaagtttgactttgatttgtttaggtctagattttgactggtttatcctgtttgggatttactcagcttcttgaatctgtagctttgtctttttccatatttgggaaattttcagtcattatttcttcaagtccttttttagctctatcttctttctcctctcctcctggaactccaatgacagaaatatctgatttttttgtggtttagttccacaggtcttgaaggctctgtcctttatttcagcctgtttgcgtggctcagattgtatgttcaagttcactaattctttcctccgtcctctctattctgccgttgaacatatcatttagttttttaaattatggttattataattttcagttctactttccatttggtacttctttatatcttctgtttatttttgagactctttattttttacattcgtttaagtatatccataattgctcattgactgccagttaactttttatttttgaaatccttattacatgaatctaatgtctgtcatctcattgctagtgtctattgattgtcttttgcatttaagattttcctggttcttggtgtgctgagtgattttcgatgaaatcaggacactgggagtgttatgttgtgattctctggtctcattacattctcttttagcttgattctcttcctttgatgtgctccaaaaacaggaagggtggggcactacctctttactaccaggtgaggataaaaactccaggtttcctgcttgtcttccattgaaacagagtgggctgggcgcagtggctcgtgcctgtaatctcagcactttgggaggccaaggcaggtggatcacttgagcccaggagtttgagaccagcctggccaaaatggcaaaaccctgtctctacaaaaaaatgcaaaaactagccaggcgtggtggtgtgcgcctgtagtcccagctgaggtgggatgattgcttgagcccaggaagttgaggctgcagtgagctgtgttcaccccactgcactccagcctggaatgtagaatgagacactgtctaaaaaaaaagaaagaaactgagaatgggaagagctcctcttactactggtcatgatgactctctactgggggccactgataccaccctggctgggaagaggctgacccactgacactgcaaagagtcagtagatggccttattacctgtgagagatagtgtaagtcctgactttctagtaggcttcatctgacaccaccccagcaaaaaagtagaggtgaaaaggggtagggatgactgaattggtggatggggtgggagttcaggctcccacatggtctctagggatgccttggtggtggttgggcaggggtggggggtgccttcatttctccccagtgaggatgcaagtcctccccagtcctccccagttggtcttttctgacaccaccccatagagggagttggggtgcatcaatatagccctcacaagggtataggtgttttctatctttctgcttgctaggctgcccctttcctggtcctttgactcaagagagtaggcttttatgtttttttgttgttggtggtgatatttcctggttactagcttctctataatccagtctgggatatatgaggtaaaaagaactcaaggaaaactcattaccatgttgtgctttgtgtcctgtggtacctttgcacttttcaatgtctaatgtttgtttatatatagtatccaaaatttttagttatacttagaggaaggaatagggaaaaatgtgtatcatttcagaagcaaaagtgtctgaagtatatatctttaaaaggataaaatgtgataagatttttgttgttgcctttttttgaacataacagtcttcttgggtgaagaattgtttaggtagagaaaggaagttgctttctaggaactgaaccagtgtgagatacagctggatgaacaagggtcagatcctggtcagaattttatatttgaccgtgtgtcctaaagactacatcttgtgtagggtaataggatgatgatacttgatgtccagattgtaccctagaccaggggtccccaactcccaggccgtggactggtaccgttctgtggcctgttaggaactgggccacacagcaggaggtgagtggctgcgagcattaccgcctgagctccgcctcctgtcaaatcagcagcagcattagattctcataggagcccaaactctattgagaactgcacatgtgagggatctaggttgcagcactccttatatccttatgagaatctaactaatgcctgatgatttgaggtagaacagttttatccccaaaccgtccctccactgccccccaccaacctcccatctgtggaagttgtcttccaccaaagcaagtccctggtgccaaaatggttgggaaccactgccctagaccatctgatcgtatactcagagggcaagatgcaggcatcaggcatcaggttttttgtttgtttgtttgttttttagacagggcctcgctctgtcacccaagctgaagtgcactggtacagtcatggctcactgcggccttgaactcctgggctcaaacaatcctgccttagcttcccgagtagctgggactacaggctcacgccaccatgcctggccaatttttttttttttttttttggtagagacagggactcacatggtgcccaggctggtcttgaacccctggcctcaagcaatcctcctgcctcagcctcccaaagcactgggattataggtgtgagccactgcccccagccaagtattttttaaagttatctagatgatcccagtgtatagccaaaattgagaatcactagcataggatattggctttgacacttacctgattgtaaaatcacttgggatgtatatccatttgagttctccaggaagtaagtatcaagatggaactaaaagtgcaagagatttattggggaaaatgcctgagaaggataaagaggctgcaatgctagttttttatacttgtgaaaggataaagaaagatggggtggaaagagctccagactgcagtgcatttctgaaaaaatctcagctagtctgatggggagccccagaccaaagaggatccatgttgtgcataattgtcccaactcaagtggcactgcctgtttagtctttacccggggagaatgcggcctcaacaggagtggacagtgcagtggatcctgaaggtgaggtagcagagactgccaggtagcagctcatgaagggagagctaaacagcaccttttatgcttgttttataaaccagattccaaggcttcctgtgaaatttctgataaattatgcctgaggcagagacccagaactgtactttaacaagtacttttaggtgattcttatgatcactcaggtttgtaaagtaccagagacaattgctgagactattagggacaaagaaaggaatgttcacattttggactcccttggtgtagtggttgtatagatggattttcagttaaagtagttgaaatataatagctaaaggagcagtagcctaactagtaattttaagaagaaacatgaagaaattgactttctgttcttttcattcttaaaatgcaaagtgcccattctattgctttcactgtatgtgtaactataaaggtttaaaactaaagcaagaatgtgtggtgtaagatatttatttgtacaggattcattgtaaaccaaacactaaatcattataactaagagtccaatgctgacacatggtcgtacactattatacaaaaccttctttggggtgcttttttagggacattattacctgtgaggttgaaaagcaatttctacagattttgaatttgttgcctatttggtgatacactatggaggatttacaatttttttttattttattttaattttttttagagacagcatcttgttctatcacctaggctggagtacagtggcgtgaccatagctcactgcagcttcagacccttgggctcaagggatcctcccacctcagcctcttgtgtagctgggacgacaggcatgcaccactacactcggctaatttattttattttattttttttagtggcaactgggtctctatatgttgcccaggctagtctcaaactcctggcttcaagcgatcctcttgcctcagcctcccaaaatgctgggattataggcatgagccaccacacctgccctatttgcatgtacataatgagatgtcttggggacaggacccgagtctaaacaggaaattcatttatgtctcatacatgccttatacacatagcctcaaagtaattttatacagtacttttagtatttttgtgcatgaaacaaagttttgactgctttgactgtgacctatcacatgtcaggtatggaatttttcccttatggcatcatgtcagtgcttaaaacatttcagattttgccacatttcagacttcagatttttggatcaggaatgcttaactaaattctgaatgcataactttcactatgctaagtgctttatgtgtatcattgatcaataaccgtatgagatggatattattgccaggaaacagaagcctgaagaagttaagcaacgtgttcactaagagcacagaactagtaagtggcacctttaaataatcaggcatcaaatctaatgatcctagtcatcatctctatgaaagtagatctaggtatttattgatatatgaatgtcatgcattgcgctattgatgaggattcattcaaaaatgaattgttattgctgtacctttcaaagagtttacattatctaaagagagtgggagggacctcagttatgaaaacacatccttgcaatgcaatgtgataatttcttgataaaacaattagtttattttgtacatttttgtgttatgaaaaaataatttcattttaaaccacagatttgagagggaagatctgatctcctagaattagagttggtacagaaaccatttcagctccaaaaatgttggaggaagatatggaagtcgccataaagatggtggttgtagggaatggagcagttggaaaatcaagtatgattcagcgatattgcaaaggcatttttacaaaagactacaagaaaaccattggagttgattttttggagcgacaaattcagtaagtacttggccattttattcctttggctttgatttgtgaactatatccaagactcattggagtaatagttaactgattgcagtggatttcgaggtgtggcaactagtggcaatgctcatgcgacagtgatggtggttttcatgacatatgtaactttatccttttttttttctttcatctcttcccttctttcatttttttttctttttctactctccacgtttttttctgtctcatagctgttttatatttattggtgacaccttgggcacgtcttaaacacaaactgatgctgactccagtgagatttccaactgctattttctttggaatgaaagttatattatgggctcgtttttattagaatgtctgttctctttttgaaactaggcaagactgtatggaagttagagaattaatagtttgctttactctaaagaaataagataaaacagatttgggaggacaaaatttgcctatgaaaaggaaatcctgctttaggaaattcatttggattctaaagcacatcagagtaatattttttgtcattagtcctgagaacttctaagtatattttaaattgtagcagacaaactaaaatgtgttacccaaatacattttagtttgtatttcaaattgtaatttaaaatattacaaacctggttactggcccaactttaacatcaaagataattttatcattttaaagattaatttctagtctgtattctattactttctttttaaaagtatttccatatttgcttcctctcttagaacatattttaagagcaagcatgttaagtcttgatgatgtttgctttttatacttattacctgaaaccaaataaatatttcagtatgcagtcaatccttattgtttataggttctgcatatgcaaattcacccacttggtaatatttatttgtaaccccagaatcagtatttgtagtacatttgtggtcatttgtggacatatatagagcagcaaaaaatttaagttgcccatcatgcacttcccagctgaggtcatcaaacaagtctgctttcttgtttcagtacctcatacagtaaacacatgtcctttttgtgttctgtttaatgccacattttttacattttgtgctttttcttggtgattttgctgtttaagaaggctcctaagtgtagtgctgcagtgctgtctagcattcctaagtataggaaggctatgatgtgccttacagaaaaaataaatatgttagataagctttgttcaggcacgagttatagtgctgttggtcgtgaattcagtgttaatgaattaacaatatatatcaatcagtaaggtgtctttaaacagaaacacataaaacaaggttatgtactgatcagttgatgaaaatgtaaccaggggttctcaaaaacctaaccctatgtttcccttaggagcagtggttcagtatttgctaattcagtgttcacattgacattatagaacgtaactactgtgaataatgagaattgactatatgacaaaatagagtaaattttaagtttaagggcaaccagtgagccagggaggtaaatcgctttttttttttttttttttttttgagacagagtctcactctgtctcccaggctggactgcagtggtgctccacctcccaggctcaagcgattctcccatctcagcctcctgggtagctgggactacaggcatgcaccaccacacacagctaatttttctatttttggtagagacagggtttcgccatgttggccaggctggtactgaactcctggcctcaagtgatccgcccactttggcctcacagattgctgggattacaggcgtgagccaccgtgactggcggtaaattgcttttttgcattcttatcctcattttatcacaaaagcaccagaacccattagaaagatgtcgggaaaggagaacaggcactgacctaaggaaattccccttcccaaaacgttaatcttagaccaccactacgctgtgactgtgtcaaagaaaaaaacatggcagataaatccaaatcatgtgggaagctgtagctttaggggaatgtttttcactctttcactgttgataatgatatcaacatccgaaagtactcagtttttcagggtgaaactgacagtgtacatgtggtctctgactcaggaaggtttgacttacagtttttcaactttagcatgggttttttgagacatagccccatcgtaagttgaggagcataaggatttataatagttcagcttatgagttttttgaatttacagtggtttaatggggtgttaaatgcatttttgactcctaattttcagcttacaatgggcttaccaggatgtaacccccagtaggtttattgggacaacccatcataagtcaaggagcatttgtagttttaatatctttggatttgaaaatgaaaaatatacacaaagctatattaccaaaaacattttcctttacatatgaaataaattcatctcttgttttagagttaatgatgaagatgtcagactaatgttatgggacactgcaggtcaggaggaatttgatgcaattacaaaggcctactatcgaggtaaaacacaggatttatttatttattttgtttgggcatattattttggctaaataaataattttgctttctttgtttcccgtataagggcttctcttgaagaatagttaaaataatttcaaagtattttttaaaaccccagttcattattcttctaaagatcttgtatagtagcaaataatacctggtactgtagacagtttgtctctgccttagaattatatgactcatgtaggcattcccagaccaaatcattaagaaactcttaagtgcctactttgaccccaagaaaatgactgtatagtcagagagtggaagctaacatacgaaaaagtaaagccctggcaaataagatggcatttgttacgacacatgaagtcacatggtaaagccttttcactgctgtaggagttcagagaagtatgagatacctgtgaaaggaaggaaccatgactaaagaatttaaagctctaaaatgtgggctaaaatttcttaaaaggctaaattaaacttccaaatggaacttaaaagtttcctttaacattttcttataaaattttgcccttttcttttggaatttaaaacaccattttcagtgttcctgtaactcaactgccaatagtgattaaagtgagagaacacagtaacaaaagcttggtggaataccatgtggcattatagcctgttgatgccaagtaaatattaattgatcattcatattgacaggtatttaatactctgcatttcgcagatgctgtgggaaataaaaaggcacaactgatatactgattatcccttctatgatgtccctcttttctgaacttttcaccgtgttgtaattaaaacttgttttctaaagacacaacttcctctgctgccttctctaagggaggctttttacccatatccctgcatactcacattcctcaagacttaaaggctgttcggcagaggttgtcttgtttctcactgctgcttccacaccattcctcctcttttctccttccaaaacctcggcaccttgaaagtccaggtcatgagacttttacccaccactaatccccctgcttgctctggtccatcaacttcctttatgcctcctttctgataacagtggcatctgactcagtttcttctccataattgtttggattactttttgaaaattcagcctgttgctcatttccttgttgttttcaaggccaacaattgtttcattaccccaaaatctaaacctctatagtctcctactccctgaccactactggtggcttgtggcttgctaactttaatatccagacgctgtcttgaaaccatcgagagcttctctgttcattgaccctaccactttttaaatatgaccttccacatggctttacttctttccttcttcagcttagtttttctagtcctgtaagcatttgcttgcaaggacctttaactcccagacctgcgctctctgcataatacttgctcagcaaaatgcccaacccagttaaacccgactatctaccaatctgcatccgagcacctgaaccatatagagaatatcagacaaccattcagactgaactttgaagctaacatcacataaccttaatgagtacatagtgctgccaggcactctcagtgttttttactcaagtctctgtcattttccaaaagagctcttttgtgttttctcttgccttaactttgggaatcccttcctcctctccactctgctgatttctttgcttcactcttctttgagaaaatagtcagtgaaaaccattttatccttcccactaccaaatcactttcgtggttaaaactcttcagcatcatatacacaggactttacaactgtgtttcccctcgtctgtccagcatcatctgctgattcctcacttgtacttcacccttgagaaatcccccatttttttcttttctttttacactatgcctggaatgctttcttgtctctcttgaccttttgccttcaggtttaacatctcagaagtctctgtgaaactttctgtggccctcatccctgaacagttaataattttttttagctaattcagtatgtttattgcatttatcactctatgtagcatttgcatatttattttccctaagagattatgagttactttagcttctggcttatggagtggcagggttttttgtctttgtctccccagccccattgcgtagcacctgttggctcaagtgaattcagttgaccttaggagacagtatcattttggttaatttttttataaagtgaaattctgctcgttcatcacacagtctcattttacttatcagatgctataactttatactctgaccttaagtaatggatgaaattttatttttatatatatatacacacacacatacatacacacacacatatatacacacacttaatatatgtgtatgtatgtaatatgtatatatgtaattaatatagtgtgtatatatgtgtgtatataaagtatatatgtatagatgtgtatatatacacacagtgtatatatatttataaatgcaaatatatgtatatgtatatatacacatatttataaacagatgtatatatacacatatacatatatgtatgtatctatgtaaacatgtctgtacatatgtacacatatgtatgtgtatgtgtatatacacatatatctatatttataaatataaatgatttcacttaaaggtatttgctctctgaactagaagccccaggaaagtaggatctaccttgtttatagttgcccccatgactgtttctctagatttgaagttttattcagaaaatgtgtattaagtgtctctgttgttctagggatataataggcatagtaaaccttgccctggcttctttgtcttaacttgtatttatattcatgtaataacattgcttagaaatatatctgaaaagtttcctttaagctaattatcttttttacttcttaaatcttttgttttctgcttttaaatctactctttggtatcataaaaattaaaatatattctatcttagtatgtagaatgctagtagttgaatactaaacagtcccaaacaacagatgatatggaagcagttatgaattattttttcaaagtctctttaaacatcctgtattgaaagatacaggtttaatgaaactgaaataatagttatgtatacaatggaaattcttctgacttcttcatggaagtcttctttaatgtgtcactttacccaatttgaaagggaacctatgtttgtgtgtcctggattatcagagaagcagtacttgaaaatagaatagatatattgaatagcagtataccagtatgtgtctcttgaagaaatctatatatatgaaagttccaagtgacagtgttaatgaacttttaggtacagtatcatataaacacataatttcttcttttagacaggatttaccactgattttattgaagtagcttgcttatttacaaacttacaccagttatataaaatcgatatacttgagaaattgggtgaattcatgtaacttttgaatatatagcttatttttttcgcttttgaaaatgtaggatttattgtaataatgacaactaaggtttcatgattgtactaacatacaaatgaccaaagaagttgcctttctaaattggtaccaaggaaacttgacttccactgcctgctctaaaacatattttggtttcttgccaccactacttaccactctatttactgtgtactttaaggcttcccgtccacagtagctttggttattctctgtggctaccagtttggatcctgagcacctgtatcatggtctaaggttgagaattatgtttttactaccccaagccgttcttggagtagatggtattttttttctacccctctgtcattcaagtagatgatatttgtatcaaattatgaatttcatcagccttgacagtattgattaacaggtcctaaatgtacagttttattcttgagtaaaagttatttgtattttttaatggggttattaccactaccttccccacacactcaggaaaaaaataaacataaaacctatgtggaaacaccagaaagaagtaggattacttgagattttcattattttatttttatctagtgaacttggtcttctaaattctctgcatgaaatgtctgttcttttttttgaggaaacagataggctggcctaatcctttctaagcttttgacagtttgatgtggcagttattactttttaaccaatagggttatttttagagaatatatttgacattatgtttctataatttaaaaaggcaaaactggttgggcacagtggctcacgcctgtaatcccagcactttgggaggctgcggccggcaggtcacctgaggtcaggagttcgagaccagcctggccaatatggtgaaaccacgtctctactaaaaatacaaaaattagccaggtgtggtggcgcacacctgtaatctcagtactggggaggctgaggcatgagaatagcttgaacccaggaggcagaggctgcagtgagccgagatcatgccactgtactccagcctgggtgacagagcaagactctgtctcaaaaaaaaaaaaaaaaaaaaaaaacagcctatcttagtaatttaactttttagctgactgtattaaaatggcaaagagggtgagatactgagataggtcctcagtttcagcgtcttctttttctaaatggtaaaagtaaacatttatcacaatacaatatgaattaaagaaaaaacagcaattatacataaaattgaaaaacagtatattgaacattattttatgttttccctttgggaaacctctttggggttccattagaatgcttttggttgctgccaaataaaaggaatttcgtactgtcttaaaactacagagacttactgatttgatagaaaagtctggaaatagcatcccttttagttgtttgttcagcctataaccttactgattctcctggctttgtctcttccctgtgtggtaccggtacctcctcatgttgatttccttttgggttgcaagattatcaccaggagcaatgacagccacatgctttgtttacatccttggggagagagggttacttcccacagcagtggttcagatgtcctgagcttttctctgattagaccacccttgacctgattgcaataatgagaggaatgtgattaattgacttggatcacattgtgctccttgccaccaccacaactcccacctccagcagagaataggtttagtctacctaaaccatatggctactatacagtgggggaaaggtgtttttagggagagatgccacctaggcaatcagacaatatctgctgctagtacagatttagatagtgatgaaattaaatagaaataaaagtaagaagagaaggtaagggctagaaagaatgaattaagatacaaatgtagtggtagaaacactatgccatatatagttatgacttgctgatttaaatcctagaaatgtgttattaatgatgcataaaaatcaacaaattaaaattttaaaaagaacaattttattataattcatttaaaagacccattatatcaaagccattgctcaaaggtattattatggacttggaatgctggcttaattgtatagtgagagatgttgaaacaagaccttcttgtaaataggttacaacagagcacagattaggaagcctctgggatcccaagtgatttctctaaagctttttagaaagttgactccaggcagtaggaaccagtgattttagttagtacagaaagatacagacgacatgaaatagatttttgttacagttttttactgtgactttggtttgtaggagaggaaaaatatctttttccttctactctttttggtccttgattgggtctctaacaaaagacagattaacaagagaaaaacttatgaatttatttaatataagttttatgtgacaaagaaaccttcataaggaaatgaaaacccaaataaacagttaaacctgaacgtttttataccaggtttgaggaagagtgcaaagttgttgaagaatgtgataggacaaatatgagctaagagcagtaaactggaggaaacttagcaagattcatcagcagaggttcattcagattccttttggtatccttctctcttcagaaatgaggattctcctttcctctgggtatatggaggtcacctctcacctgaggggcttatgacctccttcaggtgagggtcagaaaatccttcctttgggaggccaagatgggcggatcacctgaggtcaggagttcaagaccagcctggccaacatggcaaaaccccatctctgctaaaagtatagaaaaattagttgggcatggtggtgggcgcctgtaatctcagctactcaggctgaggcaggagaattgcttgaatccgggaggcagaggctgccgtgagccaagatcatgccactgcactccagcctgggcgacagagcaagactccatctcaaaaaaaaaaaaaaaaagagagagaaaatccttcctgaattttaggatctgcttcagaggagaaggggctaggggagatcaaagtgactctcctgcttctgctgttttctcagattccttcagcttaaaatattcagtacgtcaaggtgccatattttagtttagcatgtccagagccccattactggtatctcttagatgtggttcatctctgcccctatgaaattcatgtgcattctttgccctgccattgggagaggcacagttccttcccaatatagctctctgctttttgtctgctggttttgatttttcactctcactctcacccattgcatttttctcaggcttgaatcaaggcatcactagtccctaatgtccgccagttgctggaaatacgtaacagcttcctaaattggtcttgtcagcatccattctttaaggtttgagatgaagcaggtggtgatagcaccctcatccatcctactgcacctttttgcaggagaaagggtttggagtacagtacttcctctaaaaaaattcttttttttttttttttttttttgagacagagtctcactctgtcacccaagctggagtgcgatggcatggtctcagctcattgcaacctcctcctccagggttcaagtgattctcctgcctcagcctcccaagtagctgggactacaggtgcccaccaccacacccagctaatttttgtatttttagtagagacaaggtttcactatgttggccaggcttgttttgaactcctgacctcgtgatccgcccacctcagcctcccaaagtgctgggattacaggcatgagccaccgcacccggccaagacattctttacagatccttttcctttccaacccccatctcatattaaaaaaaaaaaaaaaaattcttgaagtgcttgagggagttcagagttgtgcagcaggatcagccatttgctttctaaattctgcaaataatgatctgtctcataaatcttggaatcttgtatttgttacatgctttattggtacctcagtcaaagtttttttttaaaaaagggtggagggtaaggggtcatcttttgagctttttaaactaaatattagaaagggctttccggtcattaggatttttccaaacataaaagaaccatgatgaatcacagtttgacaaagtattttatctgtctagatggaagatgatattcagttaggggaaatggaaacaagtggttgtccaacatttgtcagaattattataaccataaaagtaatccataaaaagtaatccagttgattttttttccattttagtaatatttttaggttaaatcagacaaggtggtgcagcatttgatataaaggcttggtatcaggtgaaccgtcctgctttggagatttgtgtaccattctttctatagattgtaatttatcttcttaggacttatttttgcgatcttatttcagattttttatttcctgcagttcttgttttttcattttgttctttatactgcagaaatccatttttctcctgtggtttaatagtcatacattctcttattcttaaggtgattgcctttaacttaaggcatttactgtcttagtttaagcctctgtgtgccttcccactgcgccacatgggtggggctcgtttatttgggacatgatcccaggaagtagagtgaaagactagggagaatgaggcaaggaagggagaaaaaccagtaaagcgttctaagtatcactgtgggccactggggctcagtctccctgaggaaccatgaagagaggcctcaggagcccaccaaagggaggctgaggtgttcattccacccccccgccacccagaggcatcacttcccccttgggggatgcatcagaacagcccccagcagaacagcagagccccctgcagcataggcaggagcaactggcacaggaactgttctccacagctgcgctgaagcccggttgaggggacatgcatgcagccacaggcctctgctgcagggtttgtttatttacctccctgattatgtaaacatcttccctttcttcacacaagcactttggcacattcccacatttctctggtctgtacccattctgtcccctgctaaataatcttggggttgttatggacatactttcttttggtctttgattttttaaataatgttgagcttttcttaatcattcttactgcccgtatctctggcattatctgtttggggttttttttccatcatatatgcttcctctaagaggtttttttggttaagtgtctgagaccttgaacacttggaaataccctattgtgccctcaaatttaaatgacagctggacataaagctgtaggcttaaaggtaattcattgagttttatgataaagaacaaattttttttttttttttagacagagtctcacccttttgcccatgctggagtgcggtggcacaatcacagctcactgcagcctcaaccttccaggctcaagcaatcctcccacctcagtcacctgagtagctgggactacaggtgtgtgccaccacgcctggctgatttttgtattttttgtagagatggggttttgccatgttgcccaggctggtcttgcagtggcgcgatctcggctcactgcaagctccacctcccgggttcatgccattctcctgcctcagcctcccaagtagctgggactacaggcacccgccaccacacccagctaattttttgtatttttagtagagacggggtttcaccgtgttagccaggatggtctcgatctcctgacctcatgatccacagtttcttaaaatatgattacataattttttttatttgtagttgaggtaaatattacagctcaagtaaatataagtttatttatcggtatactaatgtgatctcttcagttttattttcccttaaattctgagaaggtctcagggtgtctttgtctctctctttctgtattttgcattattcatttattatttggattaaaacctgtttttaggccaggcacagtcactcacacctgtaatcccagcactttgggaggctgaggcaggcagattgctggagcccaggagtttgagaccagcctgggcaacattgggagacccatctctacaaaacaaacaaacaaaaacaaaacaaaacaaaacaaaaaaacaaagaattagctgtgcatgatggcaggctcctcctgtaagtcccagttactcaggaggctgaggtgggaggattgattgagtccaggaggtcgaggctgcagcgagccatgatcatgccactgcactccagtttgggcaacagagtgagaccttgtctcaagaaaaccagaaaacaaaaaacctgtttttagggtagggaagattttccaaatgaaccttctgtttttacagtaatagcaaactgctgttttctttctgtggtcttttgctttctacagtattcccccagtgatatatagatatacagactagttttggctctagagtgtcttagatagcccagacatatcttgagtcttagtagaaaactcttataccagagggatgtgtaaggaaggagtaatggtaagaaaacatgccttgatttcaggaaatcctcttgacccccaggatgattttctcttgttgcttacatgcctgcttttatcaccatgctacctgaatcaatagctaataatttataaaactgcttcttctaagaggtttctgcttattttagtctttgatattatcagcctaaaatgacagttgatggttaaaatattgtcaatggatacaatatgggtgggtaaaattatgcagttaaacagggtaaaactaagtttcccccaacccctctattatatatatatatactcttggcattggctttcaaattatgttccttaggatcactggtattctactgaaataaaataatacaatttatttaaaaagtgaatagaatgaacaaattatgatttttttctcataaatttttcttaaatctgcgctgaaagaaattaagcaaatgacatttttcttaaatctacgctgaaagaaattaagaagcaaattaacaagaagaatttggcaacagcctgtaattttagtttaccattctctctagcttttataatggaattaaatcagtattttatggtattccaaaaagaatgtgtatgcttttgaggtactttgacagttgaacacatttgagaaccactgtttttggtaaaaatgaaaatagaatttatatgttgaaaagtaaagaagagtagtgcaaagatgaattcaacataaatagagtttatatgttgaaaagtaaagaagagtagtacaaagatgagttcaacatttatttacataaaagttgttttgaatggataaaagttgcccccattcttcatgagattgttttcttaatgtaaatgtaatatgttaatgtaaataccttgattgattgattgattgattgtgaacttacaggagcccaggcttgtgtgctcgtgttctctaccacagatagggaatcttttgaagcagtttccagttggagagagaaagtagtagccgaagtgggagatataccaactgtacttgtgcaaaacaagattgatcttctggatgattcttgtataaagaagtaagatggctacttttggggaaggagggacagtaattctataaagttaagacatcttaatttttgcatagttttacaggttctaggaaaaattctatactttcattttgaaggctttaatgacttaaatattttaatttacctaaaatttctgtgagctattctatgtgattggtttgggttaaaaaattcattgattcctaagtagataaaattaaaggattaaaatttgaaggctcttttagaattctaatctcaggtctttgcacaagaaatctaattcttcatgttaagtcaaaccttaatatggtaagaatgttaagaaaagcatccctagattttgtaatacccagaataagtaactatcctatgttgatgaattttaattaagggttcagattcatattgttttgtatattcagaactcttatgctcaaatttgtgaacagataatttctgttcataaatatttacttattgtattattatttttgccagttttgaaaatatttgcttggtttttacctgttttttaagtcttcttatgttagttatctgttgctatgtaacaaattagcccaaaacttagtgtcttaaaacaacaaacatctattatatcacagtttctgtagatcaggagtttgagaatggcttagctggtggtttttcatgaagctgcagttgagatgttggctaggcctgttctcacggaaaggctacactggtgctggaccatccatttctatgatggcttattcacttggcaggaagccttagttccttgtcagatgggcctctcctattctcacaacacggcagctatttctcccagagtgggtgatccaagaaagagcaagacagaagccacagtgtttcttatgacccagtcttatactgtcccttgtattgcatattagtggacacccagaccaaccttgattacagtgtgggaggagactacacaaggggctgaagaccagaagccagagaaatagcgggagcctatggggcatggttacaacagtctctaatgacattaatatcaggagtccacaaccaggaatcctgataaaactaaaattaggagtacaatttggagatgtagtcattaatatactgactttggctttaggcagcaaaattgtttcatggccagtaagaataaaataagtaattcactgtaagattttcagagtgtaattaactacaggtgttctcaggaagagataaaattaattaaaatattatacaaagaaaagtgatattttcttagtttagggctagagattaatgactttatagaaaagtcttctatgtacacatacggtataacagttggtgtttatttctcaagagtagtgaaaactaaaatcagtacaggcactaaatgaaaacatagctttcaactgattttacttaactgggaaattatatcaagctcttttaaaaagaaatatgaaaattttctgaaagatctgatccaccttccctcccttccctgccaaactgtattcagtaaatgtaattaaaagtgatttaaaaaacaagctatcagaaggcacctttgtaaagcatttttttttaaattgatgtgcagtgaggaagctgaggcactggcaaaaaggttaaagttaagattctacagaacatcagtgaaagaagatctaaatgtgaatgaaggtaaattacctttaaaggatatagattgcaaaaagaaattttattcttgcgcttttaaaattgtgttgtttagaaattatatttataacgagaacaagatttttttgtcacctaacattaagtagaatttaaaggctttctacttctttttgttagtgcttaattatttactaatgcccttgaatacttttcatcctcgtaaggttttccatttttattattatctttgaaaaatgtaagctatatatgtagagtatatgcatatgtggttttgatgcatacctgttaaaaataactcagttgttttagaactccatgatagtagatattccactaggtagttagtttatttaatagtatttaatttaatactttaatttaatagtatttcctagtttaagaaagtgaaattagaaaaagatggtaagttatttttctcattctggaattgccacttatttagattgcaactagatattctcttggatgtctattttggatacttttcttcacataaaggagacatcttttcaagagtgagtctgtttagtgttgcttagtattaatcactattcagatacttagaagagccaatcattacaagtattatttcacttatttactaataaaataccattatacatttgttaatattatcattgtactcagatactgcccaaataatttttaaaagttgaatttttaactagattgtatgctcctaattgtaactttaaatttgtttagtaagtataaatattacaaatgatgtgaaataacagatttacatgcataaatcattgacctggttctgggtgttttctttttattctagtttttaagtatttggctgaaaaataccttcagaaactcaaacaacaaatagctgaggatccagaactaacgcattcaagtagtaacaagattggtaagtacataggaaattttagcccatgtttacttggtaaagttaaaaaacacatataatatgctcatttctttcagaaatgtgatttaaaagtgattattaaactattaagtcagtgatttaagtatcaggtctcttgttaaaaggtatattgtgttaatgggggtttttttgccattgaattttataaatccatttgatagattaaacacaacagagataaagactttttgtaaagatctgtcctttatataaaggaactttataacagttattcttctgaatctgtacttacactggctcttaccttttccctttcttactatcttgcttattacccattactgattttgctttttcttatgttaaatgccagcaaaactttagcattctctgaagaacaagtgtgttgtgttctctttcacaataactgcctgaccagatgtctctcttcttgttctggattccaggaaaatgagagccaaagttgctggttctaaatcttgatacttgtataatctcttaaggacttcatatctgtattctgtcccccttcactacatatgtagaaacaaacacattattttctggacctgttttaacttagatttttcctggattctggcttttttttttttctgcctttgccattttcattgcaaaatttcttgccatcagagacctcaaatgctttgtgaacacaagacacttataataagcctctacctggtgtgatctccttggctccccttttgtcttcttcatatctactgattaaagctttaataagactcattgtggaacaaagtaaatgcagattctcttcaatccaacatttaaaggtggttttgcccttccttctgtgtagcctcctgccacaccattacatctatgtaacccatttactggttctctcagaggtcttgatctttcctgagtatgccccatgcttgctttcttcttcacttttggtcattttttttcttctattgagaatgacctctttcccatcttctgtcgaagaacaattcattcctcaaggcctttctagaaagttttcagttgtgtatctgcctgcctgaagacacatcctccatactctttttctttcttttttaaagaaacagagtctcactgtgttgtccaggctggtcttgaactcctgggctcaagtgatcctcctgtctcggcttcccaaagggttgggattataggtgtgagccactgcccagcctccatcttctaaaagaatagacatctaagcccagggcactgccaagtgtccagttctaccttcttcatgtagtttttcctttcttatgtatcagatgcaatctgtccttcctttgaaacttctgtaagattttgtgtctcttttatgacacttaacatataatgtcatatggcattacttgtttactgtcttgtcttattacattgtaaacttcttgtgggcgagaactggtcttagtcacctttgtatccctgacagtatctctggcccagaattttgtgtgtcatggatgctatatcataaattggagattacattttgtgaatagcacagttcaaaatggaaactataaagttctttatcttttagctactcatcacttttatctgtgggccacttttttactggtttagtataagtaggaaaaacgtatcttactagtattaacacagaatctcacaaatagctgggtgtggttgcttgtgcctataatcccagctatttgggaggttgaagcaggaggattgcttgaggccgacagtttgagaccaacttagacaacatagcaatatcctgtctcttaaaaaaaaaaagaaaaattagctgatggcattcctgtgcctgtagtcccagttactcaggaggctgaggcaggactgctggagcccaggagttaaaggctgcaatgagctatgattgcaccactgcactccagcctggtgacagagcaagaccctatctcttaaaacacacacacacacacaactcagaaatactgttgttactgttgttaactaaaaggtattcttgaggaagtgatatgatgtgaagttagtaagttattaaaattatcgtagttgccaggtgtggtggctcatgcctgtaatcctagcacacctctaatcccaggcaggtggattgcctgagcttaggactttgagaccagcctgggtaacacggtgaaagcccgtctctactaaaatatgaaaaattagccgggcgtggcggcaggcggctgtagtcccagctactcgggaggctgaggcaggagaatcaattgactccaagaggcggaagttgcggtgagccaaaatcacacaactgcactccagcctggcgacagagcgagactccgtcttcaaaaaataaataaataaaaattatcgtatttgctgattccaaacgtcaaagataaattgttaagtcaaaagatgcagaacattgtgtagaatatgccacaacttaggtagaaaagagaatatatatgcattttagcttatatatgcataaactatatctggaaggataagtaggaaaagtaataacatgcgtaccttaggggtgggaaaactggcaaggggtgaaaatctgggtaaaaaagagccctaatgtgacctcttttacagccttggaactttgtaccatgcgtattagctactaaaagtaaaactaaaacaagagctttaaaatcataaatctgtgtccattgatgtatgaaaggataagcaaaatgtggtatatacatacaatggaatattattcacccttaaaaaggaaggaaatgcttcagtgttctacgttggatgaaccttgaagacattatgctaaatgaaataagtcagtcccaaaaagacactattattccatttatataaggtagagtagttaaaatcataagagacagaagatagaatggtggttgctaaggtctgcagggagggggaatggggagttagttactgtttaatgggtatgagtttcagttttaaagatgaaaagagttatggagatggacgggggtgattgttccacaacattacaaatgtatttaataccactgaaccgtatgcctaaaaatggttaagatgctaaattttgttggattttactacaattttagagaaactgtaaatacttgaaaatattactgattttactaacaagctggatgcaacaggtaactcaggcgtgtcagtggcaatcactcttttccctcaatttatacaggtgtctttaatacatctggtggaagtcactccggtcagaattcaggtaccctcaatggtggagatgtcatcaatcttagacccaacaaacaaaggaccaagaaaaacagaaatccttttagcagctgtagcataccctaagatgttttgggaggaaaacaattgaattacattgtgcaatgcattaagaaacccatccagctgtcatggtatgttacaaggttttcagcagactttgctcctaatggctctctgaaagtgacagacttaaatattgctctgcagtgcttttcagaatgtagagtgagacctctggtggaaaaattattgccctgtggactcctttaattttttttacattagacgaagcttctcctgtttgtaaaggaatgctataagaaatttcaaacacaggttttgcggaattttaaatgctggaaaacataaatgaaatgcctaaatatattgttacagattttaatactgtggatcaaggaaagatagcaagcattcttttcctgaaattggtcatgtagcttttctgcgaaatagtattgaatctgaatactttcacaaaataatactgaaaggtaaaccctaaatcttgccagactgcattagtattttggcattgaaacttgtgcaatatctgtgtaatgtagaatgtggggtgtgcatgcagatgtctggtactggagtaagctgaaggtatgtgcagtatttaagaaaatgtacattctaattaattcacttataaaaccatttacatattgtgtatatgtttttattttcaaatgataaactctagacatatattttgcaaaatgagcttgggtttaaaaagtgctttgtgccaaaaatatcatacctaatttttatagtgctttactatcagaatttatattgtttattatatcttttaaaagcagtaagcagttttcatctgacagcgtagataaaagaggagtataggaatttgaatgctagagcatctcccaggtgagccttattgcagatctttttgatatagtcacccataagcatggtgagctcctgctctcataaggtcagccaaagccccttaagaaggtacacagcacatctgcagtcattcaggaggtcctgtgaagtgtggtgatgcatctaacaccttttgctgctcactgagaacccagctttgaacttacaagattacactaaccatttttaaagtgcacaaaaatattattattagtcttaactaaaattacatattttataatgccctgcaactctaaaccatccttttgtttacacatttttgtatggtattttaagattatcaatcacttcaacatttctataaccttgtttgtatagcactttctcaagagctgtcagtcccacatacagaatcatttcttttacaaaatgatttaatatgtaatcatgtgtcaggacataaattttgtcacttgggacagtagctttccagctaagataattgcgtgaactctgttaaaactgattatcactcatcaatggctttatttttaacctataaataacccctttcaatatacctggtttttacagcattgcaaaatctgtaaaaataacttttattggaaaatgtcatgaagtcatttttcattatttgtactaaacaatgttttatgtactccttttgtgttttatcttttgtttttccatctgtactcccctcatcctcctaatgttgagaaaatcaaatttcctgggtgtgtccttgttaagtgatcaaaagtaaatgttctctttgccattttagatggaaaaataaaaaaaattaaaaagtaaatttttgcttttcattatattgaaatgatctggcattatctatttcacagtaatgtaaaatgcttatttttatgtcaccagttgtcaccactcccattgctgatagtgacataggttttgggggcaaaattcagttcctaacaaacagtggatactgctaatgagtcatcttttctactctcttcaattttctactctctactctcctctttaatttttgcacaaaataatactttgcaacaaatagtcttttgtctttattggcagaaaaatcacttgttatatgtgttctagttagttctttttcatgttagctgtgtggctaaaagcgtgttacctttctatatttaaaaaaagtaatctctgaggatagttacagttcctgtaatataattttatgtacctagttttatctttttttaaataagaactgaagagagagctttgttacatatttgaatttttaatttgcactgctgtattttaaacctaaccataattagtcatttaaaataattaagtaggcctgaaagtcagccatgttaatttctcaatttaatcaattcttaaagccttcaaaaattgacattttttttccaagacccttcattctcttaaataactttaattttatgaaaccatgtatactaaagaaaaacttttccaagattccaggtgattgtgcatttgtgctctaatctacttttttaacattacggctaatcttttgcgtagacatatcgctgtggaataactgccatatttcagagttcctcaggtttccttttccttttccagtctctgtctatgaattaaatagtatatagaatgacccatataaggcaatatagttaaataaaaccaggttaaatgatttcctttgtatctgcccaaagttgatagcacacgttactttttcaaaataaagctaaaactaccaaaaagaggatgaaaactttttcctcattatggagtgaagttctag

SEQ ID NO: 17371 - DNA, 373182 bp, Human
  misc_feature (1)...(373182): n = A,T,C or G
tagctggaattacaggcatgtgccaccatgcttggctaattttttgtatttttagtagaaacaaggtttcactgtgttggccaggctggtcttgaactcctgacctcaatccacccacctcagcctccccaaagtgctgtgattacaggagtgagccactgcgcccagccagttcattctttcaacaatgtttaagcatctacctaagcctggcactgagctgggccttgggggctacaaagatatctaagacttttttctccttagagagctataccgtctatggagagggacagagagcccccaaaatgatgaacatgttctaagtgttgagatagaggcatgtgaacactctttggcagcccagaaaagaaaggggaagaggaaatggcacagaaagggtgaggcaagaactggcctggaagtctaggatggataggattttgccagttgaagaggggtaggcacatttcaggaagaaagaacagcgttggagaaggcacagatgtgtgtgaaaacccctgttggacacgttcaggggacagctagaagttgtgtgtggatacattgtagggtttgtgggaagtgagtcaggaaaggggcataaaatggggctggaaagagagatggagcctccatgtgaagttatgctaaggagatcgggctccatcctataggcaggagtaggtggtggggggcaacgggaagttttcaaccattatccaaactctgttgtagaattaaaaagtggaaagaagagaacacaggcagggaaaccataatagtgtggtcagacttcaacatgatagcagtcaattcagtaggaatcttgaatttgagtagtcaagttcatagagacagaaggtaggaaggtggttgccagaggctgggggtggggatgggggtagggttagggggaaagaggagttattgtttagggtataaagtttgttttccaagatgaagagttgtggagatggatggtggtgaaggttgcataacatgcatatacttaatcccccgaactgcacagttacaaatggttaagatggtaaactttctgttatgcatatttacaattacacacacacacacacacacacccttcagtgcacgcaaaccctgctggactccaaccttcagagcttccgatttagcagggctgagtgggacctgaggatttgcattttctgacaagttcccagatgacgttgatgctgctggtccggagaccacacttcgggaatcactggtgtacgagaccaagtgactagaatatggaggggtgctctgctcgcttccacgtggctactattgttatgaacaacaacagccggcgtttactgagcactgctcctacagcttatctcacaactgggtgaaggagcagaggatgcgcagggctagaacctggagtctaaactcgtccttcacccgggttgctctggatcttactggttgtgagacagggagggaaagagagacaaaggcagggagacaggcccagcagggccggcagagcctgtagtgacggaggggagcagccttatctccgggaacccgagcgccccgtgcgcggcggggagggggcagttcggggcgccccggcgggtcccaggggctgactcccgcccgggaagtgcgcgcagggctcacggcccgcagggggcgctgccgcgccgtccagccgccgccgcccgggccgcccacctcgcgggcgcgcccctccgcagaccagcgccgcccggcccgggacccgctcgcgcagacttctcgggcggactgaggacgccgccgctcggggccgcccctgtgctcgccttcagcgcccgctcagcccgccgtccgcgccccggtggcgggcccgacgcccgcattccgcccgtgtccaggcgcagagctcccgccccggggagcttcctggccgtcggcgggccccgcggcccgcgcgctcggcgccctgctcgccgggcagaggggaaggcggcggccggctggggatgggcggcccggctgcgccgaggggcgccgggaggctccgcgcgctgctgctggcgctggtggtcgcggggatccccgcgggcgcctacaacctcgacccgcagcgccccgtgcacttccagggccccgctgactcgttcttcggctacgcagttctggagcatttccacgacaacacgcgctggtgagtgcccgcccgactccgcgaccctggcccgcgcggccaccgccccggcccccaggccagcgccgccgccgcctttccggtctcttccacgccgccgtcccgagggggcgatttaaatgtctccgttgcgcgcggctcggccgccgggggacggcgggagaagggaggacgccgtccggggcccgctaaggtcggggtcggcgcctggaggcgggcgggggcgtccgggtgcctccctggggtcccagcccagagcgtggggggagagccgctagagttgtctcctccgccgcccagctagactcggcttcactctctgaatcgaaaagtaacttggctcctctgcctccgggcggccgccgctggcccagcgagcctcctgaacctcgcagggcctggaggagtcggggcactggagctgcacccctccccggttttggggaacccctgaggaaggagtatagcctctccagcgccgctgcgcggggtggggctccccaggggcagggtgtctgggatccactggggcgcactggagcccagagccccggcgcccccccccccccccagctcctacaagaccctgggtggaagtggagcggagaagctcctaggatatagggaagaggaaggtgagggagcacttcccagtgacaccgccggtggggcaggtagttatctcttgggagagcctgagtctcatctcatatgggccattcgacccggagaccttcaccagaagccttaagagagagacgtgtttctatagtggccaaggggtccagttgtcccctgagtccggaggggtgggcctaagaagggggcagctctcccccattaagcaccataagccgagtggtacagagcttgtgcccaaccccagcagagaagcactaagggggggttggtgccctccttggccacatcctctggaccagagggtataaacagccacacagtggtcacttcttgataggagagagagttaggctgcgggaagttcccccgttcaaggtcgtgcctcatgggggcccaggtgacagccaggccggggttgattttattgtgtattcaccagcctgagcgtccttaggggtggcaggcagggaggtcgaggtcactgatgctggtgctctcagcatgtagttatgcaggagagtcactgctctgtattggacagaggctgatggaaaagggtggtttgtggatcgcagtactcaagcattcctggaaaaggggactctgagaccagcccactaagaatcatgctgttcaggagatcagccttcaagagaaccagttttcaaagccctcacatagctctcgcccagctccacatctccctctctcacttactccagttgctgggtataagaccgagtgtgtctgttcttaacacttgtcaaattccccttttaaagcggagcaggctgaacatttttctgtgtcctgcagactcagggtctgaggttgaagaacacatcccagatccccacactaggcaccaggcacgcgggaagcactgtcaaaaatgggagggctgctgtggacagcgggctgctgagaaagggcgggcagctgagcaggcagccaagccagccggagcattgtgtgtgatctgcaggctgaggctggctcaactgccttggagctctttgacagctagagggagagaggccaggccactgtcactgtggatttgcatgggccacaggtcaaagccacactgcctgggaaaggaatgggtagagacgagagcagatctgacagagaaaaggtgttcagcctactttgatttaaaacggggatgaagaaaagctgtgtgacatgagcagatttggccagtgtgggaaaagacagtctggccttcagcttggtacccagggtaaatggtagggagtgggtgtggagcagtaatgctgtgcatattcttgttgccagttgagatgtgggactggtatttcaggggtccatgggaacccatgtgtctgggctgctgagctcaaaagtgccctctcttgttctgatacaagctggctactctttgtattggagtgcttgtccccatagctgttcaggcaccaacttaactctactgaaatctttttaaaataatgcttctttttcctccctcacccaccatattgacttaattttttcttagattgtgttctccccttgatttctgttctcatgctgttgttttcaagtattttcctccccatccttttttctctttccctttttcccagtattctttgtcttagaccttgaatgtattttttgctgtatgtatgcttgaatgtgttttttacccaggcttggtaaactatggcctttggagcaagtgacttccaacatcttctttctcctttttctttcctctagaggctagacttattgtgcaaggctgctgaaacttaagccaaaggattcttgcttgcataggcccctattaatgccttgtccccaattttataattttatgttaattttcttaaagttagtcaccctaaatttgtaagatcaggtcctgtgaattctggatctgtcctaagtctgtaccttaacttcaactgtggggttggttgattgacttggtaactgattgttggtcgcttactcctaagcagtacctgagccctggatcttctagtcctgcttgagggacatgtcagtcattttcaattattcgtgattgcaaacagcagcaggggtaaacaacctttaacgaaacccttgaggacaatcttaattatttcctttgaataaattcctgggcttagaattgctgggtcagagaggatggaagcttcaaggcattctttatgtattaccaaagtgccagtgaagtgtgtgtactttagaaaaatacattaatttattcagacactggaggcttgggagtagttttgcaaagggctgctctagtgcactgaaagagtatagaacctacatgggggtgacttaaaaggatcacaaatactcgtcaaaatgagtgaggaaggtaaaatatagacatgaaagggaaaagcagtatagcaaaactttgaaaggaaaagaagacatgttaattaagccttgtatcttacgtctctcttctcgaagaaattattctttgttacttaattcaatattttgcagtctaagatatttgcttcatgctaattaactacctgttttacaggtgaaaagatgtgttgtctctagggaaagggagggagaagaatgtgctggaagtggtagggggagagcacagaccccaaagtcagcacggactctgcaggcggcagagtagagcgttcccatgttgagggacctgcgggtgtacatctcaaagcatgtgaatgtgctctgttggtggaactagcacttctctaatcccataactgagcatttctctcaattattttgtagaccaaaattgtcactaatcggaggatcctagatccctgtgtaagtgtgggggtgatcttgcttttcccagccctggtgactgaacccagctctgtagccatatcacactgagcacagagccccagacccagcttctctcagagtacttgcttgagtggtcccgctgtcactgtgctctgggcagtgagaactgtccccatggctagatggaccagaatatcctggacaatgttccagatgacgtttgtatcagctaggatacaaacatgcaagggactcaattttctttttttctaataacacccagagtgtctgcctgcccagagccagcttcctctcctatagctcccactccctgagtcttctggcgtcctttgaacaacaacagtaagtgccagggaacatggacaaagccgatttctgtccccttcctttagacatggaccggttactcagctgcagggctgacaactgtaacaccctgtgatataaataaatgctgcctggctggcgtgcagcctccagagcggacgtctttcacaccccaccccgtcccctcctccttctctgccccagacgccctggagtccaaagtggttgggtgcactggcttcctttctggagacgtgcttcctgctccctctcctgggacacatcaagacggctgtgcttaggcacagagcgagtgctcggaaatggaagatgtgctgggctttttgctttgttaaagttgtcagagtgttgttcagtgaggaataggaggcaattccaagccaaggagaacatatccttgatttgcatgaaggttgagaattaaaagaacaagctagatagttctggtgagctgtctgatgtagtcaccactagccagatatattggtatgtaaattaactaaaaataaaatttaaaatgcagcttctcagttgcacttgccacatttcaagtactcagtagccacatggggctagtagctactgcattggacacaacacagagagaacattttcatcatcacggaaagttctactgggcagtgtgggtttagagcaatgatgtaagtcttaaagggctagacaaggatcaaaaggagaggtaagaaaaagaaaaagaaaaaaaatcaacccatagcatatgtgagtactaaaaccgaaacgggtgcttacatctaactaaaaattattgcctgctgaagaggttgaattgtctttctactcataaaacaccgcagggcctgatctatatttagggctgggggttcaacaatgaaaactttttgctcacaatctgacaggtgagaaaattgtggggttctagttgtgtgtctcaaatgaaatttaagatctaggctctgatgggggagaggcttgtcctcaggcaggcatgagttgttcagaggggcagaagagaaactcctgtgaagggaaaacatttagaaggggagccctgggatcataggacctgctgcccctggccctgcccgtcttgctgaggaaacacccagaaatggtggtgggagccctgccttctcataacctcagtggtgagcatctttgcagagttcctctgtcctgtgccagactctaggggaaggtgtaggtccgcttcctcatttgaatttttctagggaaatggcattttcagacattgttcctggtcctcactcaccctacagagcctgctttctcaagctctcaagaaggaacaacacatatatgaggcctgagttccaaggggatccaaaaagcatcttctcggggtttctgggaaatttctctgaagatctggagaagctggcaagggtgctgttttctgagctagtgctgaatgctggctgggggcagagacagctgtcttgcccagtggagaaccttccagggcaagaagacagtcttgtctcaaccagtcattaacggccctgagtgtgagagtgtgaagggccgggccccagccagctctgattccctggtgacatgctgctgttcaggaaatggtctcctgataacttctattgtgatttgttcagggaaaatgttgtttttacatttgttaaaagcagccatggtgttctctgaaattccttgctttcaaggggttgcatggaattttaacaaccaaaatgaatttcgtcagatagtatctacaagaagtcagatgctttcacaggcataatattctttagttgagtctttgtaacatcctggtgagtggtttccagtttgctatttggggaactgaggcttacagagttacacgccttgttcaaggcccaccccagcctgagagatcaatgcacattcactgggggcttgtgtcagtttgcatcctttaggaagcagatgctaggacagagataggagtgtgagagaattgttgggggcgggtattgcctgtgaaagacaaatggggaagttggatgggacagagagagcctctgactctatgcagatctgattaaagtctcagtcaactcaacagagatcactgggcagaaatagctgtcctctgccagggtcaggtattggctggagctgtctgggaagagcacagcctcagctggaatcctgcagcagatcccaagaaagctgcagctggaggctgtcagctgacattccgccttgcagctgaacagcatgaagtgacccacacctctgtggctgccctggagcctgccacgcgtgaatcactgtgttgggagggtgtgagatgtgctccttggcctgcagtgtggctggggatcatctttgctcatacctctgtaatcagtgtgtggagcgtcaggactgacagtagggccattgggactggcccagaaacagaatcctgagcaatcttgccaccagctgactcacaaggtgcctctttctgatgtcagagaagtcacaggtgatggatttcagaagaaaggagctctgctttacgctgagccaccgagttctctgaactgcaaatccttttagccaagtggatttggcgatcaaccaaagcagaataaaatgttttatcccaaccttcctttttgccagaaggagtcctaggaagccgatgtaagtccaagattgggaaaaatctacagtctttgaaaccacgggctcacttggtccaccaatgtctgttctgaccaaaaaggacttctgtgttgagtttaaattagcaacagtagcaacaataacaccaaaagcagcaacaatgtatctgaatattcagtagatgtcaagtgctatctacattggtactcataccagctcatttaatgttcccaacagtcctttcagctggtagccatttgggctgccataacaaactgttataggttgggttgcttataaatgacagaatttatttctcacagatctagagccttggaagtccaagatcagggccccagcagatttgctgtctggtaagcacctgtttcttggttcatagatagtggtgttctcactctaagctcacacagtgaaagggatgagggagctctctggggccacatttataagggcactaactcattcataggttatatcctcatgacctaatcacctcccaaagtccccacctccaaataacattaccttggggtgaagatttcaacatatacattttgagggaacacaagcattcagtctgtagcagctggctatcattttatccccattcatggaggggaagctgaggtacagaggcattattgcccaagttacatggctaatgagttgtcgagcacaggcctgtgcctttgcccacccaggctgactgcctgtcaggaagtcaagaatccgagtttgggggcttcagggcgctcaaacatctgtcttgtgaagttctgttctgcctgctttcctggaaaagttattgaattgcaatagcagtagcttctctgcggcaccctttggggatgcttattcatgacccactggctactcttggggggatgctagggttctgttttctggagatgtttgatcactgagtgaacagggacccaatgattctgccagggacatttgaagggcctcttctcacaccaaggctgtctagcattaagacagaagtgtcccaggaaagatggagtactctgcaatattccatgtatccctctaacctcctggggctgctttgttactatccccccatccactctgagttctactggctcccaccacttatttaggaatctctgaattggggaaggtagccatggtggccagtgtttcagaatcactcctgggtttgtaactttattaaagaaacccacacagagtcaaacttctgcaccagtgaccaacaatatgtgagaggatgatttgtatcctcaaatatttgaacacttaataaaaggcatgaatgggtacaaaaaattagaaagaatgagtaagaatgagtaagaactagtatttgatagcacaacaaaatgacaatagtcaacaataatttgattgtagtttaaaaataactaaaagagtataattgaatcacttgtaacataaaggataaacgcttcaggtgatggataccccatttaccctgctgtggttattacatattacatgcctgtaacaaaatatctcatgtacctcataaatatgtacctactgtgtgcccaaatcttttttttttttttttttttgagatggagtcttgctctgtcacccaggctggagtgcagtggtgcgatctcggctcactgcgagctccaccttctgggttcacgccattctcctgcctcagcctcccgagtagctgggactacaggtgccccccaccacacccggctaattttttgtatttttagtagagagtgggtttcactgtgttgggcagaatagtctcgatctcctgacctcgtgatctgcccactttggcctcccgaagtgctgggattacaggcgtgagccaccgcacccggactatgtgcccaaatttttaagaaaaataaaaaatcacggaacaaatttcctccatcttagctgatctgttggtgtgttaaggccacctgggagatggcctttcctaccccttcctatctagtgtccaagtgctgtgatgtatgtggatcccagagtaaacttggtgttgtgcagtacacaccagtaggcagcattgcagagggtcttggcacctcttttgcaccaggatgggtcctagagggtggatgttccagattcagctgagtagtgttcctgtctctaccttcattgaatccctggttccacagcaacaaccagatccacgatttttgtgccataaaagggggcactgctgagatgcacaagtgcctggtggccaagagagtgggctccagcattagccctgccctcagcctgccttactcagctctctgcttaggagctgtgtgatcttgaccaattacttcagctgtttgaacctcagtttccttttctgtaaagagtaataagggtacatccctcattaggttggtgggggcattaaatgagatgatatctgcaaagcccagagcacaacacggcacacagtaagcccttgatagatgctcgtagttatttctcttgttacttgatctgatttatgaaaccaatggtctttttcatcctgacttgagatgctgagttttctttcagtatttttgttgattcattcatttattcatcagactttgagtgttgacactcaacactgaaatgaatgagatattctaacatagacacactcttcattatgtgtggcctctaacatttttgttatgctctacataaatctgcatttttgtgcattcatttacaccctgtctgcttccaaaaaggatctgagatggctactttaaatggagatctttgggattgtaaatcctagaattttgcctgcctgtttcttctctgtgctcttggaaagccaaggagcagatgggaggccacccttgttatggggagctccagctcccaccccaggctccagataagtctgggaggtagatctacagttccaggatgggatacttttttaaaaagtaaatgtaaatgtattgccatatttctcttgaaaaaaaattatcacaagaaaccaacaagaagatatcaaggctttttcttagatctgccagaagtctgtaatttgctctatcccttggattttagtgttcacttgctgctttcagatgtggaaggaaaacctcagtccttttgccttgcctccttctccagttgcctcccctcagtgtgtctgccaagacctgagccccaggccagggcagcagcctctgacctttcactccctaacacacaagctggggaccaatgtcactccaaggttggaccctgcccccgtgcctctgcttttcccagttgggcatggactccaccaatttcattctctgacttagcgttatgtggtgtggattgtactgctctccctccatttactgtaacctaggctctccaggataaaaattattattgccaaccttttatgaatactttctatatgccagaaccactgtgttcatagttccctttatgcagagcaggctaccactcccgaagcacagagaagccaagtcacttgtccaaggttacccagcaagtaagtaaattacagagttgtgctttgaaccaaggtgggactgatttaatgctaaactgactgttctcagggttagccatgctaccctccctacctccacctccatcaaggccctgtccaaggtatcaggtttctaaggaaaaaggagaagggccctgaaaggaaaagggcttcttcggagggcatttgtgtctgctcttggccttgcagataaaataccataatctactcttgcaaatcaggccatcctggggtgcatggtcccccaaacactttcatctgccttttccttttgtgcctcatcactgccttgggagggggatcatgcatttgttattatccttgttttacagaaaaggaaaggaagggtcagagtggccaggggacttgtctaaagtcacatagctgtagctggcacactcctgggtgtgacttcggatacactctttagggcctattctactactccaccatgcctgtcccatctcagggccttcagtaaaagtctgtggtcctggttggtgatgagattcctttgagggagggaaaggagaccaggtagctagaggagccatagcaatagttgtcagctgcatagttggataattggtttggacttagcgggaattagtgggcgatggaattaccacggtccagattccgtcagaagtggcatgccttagcttgatgacgtatctgttttctatcaccacaatattgctgcatccctaacaaaccaccccaaaacttagtggcttaaatcaaccaccacctgtagcttattctctggttggcagcttaggttgggttcagctgggtggttcttctgttctctccaggactcactcatgcatctgtggtcaacttctgggttagctggttggctggctggcaaaggatggcttcagctgggagggcttatttttgctccatatgtatttcatcctcttgcaggctagcctgggcttgtacacatggtggttgggtagggtaccaacagaacaatcagaggcttgcatgatttcttgaagcctaagctcagaagtcaaaccatgcccctctgccacattcttttggccaatgtaagtcacaggtccagactacatcaagaggaggcagaaacacatttcatctcttgacaagagaagctgcaaagtcacactgaaaagagcagggatacaggaaggatggggaattgtggccactttgtaatatattactggtggtgaaagcatcctggctgtccctgaattactgtgacagtctgaataaattcctgcccagcgcaccagaaaagggaacaaggttctattaacctaaatagcaaacacagagagaggctctctaaaagaaaatgtttactcaggaatagggcattgcagtgggaatacatgtgtcacagtaatctgcatgaatattcagggaggtaaaggaaaacaaaggcttttaaaggaaaaatgaggattacttaattgttttgagataattatctttggatacaaggatcagtgacaagggtggcaccagtttgaggttggatagagagttgctaggtagatttcctcacagaaggtgtgagtgtgtgtgtgtgtgtgtgtgtgtgtgtgtgtgtgtaaggttgtgatggcctttgtgcaagattgtgtttttgcagatttttttgtgctagttcttgttatcagttgtttatgcatgaaaacctttccttcatggcgtcccacagctctatttgtcagggttttttttttttttttaaacataagtgactccattttgattctgacaacttttgcaattctaaggatctatgagctcttgggtgctgccaggagttagaactgggatgagttgagtgtcaaggtgtttgacctactactgcccagcagtctaacatttctttgaacacctactttgtagcaggcactatgatgggtgttttataaacattcttttgcttaaaccttacaagaaaccttcttaggtacacttttattcctcctgttttacagaagaggaaaactgaggcttggagtgtttaagacacttgtctaagagacacagcttgtcagcagtagaggcaggacttaaaccctatgttactgcctgtgcttcttacactttatcaccatgcataactttcccataaagcttagaagccaggtagaactactggcttaaaaccctagaaagcagtcagtatccactgcttaaataccaggagcctcagtttccccaaatataagaagagcttatgaggcctttcaggtcccatggctccattgggcaagcattggtccctagtgagtcccctccctctggaaatgaagggtttggtgtggtcagaggtggctatcctggcaccagctcttcctttactcaagcctgggctgctttctgcccagtaagggatgcggacaattcctggggtttccccgtggtggacacacagtgaagaatttgactcatgtaaccaaaacgtgggtccctggggaagctttggctttgggatcaaatgctgaaagcaaacctaatgggtttaaagtttttaatccccagttgctgtccttgatctggctataattttgcctgtggaatcgctgctgtggtgtttgtggggagggagggaatctttgagacactgtcagttctcagtcctgcccagggaggcagctgcggctcagtccttctctgtcacccgctctccagagaatttacctgcagattaccctcaaaacatgagacaggttcagagcgaggtgggcggctggaatggagccttcacagacagcttgaccacacacagggagctcaggaagcagctttgttggaaaaatgcagggcacttaaactgccacaccaggagggggtttggagaggctggaaagagcatgccattggacacagacactctgggttcaaatcccagctctgccacttactggtggtgtgacccaacatctctgaatggaaaacacatgagaggctgcctgacaggatggccatgagcaagaaagcacccttgtgagcataaccagtgttggtgcatgaaccgatgcacccacactgcttattaagagaggcaaacctctggttaacaccatgacagcagtgtcaatgctttggaaaagcaaggtgattgaagttcaccttttgagtcacctgagcctgatggggaggggaaggtcttttctcttccaaaccccagcatgccctttgacatgacggagctttcacatcagagttctcacttcagagctgccctcaaaggctcactggggcttgctcaggtggggattacatatgtgagtagctggcaccagagggggcactgggtacctgttggttcccttttcctcctttcaggctgatgtggggtgggtagaatagggcacgggtgatgtatttgactactggggtgcgtgctacagcttggcatcttaacatgaataaccatcttaacctcctctggccacctgcttccctatctgtaaaatggggataatattagtacctcccgtagggttgctgtgaagagtaaatttgatcctgcccgcaatgagcctaacccagcacctgcacactctacgtgcctgctacatgctggttgccctaattagaagtttagagtcctgcattgatgagaggacctaaaaggcttatgaggccaggcatagtggctcaggcttgtaatcccaacactttgggaggctgaggcaggtggatcacctgaggtcagaagttcaagaccggccttaccaatatggtgaaaccccatctctactaaaaatataaaaattagcggggcgtggtggcgtgtgcctgtagtacccagctactagggaggctgagacaagagaattgcttgaacccgggaggtggaggttgcagtgagcggagatcgccgcactgcactccagcctgggtaacagagcaagacaccatctcaaaaaaaaaaaaaaaaaaaaaaaaaaaaaaaagggcctttgagtttgtggcatctttaactggggatgggataggaggagagagccttgcttctcaagggcaatctcttctactggctccaaatgaacataattatttgtaatcagtttagatagttacatagtacttcttaaactatcaatcacctggagagcttgttaaaatgcattctgatttaatgggctggggcctaagattctgcatttccgacaagtgccaggtgttccccatgctgctggtctgaggaccacacttgaagtagcaagcaaagcagagaagtagcttgatgctttgttgatggcagcctgttggtggggacactcaggcccttttatgtggtaaccatagcagaaaggaacatagtcttgttgagagtaccaggagagttggggcgatgtttgaagtggctaggatgtctttttataacttagcagatggcatcttttcagtggcttgttctgaactctgggccatggtaatctctgtatcccttgggatcagcctggtaaacagccagctgaattaacttcagaaaagacccactcatgggctggcctgcggtagtcttgctggatggtggcctaggtacagagcagtgctgggctgcggaggaagccacgatgttctgtaaacacatagatacaagcacattcccgcgtgccacctcgtgagtgtcatgcatgtgtgtgcatgcccccttatctctagcctgattttccattgcacaggatttgggaaaaacctttcatctgaccagctgatcagaagttttgaactgaaaggttgttatcagggtttgaatcagctattgttgttagaaccattgagtaccttgggcttggaaggaaataataattcagcaggttcctttccactttagattttggtgtaaactttgtccctgtcagtcttggctctaggctggaggaagcagtgcctgggaataagctctccagggtcccctcctgcttagataacctatgaatctgtgtctgtgaatttggagccatggcattatctgaaatttccagggttccaatgccagtttgggagacacagtggaggaagaacctgttgtttcttgcagccttttcccttccctcggacgtgatgaattctcactcttgtgaatttttttgtgatttttgtaaaataaattacaagtggcaattagtcactgtgctgatgtaaatttggagttggtgggaatttttggactctgctgtgtggccctggggtttttgagtggaagaggtattttatgctccccaggtcttagaacctgacctgtggaaaggctgaggatgtttcagcagtttagacagggcaaactgctaattcttctcacctgtgaaaacagctggtcttatgaagcgcaatatgtgacttaccccagtggctctaaagctcagccgctacagcaagggggaaaattgatcccttaatgtggctttcttctcactggagttttgttttgtacgtcattgtgcatttgagttacagcagacaagggccagccaaactgctcttgtgtgggtgagggaggcaatgtgatctgtttgggaaagtgcttgctttgatttccaaagggctgtgggttccagccctgcttctgcttgggaattctgcagttgtgcccagcaaacacctggggaggtgcatcccagggcattattgaggagccgcagggcagcctgggtacctgcaccattgggagtcttgcttctctcactccccagcagggcatcttcctcatggaatcagatacagaccctccaagactgacctggaaggagacactccagtgaggggtgggtctccctggctctttgtaccctccaattcttcaggttctaggtgttgagctcagggcagtgggaattaagatgggacccacacacattcccatgaaccttaacaccatgtctctgagccaggttagtgacgatgtcctttgtgatatctgccagcctttgctggagtcccctttgagggcctcagacttctgttgtatgatgtagaggccttgtttgtctgcccctttgcctagctggagtgttgcaggaggagcagcagcattccaagaccagggtgcagtgaatgactgagatcccaagatgaaggtggctttcagggcagagggaagggagcctgggtcagctttctacatccccaggaaagctgtccagggtcatcctaacctctgctaaacaccttttccacaaatacataatatgtaatgcactctattccaaggcatgtgggagatgatctatttcatgatacagaagaaacccttgtgaggtgaattccctctcttttctaggctgctggagataaggaacaacgcctgttctcactaagaagtggcttggcattttctactctttgaacatcagtgtggattttgtttgaagtctcattgtccaagaccttttccaaatggctcgtagctcagcacaaaccgtgcctgattagtgttgtttggtattctttgctatagatcttctgttgactgctttccggaaacaatgcataaaactgtaggtcagaattatttttgtaacatctggaggggagcttactgccatttcccccgtgttctgcactcacacaggcccaaacctgcctcttctgtcttctgggtgggtcttgcccctttcctgtagccgggggatgctcctgctggggatggcccaccctaggcagcttttcagttcaagatggaggatacagaggttcattcttgctcctgtttgcatgcaaactgttctatttctgttttgcagtgggagagaggatacggtttataattccgcactgctgctattttttttcctatttgcccctaaatgtccatgctgtgtgtgtggtgggtggtaggaggaggagagggagacagaagagaaatagcgtttctaaattttctatttgttactgaaatgtaacacatccaggaaagtgtccatatcatatacagttatcacaaatttgtataatgtcactgaggttgaatgacaacattatccgcacccccagcaattcccctccctaattgcaaccctgctttctcctctccagaggtaaccattatcctgccttctaacactatagttaaatttcacctgcttttgaactttagataaatggaatcagactgtgagtatgctattgtatctggcatcttttgttcagtattgtatttgtgcagttcatctctgtggttgcagttgaatgctgttcatttgttttcattgctgcatagaactctttttttgttttgttttgtttttgagacagagtctcactctgttgcccagactggagtgcagtggcatgatctcagctcactgtaacctctgcctcttgggttcaagcgattctcctgcctcagcctctcaagcagctgggattacaggcacctgccaccatgcccagctaattttttgtatttttagtagagacagggtttcaccatgttgcccagactggtcttgaactcctaagctcaggcagtctgcccacctcggcctcccagtgctgcatagaattctgttgtattgctgtaccatgatttacctgtccactctagcactgatgggcctttaggtttcttcttgtttttttttttttttttttgatattacatatgcagctttgaacattttgcatgtctcctggtagaaatgtatgcatctctattaggtatagtcctagaaatggaattactgggtcaaagggtaggtgcatgttcagctttattaggaactgttgaatagttttcccagtggttttaatggtttatactgccactagcagtgtatgaaggttctagttactctatatccttgccagcacttgggattttcagtctttttggtttgagccttctggttggtatgaagttgagtttctctgataactaacatagttgagcaccttttcatgcatttattggccatttggctatcttcttttgtgaagtatctatgcttgtctttggcctattctgttgacttgtcttttcttattaatcaatgaggagtttttaaaatagattttggataggaaccttttgttggttgtacgtgttcccacccatccattcgcagtctcctgggtaggtgggactaaaagcgtgcgctgccttgcctggccatttttttttgtgaagatgggatttgccatgtcacccaggctggcctggaattcctgggctcaagcgatccacccgcctcggcctctcaaaatgctaggattacaggcatgagccaccacattcagcctccttaagctttaatatgcctgggaaagatctaacaggtttcactttaggacctctcccccaagcccacacagaaaagtataataatatgattttcaaagtgagcactcagagagcccacccgtggttgggtgaatacttagccatctgcctcctattttcttatcgtaggttgtgacagaatgcctttttctcttgctgcagggtccttgtgggcgcaccaaaggcagattccaaatacagcccttcagtgaagtctcctggggctgtgtttaagtgccgtgttcacaccaaccctgaccggagatgcaccgaactggacatggctcgaggtgggtgaccattactgctgtggtggaaatgggttctgtacccttataccttgctcttcttcttcccaggatggcctgatcattcactcacccatccatccttccctccttccctccctccttctctccaacaagcatgtattgagtacgtaatagttattaagcactgggatacaccagtgaacaaaaaaaacaaggatgctgccatccctagtcccataaattagtgggcaaaagagatattaagacaagtaattgagagagaaaagaccagagggaaggtgagtatttgatttaatctagataggagggtcaagaaaggtctgggacctttcgacatgattagaaggatgcgtagtcgttagctgggcaggtgcaggaagcacagccttcaagcagaggtgccatttggaagcacagagcgaggttgtgcagctggagagggagccaggagagtggagcacaggagggcagcaaggcaggctggggccaggccacgtggggcctagcaggccagggcaatgtgctggaattttattctgtgtgtgagtggggaggccactgaaatcaattttgggtattacattttaactagggaaagatatgatcagatggatgtttttaaaagctcactttgcgctgggcatggtggctcatgactgtaatcccatcactttgggaggctgaggtgggcacattgcttgagcccagaagttcaagaccagcctgtgcaacatggtgaaagcctatctctactaaaaatacaaatattagctgaacgtggtgatgcatgcctgtagtcccagctactcaggaggccgaggcaggaggatcacttgaacccaggaggtcaagggtgcagtgagctgagattgtgccactgcactccagcctgggtgacagaactgagactcttgtctccaaaaagataaaaaaataaaataaaagctcactttgatctagcagaaaatataagatctttggaatcagatggttctgactgcattcaaagcccagctgggactgattgggaatgtcctatagcttcttgggcctcagttccctcaccttcaagatcaagactaatatacctacctcgcaaggatggtcttgagaagattaagtgagataatacaggtgagtacacagaactgtgcttggcacatcagtacaaaggaggtattttgttataatcatgactgcaagcatttctttctccaaagtctttttgcataaagattttctaatttttttgttgttttttgtttgtttgtttgtttttgagacagagtcttgctgtgtcacccaggctagagtgcaatggtacaatctctgctcactgcaacctctgcctcccaggttcaagcgattctcctgcctcagcctcccgagtagctgggattacagtgtatgaccatcttcggctaatttttgtgtttttagtggagacggggtttcgccatgttggccaggctggtctcgaacttctggcctcaagtgaaccgcccacctcagcctcccaaagtgctgggattacaggtgtgagccaccatgcctggccaagatcttctaattattttttaaataaagagttattgtgattttctttagcagaaaaagaggtttgtgaactgtttgttactggtgcataacaaattaaggagcttacttcagaacataaatcaaggccctgcctctttccatgagaaagtcttgccatgtggttgggtgcagtggcttatgcctataaccccagcacttcgggaggttggggtgggcggatcacttgaggttaggagtttgagaccagcctggacaacatggtgaaaacccatctctgctaaaaatatgaacattagtgggatgtggtggcgcacacctgtaatcccagctacttgggaggctgaggcagggcaatcgcttgaacctgggaggcagaggttgcaatgagctgagatcgtgccactgcactccagcctggacgacagagagagactgtctcaaaaaaaaaaaaaaaaaaaaaaaaagaaagaaaaagaaagccttgctatgtaaaaaaacagttgtctggattaaacagtatagtacatagtgatggagttgatttacattttgtggaaagttccttatttcctcatagggctgtggaccaccctttgaaagcagccagcagaacatcactcctcaacccaagtctggctcttctcctctttctccagggaagaatcggggcacgtcctgcggaaagacctgccgggaagaccgcgatgatgagtggatgggggtgagcctggcccgacagcccaaggctgatggccgtgtgttggtaagtccctcctgggggtgctgtgggaagggggtggcactctgagaatgaatgatctgttaggaaggctggatggcatggtgacaagtgcatggctttgaggttgcttattctggactactgcttagacaaatgacttatcttcttattttctttatctgtcaaatgtgaataatgtctgtcccaaggtgctgagatgtgactattgaaaaataaaacatatgtgaaaagtgctttgtacatctcattcattacataggtatttgtgtgtgtgtgtcttaaattgaggtataatttacagtacacaaatcttaagattacagtcttgattttcacaattgtacacacctgtgtaaccatatgcccactgagatatagaatatttccatcgtcccaaaagtctccgatgtccctttccagccaactcctctcacctgagacaaaccacagctgtgatttgtataatacattacttttgctttttctagaatttcatataaatggaatcctacagtatgtgctcttttatataagacttctttcactcaaaataatattttctgaaattaatccccattgtatgtatcagtagttcattcctgtttatctctacataatattacattttatgaaataaatgttatttttaactagttatttatcggacctccaaagcacctatgctgtattttgatccgtaggtgctttgagggagatagaaagaaaagtctttgcatttgagactcctgagatcctggagttgtgctgtgcagtaaggtggccaccagccctgtgtccttatttaaacttaaatttatccaaattaaactagaaattcaggtttttagtcatattagccacatttaagtggctcaataatcacaaatggttactggctactctattggaaagcagagagagagaatattttcatcatcacagaaagttttattagactcaacacgaaaggaatttctaacactgcagaggttttgtttttgtcaatttttcctttaagcttttctatgaggtataatactaaagcacttaacacacccagctgtgagtgcacagcccgatgggttttcacgcatgtacacttatgcatccccattgccagtactccggaaggacccctgcaccctttcccagtcagttcctctgcccttggtgagtgaacaactgttctgacataggctttctcttgcccttgacttttatcagaagctgtacgaagatttttgttataaaagcgtaagctcaagaggggaaagtaatactagctgccgcttatggagggcttcatttgggtcacatgctgcaaagctgagggtttcgtgtgtattttatcccagggaaacaggttttccttaaggcactaggcaaagtgtttttgtcccctctctaaggagcccacttttgtgttaaacttcttcatggcataagctgttaatctgaattccgtcctcagcacaattaagcatctcccccttgtcgggccccttgggagaggaggaagcagctggatgctgtcgccagcatggtgggggcctccctcctggaagccgttgtaggtcctgcacaggctccctgagcccgctgtttgccttggtttccagtcctttcatcactgtcatggctggccctggaccctctccaaacttccacattcctccaggcatggtggcctgaccctgactggacaaatgggccccagaggggctgaacccttgtctgccattctggggaaagaaagggaagaagctgactcatctgtaaatcaaagggtagcccaaggtcctgattcagaacaaaaaggaggtggtggccccgtggcagcataacacaagatgctcttaagggcatcgagcctagagtcagagtttgctcctgtgaaaatatttcctctctgcaaggaaggataacctctctgtggctgagggcttgtttccagaggggcaagacagaattctgtgttaccacagatcagtatcacaaaggagtcatttctggggacagtgaacagcaatgaggaccacagggaagatttagcaaagggagccaagaaggcagcactagagcatttgtggataatggtgccatggatagtcctgtctaattaattgcatgcaggactatttttttaatgttttatgaagttattgcatcatccactcagtaagccactgtatatgggtgctgggcaaagaggagcatctgacaccatctgctttccttgtgccttttgtttgtttttctaattgtggccaaacacatgacataaaacttaccaccttaaccattttgagtgtacagtagtggtaaatgtatggcacattgttgtacaacaaacctttaaactttatcttgcaaaacttacatccattgaacaacactctcctttttctccttcccgtggttcctggcaacattgtatttctattaagagtttgactactttagatcttatgtgagtggagtgtggtgttcgtccttttgtgacgaacttacttcatttagcataatgtcctcaaggttcatcatgttgtagcatgtgaccggatctccttcctttttaaaggcagaataatatttcattgtatgaattcaccatgttttctttattcatctattgacggacatttaggttggttctatctcctggctgccgtgatgaatgctgctataaatgtgtaccaatatctctttgagatcttgttttcagttctttggggtatacacccggaagtgggattactggatcaaatggtacttctatttttaatttttaagaaacctccatactattttcccaaatggctgcagcattttaagttctcaccaacagtgcacaagggtttcaatggctccacgtccttgccaacatttattgttttcctttttttttttaaatagtggccctcctaatgggtgtgagataatattttattgtgattttggtttgcatctccctgatgattagtaacattgagcattgtttcatcatctgcttgttggtcattttatatcttttttggagaaatgtttaggtcctttgcccaattttaaattggattgtttggtttttattgttgttgagttatcctcatggcattttgcacatgggcagtcttgctaggaaaggcttgtcctaagtcccctctgcccctgccccactctgtcctcggcacttctctttcttcccctgtatgggctctgcctccttcgtgaagcctgttaagggttttctggaacaagctgagcatcttttgtgtcattaggaactcaacatcatcttattacttatattgtgtgtataatttattttgtggccatatgtccccttttatggaagccacttggggatagagaccaaatctacccactttcattctcagcatctggaggacatctctctaaggaatggcatctgaaagtgtgtttgaataatacagggactgagggtcaatgttaaaacaattagaaaccaaattagttgccatcttttcttggtggctgattctaagtggctgaaggaaacaccaggaaacattctgtaaaatgttccttggaaatggcaggcaaaaacaagatacagtgagtgtccctatttacatttggaggtctcatagccatttgcttttttctttaatgtttcaaccctacctgtcagagctttctgggaggcaagtatttacttttaaattaaaaatgggaaggatatgtgttgttcaggtgcattttgagaacttgagaagtgcctgggggtgtaggcaagagaccagtatccccaaggagcacaatattggattccaaggttgggtttgaagagggagaggtgggctagctcttttgaaagtggtgtctggtgctgatagaaaacctaagaacaaatggagaatttgaaagctgcaatggggcgtgaaatgtctcagtgaccaaaggcattatgtggaccatggacccagcaaccagctctggcaaggaccagattgtcaggctggtctggcaggttgaccttggcttagtgcctgcccatctcagctccatggacactgttgcacctcccaggttttccccagaaacaaatgatactggatgtaaagatagcatcaggattagaggcaagccccttcccttctcactctctcatcctgagcttcctgtgtgcagacgacattttaagaaatgagcggggaggggaatcacttcttgaaataaccactgaacaaactctgtataggcactgactgctgctcagactttggaggacaactcaaaatgttcaagtctaatgtcgccccttttcatcagacttgccaaggctcagacaacaaataatttaagcttctagattatttttgtgcagaagcagtattctctggttctctttgtcatttcctttctaattatcagggctgtccttatctgttcagtgcttcccatctgtccatttttttttttcaaagccacagggtacatttttgcatttacttctgttgctctgtttcctgattttttttaaagtgaactttttattgagctgtaacacacatgcagaaaaaggtataaatcatcaatgtatacctcaataaattttcattaggtgaacgtcctcagaataacattttcacaccccagcagccccttcccaatgcccctcctggccacttcctcctcggttggggagcttcttaggggagtctcatggcatctcagcctctctgtgatcctgctccccaccacacaccattcttagcagccaggcccagttgtggccgtgcactgtggacctggatgcatgacaaaggctttggccatctctatggcaggtgcgaatgtaggagggttggcagggactgatgtgcctttgtggccgaagcacccggaaagtgccattacccacctctaggagggatgtgttgtttccatacaacaaaaaaggcctttgaaataaagtgtttattttctttctctttttcctcttttgggaggaagagcaatccttataccttgaaatgtgtcagattctaatatttggagtgggacaaggccctccttcccctttcttatgattagttgaaatctgagtttgagcaagtcttgctgttttcagagaatgctctccttctcctgttcttccctcacagccgaactcatttggagagattgatggagttactaatgctttggagacagtccctaggaatttttttaaaatgtagtggtcagattgacatgtgtgtatatataatgataatcaaggctaaacacagtcttctctttctgtaatttatattcagagacactttgcattgttttcctacatgaatccttcctttgacactttgatctctgacctcccagaatgcttttagtttagtatgaaatgcaatatttggatcttctaggaattttccaagatcaccccttaaatagtttatggcacttaaaaaatgagacaatacaccagacattaagtacagcaaagccttcctataagtgtcagtgtgcagctggctatcagacagcaccatgataaacatccgcctcttttcacagcccctccaactcagaaatacaataaaacatggtcaacccttgaagccaagggctttgctaagtccaaaaacttagcaaaaccaaaacataactgatttacccacaaattagataacaataagtgattcaagtttgcgagccataagaattgagtcagaactttaaaaatcaattatttagcagtatggagtgattatttacttagtgatatattttttatagttctctgcctcatatcatttcagtctatttagaaacctgctattttagcacaaaacaatatcaaggagaggagtgaatgtggtttgcagcagaaaaaataacaatagattgttttctgtagtttaatgtcatacgacaagaggcagaatgtgggcaagctcaggttttgagagtcattctgagtgtgtcctcttttgccattgggcagagagtggccttgtccagggccttggtggcagtggcttgaaggatgaagagcagagagcttagaaggctgtgatcttatcatagaatgatgtcagggagaaccaggccccaagagccccctcactcactcggtgacgtggggcattccattcgaccccagagtggttatttcacatgtcctgggacatgtggcaggggggctgtaaagaggataaagtcaccaggcctgccccagggggtgggttttgatggcctctcaggtaggaatgagaagttttaagatggaaaatgcttcatagtgaaacaaggaagactcagaattcctggattccagtgctgtttgcagcacttactagctctgccacttaggcaaagcactctttgatacatggtgctcttgtacagaaaatgggaattctaaagacacctctgctcaccttccaggattgcagaagaggtcagaggtaggccataagaacgctaaatgttatcacttacgaaaacaatgcgtttgagggaggcaaaccaagatgttaaaaactgattattttcaaaagcaatattttaagaaaatgcattcactggctggggtgaagtgaactgatatcagaagtgagtagtgaatgcccaggagaagtggaacgggctgggcagggtagagtgtgtgcctctgagtaagcagctcggctcttcatcagcacagcagtgacatctggatgtgcagagacatgcacgggaactggggccactgtcatgtccaagcagaaggcaggggcatgtttagtgtggcagaaggacgatccaggcctgcatcctggctgctggcactgctccagtgtctgttagcagagctgccctgcctcatggtgtcttgcgtggcttcgaccctagtgctgagaggctcctctggagagctggccaatgcatctgtccatcttcttcgccagtatgcggagctctcgtgcaccccaagacccttggccatgaaccttccttcagctttctcctcagagaggccttccttgacctgcctggcaaaaccagccactccctggcatgagggaactttctggtgagatggagatgttctgtgtcttgctagggccttggtgacatgagtgtgtacatttgtcaaagctcatttgtgcattttgctgtatgtaagtttccataaaaaaacaactctccacacacatttacttctagttaatgagatgcatgctgaagtgtttctgtgggtagaaacatggttgaatatcagccattcctcccttccctgctgtctccacatcggttcagtcccttgggcctgtcagctctgaagccacccccgtcgcccatctccactgcccctcctggtccagacctgcatcatctctcacctggtgttcatttgcacttttgccctcctgcagtctccaccaagcagccaaatggtctttccaaactgtcacttggatcatgcttctcaactgtgtaagactctccaccacttcccattgcagatctgctgaagtcacagccattcctacgtccccctgtggtccaaccttggccgcctctttgatcttatctccttcccaccatggtcactccagaccggcctttctttctcttgagcctctgagcctttctcacgatgtatcctttacattctgctatcctttgaatcctcccagaaccctcttcccctcatgcttcaggccttcccgacctctggtggaaactatccttcccactcccagattctctattctataaccttgtttctttccttcccaatgctcaggactagctacaattctcatttgttgatatatttatttcctgtctcctagtaggctcccagtggcttgttcctgttcatgcagttttctgatgcccagaaaagtgcctgttatgaaggtgtggctttctggtccctctgctcctctcttctcccacagaaagaaacatctggcactgacaggagtctgctttgtgatcttttggggccaactttcctgctctcaactgctctctatccctttaggcctgtgctcatcgctggaagaacatctactatgaagccgaccacatcctaccccatggcttctgctacatcatcccctccaacctccaggccaaaggcaggacgctgatcccttgctatgaaggtgagcatggattgatttttcctcatccccctacccacctcatgccctaagcccgccttcccacctctatgcaccaccagctgaacatttccccagctttccacatgctcatgatagggcagcactgtttgctcccagatggtctcttggtccccaaggccctgcccagagaagaggcaggtacagagggggcagcagtcccaggcctttccaaccctcacctgacttggctgcagagcccacggtgcttaccaagcattatgaagtctcagggaccgaaattcaccaagcctcagccaagtgacctaacagctgccttggttttctggtaatgccaggtgctgtgttgccttgggaaacttaccttctctctctggacctcagtttccttgtccgaatattcagtggttggcccagatgatctctacagccccaggcagctccaagtcagtcattaggctcccacacagcttctggctgcactgtggacagatgtcctgaggctggggggagaggagacccaggattcataaagcaacagctggacagaaacctgacactctgaactttcagcatttcatgacatttgaggtctgactttccttcccatgtggtcctgcagcccaggcagatgctggagaattgggcgcatcctgaatgtggttttaagagctcctcgccaaggggcacttggaaggaaaatgtatcctctcagacttagaaccttcaaatgcctgggcatcgaggacagtcactaatagtgattgagtcagtcactatttagcccagtcgaatctgagctttaagcgttcagaaaacacggttattttcttcagtttgatagctcgtagtttcaagttttctcagcctaattttgggtaagctggaacctgctccttctgtaagtgctggactatttatttcttaattcccctcctactttatttggacagaagtctcactggcttatgtccacattgcctttgggcctccctgggttttcctaggtttcaaattttgtggacactaaaaaggattcatgagaaacactatatggacactgggacccttctgggtactgaggtgacacaggtagggtgctctgggaaacgtcccccacagaagagccagcaagatctctgcaggaggcacaaaccctctcccctatagagtgagccttcctttggtttttctttctcctctgtatcagcatttgatcagctctggctgggccatgtagggaaatgaaactctggccctgtttatatctgtattgtcccaaacagaagaagaacaaacttcatcttaaaaatagaggatgatataatcaatcaagagtggagggatcgttggtttcagaaacgcaaagcatgtgtcaagcctgggtttccactgccccagtttactcctcctttttcctaaggaagaaaaaggaaaagcctctggaacaaccggtggggcagctcttcaggctgagaaggagcgatgggctcagcagggtgatggaggcagtgattgttgaaccatactagttatgcataggaccagtactttggttttcccagaagatgacatgttgtgacagggacacatgatggtccctgatgattcctctatatataccacaagcacaaggacagccctctgaagagggaggtggagttcaatgtccatgtgtacgcaggtccacgaggctcataattctgcattactttctattaagtagctgtggatcatcagtaggccagtgttgatctgaggtctttacacattctctcatctaatcttcccagaagctgtgaaaaatgtttgtttcttttttttcttgggtctgattacaggtattttattttggaaattgttctagaagacaccagtgaggcagggggaagtaagaatgggaagggaaggcagcccatggaagatgtactcctcagcacgttacctgggcgagtgggtgcagtctctggggtgggtgctggggccagtgtggagcacacatctagagtcctcctgcctgagggctgaggggaaggggcttcctccacctggcatcctgtcctgccatgtgtgtgggctgggaaagcctccaggacagaggtgctggcaggtggcagtcaggccacatcataggaacggtggtaggagctggggggagacaggtgggatgcccaaaggccagcttctgtgttgtcattctcctgtgacaggagtaagtggagactcagagtgtatgtgaattgccccaggtcactcaaacaataaatggtggagcaggattttgaagctggcctctgtctgactcagcaaaccattttgtgtcctggtaattaatggtaatttctgttagtttgttttttagggtttctaatttaaatgagaagtaaaagccagtcaacaaccctcacaaagcaagaaagggtgactgaactatcccaaaaatacaatggacttaatgatggttaaatggaactggtgaagaaattagcaaaatgattatgcccctgcccaatcttccttcccatgggcgcacacacacttttatatgctaacccattcattggcccagggtgggaaataagggatggatggggctggcatgtggagtattggggtgtaagagcagccccttagaaaaatgggggactaaattgaaagtttctgtagttcttggccctgtaagaggagaggggtagaagatgctgagtatttttctagaagactggactggacgggtggggctgggaggatgccggccgtagtgagagggctcttgtctgtgctctgttggctttaggcatctccacctccctgttttgtggtttaaactagacctactatggcttttaaggccaccattatttcctcaatgtggagaaactcagtaatgcaagttctctgttccacgttaggggtcacattatggttaaagacaatgggaagattttagagtttgacaggacctttcagataccacctagaacagcctcctgtctttcatgaggtccagagaggtgatggcctgagtttttctttctaatctgttattcacatgccacacaatggagaggcagagtagcttggtggccaatgcacagattctggacacagactgccggagttcaagtcccggctctgctacttcctcttattaacagtgtaatctcagatgggttatttaagttctctgtgcctaaccaacctcaagggtctatgaagaggactgagttaatgcttctaagtccttagaacagtgtctggcatatacttgctaatatatgctaagcatatatatactaatatgccatgtacaacatactgtattctgagcaagtgtttgttaatcatcatagggtgactgacttgtgtaccgggaatagaatccacttaatcttaagtacttgttagttgccagatagacaaaacccaagtgacacagttccagctaccaagaagctccccatctacaggggaaaacagagaggggacagggtgttttaaaagtgggagggccgtgtggagagagaatttcctgccagtgtgtactgctggagcccgtccccaagggcttgagctgcatccaagtgcaaggtggcattatttcattttacaattggaaaaactgaaacccacttaaagtctgcaggctgttgagactatggaagagagggatggtggaaattcgagactggtcatggtggtgggaacagggcaagggaggagggggacggctgcctctaaacccacttcttgtgggatggtggaaagaccgtgggaggggctgtgggttgaggacggctctgctgcacttctgcccctttagcctcaggcctgtcacttggcctctcagtgggagtcgatgctgtgatgcctccactgcatttaccgctttgggttatggtgaggagctcccgagaaaactcaggtgaaagtgctcagcaaggccacccattgttctataactgtggcctcatggtaagtctccatatgggccagctgtgctcctttacaacattggaaggtcggtttggttgcagagactctaaatatgtggggatctctccaaaatgtctcaagcttttgaattcttaaaaaattggtctctggtttggcactaggacatggcttctcaggtgcttcctgtttctggttggatgggaaaagctaccagaatatcctgttggaaccaggaaaaacagaggaaatgggaaataaaaatgaatttaggacataaactcatggagcatatccttcagtcagtttagtttgtgtttgtctgatgtgagaacatcattacctaccatatgttctttggttttatcagaatgtgtgagaaaacgagagctttggtgggacgatgtatagggaaaactacttgtaaattaaagggcaagcactataaaacattaattactattaaccaagctatgatattttaggactccgaaatgttaagtcaatgcatgtgataaaatcaagtacagagatttctttcatcctttgcccttgagaccactgaggcaagaagccggaacttagcaggagtgagactgcaaacaagttgtctttttattgtgaccgaaaaacctgatgagtgtggaatagtttgggagcagcatggcaaattaacaaagcctgttcaagattaaactctgagaaagaaatgcaagaggtaattatgatgccatggtatgttagacctaaattgtggaatctggctttactactcacttattgctatgattaaacctatatgctcctactttctgacttagtgaccttaggcaagctccatgagcctggtgccctcatctataaaatggggagattaagatctacttaagaggtatgtgaggtataaagtgcctaccacagtgctcagtcgagagtgaatgctgctcattgccttcaattagaaaatgtaaattttctaattaattttcaagcaacataatagtattcttaaatattctcagaaggtgtctaacatatcctgttttagtgactagataatgaagggtagaaagctggatattcctaaaatgattttaagagcccttggcaagttataatttctcaaatactgttgaagatcatattggcacaatttggttggtaagtgttccttccctctttttgtagatgacctaaaactttaactcatgccatgtttaaatgttcttaaatttgggattgttgaagtctgaattttactgtgctttaaaattgtgatggaaaaacttcctatggattccaaagatttctgtaccactctattatcagggaatgactggcttttatttctagtgtgtgtttgcatttcctaggacagtgatcatttccagggaaggaaatagattacccattcaaaggtgaagatttttttcccctttaatgttaaaagtggtctccacaagggataaaaatcaacgaaggtccatttacaaatgaaaaggaattggggttttgttgtatttttgttttgtttttgttttggagagaaccataaaaggctaagttgatccatttaaaaattcaagaacaagcctcataaatttttattaaataaagacctctacatttacataggattttatggtttccaaggagctttaataaacatatcttatttaaataaatagagcaaattaaagagaagaggatgcagttgtacattatggccagttaaacagagagggattctgagggggaggaagggagggtggccccagaggacagccatggctgtaaggaggaggccagaggtctccagcagggcctctctggggctttccaggtttccttggagccaagaattttaatcttgggcaaacctgtctcctatacttcaaacgtgtttccatgtattacgtggaattatagactacctaaactgcatcttttgtttctctcagaaaaattcacagattcagattcacctaatatttattgagcacctacctggtgccaggggttgtgctaggtacttaacatttttgatcttactgagtaatcacatcattctcagataagtattcttatccttgttatacagatgagaaaactgaggcccagggagcttgatgaaggtcacaggcttattagtcagaggaggggttgacggcttttaagtgtgtagtaggtttctttgtagctacctgttctgttgggatcctggttttcttggtgattactgagtgctgtggcctatcacagaaaaaaaagtcatattttttttcaatggcataattttatgaatttttgggacactacactatagacttgttaagctatgtttcagttttgcaattatagatacactctgtagacaagtcccagtaggtacagagggcagacgtgggtcctcagactgataaaatgtagccaggagaccaatctgctctagtctggagtggctgcttactgggaacatttggtttcagtatctgcacagcagtttgtctgtccatgctttggtgccagttatttcatgagtctttttatttttattttttggttatatagatcagaggtttccgtgttgcccaggctggcctcgaacgtctagcctcgccttcttatgcgccaggacaacaggcctgagccactgcagctccctatttcatgagtcttttagctttggtcccaaaattgaattctgctcagttctgagctggggttctcactgaaatgtgactgtcccatgttcagggtcacttttttttttctgagagtagagcatgacataatgcatagtaagttgcatgtctatatatacattattatgtgcctgtattattacttgctgctgaagtagggagttggcaaaatgggttgctaagttctaggtaaagggaacgctttaaagattacaaaactccttttttggtaatattaaaaaattattggccaggcgtggtggctcatacctgtaatcccagcactttgggaggctgagactggcagatcacctgaagtcaggagttcgagaccagcctgaccaacatggtgaaaccctgcctctactaaaaaatacaaaaattacctgggcatggtggggtgcatctgtaatcccagctacttgggagggtgaggcacgagaatcactggaacctgggaggcggcggttgtggtgagccaggattgcatcactgcactccagtctgggtgacagaatgagactctgtctcaaaaaaaaaaaaaatattgtaaaaaataaataacataaaaattaccattttaaccatttttaagtgtacagttctgtagcattatgtacattcacactgccatgccattatcaccaccatccatccccagaacttttgcatcatcccaaactaaagctctgtacccattaaacatgaactcctcattccctgcttcccctagtccctggcaactgccattctactttgtctctgaatttggatactctagacacctcatgtaagttgaatcatacagtatgtgcccttttgtgactggcttgtttcacttagcataatgtcctcaaggtgtatccatattgtagcatctgtcagaattttcttcctttttaaaggaaggaatatttaataatattccattgtatgtgtgtgccccacatttatctattcatctgtttataaaacattttctttggatgataagaatgttttcactggaaatgtgctttgtgaagcataagggagtggcagaagcagatcagaagttgggagccttgctcttgggtcctgatgctgaggctaatcagcagtgtagctttaaacaaaccacttgctctttctgagcaaaaatattccatttgtaaataaatggacagagttagagttattaggcattccctaaagatcttttccccttttaaaatctttctttcatttaattctaagtttctggctttatgcactttgtgtttcatgcacaccatagcttagtcatcagttattttcataaaatgttctcgcttcctctttaacctagctgtttaatttatttacattttttcccccatttatatggtggtcccttgtaaactgagggtagttttattctctcttcatttttctgtataattgcccttttttttttttttttttactagagctgtgtctgcccaaatgcattgtttcctgtattgtacaattatcagttatttagatttgccactctgttagaaacaaaatgcttgttcctcagtgccacaatgaaatagcacttgaacataaatttaattttctcagcaaggcaatttttacttctactgaagcgtgcgacttgtggatggagtaatggtgagagcacacctggacaggggaggggcaggggttcttattcctgttgcaggtagcccctactgctgtgtcgttcccctatttcctggggttcaactgcatagtctgagctaattccaactggctgttttaaagagagcaggagtacgatcctgagtggcggggtgagtagtttggtgggaagggtggttacagaacaggtgactcaggatgatttgggtcagagcaagtgaccaggggtgactcaagatggagcaggtaaccagggtgacttaggttaaagcaggtgaccaggggaacagatctgaactactgattagaactggcgggaaagttgtttactgaaactagaggcaagggggccaaagagaaccaggaagttaaactttaaaatggaaaatcaaagaataagagagctgaacatattgacatactgattctttgaagagaaacttggaattcgctataacaactccttggtgaaattcagaataaagactggcaagctatttttcccccagtattttatttcagagctaagctaaggaactacagaaaaataattgtaaaattgatgtgttaaaaagctttgaaagacagaactttctcaaatgggtaatatgaagggagattattaggaagaatatatgttatgctgtatgtgaatcttgatctttctgtggaatggttttatcctggtcttttggaaagggtacaggaagtgaccccacccgattggtggtctgcttgaattacattcattaatgtaggctccatgcattgagttgcggattgtgaacatttggaaaccagtattttttttcctctctgaattgccttctgtttagacagggcttaataaaaccagcagctaaaccaaggaaaatactcccatttttagaatggaggagccatacgacttaatgaattaaagcatgtaatgcaggccaagtaattcaaacccacccatggcaggaagagttccacaacctggttccagctcctctaagtgacttctaagtccccttgttcaaccctatcttttgggtctcagatttggcttccccccccccctttttttttttttttttttgagaccgaatctggctctgttgcccaggctggagtgcagcggcatgatcgtggctcactgcaacctctgcctcccagactcaagccatcctcccacctcagcctcctgagtagctgggactacaggtgtgcaccaccgcatccagctaatttttgtatttttgtagagatgggggtctcactttgttccccaggctgattttcaactcctggactcaagtgatctgcctgcctcggcctcccaaagtgctgggattacaggtgtcagccaccgtgctggccagcttccccaaatgtaagggttaggtttgttacagtgcctgtgagctgctgtcaggcaaagcctgcttttcccctgcttctttgaggtggataaatgttttgttcagtagtggagagggcactagctattgtagtcctctctgcagggccatgtccctgggggcatttggagaccaagtagacatgcccaggagcagccaactgctgggccccacggcctttgtgtttgtgcaggaaaagttcttcctgggaacacaggagactggaggtcacccccaccccttcccaggtccctccaccctgcacttcctggacttgtcaatggagggagggtgtgtgacccaggcttgttggggatgttgtttgtggggcagccccttgcctctctctgcgcctacctcacttcccatagctttgtgatataggctgtcctgccatctcaggtctagacaagcaaaatcaagttgtatttttaagttttttagatacgagtatggtagaataaccctatgtacatactctttggggaagaaaggctcgtacatgaacatttagaagatggattagggagaaacctaaacctgccctcttgacatatatatgaaggaatcaggttaaaataatagtagtgcccttaactcacagaaatagcattcaaaggagtgaaaacaatggaaagcatgcttgtggcctaggctgtggaaggtgtggaatgtgaaactgtctaatccaataacacccactaactttcctagactagagttgccaggccccacaactgcccccaaagtgtgtgtggcagggatcggataggtggtagaaggattagaactggattctactctaccttgaagggattaatgacagtcacagaagtttctgggaggctgggacatggcctgctctctgatctagatttgattataggagccagtcaggggcccccattgtttgattccttgccctagagcatcctgagaaggcagcttagactttgggtttcagaaacatgaaagtcagtgatggtaccgacttccatgtgtgtcccaggccctcagacctctggtggggcagtcccagcttgggaaggcggaggctggcctgaaaacagtgcttcatgctgcctgaaacaggggtgcctttaagggcttccccttgctggccttcagcctgggccagaagtggggtattcttagctcccagtgaggctgtcaccacctcggaaacccgaggtcctgctcccaacatagaccacaccaagtacagtttggggaggaggcactgaagttctcaaatctcccattttttggagaccttgtcataaagagaccttgagactgctttaaaagatgaaagagtcccacacaattcctattcatgtcagaaatttatgaggctgaactggtggtgtgtcttgcactatagtttcattcagctcatggggtctgaatttcctttttatgtttcattttttcaagagttacaattgggtgtttagtctctagagtcagtgggatggatatgctttttgccagacttttcacatttaatatgtaactgtttgtttaggttgagacattttgatcctttttgccgttgtgctatttgatgcaggatttattattaatttgtattatttcttgctattatgaaatttgatgcaggatttgttcattgctttgcactagtctcactcgcagccctggtgcaagattctgcagggaacaaacaagttccttttgtcactggactgctttctggcaggtctagcagttgtccttataataaccggacaaggcgggagaactgattttatcctgcatggaagaggagtaactcaattgacattctttgtcatttagcagtcagttaatggccacttactggaaaatgttactaggctctgtggtgagtgttgttagaaactgaattactctgtatatttccccagggccctttttccccttgcctggagtagacactcagaacggcaggaagtggcactgtgttgcaatcatagtttcattgttcctttgtattttgcatttcaaaaataatgatattgcttttaatggtaccagagacttgccaggagcccagggggtggtacagggtcactggggtagccccagcctgagggtgcccaggagtggtctgtggaaggtctccagcaatgtcagcctcacatgtgattaatttgagtcactgtgaacatctctccacctccttgactttacccatgaaatgatttccaacatccagtcactttcctgggtatttttagtcactcactttgcagaacctttgatggtctacagaagtgaaggaatgggtttctaagtccaagctgaggtagaatcctggcattgccatttactagagctgtgtgaccttagacaattcacttaacctctctgagcctcagtattcttacctgttaacaagtggggatatgggttcccagggatgagggaccggtgaaatgatatgcctggagacagctaacacaatgcctggaaaatgctaagcacttgtcaaaagtttcctacccctcttccttgccagcttaaaattataactgcagcagcagaacgcccccatttgttgggtagcagtgttgtgagctgagggggtggaggagaaaagcttatctgttagttttctttccacctggagagatcttccccctttccttccacacagcaatagtgtaaccgaatgccagagcagtcccttcttcttgcggtcctctgtggacggcttgtttctttttggatggtaggaggcatccaaagcctcttttagggaaggttggtcttcttccaggagactccacactgggatggccacatcattccatttctgggtcacgttttcagctccttgggcctgcaagggatctctgtcccttctggagtaaatgaaataattgtcactagcctcccacttaatgactgtggctattgctcctctttctcgcacacgaggggaggaagtctgctggggcactgggcagcctcccttcccgatggcaccagagcctggatttttgaggtctggtggattcctgagactttccttcctcaccccagtctggacagcatccctgggcccagcctgccgcggcactcgtgggaagtggctggctggctctgctggctccacgcacagctggcatacactgacatggctgtggtttgcttctctctccttccttgcccctagagtataagaagaagtacggagaggaacacggctcctgccaggctgggatagcgggcttcttcaccgaggtgggtgtctgctgtctgggcatttctgttctcttgtgggtgttcatttccttgcttatatgattttggcaacccttagaggtgggacttctggagtcccagatacttgagcctcgagggagcagattctggtcctcacaccagaggaggctatttctacctgccaggagggcaccagctggccagagaccactgggcagaggaggtggggtggctcatctcgaggctacccctatttgatgatttttgtaggagtctgcttgactctgagacctggggaaggagtcgatttggggatgtgtgagtgagatgacattcagtcaggttgtgccccatcattggcgactgtgcagatacatgaagcgtgtgagcatcccctcctagcagccttctctccttagtggagagacttgtttgtttttcgagacagagtcttgctatgtcactcaagctggagtgcagtggcgtgatctcggctcactgcaatctccgcctcctgggttcaagcaattctcttgccttagcctcccggttataggcgcccaccgccacacctgtatttttagtagagacggggtttcgccatgttggccaggctggtcttgaacacctgacctcaggtgatctgccagtctcggcttcccaaagtgctgggattacaggctgagccaccacacccggcctgagagacttggttttacacacaactctaaccattccttttcccagattcagaaggacaggacacctgcatgcttatgtgcccgtgtggtagtagcatgacttttggctggtagtacatttttagggactgttttcttgtgtcattcttacttactgtaagtttgcccttcgtatcagttcctcctctctcaaacactttcatgactgcctgctggcactgtctatccatgtggttgctcaggccaaaaaaagagtactttttacttctaattcatctgcagtcctgttgttttagcctccaaaacacatcccaaatatgacagcttttattactattacaatcacctccattatcaccatcatgcttctagaaaggccaccaccatcacctggaggtacactggccctgattggtcttcttatgtctattatgcttttttaaaaattgtggtaaaagatgcataatataaaagtcaccactttaaagtgtgattcagtggcattagtgcattcacagtgttgtgcacccatcaccatgggctaggttagaacactttatcacccagcctgcatccattctgacctgtgaagtgtgctttctgcatactagccccagggtccttcaaatgaaacccatccttctgactccgaggcttcccagtccatggaggattacaatgtaaagctcctcatcctggcccctggacttggctccctgaggccacctctctcttttcctcactccaggagagcagagagctggggaagggcatgggacatggggggtggagggaggatgaagggtgctctctggcttccaaagtgagggcccctcctgagtcaggagcaagactgcctaccttcctttcagaaactgctgtttaaatccaaagagaacatagacagttggcaatatagtgtctgatccagaaagcaagaaagaaaaggcagaaagtctgaagttttattttcactctcaaaccaataaataggagatgctaccctccaacccccattccgcaccctcagtgattcttacctcgctggagaatcatttttatgacagtcgacagagttctatgccctgggaatggcaccgccaatcatcctaaccattgaggccgaatttaaagattgttctctcacctcactctcctacttctaagccaccttgcaagtcccaccacctcctatgccctcaaaacctctaacaatgacatccattgccctccacatcctctgccaccctacaaatctaagccatagttgtcttgcttccaacccactgcggaatccttctgccgtcttgcttccacccttgcctctggacagactggtccccatgtagcagccagaaccaccttttacaaacaggaaaaatatcatggtgctcccttgctcaggactttctggtgtcttctcatcctacttagaatgaaatgcaaatgccttcccttggcctcccagccttcatacctttccaggctcatctcctacctcacccactacatggtattttcagctgctgctaggacatgccggactcccactggtggcattgcactggagatccattcacgtggctccttgtacacaagtgtttctttagaagagacactaatggaggaactgctgggtccaaaggcactcagatttgaattttgatacatgttggcaaattgcacttcagacatgtttaccagttgacactcccctgcattgcttctgtctctatcttctctcactcagactttaaatttttgttatgaaaaaacatctcgttttaatgtcactttccctgattattaatgtcatttaatatccttttaaaatattgaccatttgtatttgttttcctggaagttgcctgtttatgttctcagtacattattctgttttgttgttgttgttgttttcctggtttttaggaacttgttacatattttcaacagtaatctcttacctgatctatgtgttgcaaattttttcatcagcctttttcttatgttttaagtttgcctatgatgtctttatcatcctggcaataaacatgcacatttggccaaatctatcagtcttttttttttttccctctagattctaaacttatctcttaagaaggttattccttatgtatactgcaagttggcatgaacagctgggcaggagagtgcccgggatctacaacacatgtctgggctgaacaaactcccatattttatacttatattttcaatatacttgtatttttaatagcactttcataggttgtttttaaaaaagatttcgatctttaatctttctggaatttgtgttgtatacattgtgtgatagaaactaactacattatttttctaaatatatagttggttgttctgatactggtttgttaaacaacttttcctctccccattgaaatgccatcctgccgtgtggcgacttcactctcttcttccatctcagcaaacatttagattgtgtgacaactatggctgttgttcctccaacaggcctgtctagtattgtatgacttgagtcaataggcagtgggaaccactgtaagttcacaagcaggtgacacactggcagatggcagtgttgaaagaaaggctatttgagctgggtttgcccagaactttgggagtggaagggcctgaagggaggcctggtaggaggccgtgatgtggtaggaggccgtgaagcaacaggacagtgtagagggaggcttaaggaataaaaatgattgggggaggcagagaatatgaaggaaatgtcaaggggctgggtggccagggagctgtggggtagaggaaggagggtttgagccaggcttctggagaatggtggtgcctctggtgaaaaggggttgcctgagaaagaacccattgggagatataaactgccaagtctgctttcagacacagggagtgtgcgatgtttttagaggacgtttggacttagggactggagtcctgcctggggcagaaacttagatttggcccttgctcatgactctcttaggggatgagtgtgcttagtgtagggcatgggggagacacctccctttagatgggaggagaagctagattgatgggagacatcagaactcaacggagatgttgacagagagccgaggagaaagtgttcccaggagggaagtgtcattatgtttgccgcagcagctggcaagtcaggcattgggctgagtggaggcagggagtggtaggaggaaccggcggggcaggagtgtggaggggaagtccaggtagctgtgcaagctcagggtgaccagaagaacagaagacctgctgaaatccaggctttgggatttagaacctgagggaaacatggggtgtcagcatgtgctggctgtgctcatggtacagcaaagtggggacatggtgggtgtacagagtgtccggggagggtgggcagtggtgagtgggaaggcagcccctctgggcgccactctgtcctctgaccccggcctgctgtctcctggctactttggactttggcctccgcttcagttcccaggcttttggcctccttaaacaggaggtctttgaactcactgcctgccttgtttctggaagttcagctgtttgtggctgagcaggaaatgtggttgaagggtccaggccagcgcgactcccctcctctgccctcttgctgacctcgccacttgggcttgccttttctgtgagctgttgtcccctcccaagctggacatggatctgtggccttctggtcatagctatgttgccccaaaatattttggcctaaggtgcctgcttgacctacaggtcagtgaccctgagcttaacaaagccttcggagctatggataccacctgaattttagcctgacattgaggattagagagaatttcctgggaggtttatttatttttgtagatgaggctaacagaggtagtagatactgcttagcagcaagagaggatttggaccagctgggctggcgttcacgcctgctgtagaagcctagaggcacttgggtgggagtttgttcagcacggacttctgttgtagatcccgggcactcctgcccagctgctcatgccaacttgcagtacacagaggaaatatatggcttctcccaggcccacctacataccccggttcctctaggggttctgctaataaatgcatcttgggaaaaagctgcattgcttattgatgggattccacaaatgtgatttaggtagtggtggcctttgcttagagaagctttcatttgtgtgtgtgacattgacactggctgttcctgcatggtggggagctaagtattagtcactttttcctagcacttgtgaacagcaccagaaaggtcacaagcatcatccatagggaacagaaaaaacaactatgagggatttccaggaaggcactgtccctcccttcagcctcagccctgagggtcgcaggcttggccctgttttatgtagtatgggctgaagggagaggggtgtgagcactgggggcggggtggcgtggtgcggtaaaaacaagagctgttggttttaaaggtttttgaagacaggaattactttatcttaccctgtttataatgtttgagaggggatgcagtggtatggtaggcatacatttttcaacttttatcctgggttagtctaaatcatcagaaagcaacatatcccatccctgcccccaatgttccgaagagcctttgcaggcctgtgctgatgctcaaagctttggcctgtgcaaagctgcaggtggagaaagctctgcactgaggatacatctggggctgaggaggttgctcattaggttcttcagtgccctttgtattatatttggacactgattacaaattcctttccaagctcaaggccaggagaaaaagtctctcctctgatgaacttatttctgttttttgtactctttctagaactagcgtggtctcttatgcaggacagatgagtgtaaaaagaatgagtggatggatgctctgctgtgtttcccagtggagcgtcctgactgcagaaagctatctatttttataaaacagtgagatacccctgggaacatctggcttatcatcaacagcttccttcaaggggggtaggatctcaaaactttaaaatgaagtgctcatcaacagtcatttcttgtctacaccctcctgaattatcaaaaagcaagcctttccggcgagaatctagtggcttttcttccatctgtgttcctgccctatcctttgttaaggctcttccccaaattaaccataacacgtattgtttaaggcattgccctcttgcctgcaggctctatcctcctctctctattttttttctttaggtacttctggcttttgcagacacttgctccctgagaattcagtggtgactttatgaattgtcctcagaaattctaaatctctgcggcaggatctagcctccagggacttgtcagagccagcagcttctgccagtgcgtgggctcgtctctgcagagggagatcaacctgaaaagatctgtttctgaaatatatgtgggtgaccaagggacggggtgcaggggaattctgaaggctcaggggaaggtcaggtgggtttcagcagtgagagacttgacctgcacagcatctgttatccccatgagccttcatgaccagtatctttggagttttgtctatagctgaaagatttcctctagaaattttgttgattttaacctgtttgcatagaatttttttctgaaatactttgcacattaccatgctgtcttaccccaagaatgatctacgaagggactttatttatctttatatctagtgtgaactctgagatataatagtaggtgcccaataaacattgttgagtgaaaaattactgatttcattagaaaaataattctgattatttcttattgcagtgtcgaaactttagaaaataaaggtaatccaaaagtagggattccctgttggggaaaggaaggactgaaagccagggacctctgatggatacaagcacagcctgcctcctagctccagcacagcctctgcacaatgggagcttcgtcttaatgcttgtaaaatgtcatctcattagcatgttttgtgtttttatgtgatgacttccttgttagtgtttaatcactgttctggaattttaaaaagtcaagattattaattaaaaaaattaatacatataataaaatacactattttaaatgcagagttcgatgagttttgacaaatgtgtataccatgtcgtctctgtctgaatgaagatgagaacatttccatcactttgggaagttcctcatgcccctttgcagacagtgttcctcctctttactccaggtacccactgatctgacttccatcagtgtggattggttttgctgattctagaacttcctatgaatggagtcatttttttctcatcaacatttggtctaggattcacccatatttcaactgagttttgaatactgcgaaagggttacacaagcagaggaagtgtgagggcattgcacagatggagataaaaagatcagagggagttccgaagaccagaattagtttagagtgtcctaggcatgcagtctgagggggcagtggcaggagaagagcctaatgtggttgaaatagtggacagtgttgaattttacctgagccctgtactcttggaaaacagtgtggtctagaattttgaaaaatgcaaaggaaataaactttgggagtgagagaacaggggatgttgattgatttccattatcgtatcacccaggggaaaaccccagcagatatctgtgctgacttccttgggtgaccaaatcatttctgggaacttagggttgttgtcagcattggtgatggttctggggcacaaacatgctctcagccctgttgaccatttccccctgatctaaatgctgaagacagctgtgcctcttatgttcttgagtctttttttttttttttttttttggcagagtcttgctatgtcacccaggctggaatgcagtggcatggtcttggctcactgagacctctgcgtcccgggttcaagcgattttcctgcctcagcctcctgagtagctgggattacaggcatgtgccactacacctggctaatttttgtatttttagtagagacagggtttcaccatgttggccaggctggtttcaaactcctgacctcaagtgatccacccgcctcggcctcccaaagtgctgggattacaggcatgagccactgcgcccggccttgagtctgtttttaacagtgataccgtctattgctgccttgtggtcccctcttccagtttgtgtttttccttagttgaccttgctggtctcttggttttgttcttccatgtttgcagtggactgtaatgatcggaaaaccatgttctagaacgtccctgagagggtcttgagtgtggtctggaggggattccctggagtactagtgcacagtttcctctcgctacgcatcaggtcgggggagttgaatggtgagcctggagtccaggcagggtgcggtattgcttactgcttttcatgagtggtgttccccagaatctgtggttgaggtcaatgtcagctgtttgtcatttccttgttagagcctgatgtaaagttgaggaaacgtgtgtggtctcatcgtggatagaataggggcctggcctgtcgtgaattctgtcaccttgctcagtctcttcacatctttagtcctgataatcccgtctgtataatagattccataatgctgatgaatctggtgaaatctgtttttgttgcttagctggggaaaaaaaagttcttggtgtgaggaatttctcctttgttgtgactgtggttctcattgcattcccctcctcccctcctcacttccttctctgcttaccgttggatttctttttggtaggagctggtggtgatgggtgctccagggtcattttattgggctggaaccatcaaagtgctgaaccttacggacaacacctatttaaaactgaacgacgaagtgatcatgaacaggcggtacacctacctgggtgagtactcagggagagaacaggtaagaaaggggaaatgggagtgattcccaccagattcacaaattattgcttcattgttggaaagaggagttagttggctttgacgcctgttgttctaatgacttacatctttagccagggcatcttcacatctagctccacaaacacaaggtagagaggaaaaccaaggagggaactgaattaaaactgtatgctttaattaaaaagctgacagttgaacctccagggaaataaacattttattttctcattttatcaattgttgaagttcagatggtcaggtagaaatgagtgtgatggagtcttgattttccacgggcgtccctttggatggagtccttgctttctgatcacaaaactggtagcaaatagaaagataagaactagaaattatcatgacagatggcaacctaatgctgaaggttaattaaaggctcagaaaaatttctcttgctttcttaactcttttaatcttctggaaagaagatagacacaatttaatgtagctatcaggcagaatgacactgggacaaggtccatgccaatttaagaacagacataggctgtctttgcttgtgtagatgacaattacaagactcttttctttaatttatgccctaaatgctataattctggattgaaagcgaagctaaatttaggaaggcctaatgatgacacacaatgctctttcgcactcatgatacataacttacagggaaaggccctgactccctttttgcatagcgtcactgggaacttcttgttaaatggggttagggagtcgttgacttgccttttcccttctaactacaagttttttgcctggtagcatagacccaacaatccttctactctggggtgtttgctcctgtaggcacccagctgcctagtgctgttgcttattaagcatttaccctatgccaggctgtatgtattatttctttttaatttctgaaacaaccttatgaagtagctattattatctacattttatagataaactgaggagcaaagaaattatacatcttgccaaggtcacatggctcctaagtagcaaaattagggtatgagcttgtggtttctgagtgcagagtctaaatgctgagctgccttccctgtgggtgcgtctgagagagcacctatcactggtactgtacttctcactgggctgggagcaccttgaagacaaaatgtgggattgtgtctcacatttggtatagtgcctggtgtatagtagtaactcaacacatatttattgaatcagggaatgaagagagagcagaagaaagcccagtttggatgatgggtttggggtctagaacagctcctttgaagcttcgagcctgtggtttctctttgtatacacattagaggctcttatcagctgcagggattatcaaggatccgttcaggctttgatctcactcagaatactcttaggtactatcagtcgccagtctgagagaaatcagccacatggtgaggaagaattgatcatgatatgatgtcatcgcgaaactcaaacaacttacaatcactttagggttagagggtgatgacaagtttggggattatatggcagcctgtacaggatttatgctggccagaggagagctttcagcctgctagcaaggctctcagaaagcaggagacgttgaggctaagcctaggcaatcttttcctttgtttctaggttccttttgcatccatattttttcactgaccaccctcccacccatccacccatccatctacccaaccatgcatctacccacccacccactgacagcttcttttgccttcttgtaggagggagtgtggttaacagcaggggctttagaggcacagattagatttgagtcttgctgtgtgatctttggcatgttgtttaacaggtttttctaattctgtatctgtaaaatggaagaaacagtcatgccttcttcataaagtttttagactgaaagagatacctaaagacatgcataaaaatgttggtagcaaccttgttcatattaaccccagcctggaaacaacctaaatgcccagcaacagaataaacatatgacatatttatataacggatattactcaataataaaaagaaactactactgtactcaacgatgtggatgaatgtcacagatgttatgttgagtgaagttcaagaaaaggcaaacctaatatatggtgatagaaatcagaatagtggctacctgtgtggggcatattgactgggaaagggcatgagggaaccctctggggttatggttctgtggttatagtcacttccttgatctgggtggtggttgcatggctacgctcatgtgtgcattcattgagttttacacgtcagatatatgaccttaccgtatgaaaactatgccttgaaaagaagaaaacagatatatagtatttcatacagtacttgtccgaaagaagacactcagaaagccctctttcctgccctgatatccttgtgaacatgactttttgtgagatgagagccatttcagcatgagaaggttgacagctgccatttttttcctggtagtttatgttccaagagtagggagcatgcttgagaaacattttcctctgatggatgtttttttttcccttcccttctttttcaaccgtgtgcttggtttccgcccatcctgttcaggctacgcagtgaccgctggccacttctctcacccgtccaccattgatgtggtaggaggtgccccacaggacaaaggcatcggcaaggtgaggagaaacatctgtggaatagctggggtcagacagaagaggggagcatgctgtccctggtgcagaggtttgccagctgacattgacctgaacattctactgggtggctggtggggaggtgatgaggaaccccctgactgccccactccattggaaagtttcccttgaaagctcaattagagtgtgagtatactcacactctcgatttcctgcacactctcatctgaggtttttcacagctgaccatgtgtgtgtgtgtaatttataagactgagccctggccttatggtgtccttcaaaagaatggcatttagtgctgtccaacttcaaatcccaaacccttcccaagtttggctttgatttaatggagctaggtccagtctcagatatctttgaggctttattcatgccccaaattattctcgtatttatttccccagtgtttgagaaggaacattgggttcccaagactggttcagcccaaaggctggactggaaatatgtgggtctggctttccctaaactatagtatctgccaaaaaacccaccccctggatctagggctgcctgaattcctttgggaaacatgacctctgaggggcctgaattgtgaactacgcttgttggttctttatcatgaaggtacaggaaatccagattgagtaggtacagatggatcaggaacccacatttttaagaagctccataggttgtctgatgggaaagactgagtgaacagaggaatgaactttggatctggacctttaggggtagacctgtgatagagtctggtcatatctcccagggcttggagaagtggaatctggattctggattagcccagatgagctgagaccactggtaattggagccttcagccaggaggtcaggatgatcagggagctgacgaactttccagttgactaggcttgactaaggataatttctgtggatcctcctgggcagaggttaggagctgctgctcacgtttctggagcatgtgcctccctcctccctaacactgatgctgtggaaagaggttcttcaaaactgaaaccagataaaccagggccctgagctggcagggaggagggatcaagcaggtgaccttcgatcacctcaagaaagaggtggttctttctgagttgcatgaatttatctaagtagagaaagaagcactgagagctgttcacattgatgttgtcttcttggggaggggctgcgggctaccgggcatctctgtagaaatggtaaaaatgcctacgtctagttcacagtgatgcgggtgcctctatgctaatgatagcagctttcttttctccctaattgcagaaaacacgacccagttttatagtttttccttcagatgattgtgatgaacttcatagtccctgtcaagtcttaagatgacccctccgcaaacccctctcactggctatctggggggtgcaaggtataaagttaaaaagttgagaatggtacttataattgatagagccagacagcgggactcctggacccagtttataaagtacataaaaatgcttctttcaattagaccacctgagaggcatggggaaactggtcatagtgacaaagttgctgacaattccacattcccagggattggggctagtacagacttgattcccaaggacccctggccttcaggattttgctggatattctagtgtcagggcacaaaagcactcacactaagatggcagttccttatctcatgggaaggttatttacactggttctcatgagacactcttcccacgagatgtaatccaaaaaaaagaacttccatagtcaagtacatttaggaagttaaatgtcagtgatcgtctttgcagtggcgatgcatagttcacatgaacatgctaaaggctctaaaaagttccacagtcaaagaatttacttaatgtttaactccacatttcccaaatgaaactcatttttacccaggcagatcacatgactctaatattacgtgaaatcactttgggaaactgctttgtctacagtactcatctccacctatccctttatcttctgttgtaatgcctggtaaagtcttactgggaataaagtccaatccataccaccaactaattttaaaaacaggaataaaggaaatatttcaagaaacaaaatactagctttttctcagagttgaattgtttacttgtaatttggaagcttcttgggtcttattgtgtgtggcttttataagtattgtggttcaggagcagtggaggtgatgtctgcctcaggattgaaggacccttttttttgcagggctggtaaaatgacagctgacttcttcatgatcatcagctagcataagcacatctgctgtgcacctggctcttaagcttttaaataggactcccaggagagtgctgataaatatctttgatcattgatttcatcctaactagattttttttttttcattccataggtttatattttcagagctgaccgaagatcaggcaccttaattaagatctttcaagcatcaggtaaaaaggtgaggttcttggtataagtgactattttttatttgagagatgtgatcatgtgggagtcagtactttttagaaaattggtttgaaggccctacctgtgccctgtgtttatatggcagtgctgtctgcttgttggtgtctttaccttctcagcggtatgtgtaatctgtacattcatgggattcatactcgctttaggagacattctgtagcaagatgagttatatggggccaagttacagcacagagttttaagagattgtccgtagttcagactgtcatcaaagtgactgcatgccctgtctctctgcctccatcctttctcaacgaatctccacctccagagagagcagatctttctgagtacaggtagcaataaatgcttctcactgagcctgtttcaccagcccaacattacccccttccctaatcctcagccctcaactgtcattgccaaggtgactgttgccacacaaagaaaatccaaacacaggttgcctgattcctcttagaaccttgaagcagaaatagctcagggtgctgccctaaagttagcctgggtgagattactctgcctgggtcctccccaccctgtccctaatcctctctctgctttctgaaagtttccattatactgccctgttgtctaaaattaagccaattagagagtcctgctattaataagcaacagttttcatgagcttatcagtcatgcacttcttgtgtggcttagatcagcaggactgtttggctgagcttggctactctaagggacacaagtttaggctgggagctgtgggggtaatttggaggtcttggtggaggccttagtgggatctgggaagaagcataggatgtctgggacatgggaggaggccatgtgcctcctcaattctgttcctgccgagttagaactgctgtacgccagcctaggatccttccatgttgttctcccattcaagtagacctttttgcaattttaacaatccgaataggtacacttagtgtataattgtcattatcttttgaataaaaaatgcatcaccaaacttggttttgcatttttcctcagaatggctctgccttcccgagaactctgctggcttgtgttattttaacatttccaaaaccccaaagcaacagcactggaaaatgactgtgagccattctgcaaaagggttttccaagcacccttaaagttagaaaagaaataactctgtgctacttgtgatttacaaaagagagtttcaaagagcaagtagggtatgagtggaattaaggctaacattttagatcttctgcagaagataacaaatgggtgaatgtatctagcatggaaacaatctccctcttcccttcaaatgtacctgggtttgaaagcctaaaggtaaaggattcctttttttttttttttttgagacagagtctcactatggcatgatcttggttcactgtaacatctgcctcctggactcaagccatcctcctacctcagcctcccaggtagctcggaccacagacatgtgccaccatgcccagcaaatttttgtatttttttttgtagagatgggtttcaccatgttgcccaggctggtctcagactcctgggctcaagggatccacccaccttggcctcccagagtgcgggatgataggcatgagccaccgcacctggccaaggattatttaaaatgaattgtggagtttctgagtatctttatgttcagttgtagctgtgcccccccaaactgcttttccttccctgccctactccttactgtctgtgccctggggaggtccggttaattcctattgccttcgagtaattaacaatctgtaattgtgccctctctcctccttgaaaacctcttggtttggatgagaacctatgctcaagttgatcaggtttttgggggtagatctgagagtgggtggtgcaaggaggatgagattaacctttgagaacccacttgtctaaacttcctgaagacttctgccattgagttccaggacaggttcaggcctgaatgtctgcttggatgtccttatcataccaagatacatcaggttccctgagaagggacagaaaggcccaggtattcaacttcttggcttcgtagccatttgactttttcttttctttagggctcttctggccctaacctttgcaccattccataggcaccccttctttctgccactcactcacagtcctcttgccttcacttccttctactagtgtctccaactagatttaccctgtcatcatcgttctgcttttgaaataggccatgacctttctttatacaacttattctacttcttgccagaagaaatgagacattcatgtctttctgacttctccattacctcctacaaaaggacatgaccccaggctttcaaaggatgcctttagatttatccctatgtccagagtcacatagacaggagggttctaactcagcaaaccaccggttcacttctgcttccgtttggctagaatttggtcagatagttctgtatcctggcttcctataagaagaaacaaagcaaaaagattaaaaaaacaaaaccaaacaaaaaaaacctggttcttgtctttattggttgactttctccaaatagtacacttaagaaatcaccaacatgtgtgcagttcagatgttaatacagacacacatctccacatttccaggctgatggggagctctgatcatcggacacacaccccaaagcatgtcattgccatattgaagttttattgaattaacggagtatgtgaagcatttgtatttcaaaactgagataggaaacttcacatatagagatttctaatttaacattgatgaagatgccaagttaaatagtcctttggaatgaaacaaatagttcccctggggctcagccagtgagcgcagccagcagcttggctctttgggtctttgcctgtgtcttactgatttcttttaccaaagctcagatggggagattggcaaggccactgaaatagtgactggcaactcggtttctttcctcctcaccctttgtgatttcaaccctttcctgctccgttctcctttgagaatgggtaatcagaggggaggaagatggccttggcatatcactggggaaggatttctgagcggccactacaaagccctcctgtgaccctgttagctgcaggaaatagattggagtgtcctctacctctctccctcaaactccctgggtcagctgccaacaaactccaacagtaaaagaaaaggcttgttcatgtccatcaacccaggggccttttattagaaaacatttattttaaaagaataatgctttttctccttttcttttcttttcttttcttttcttttcttttctttctttctttctttctttctttccttccttccttccttccttccttccttccttccttccttccttccttcttttcttttcttttcttttcttttcttttcttttctttctttctttcttctttcttttctttcttgacagagtcttgctctgttgcccaggctagagtgcagtggcatgatcttggctcactgcaacctccacctcccaggttcaagcgattctcctgcctcagcctcccttgtagctgggattacaggtgcctgccaccacgcctggctaatttttgtatttttagtagagatggggtttcaccatgttggccaggctggtctcgaactcctggccttgtgatccacccgcctcccaaagtgctgggagtacaggcgtgagtcaccatgcccggccttcttcttttatttttttttaaagtagaggttgcaaactgacagcctttggaaagaatacagcctacaaatacttttgtttggcttgcacagtatttgtttattgtttttacacacgaagaagttgcgagcatttaaaacactggcactttaaataaagttttaaatttttggcttcttttggaaaatggaaaggttgctcctctctgggtcagcattcctcttggtggcagttagctgcagctgggttgaagctgctcctttagccaggcttgtgggctccagtttgccacagtctccaccactccctattgttatgtagacaaggaagacaagtgtcacttgccacattaattttttttcttatgcctgttatatcacctgcctggatcctgttggtatttgggtttgagacccctaattaagctataattaaaagtcaatattatcttgctctgttccctcatcagttaaacagtcttaaaagttgtacctttttctgtcacttcagctcatgccttcctaaccaatctttcacctgtgcataggaccaggagagaataacctatttccccatgtaacatttattttcatgcctttcttgtgttgtgagatttcatattcctacttgcttggccttgtcaaatgtctgatataaggagcatttttattatggttgtaacataactttgtgtcctcagcttgcatttttaaaaacagcacctcattctgtgggcatcaatctatttatcttccccttgataggactccaggaatgggggactttgggccagttagctttgtctcacattgactggggccctgccttgctgctggaagttgggtatttcactctttgctaggcattctggtttagggggcagcatagccatccagcctctgagggatgtttctttttttttatgtttttattttttagtatacattaagttttagggtacatgtgcacaacgtgcaggtttgttacatatgtatacatgtgccatattgatgtgctgtacccattaactcgtcatttaacattaggtatatctcctaatgttatccctcccccctcccccaaccccacagcaggccctggtgtgtgatgttccccttcctgtgtccatgtgttctcattgttcaattcctctgagggatgtttctaaagccaatggggtggaggaaagcgagggcatccttgtgtgagagcagacactgaatgctttgttgcaactcaacttggttgcagatgggctcttacttcggctcctccttgtgcgcagttgacctgaatggggacggcctctctgacctgctggtgggggcccccatgttttctgagatcagggatgagggacaggtcactgtctacatcaacagaggaaatgtgagtacaatactgggcaatgtgcggatgggtgtgggggagggacatttgtccagccagcagtggccgagcacccctctgggccggcactgggggcaatgttacccagaggagatgaaaatatgtgatatctgtcttgaataagctcaatggcccattaatggaaagttatatacaatgttacaactgcagacacccaggggccaaggaagaatcttaataattgtcttttgagtgcttactatgtaccagggactcttcttcctgctttctgcgagagatttctatgcaatatacacatggtatcaagggtgcccatttttcaggtggaaaaactgaggcccagagaggttaggtaatgtgtcccaaaccacacagctaagaagtggggctgggatttgaacctaggcaagctggctttagagctggcatgctttgtctcaaggttatgccacctctctgggagcatatgcacattttcccagggaagcagaggaggacacaatggctggggaatcttgaagaaggagtaggagttagcagacaggcagggtgggctggagcagagctcccagtgcagagctgggcaagtgggttggggtgtgaggtggcatcaccactcatttcagcatgggggggcaggggactgcatgggaaccataatctttttgttcgtttgtttgttttgaggcaaagtatcactccatcacccaggctggagtgcagtgacgcagtcttggctcactgcaacctctgcctcctgggttcaaactcttctcctgcctcagcctccccagtaactgggattacaggcacttgccaccacacccggctaattttttgtgtgtttttagtagagatggggtttcaccatgttggccaggctggtctcaaactcctgatttcaagtgatctgccctacttggcctccctaggattacagacgtgagccaccacgcctggccaataatcttggtgtcccctattctgcagaaccatgaaagggacgtgacatggacagaaagatgcctctggccctctgtagctaatggagggtgggtgagtgggggctgggttgggggacagcagtgcatcgtggaagcaggagaccagtgagaaagcagtcttttcaggatctggaagtacaagtgttcaagtacaagtattcagcaagaacaacatggttcaatgaaaacattctggtgccgcctaccttttctctaacatgagaaaacgcttatggagataatcagtggaaaaatgggatgaaaactgcatgtacaaccagtcctcagaaatatgccaaatacatagaaaatgtgaataacagctctctggatagatgtttagttttatctttatccaaatagtgagaatataatttcatatttaaaaaaatcgaagtgtactgttaagcagtggctgagatgctaggtatcccagttgggagagggcagaggtttagctataactaagtgggcagatgccagaaaggaaggaagcagtgaaaggagagccagggattgttagagccttatgttgcgtctgaggttttcaggctcttcaggaagtcagatctaaaaccagggaggtttgggaggcccaggtgggaggatcacttgaagccaggagttcaagaccagcctggccaacatggtgaaaccctgtctctactaaaaacacacaaaaaaattagcctggtgtggtggtgcttgcctgtggtcccagctgaggctgaggtgggaggattgtttgagcccaggaggtggaggctgcagtgagccgtgatcatgccactgtactccagcctgggtgacagagtgagaccttgtcaatcagttagtcaacaagccaacaagcaaggtgcagtggtggttgcctaggaggctgaggcgagaggatcccttgagcaccggagtttgaggtggtagtgagctatgattgcaccactgcactccagcctgggctacacaatgagactctgtctctaaaaaaaataaaatatctgggagggaaggtgcttattggtacctgttgcaggaactcttggcacctgcatacccactgacattccaggaagtcagggcagggtgcagggagaaatgaaggggacattaaataaatgagtgctgtgggcattcagtggtgcctgccattgtatttgcaggagactgagacatttgtgtaggagtcaggtccaacagccagactgtgtgtctaaatcagaaggtggactcttgaagcacaagaactcccccaggcctccactgggcatgatgcacccacaccctcccctgccaaccagtgtttcttgatgttgtatggttattctaagtaccagagtattctcatttctgttgaacatcagccatttgaataaagatcggaaggcagtgtggagtagtggaaaaaattctgactttggagcaaggtggacctgagtttgaatcttggttttgccatgtcctagcctgtgtgatgtggacaaatggcttgaaattggtggcccaatttcctcatctgtaaagtgagaggcatcataagatcttccttatggagtcattgtgtgatttgaatgaggagctggctgtacagtacctggtacataggagcaatcagttgctggtgttcctctcctcttccccactacactgaaagaaagaaattaatgcatatttgtgttttggggtggaggtttcattcacccaagaaatcatctcaccttgactgttttcaaggtgtaaattgtgtttatagtgaaaaagaagacttggtcatgataaaagccagacactcgtgggatggcctgtaggatatagtgggcccagactgcctctgcactggggaatgcatacatcttctcatgtctcaggacatcagattgcattgtatcactctggtcttcatgtgtcagtgatttggggtgagagtaggtatgactttttcccccaagttagatgacttttcctgcctttgtacaccattaaccccctccctctgttggttagtattttctcaggaaattcatacctgagccatgcatgaataataggcacagtgacgtctgccatcacagccaccctctggccaagaacgactgggtgcttggattttctgaaccatgactccctctatcaagataactcatatatgcactttgcaaaacagttttataaacttgtaccaaaaggcacaggaaagaaaaaatagaaaaatgtatacccttttaaaacaacattggggaaaaagtgctatgccttaaggacgtggagagcacatgggggaaaggtgggtagggaggtttgcttgtgtgtagtgtattaggacaaggcagagagtgtagtcattggctaccatgacattctccttccctcaaaaatgcatctcaggctatgggagaccatcctgctaagcaggtaaaagggacgcattttgccagcaggagagagaagtttgggttcctgtaattctgcccaggtgtttcctgtcaatgagtgtgctctagcagggcagcattcaaactctggttttttattgatttttattgtttgttctgtttgtttttgttttgttttccattttctcctccatcctgtttcccagggagccctcgaggagcagctggctctgactggggatggtgcctacaatgcgcactttggagagagcattgccagcctggacgatctggacaatgatgggttcccaggtgagtgagtgctcctggtgcacggagcccctccaggtgcagcacgctgctctgtttcagaggggcagcctgctcgctgactgtccatctctagtggcatgctcctgggtctactgatccccttcgaaggcccatcaatgtgctgtggggagataggacacgtttagaggtgctctccctgtagacacgcagggctgagcttccagcccactggagttttgcctctgcataatcccttctcaccagctcagtgttctttgttgtttgcagtggaagcaaaccttggggctggtccatttgggacttcttatggcaagaagtttgaatagcttcatcctgccatcaactctccttgtttctgagcctttgatgctccatcatgctctaccatgttgatggggaaatgagtgaggagaaaattagaaacccagacatcttctgcctgattatagcagcagctagattgacttttgagagtgtacgcgtgtgtgtgtgtgtgtgtgtgtgtgtgtgtgtgtgtgtgtgtgtcttgggaggcatggaggcatatgtacctaatgtctaggtctgtttggacagcagtgttcctcacagcctcttggcctctctctctggcttgtttgagcctcttcacctcgctgcatacacagcatacagacgtcgggaggcagagcaaccatgtcaccagggcatgtggtggtggaggtggggcaacccttgcccaggccagccatccagacgtctttgatacctcctaccactggctacagtgggcttcattttcctcccccttggcctcacttctgcagacacatgactttgttagaagcaagggaaaaaagttaggaagatctaggttttgttctaggagttgccagtttgtgagagtaatgttatttcttgtgtgtgaagtgaatgcccttctgtatatttcctttatccaggaatggatttattatcaaataataataaggaatggtcctttatccaggacctcagactttctcagttacacaatagccattgtctatggaattctccctgatggaaattatggcacgtagtttatatttgcatttcttttattggatgggtcagtggtttttcttacgagcataaggtagaaacttttttggaactaaattcttctcagtcagcttctatagttttcactggactttttttttttttttttttttttttgagatggagtctcactctgtttcccaggctggagtccagtggcacaatctcagctcactgcaacctccgcttcccgggttcaagtgattctcttgcctcagcctccagagtagctgggacaacaggtgcgtgccaccacacccagctaatttttgtatttttagtagagctggggtttcactatgttggccaggctggtcttaaactcttgacctcaggcgacctgcccgccttggcctgccaaagtgctgggattacaggcgtgagccaccacactggcctacttttttttttttttttttcctgctgagggatcttgtccccaaattaatgcttgaacaatcaacaaccaataatttctggtatccagggactcagacatgacaaccagaattagggaagctgcacttgtattattaatgtggctttttaacccatagctgtttttttaccctcagatgtggccattggtgcacccaaggaggatgacttcgcaggggcggtctatatctatcatggtgatgccggtgggatagtccctcagtactcaatggtaattagtgtgagagtgatatggcaactgttcatacattcattcagcaaacatgtatggaaccttcattatgcaccatgccctggaggtacaaagaaaaacatttttcttgccttggccttcctacccttttgtgaaagatacaattaatattgcttattaaatactaaaaaaagcattcttagaatcccaagttcgctaacactcagggatgcattttgcctaaagaagataattttcaactcttactcagagttggagccatttatttaagaaaggaaaggaagctttctctttttggtgactactttgtcaaccgtctatgctaaggcaaaggaatatgttttaatatataatctagaagaaaaatggtccatggtggaggggcctgaaactgatcacagactgtcgtcccagctggcctcaaaaccaggagccagttaggactctgcgcttgcgccctatacttgggaacatggaagtggtgagttctgttttttgccgtatcagcttggtgttcaatcttgctgatggtgtcaagcccagcccatgggaaaaaaggaagtcatgctctcagcagaagcattgtcaggatatttgtggatgtctgcctgtggagtggcactggctctggtctttctcccagtgggtcagagacagaaggggacacacattgagaaatttccaatcaacaaatatttatttattgaacacttactacatgctgactacttcctactcatatgtatttgtattttaattttaagaggcagcaggtaaatgcaagtacaacttctacatgaataattgtccttggcagatagagataaactagttaagggtggagggttggttggttgtcattcgtgcctcagatcccctctctactggcctcctgctgagctcagtgcctcacctgcaggagacagggctttgggaggcgctgcgaagaggagggactgttttttgggtgcctactctgccctttctttacctttaatcctcgcagcagccatgtaagatgggtctgtttattatccaccatttatttatccacgaggcccaaggaggttatttaacttgcccaaggtcataagtggcagtatggccacagaatctttgccagtctgctgcctgaaacttgttatcgtaaccaccatcctcaactccacattgcaaaaaggaacgctcggaaactcagtaggaaaacttacgaatatggaaactattttgccatgaggcatacatagtctgaggggcatttatctatccagaccatcctcttttcattagaagtacataacaggagattaataaacttcggtgattcagcccacaaggcaggaggaagagagctttgggcacagtttgggggccacatctgagtcacaagagctgccctaggctgcggcagggatgctcttcccagggtgacaagctaaaagtcacccaaggagccccgtgctcgggcagcggtcagggtcattctccacgcatcctccgggaagcttgttttcctggacctcggaagctaatcacacagtgaggcaacctgtgagagaccccagcttcccctcctccggggccctcccagtgttttgtttggttgctgggtggaatccctgtagagaaccacagtataactcttgtggttagcgtggagcgtctttagtgggaagcagggatagcatctggaccagcctgcctttgtcagcacgcaggctggctcctttgctttgacaaagagaagtggttttgggctcttaaggaaaaaaaaagaaagaagcaactatgactgtacgttcccaagctgctaatatgcatatgataagggcagagatttaaaagaaaaaaaattctttaatggcagattcttgcaggcccaggtcctggacagagcaggcattgtgtgggtgaactagaggaaggaatcagaaacaactctgggcaatggaatcactttgctttggcccagatttgtattatttctgctgggtaaattgtgagatcagggcctacacttcttccacattgctctttaactctctctcgagtttaccacggagagtgtttattttaagatccttgtgtgcctttcccaatgtgagagccctctgggcatatggcggcccctatgatccttctcttgctggaggggacactgcatagaaacctggtcaagtggaggtttccagggctcctggttttcatttagggttattagcactgggcagacttatcttcttggcttttagcataatggcctgcagatgtctgtgggataacttaagcctgcatcaccaccccagatggaccaccccttcgctctgcccctcgtcccagccacagcataccttagaaatgtagatccaggggcaggctgctgctagagttcttggacttcagagccaagagggtctgcttcaaaacgtggcttttaagaaatgtgcagacacacgtacatgtttgtttagacagagccatgtgggatgtagggctttgcctgttagtgtgaaacatttcttcagtgtttcctacagtgttctgatttgtactttggtgcttggacatttcctgttggatggcttaacggaggatggcaagcagccttctctgatcacttctaggagggttatttgcagttatcagctgctgggggtcagggggcatctctcgtgcctccatctgtagatcctgtgaaaactcccccctccttgccttcgtgacttctctgcaggatgactcgggaaagagaaggataaggaaagaaagtcaaagtgagcccctagatagctgtaaacctggttctattgtactttgaaaacaaagcatttctcttgtcctccacagtgaggacatcaggaagtaagcctcccctgggggaccatgcagataaaggcagaaggagtaggtcagaccccagaagatgggacttttctgattcaagaagttcagtatctttgtgaggaactgcgccacacgaatgttgatgcgcagcttcagtgtgacaaaggctgtttgtacaataaatattgttgaatcagtgctgcctgtgtggatatgtgatgaacttaatgatgaataagaagtgagcacagccaggagtggtggctgtaatcccagttccttgggaggctgaggcaggaacatcgtttgaggcttggagtttgaaaccaccttgggcaacatggcgagaccccgtctgacaaaaaaagtaaaacagctgggtatattggagcatgcctatagtcccagctacttgggaggctaaggcgggaggatcacttaagcccaggagtttgaggctgcagtgtgctatgattgtgccattgcattctagcctgggcaacagagcaagactctatctcttaaaaaaaaaaaaagagaaagttttttgtttttaaaaaacatataaagtaagcatagatgctagtgtgtcccatggtgaagttgtgaactctggttggttgagggggctgttttctagaggggagggcagggcatcttcttcagctgagtgcttttgatttcctacagtttaagaagtgttcaggaccatggagttctagatttactgggtaaaactgttcactcctgtctgtgaagctccagaatctatagatcatctggttggctggatggagaggtagtttccacatggccatcttttccagctggacatgttaattacctgtctgtctagggaaagactctgtaatgtgtgcctcttaggagcagagtgttaaatatttagtacatatttgggaagaaagatacaagctaaatatgttcttagaatttcagccagctacacctgtgtaaaaacaaacagaacctgcattaggaatggaagttaaactttatccattttgaatttcaacatgtcaaaacattatcatggtagtctaggtggatttttttcattaacacagaacttagaaaaaattttaaatgatgacgtttggccaagacaagtaataataaaggagtgtgtggccttcaactgcctgctaaagacttgctgatcacattaggattactttttttttttctttcaacaactttaagaccaagtgtcctagggaagctggaataaagcagtcacagttcttatttgtgactgtggtcttttcctgtgactccatttccctattatctgtttcagaaactgtctgggcagaagataaatccagtgctccggatgtttggtcagtccatatcgggaggcattgatatggatggaaatggctatcctggtaagctgtttttctttaaaggcacatgagataaatgaagataaatgcatgaagtagaataattttcagtctggttagcaatcatcacatccatttaggattaggacaattcacacaatagaatagggtgttttgcctggtgttcaattttaaggtgaaaataatgttgatatttattttggggttttaaactgatctactctgaatggcttagcaccaggagggtggatttgtgtagtggtttctggggcggtaattctaatgaagaaaaaaagcactggccacatctaaaatggttgaatagtgaaacctcatgttttcctttgtatttaaccacattcaaaggcttcttactcttgagagggaaaaagagcagcacccccaccgccccctgcccctactcttgaaataaaatgatggagaaagatttggagttaaaagaaaaccaagtcctcttgcgtgtggacaaagcagaccttcaccattcaatgctggctggcttggctttagagttaattattgcctgtggtggttgtggctaactggataaagatacatgatttcaaacccaaccccaagtgatatctggcctaggtcaaattgcctgggtggtggagtagtggttcttcaggtgtttcaagatggagtggggtaaggtaaggaaacaacagtaagaatttgaaaaaatccagaatggtcatggaattcaggaaacatttctctaaattttatagtcatcttgcttttgagaaatatttctttccactaaaatttaagaaaactaacgcagtcttgtatgaggacaccacattgtgtatttttgtacagataggagttttggaaattcctcaagacaacagagccaggaggaagtaagggaatagaaagaagtcagtgttgaagcttttgtcccaagaaagacccttgtgggcctttttaagtttgagaaagcagttcttgttctggaaaatttgtggccatccccaaataataccttatatgggtttagcatttaatatgtacaaaatgcttccacatgcaatgtgcatctcgcagtgaccccagcaggtaagtaggatagggtgttttccccactttataaacaaggatgctgagactcattgtgaggggctgcccagagcctgcagtgcacggggatccatgcttcccagtggttcagctacttttctgtaaatgtgaggtgagcaaggtgttcacagttcacaatggatctgaatttctgatcttgtgtttttcataagggaaattgacaaattcatcaggttcttttatttttaaacatatagcaaatttaaagactattgaagaacaaaattgatacaacacccaagtggagaaattttaggaacactataattcatggatttgccatttgtttttccctaatgagggcatcatatagatgctcagtgcatttagtgatgtacagattcagaccctcttggactcagatacttggttctgtgaagtagtagtgggaaccccagggccagggatttatatggccgggttggggtggtagggagaaaggcatagaaccactggaagagtaagtacttcctaaattaaagttatttaggaataaacattaccagttaaaccagggtcttggtttatagcttaccaagtatttccatgaatttactgacttaaatatctgatttcatatatttaataaatatttactataaatctagtgggtacttaatgaatattatataatgactaataaatattttctgatttaaatgtaatgaaatattatcagcttttgaagaaggccctggggataattatcttcattttacagacagggataccatgagatactcaggtcacatagagtgaggggtggagggtgacaattccatgttcttcagaacctagagcattttccaagagtcactgaattctaggtatgtctttctctaattcactgatgtgaaaagaagtataagccatatgtgtaatctaaaatattcctgtaattacataaaatgataaaaaaggtgaagttaattttattaatttttttagcccaatatagccaacatattatcatttcaacatataatcaatatgaaagttattagtgaggtagttaatggttttctgtactaggtctttgaaatgtggtgtgtagtttacactcacagcacctctcgactgagactagccacatttcaaggccccagtagcctgcgtagggattggctgccacgtcagagagtgtggcttccattcttacaagatcattgtatagcccagacagtggtcgtctgagggctctccggcctcaaggctgggtctccatccttgtgagcgcattcccagggcgcggttgtgtatgggcttcagcaagtttctgaacgctgtaaacttctcattttcagatgtcactgttggagccttcatgtccgacagcgtggttcttctcaggtgagaggccccactcttgctccttgaattgtgctgttcagggtgagggatggagccattcaccattcatgggctctttcctctgtcctgttccttgtaggctggaggtgcttagtaagtggaaatgctaccttattttctcattctaattattctctatcccagagtttctagctgtggccttgaatggcttgcaggtatgagatgataacatcctgggagcttctaggtaggggttggggtagcctaactcttaagcctaaggtaggggttggggtagcctaactcttaagcctaactcttaagctatttgcttttggccaagaaccttccataatgtgccataaaaatattttataatttcctgcgggtgctgggaagcactgttcattctgtctcttcatctgtacaccctgcatttgtacctccagtcagtccacaacaccctggggaccgggagcctcctgcccgttagacagcacgtcattccctgttggctgcagaggtgagggacatgagctgaggcccagagcttgctgaggcccgtgcagtctgcatctctcctgcaaaggccagtgggccgccgccaccacccgtgaaccctctccaagtatttctagctgtatgagtcagaggaggcagaattacactttggagtgggagccaattcttaggttttgttaataacctgatggcagaactttctaaaatagactaataggatctcagagctggaagggatcccagaggccatgtagttccacaccccagatccttcttattcagcggtaccttctgctggtctccactgcagggctacacagcctcctgtttgagtgagatgccccatgagtgggagcccagttacttctaagggaaccagcttgccccgggtaacattaaatcttgaattattaaagaggcagaagagccttgaggttgaatgtgaactcaggggccaggtggccgggttccagccctgactctgcccttactaggtgagtttcctgggcaagtcccctgacctttctgtttcaggattctcctctgttggccaggacagcaatacagatgctccttgacttaggatggggttatttccagataaatccattctaagtcaaaacatggtagtttcaacttaggatgggtttatccagatgtagcctcatggtaagtcaaggagtgtgctgcattcctatggcttttgcaccgttgtgaagttgaaaaatcataagttaaaccattataagtcggggactatctgcagtacatgtaaaatgttcagaacagtgcctggtttaactgcttaataaatcttagcaagtttgatgtaaattgggttaaatttgcctccctaaaattctgcttctcagtcttgtgtcttttatgtagcaaccctttagtatctgaagggggcaattgtgtcccccaagtggtgacttcactaagataaggcctccctggttcctgtaattatttcccatgtgactggattttcactttctttatcagcgcttcctctggataaaacagcttttgtggctccaaatgattgaggttagatttgtgaatctggttgctctagttggtgctttcatgatgtcatctttgctctcttcattatcctgagcatcttactttggtttgtcaggattcttctcaaataaaacacactcctcaacttttacagttgaaaacaggcttttttttttcttcttttctttttttgagatggagtcttgctctgtcacccgggctggagtgcaatggtgtgatctcagctcaccacaacctccgcctcctgggttcaagtgattctcctgcctcagcctcctgagcagctgggatcacaggtgcacaccaccacacctggctaattttttaatatttttagtagagacaggtttcaccatgttgatcaggctggtctcgaactcctgacctcgtgatccgcccacctcagcctcccaaagtgctgggattacaggcgtgagccattgcgcctgacccaacaggccctcttaaaaccggggccatctggctgaaggtccatcatatagactctgctttctcatcattcttgtgttttttaatcttcctgctgtgagcttaatccaaagggtattttctttttctcttcttcatggtgagggacagccttctccaggagtttgctcacatatggatgtaaagtaaagcgaggcagttacacaatgggtgggagaccccagactccagcctaggatggagggttgaatctggtgagttggagctcaacagggacaaatgtaaagttcttcaagaagaactccagggagagcacatatcaagagaagagacctaggagaggagcctggggagccctgccctgaataagagcatggaaggcccaagaagagtggtcgggccatgacagctgtagagtagcatgcaaggatgttgtggtcacaataatccattatcttattcattcagctaaggtgcattgacctgttgagatgcagccatgcatcagatcctggggatttgatgggaaacctgacctagcctgtgaccttagattatagccagagagccatatgcaagtgaataataatgcaaccaatgtttggtaagctcctaccgcatgcctggcacagtgtgagcacttcatttgtgttcattctttgttattgttttctttctgtattaaggtagaatttgcatgcaataaaatgcaccaatttgagagtatgactccatgagttttgaccactgcatacgctgtgtgactaccaccccaccacaataaagaatacttctgtcaccccagatagtttccttgtgcctctgtctggtcatacccctctcctgatagacaaccactgttctgacttctatcaccatagatccatcttgcccattctagaatttcacattggtgggaatatacagtatggactcttttgtttctggcctcttttaatcagtgtgatgcatttgagattcgttcatgttggtgtgttgcttgtttttccccttactgagtagcactccattgactgaatatccttgagtttgttcatccatcctcttgttgacagaacacatgacaactcttagtcttcttaacaatccatgacataagtggggctgttatccccattttatgggtgaggagaccaaggacatgcagatcttattaatataaaagggaaggtgattccagatggtggtaggtgctgtgaggattctaaggcagggttacttggtcaggcagtggtgtcaaagtcagcaggaagggccaagcagagtgaggcctgagacttgttggaggtggcagggggaggtcaggggtgcccttggctgtggtggctctagagaagtgatggggcaaaagccagatggcagtgggtgggtgagagaagaaacaagaaggacagtgactcttgactgcttctccagaagcttggctgcaaaggagcaaatgggaccagcaggtagttcagggaggtgttttaaggacgggaagctctagatcagtgattaggccaagaacgtctttgagccattttctggtctcccaagtcccttaccctcttggaagagatcagaggtggtcaccctcagcttcgccctcatctatgtgaaccctgatgccctaaccctgtgcctacacccaagggtcctggagaggttgaagagacaagagggaggatgggaggctgctccagggatgagggatggggggatgaggttggtgagagtgatggaatctggtacatgggctgggggcgaggggccctcatcttctgagccaggccccaagataggaataaggtcagagcaaggttcagttccggtacatgggctgggggcgaggggctctcatcttctgagccaggccccaagataggaataaggtcagggcgaggttcagtttgggatgtggatgaggatgaagcagagggtgaccaccctggtctattccaggaggacaagggaatcagggagagcagggaaggcttcaaagacaggctggagcccctaagagaggaagcaaggtggggcaggcaaaggggttgctgagcatgtctgaggggccagcaggctggatgtctgcaggggcagccgttgataaagtcccaggattcagctgagcagcagtgaaggcctggaggcatcagctggctatgttaagtaggggcttggctcagcctggcctaactgatgttagattttgagttactttaggttttgggtgggactagaaaagcagggagagctaggagaccacgcatgtgcaagcacacatagatatatattgcccatcgttcctaaccctcctaagggcaggaggccagaggtatgtgggttaggaatgctatgggctgcagctaagagaaaacctggctgaggctttcaactatatgacctcaaattagctccctggaggtaggtggccccagggctggcttagtaacctaacaatggcaccagtggcaccaggggtgaaggctctttatctgtccttgccttgcagaaggccaaggcaccttgagcaacatgtcaaagggcatcccaactggttgtattatttaccttgaagtgaagtgtcaggatttgaactgtcagccctcagggagaagtgttccagctaccaggtttttttttttttttttttttgagacggagtctcccgctgtcaccaaggctggagtgcagtggcgcgatcttggctcactgcaagctctgcctcccgggttcacgtcattcttctgcctcagcctcccaagtagctgggactacaggtgcccgccaccacacccagctaattttttgtatttttagtagagacagggtttcaccgtgttagccagtatggtctcgatctcctgaccttgtgatccacccacctcagcctcccaaagtgctgagattacaggcgtgagccaccgcgcccggccgctaccagcttcttaagaaaaaaaaagcactgaaagcacttgtgatgctgtccttgggtgctcctttgcttttatctcagaggctggcaatttgtaggcaggactgtgagacgcagtctcccctgcccccaggagtgtggctggcccactctgccctcaggaagtttgcttccctcagattagctccggggcaggtcctgtgtcagggtgataggcacacggtgctctcccattgaaggtcacaggaagcgatcagagaggcctctgaaagatttctgggcttttcttcatccaaaaacaatacttggagttgaaacaaaaaggttgaagggaactgatccgacagctgtgggaaggagatgtacctgtgaaggtccctgtggtccatttcaaaggatactgtttttccaacttccactgaggtcactgtgtctgggctgcccacgtctgtttcctgcctgccgcactgtcttctgcagagctcttttgtgagaggaggattcggcctcctccctgacgaggtggcccctggggatgatggggcgggctaggcttttcttctgtaccatgaccaggcgcgtcagggaccaggcaaggtggagaccagctcttcatggtacttctgtccatctgtgaggctttggacactcgtggttttcagtctcctaggctggagtaaaatttgtatttatttaacaagggtgtttgcacatttattatgggaacgagaggatgaattcaccggatcccagcccttgcagggtgctgcaggatggtggggcaggtttggaaatagacaatgactgttcaccttagtaagtgggggccagaggtgtgtgtacagagctggaagcacagagagggaggatgcctgtcaggggtactagagaaggcttcctcagggtgggaacatttgagctggctgttgaaaggtcgacggggttttatagggtgtccattggcatctgcacaatcacactggccaggggtaagagatccactttccgatttatttctagtatcctataaggatgaacccagaagaaaatggaaagactaaggtgttggccttctttcaggcactgctattgtctgacttccgtttgtcctgtggccagatttgctctggaagtcccgcagttccactgcatctgttatcactactctctgttgaccccatctcccagcatggtggcagcagtggagtcccctcaccctatctgtgcctcgtgtctcttcacttcctttgttcacccagattttccttaacgctttcttccattggagttggtgtgggtcatcattcccatccgccctatcaccctgggctctctttgagggatcattgtacacaggggcatcattgttctcaagctactaatgccccttaatcttgttatgtcaccccagtggtgtgaaggccagggctccttagaggtaaaagggtctctttgtgaggcctggaggggagaaggttgagcagtagcttaggtgaatgctgcctgagcagatgtctgcagtgggagcagaatggtgtgatttactctttgtttttgtgggatgtccttggggagcccaaggactgtccattcatcaagcactgggagatggtccatggcagggaggagagtatggctttttattgagtttcatttggtcataagactgggcaggttgatttcttctgccctgaagcactttgctattaccagctgggactccacttatcaagttcttttaggaaattacccaatgaattggtggaggtaaatgatgcaggaggtttgaccaactggatggggctacaacattgcagttcatgctcataatggcagcaaatgcttgagggaatccctgagtatgcatctatttcttgaatcatggcatctgctataggaaatcctcttaaatgtattcttatctccctaataaaatggaaattggtacttaattggtaaaattttaaataattacccagcatctggtggttcatttatggcttcaaccagatgcgttttattaacaacaaacttgcttttattattgggacgctaactattaatttactaggcaatatgccccttctaaaaccagaaaaaaatgctcacagaacatactagcccttctctcttgggatatttcatgctttaattaaatgctgggttgaaggcctaggatttatcctgttggtctagttcttgtttggttctgagagctgctccttaccacgactaagtcaccttcctctcttgccctgcagagcaaggcctgtcattacggtggatgtctccatcttcctcccgggctccatcaacatcacagcgcctcagtgtcacgacggacagcagcctgtgaactgcctgaacgtcaccacctgcttcagcttccatggcaaacacgttccaggagagattggtaatgagccaccaagtcagggctcaggatacccgtttagctggagtgggctagtgggatatttccgatgttccctgtcgctgttcctcccagctggttttgcaggcagcaggcacacaggctggacatcctttccctctgaggttcctccccttctatttcctgcttatcaacatgtttctaatgtcacacaacctccagctctaggacaaataatgttggaccccaagcattctttttgcaaatatgagggctagactgaagcctcattggaccacaggtcctatgggactggtggagatatagtgcctggagcctggcccttagggaacattcgagcagttagaaagcagaagtgacaggactttggaggctccttattgagcttgtagcatcagccagatgtcaggggacttataccatttactatggaattggagaccaaagatggatggtgggattcggatgctggtgttacagaggcttaggtttctaaaagaggggtgctgctttggcagctcagaattgaaaagaggcaggcattgtcctgacagctggtaactgtccctgccatttgtctggctggggaaaatcaacttgctagcccagctctagagactggattaaaccccagaacaagatagaaccagtgttgattggaattcagagcacgtgatcacctgaaggaaatgaatctggagctttatgcatattactaggtgcttcatttttatttaaaaggctgatttaataatagaaagaaaaactccaggcaaacaaaaacactaacggacctgaacctactgacgttcttagatatttttaatgtcatgagtgactccttttgctactcacagtgtagcccctggcctagcattgtcagcatcactgggaacttgttagaaatgcaggactttgggctccgctttggacttctgaatcagaatctgcattttcacaagagccccacaagattcctgtgcacatttaagtttgagaagcactgctctggagcacacatgtgtgcacacacgcccactcatgcagaaatatttacgtgagctagttcattcctcagccacacctcaaatgttctaccttatttaatatgttcatccttcttggctgtctcattggcaatttctcttgatcttcaggtatattgaataagctcaacgattaaacatatttattttatcattttttaaaaagagcttagaaatttcaacattgaatgaaaccataccataaaacttgggaactggttagtgagggaggattaacaacattttcttgtgcagctcaatgagaaagagcagctcactcaagatcacacagatattgttgaagccaggagttgaatttggatcttatgatacttagttttgctttctaacaactatttctcaccacctccataattgtttaagatactacagtcttaaggaaaaaagctttctgatagttctgggactcgtgtgtcctccacataattaagcagtctgtcttctgtccagtgccagctcatcacgtagttggactctgttaaaaaacatttttaaagaatgaagattaattttgatacacataagaatgagaactattctagaactctcaaaaagggcaaacgagtaatagtgtctgtgtatgttcatttgacacatgcttattatgtatccacatgtgccaggcactggagatatagtcctgccctcatggagcttctaaagggagttacaaagagtttctactattttggccttgaagcagtgttagacaacgttcacttatcgctgttgtgaaagtgaaggtaaattggcatagctgaagcagagaagaagaaaccaagatgcaagttagagcaagagtgattcagagcatgagacaagtggtagagcaaactctgatttgaaggttcatgagctgagcgcagaggagatgtgggtgcctcctcatgctgttcccgaccagtggctctttctggggccccatctagcatgagcctttcacagactgctaagcacaattagaatgaaggtctaggcttagccatagccccagaagtgttggggtaaagtggaagaggccggcagttggatggcatcttgtactgtaccttgtgggcaatgcgaagcaacctggcttatatctgacattaggtggggcccattcagcaccagtgtaccctcccattaatttctcttccctatcctccatctgccacatgggttcatagataaagtcaaacatccctttatactctaagggtgtgtttccccgataatcaggcttaaaggggatggtaactggagaattttgatatctcagtataataaggcaatgcagaaaattattcatccccagcatgtttctgtcactttctctggcattcatatctcaatctttgcagtagaaagagaaatgtagaaatctgccagaaaatgtgctggcagtgaaatggagagtttggggagggaaaaatgggcaggccttatggaaatgtgataggaaatgaggtggaggtgaaaggtcaggtaactgtgggggcccagctctgggtgaggtgtcctagaattcagcaaggaaggcagcctcttggctctgcacagttgggaaggtcagtcttcagatggaggaaagatgggcacttccaggacacagataccctccactcccatccaagctcagcagagggtgctggccaactctgtcatttccaggcctccgcctcaggaacccacagctgagacactgggttaccagccttcctactctttgtgctggcagctgcagaggaaccatgtggatgatgactttgtccatggaatgcctggtgaatgagtgccagccctgggcaggccttccaggcacctctcaatgtctgcatatcttgggctgagtttgttattaagacggctgcatttgggcagagcaatacacagatacctgtggtgggctaggtactgctgtcagaagtggtatcttctgtggtatttatctgctgctgtcttcagctacatgacctgctctctgaggatggttttgagagccataagcagctgatgttagtcttgtgcctttggtttcttcttctctacctggcagggttcaagcctatgtacagagaagggacaccaactgcctctttatttcctgctttagaaatgggagaccacagtgcctacttggtcatgggagtgttcaggaccagctcattagcgggacacaagctgctgtagcctctgtaaatactgtaggaaatacagactttctctgtaggaggtgaatctgccttggcctctgaaacaggcagagtccagtcaggaaaacaaaaaccataccagttattttaacagaggaaatttagcactgggaatgggttaaacaggtcatggacgacctgggagtaactgcaggaagcagctgccgcctccaggtctgcaccagtggatctcaaagtgtggtcccagaccagctgcattagcatcacctgggatctcattagatatgcaaattctgactagaaactctgaaggtgggacccacatctgtgtttttacaagcctccagatgggttcaatttgagaaccactgttcaaggttatacttcgggttaaccacttccttggggttatcagaacctatgagcttggagaaggggccctgcggagctaggacctgaacctctgaggaggaggctggtgctgctgatctctctgagggagtgcaatgaggctggctctgggagaatggggggaaaattgaaaactacaattaactgctgttggggccagctgccgtgagaaactgttgctgggataagctgctaggaataggaagcagggaggaaggagcgagttcctttgccctctccagccttgcaggctccctctgatgctccatattagcagagccgcacagcgagcctctggcaaaacaagtgaggtttgcagggtcccagctccagtgtcacagtgcagggtagagaagggtgggttggagctgaggacaacagcttcataaaccagcacagcaagcatccagttacattgagttgctgaatccctgttgggtcattcaatcaaacaataataattaaggtcctacagagtgccagacaccctgcttatcctggggcacggagcagtgagcaggacaggcaaagtccttgccctcatggagctggcattctagtgggaggggggcaggcagacgggacaaaaacaaccagctgctctcttgctggcttttctagatgagctccgggccccttgtgtggcatgcactgtgcttagcactgggacacagacagacacagacttctcactccgactgtgggctcctccaggagcaggtttacaacgtatttcataaagcactttaaaataggagttcttcctgtccctaatagtattattcatcacttcattcttggcctgggaacagcctgtggccccttggagcctcctggctagcataggtgaaggtggtgaatgctttgcccaaggggaccctgcccctcacccatggacggtgcttgtacctactcactggccaggctgaagcctaaacttgcttgtcaatctctggaggctgggaatcaagctggcagttctgggctttcaccagagtgtgaaacgaaaaccaggaaggggcgctctctgagtgattgcattttgcactcagacccagtgctcctgtgtttccatggttagcctgaaactcgggaaggagaatttgttagaatttcacagctgaaatcttgttctgacagagagcaggaattaatcaaaacttgctgggagagaccagagctagagttgatgagagacagctggctccctcctggcccaggcccgtgcaggggggctcctcgggaagcagccgggggcagggcagggaggtggctgaaagtattactcggggctgatcagcttttccatcaccatgacatcattcgacatggcagggacacaagctgccagaaggaaaaacctaaagatgtgaaatgtgctgttggagcaggccctaatcagaactagcagcctcccagggacagacaggggctggccaggctggcttacctcatggccggctgtgggcaacttggacagcctgatccacccaccttcccagggccctgaccgcggagcccgggcagctgatcggctgcttcccagacatgtcctctgcttccctttccaccagaccctttaccagtgggtgctggtaaaactgccagttccgctcagggctttggaatgagtggtcagcatttcttcttgcctcctcaggcagggtctctcgttgtgactcttgctttcttctagaggagacagtctgatgtagaagtaatttcctttggggtaatttaaaatgtcaaaatttaaatcaaggaaaagtactaattaggcagttctagagatgaaatgcttccagaatgattgcacttggtgaattggataatgcggtatgtctgtgattgtatgttttaacattttagagaaatctgaaagtttaatgtgctggcatgcacacaccccgctggagaggagcagcagttgccttgtcctcagctcagtttctgtgaactgtgggttgtttctctcttccttgagttgcaagagatcagtacttccggatcagtacttctgcagtgagatgaaactttggaggagtaaagttggtgtttgtaaattatctagcacagtgcttggcacacgttgcaggttgaatttatttgcttttccttacttaccctgtgttaatatgggttctccccaaaacagagcctgggtcaaggatctgagtgcatgtggttgatacacaaatgatcccaagaggtaccagtaaggaaatgggacagtgagacaggaaaggaaggcagttgcaggcctcaggcttctccagagaaacagaatggagagagaaagaaatggattagttggttgattttcaggaattgggttgtgagattatgaggtctgggaagtctgaattcttgggggcaggccagtaggctggagactcagggaagagttgatgttgcagctcaagtctgaaagcagtctaaaagcagtttatttttttgggaaccttagtctttttctcttaaaaccttcaacagatgaggcttgcccacattttggagggtaatctgctttattcaaagtctactgatttaaatgttaatctaatataaaaaaataccttctcagtgacatctagattggtgcttgaccagattctgggtactgtggcccagccaagttgacacataaaattagccatcagagcagccaaatagagggtgtcttattgagcaggttaccactgtgggcagctggagctcagtcctgctggggaaccctggcagtcagtgtagaccgtgccccagaattaccccacatcaaggggcaagggagctggggccctgcattatggagggctgctctggggacttgagttccctggcactcctggcttgccaggcacatggacagagccactagagaaagccctcaggagaagagatgcaggtactggcagttgcaatttgggccggacagcagagaaatggtaaaagccaagaggatatgggtgggggagcaataccatcagttccatcttcctgtgttcctttccacccaggttttctctgagctcagctagttcatctctggtaagatagtccagtctcgctgttctctccattgtctcccttcctgagggaaggcagccattcacctgggaaggaggctggtcaggggaccccgaggagagtctgctcagcagctgcctccaccacattggttcacccaactgtggcctctggcttgtcttccagcaatgtgtatctgtagccatgactttgcttaagcgaacttggaaattcacttcatttaaatgtaatctttcttacttcagggcagttgttcagggaagttgtgatcagtagaaagtaaattggctagagttcagttgtagatctctgcacttgtttggacctgctatccatgcattcaaaaaaatgggaggttttggtcaagtaatgtacaacatgcagcaagaacaagtgtggtgggaatagcctggcaccagagattaagggagtcctagattcagctgtttgatgggtggccctctggcctggagcaagtcttgttcccttttggggcctcagttccctcatcttaaaaaatgaaggtttttgagcttagtggtctccaggattgcctcaaagctttgccagtctgaatctacccttttcttgctattgtccccattggaattggtgtgtgacacttgcacaggtgccagtgttttctgtgtgggagcactttcctgtatgcattattttcttcttaataatggcacctcctgagagtatccaggtctcagatcccttctggtgacacagccttgccttgtaagtcaactgtttgctggcgttaaacaagttggggcagatggctctgctgactaggaatttgccagctcggcatggcaagatccctgagatggcagaggcccagggaggccattagaagcatcaaaaatacgccctgtggcaggtgcagaatgcccattcaggtcaccttcctctctgcctgttcatacctcccctggtggctgatcccattgatgtcattaaaagccggagccttccctaatgcctgacttcacttacttaaatgccagtgggctcggggctacttgttactgatgcaaagcccccagattctaagaggcaggtgtgtggagacagggcagggctgggtcatctgccttctgttgcttagccatcttgccttgtcattccagggacagagattcctgttctctcactttaaaaataacatatttccttgaatccccaaaacagttaaaaaataaaaagggttacggaggggatgacctctggcacagaaaagcagtaaaataggtgtattgacactgaagtcatatttctataatgaaatacatacctatctatttacttattgactctgaaataacagaggtagatccttccaggtttatctagcctgcatttgatactgtgatcatcttttttttccttctttctttcttcttttttttaaattcaagactgtgttacaaaagttctgccatctggcatacacattcaggtatgggggtgagttattctttgcaggagaggacctcagtacaggccctaccgtggtcatagttttgttgaaaggataggcactacaaaatgtttgatcaccacactcggctacctgggaataaaggcaactccagccttcatctgggttcctgtgcatgtaaactacctgaaggcaggagtttatgcctgcgttgttcattgatacatcccctctacctttagcggtgcctggcctatagttagtgctcagtaaacgatggcgggcacatggtctggtccatgtactgattatagagcacgactcaactttgttgagatgagttaaaattatcagacgagatggttcccttgtgttgggcataaaccatgtgctttatagaagtcagtattacacaaagccttgataatttcagcagcttctggtaatgttctgtaggtttgtcatgatgttttgcttgtcaggacactaacctgtgttgggtacaccttgttaatgggcatattgctggctcagttgatacctcatgatggcatgaggtttaaatcagggagagccgtgaagtatgacacaaggagagtcattagaaaggcagaggacatcatgcttctctctcgattctttgagcaccctggctgtgtgctgctttctgagcaagtctctgcttggggctgcagtctcctgccatggaagggtaggtatcatatgagatgtgcatgtgatcctgtgacaaggaaaagaggtggcctcatcacagtgtgtcggtcctttctgacattttgacctctcatttattggcaggcctgaattatgttctgatggctgacgtggccaaaaaggagaagggccagatgcccagggtctactttgtgctgctgggagagaccatgggtcaggtcacagagaagctgcagctgacttacatggaggagacgtgtcgtcactatgtggcccatgtgaaggtcagtcctctcctcctttttatcctcaaactttgatctctgcagatgttcacttggagctggtggaaactatttttattatgtattatgtgtgctcttccaaaattttatttcacagggaggagcatatccatttcttcttttcttttaaagttggcctctgacagcccttttatttatcttactgtgttgatttcagcctttaaggggggtcgtggtggtctaggagaccagtgatggtccctggctttgacttgttcttttgagaggtttctcatcctctcccctctatgaggcttggtagccttttcagaggagagccttggaagcatgtgcctctgggtctgcagtgatgctggatcacactgcacctgatgcctttctcagtggtctactacaaattagctcatggtcacagttaaggcattttaaaactggttggactagattcttcccccttgactactttctatttattttaggatgcattttttggcaacctttcccctcgcactctaaataaacttgcaaatgtttttctcctcttgaaattgtttgttaaatacactttgctgctaattcaggaggccaggctttgattagctacagagtggcccttgcagcaggcgctggcagggtggaagacctggcagtgcctgatgctgcaggaatggccagacactgacccatgggcagggtcagagagcggaggaggtggaagaatgcacttaatccaggccacatggtgggtggaatgagcatgggttttggagacacatagatccagtgtgtatccagctggacacataattgtgacctctccctgtctcagtctctgcatctctaaaatggacacagtagtccttaccttgaaaggtggtcatcaggattaaacattacacaatgaatttacttaaaggaccttgaatggtgtctgataaatagaaagcaaccaaattattattatttggttgggctgtatataattgccaatattctttttgacttacaaaaatggaaatttcatatagctcaacccaatattgtttattagccactggatttctgactgatagtttgaaaagtctgcagattagagatgaagtgtcctcctgttagtgccagagcagaagaataacagctgcttctagatgcttcagggctgtgtatagagagatgccccacacacccatggcccagagcccatgagtccatgcccctcagatgcttctcagtggggctgggctgtgtcttctgccaggactcctgcaggggcctgcccagaccagctgcctgagggcttgggatgctggccatttataaagctgctcctgtgcctgttaagccatacagccccgccccgtcagtcttagattacattggcttgttggtgcctttggtggggtgtgaggctgcgcagtacaggctcgtatgcaaacactgtcaggcctttgaatgcctgtgattggtgtttttatacctgctggggacagggcatcttctctcgggcctcttcttgctaggtctgttcacaaaacctttcctttaggtttctttgcagcttcttgctttggctgagaagttatcctttgttcctagttaccaagggtactggctatgagatgccacgtagagtggcaatagtgaagtgcaggccagaggcagggctgtttctatggtggccctgagggttactgggaaggatcagggttgcgcaaggggttggtcctgctactttctgatatctagggttgccagacttagcaaataaaactatagaactcctaattaaatctgaatttcagatcaccaatgaataattttttagtatgagtgtgtcccaaatattgcatgggatatacttatactaaaaacattttgctgtttatctgaaatttaaatttaacttggcatcctgttggcagattcaactctgctgatcttcctctacccaacaagtggcatttcttcactcaagcaaaacctggctgccaagaagagagattgagatgatggttagaagagtttggaggctgagctcagggctctcgagtgcagatccagcacagaccttgacgtgattattttggtcattctagggagagcaaaagagcaggcctgcttcagtgaattgggacctagagtcatttggatacagtggttgcttggccattttctcatgcaaggaggtgggagcggagaaatacaccagatagacacatgtctctgagacctttatggttcaagaggcaacattgttgccaaggtacactcaaggtggctgatactttatagccatactttataaccatgagaatgtttatttctggcagttactgtctgggctgtagcagaggactgggcaaatggcagagtgcacccgtaggatgagtgctaatggcctagctagctgtccacagaggaggcagcaggcaccgccccggcttactggctgtgggaacacagctatggaagctgaggcaggaagcaaggatgaggggaaggggagtggcagccgggccacctcctggagcaggaactggggcctggggggtgttggtcaggggtcaagagcaggatgcagtctctactgcaagtggagctttctcagtggagctggctctcggctttatggacaaatcaaagaagataaataaaagcattctggcttatcacacaccatatggctagcagacagtggggccagcatgaggggctgggcctgctttgtttaggctatctttaggtatttttttctttttttctttaagcctattccaatctttttttttctccctctccttttccctggaagttttcttgccatatatggtgataagtgactttatcatggaagaccgcacaggctaacacctgttttccaggctaactgtcttgtaccagactttgttccattcaccgtattggagggcacctccggagggtataggattttgtgataaggcacatcctcctgaggggagggcaggtactttctcacggcctcactgtggtcagcagagctgaggcagctccagccacttccttggcttctctgcctcagagttcacacaccccggcttatcttccctcttccccgagaccagcccagttttggggatggggcccctcccactagccagtcaggctggaggcctctggtggatctcacagtcacaggcgaaagcccaacacctcccctcagcatcgggctctccatgccctgcctgaccttacctttctagacccatcttctgccaccacatcccctgggccccagctcttgtcatgacctgcccctttcctcctggaacctgctccttacacttctttgccttggttcttatgctcacagaagtcagaggcctggtttgtgtcatattcatgtagaaccatctaccacctgcatgatttttacatttttttggtcttaaactcatactgcctgtgatattttctttcatatttttctctttaaatcagccaacttttggtctcaaataaaataatttaaaacagaaactttgtacctttctataagcagaaaaccatctaacatgtccccaaaacagaaagtaactgtaaaaataaatatattgaagacacaacagtgtcctagaattctagctggatttcattgtttgtcaaagttgctgataaagcgcccactccattcatgtgttagaaagggaaatgatcaagttctagggaaggcttaaagacatactagcaccgcgctggaactttcttcctgatgcaaccagaaggactgcaggggaattgactgggaacaacttttcaaatatgagagttgttttacagagtcatgcctatgtgccatggaaatccaccttgtgggcccagtctgggaagccctggccatgctctgctttgatcagatgtgccttgccccatcctgcctgctgaaggcttgctgttgttcaaggctcagtccacaggttttggacatcctcagtggcagctactgtcctaggccctggggatgccactgtcatcttcctgacttcttggagcttgttccatgctgcctgactcctgctttggggatacttgtcaggcagaaccttgttggagtgactaattgggttagctggagtgtggggtcacaaaggcttctgatatggagtggggcctgcttgcctctgtctggactgactgctgggaagtgatggcttgagatgatggagaagagaatttgggatgcatggtgtgtgccaaagaataaatgcaggtgtcctgttgttactccatctgtttctggtttatgtgttcttacctggatgacagctgtgctcatcctctaatcctgtacaataccttgagagcacaggccttttgtgagatcaaatgcctatgcatgacaggcaaataagcaggctcttcaggaccagggaaacgatggcaacagttctgagtctgatgcagggatggcagagaagcccaggcagagtgcaggggcagtgatgtcattccctattgtgaggatcagtgacaccctctagaggcatttagggaactttttttgaacagaaccatgtgtcagacactgtcaagaaggccaataacggtattattgttaaaaacaaaacaaaacaatctacactagacgagggaatatgcacatcagcttttctgagaagctgcagatgttcataagattgttcttctatgttcctgaaggatttttcaaggaactttgaaacctaagtggctgcagctccttccttgcttttgtgggcagatgctcatcctggcctggcgaagggtgggacatcaccctggccaccaggtctcctgagagatcataccctgggatctgcccaggtgttttggcctgtttccattttcatatccaacaaaatgcgttgggaccatggcttcaatcacattacatgctgtgagtttagagtgttggatgctggttttcagaggtgatcaaacctttttttttttcttgtttaagaaacagatagttaagaaagggagattaagttggagttaataagaactctgagaaagaggagaaagaaaaacagcaaaagtttcttctttatctggaaaataacatgctaaatctccgggtcatcttgagaaatcaaagaaatagctaagaaaaaaacagttgcagggtttggcaaaaggggacaccaaccttagatatgaggtcttctgaaaacttttaaaatttgtttattttttgaatcagtagtgtgtatagttaaaatttttaaatggttataaaagttgtcaaagaaaggatgtctttcagctatcctatttttctcccaaaggcaaccacagttccattttcttaacgtgtctttcaaaagcttgtcaataaatatagaaatctgtgtgtgtacctccttttattttatgcaaatagtagtatactgtgtgcacactgtagtaaacttacttttcttttaaaacatccaacagcagaatggaggaacagattttggcaaatcgcacaaaatctagctgtaccagatgaaatacaactcagcaataacaatattatgttattatgatacacacaataacatgaatgacttttgaaagcattaaactgagtaaatgaagccagacacaaaaggctacctactggatgattcatttatatgacgttctggaaaaggccaactaaggagaaagcagattggtggttttcagcggccagggtttgggggaagggctgatgatgattgacttcaaagagggatgagacaactttctggggcgatgaacatattctaagatcgtggttgtagcggttgtatggttgcatttattaaaacttaacagagtgcacacctaaaattagtgaatgttatgtatgtaaattatatctcagtcaaacttattttgttaaaaaaagtttcgtggagattattccatattggtgcatatagagctttcctgttctttttcagtagttctttttcactattccttgatttatttaacctgtccaggtggtcttctatatgtcagttccagactaacctgatctgatgcttgtagactagttatcttagtttgcttctccagaagaggctcctcttctctcccctagatccatagtatcctggctgaggacccctgagagggcagcatggaggggccctggtgctctctaaggtgaccttggacatatgtcctacagaggacaagcctctcagctatagggtgcccaaggaaaatgggagatttttcttgattcctgcagttggctttgtgcccttggcaggctctcctggtctgtaggtagcatagatggcctgaatgtttggtaaggggtgctggaaactagggcaagaaaagaggggaaggttgggatgcatagaactgatgtgtgggaaactaccttcatcatccagctcaggtgtgaagccgctgctcatgcgatatgctctgctcacacagatggcactaaggaaccgggaagctgggctttggagaccacgctggaagtcagctcactgagtgtgggttgccttgaccatctcctctgggaggccatgttgtgcatagctggagaacaaactggggatgaatcaagaagggaaagggtgtggtgaatgttcagcatgggagctgatatctccgatgagcactgtttggccattgatttatttcttgggtgcaatgaagggctcttaatcttctgcatttggacacttgccacagaggacattgtgattagcaaaggaaggcacaaaaattctaatccaaaggctttgcccgccttaagtccttttttgaaatggagctgatttaaatatgtaagtatggtcacagcattgacacttcagtggttatcgtaagcttatttgtacagtatgtgagatgcagtttgtagcaattgctatgggtaaaatttttattttaagaggtgactttctatttacagttattcatttacactgggttcatctattaatatatactgttgatgcccttttaacactggtattctttgaagtcacacatgataatgtgttctgttttattggttttgtctttatatttgagatgtgattataaagatcccttctgcctcaaaccttgaacttagatattcattataagcatgattcccttcaaagtaatcaccttctagtcattcctgttttgaaatttcttccatggtttgtttattcacttttatcatggtccatttttactctaggagttaattcaaattttggaagcagcaagatttctctgcaatcctctctagtagataatagtgtgtttggggaaaagtgaggtataataatacaggaattagtattaaggaatgtagtaattaaactccttttgaaaatgattttaaaagaattcccatgatattcaggtaatagcgataaaagcagctaacactaatcgagcatttagtatgtgctggttactgtgagtcactacatgtgagatagttactgtttttatcctcatcttactgtttcaaagacaaggcatagaggagtgaagggacttgctcacaaccttacagttgacaagtagcagaggtaggatttaaacccgcaagtctggctcctaagacttgggtttaaaccactacattgtaacacccctcataaatacaagctagaactattagtaactagtacttattatatgccagatactcttctacaggctttacatgaagaaagagaggttaagtaacctgactcaggctatgaactagtgagagacttcactgcctcttcataatagagtcctgggaccttctctgtgttaagcatatggcccccagaggtgacagcttttgggggtttatgttctagagcagtgatgtgctgctaatgtttaacaactagctcttggaaagaggggacatgacttttgtagcattttgcaaatttccctggtgtaaatattcttatcatgtctgatttcaagctaccaatgagacatcactgaatgtggagttaggaagagatgcacaatagcacacagttgtttagtatttccaatagctctaaatatctttaagagcatagatgatagtaaagtatggtaaaataattaggaagttatgagtgttgagtatttattacatttatcttaatataatttacttatttttaagtttattcaatttaacttttaataatggctgtgtttaacaaccctggctcataaactttctgaaaatttaacagttggcttttggaaacccactgcagcaagctccagcacacaactgaatatgttgagggtttttttgttgttattgttgtttttaattttagattcacaaggtacaggtgcttgtttgttccatgggtatatcgcatactggtgagtattgggcttctagcatgtttgttaataagttggtcatatcactcaagtcatgcctgatacacagatgtttgattatcagagtcttttttctttcttgtttcctgtggctttttaagttgatgaataataggaaagtaaatttgtggggtcagttaaaccaccagacgacagcttttatgtttgtacattggttcagaggtactctgtattttgactggatttattggatagtgtaattgtttccatttaaaacaatggaaaagatttcatttaaatttattgagatcttatttttcaccctcattccgtgcacatttgggattctgttcgccagcccctctgcactctgaagatgcacagcagcctctctgtactctgaagacgcatgaattgctgactgttgggcttgcttggaggggactgggggttattacctcccacaggactgtttaagctctggaagttttcctacctcctgcaactgaatttagtcttaattagtacagagtgaactagctgtgaacaatctggttttcttgctttgtgccttgatcatgtgagacctaagggctggtcctgcccttttcttatccattgctttaatcagaaataacatatcaaggtggcccaaattgtgtcactattctttcctttgtcttctccacccattcccacggcatccattcctaaggtcatttggagaattctctgttccaataagtgggatccacatggctcaaggagcaacaggccttggaatcactctttgagtagtagctggtccctcagtctaccccaaagagctgcctcgccagacctccccacctcccggacatacagactccagatgtggaaaaagcccttgccatctctatcctccaacacagagctttggtgtccgagacacatccaagtgacaggcccaagagggcctctgaatgaagacggatgagccgtgtggacacagccacactatgttttcgtgaaggcataagaccatgggccaactttctgggcatccagggctggctgcagaggctggagtgagtggctttcaaggcaagactgataatgaaagtcgtgtttgggtgggaatcacaagcaggggaagtgggggagccagcttcccttcgtgctgtgtgtcacaataagataggacacagatgcaaaagcagatcgctacagctggatctgggtaaaggtggcagtgacgcgtcggtgcagagaattcctgttttgaggaaagattcggagccagctaaggttttctgagggcccgtcatgtctcagactgtcacacttattcctctgtcatgtatgcttaagtctgttttagatgaccccttgtaaagaaaggaagcctggcccctgaagcctcattgcgtgggataaggggactaacatattctgtggttgtaccagcaaattattatttatttcttattttataaaagtatagattttattcatgcctatattgttagagaaaatcattatttttagtcaacgtattagtattaatatcatggcctcttttcttctcattttggaaggggaatatttttagactctttaatgagagagtcattttctcagtaaatatttgattggcctgaagttaagtgggtaggcgtaaaaaattatggaagtattggacttgagcaaacttttgacaaatagcgctctctttctctcttgggcgtatgcgtgtgtgcatgcatgtactccagctctctgtgtatgttacacacacacacgtttttcgcataaaacatttttattttgggccaggtgtggtggctcacgcctgtaatcccagcactttgggatgctgaggcaggcagaccatctgaggtcgggagttcaagaccagcctggccaacatggtgaaaccccgtttctactaaaattacaaaaattagctgggcatggtggtgggtgcctgtaatcccagctactctggaggctgagacaggagaattgtttgaatctggtaggcggaggttgcagtgagccaagattgtgccactgcactccagcctaggagaccgagcaagactccatctaaaaaaaaaaaaaaaaaatctttattttgaaataatagcagtcttacaaaaaagtcattaggatagcacaaagaaataccgtaaattcttcacccagattccctaaatgtcatttgctttgtaattttctatctattcgtacttcttacctgtttgagagtaagtcggagacgcgatgcccccttatccctaacatcagggatatttcctgagaacaaggacattcttttacgtaaccatagcacaattattgaaataaggaaattaagtgatacattactgttagcttatctgcagaactcactcaaatatcaccagttatcttcatgtccttggtagcaaaagaaaatcccgcactattgcatttggctgtcacatctctttagtctggaaaagtcactcagccttgctccttcatgtccttgacatttttgaagagtacaggtcagtttgtctgtttcatcatgattagattcaggatgtatattttctgcaggaataccacagaatacttgtgtcctatatatttaaaaacatatacatccaacatcactgaaggtatgtatttttaactcctcctttaaagtggttttccaaagttagttgccatccccaaaagggagcttttagacattgagagaggtgattatgaaagtacgatagcttgctcaccacctctctcctctgctcctgggagcacaggggagtttcaactctggggaaggtgatcatttgggtcattagtagcgctttgagtaccatggtgtctgcagggagttcccagttcttactgctgtctgagaataaaacataatatctttggtcttcacagaggtatcagacaggaattccactcagcttgcaggaattgagaccccaggacaggggcttaagcacatcaagataatttctctctcttctagaggaagagaagttgctgatgttggttcagtgactcgaggatgttctctgacctttcacttattcaggaaatgtgcattgcatacctattatgccgtaggctggggggccctcagctctgctgtgaagagacaaggatccttgtccccctgggagtttatatcccagtagggggagacagacaatagatataataagaagaaaattaaggtgcattagaaggcgatgaggctatggaaaaaaagaaagaaaatagagcccagtgaagcgggtttgggagtgcaggcatggggttatgggggtcagggtgacctcactgacgaggtgtgatttgagcaaagcatggaaggaggctggggagttagcacagcgggttcctggaggagggctcagaccagtgtctgagtgtctggtgtgtctgaggaggagcagggagaccagtgtgggcaaagaggtcagagtggcagtgatggttgtgagcgggtcatcttgggcttcctaggccttgggaaggatttgcctttactcagagggggatgggagtgtgtgagggatctgggcagggtggtgacctggcctgccttccatttttacaggcccctgctggcggctatgttgggaaggcctgtaggaggcggtagagcagcaggaacggggttaggagactgagcgttacccagggaagagggtggctccactggggccatagtggtaacattgtgagaagtggtcaaattctgcgtgcattttgaagggggatcctacagcatttcctgagggtttgattgtcagttgtgagggaataagatatcaagggtcactccaagcttttcagcctgagtacctaaaaggatggagttgtcactggtggtgttttcaacggaaggtgcaggtgagcaggttgaaagggggaagatctggagtttgtttttagacacactggtagatgtttaagtgtgtatgcgtatgtatgagtcttcagtttgagtagtagtctgagtaagaagtatcaatttgggagtcgccagcagacagatggtatttaatgccaggagatttgatgagatcacccagggtgtgaggggagatagagaagagagggggaccaagggctgagctgtggacactccaacactaagagcatcttttcctcctacccctaaaatggctctggggctccagccattgtatgtgtttttcatgcaggaagaagtgggacatgcaaaggggctctttataatctggtctgaggcccctgtaaagagcctccagtgacttctgcttataacgcattgaccatccatattttaaaagaggttggaagatgtctaagtaccagctagacatcttataaatcctatcactatagagttttgctctccagcagaactttctgtgatgaaggaaatgttccgtatcagcactgtccaatatggtggccagtgaccacatatgactgtgagcacttaaaatgtggctagtgccaataaggcattgactttttacttttctatacttttaattaatataaattcaaactgaaataacacatgtggctagtggctaccatgttggacagtgcagatattgaagtttgatttttaagaaggagagggacagacactggacagacaactcacagctcctgccacagtacagcatggagcctcccaaggcactagtcacacagatcaagccacacagccaaatggaaatacaaataatagattgaggtcacattgactgtttcacgttgtacttagacatgctgattaaaacctgagttgcaagtgtgccatggaacataatctctccctctagtgttttggaacaatcacacacaaatgtttatatccacatacaggccccatatacaatgggggaaacagaacagaagaaggttggatggttcaccaagttgagtgggtccttcaaaggatgtcaccatcttggatgtgatgttttctgttttcagtggcatagaactagataaaaggtggcagtgcagaggatggaagtggtattgctcagtgggaaagggaaggcattttaggtttgagacatattacaatattgccttttagcgtagaaaagccctccttcctgatgctcttgctagtgctgggtggaaagattccctttcaactcaacatgtgtgaagcacatgaactgaagcactcttcctgcttagcatggcaggggctgggccaggccagggtggaccaggtcttgctctgatcaaccacatggtctcaggcaagttgcttcacctttactgctgagcttcagtgtcctcagctgaaatggggagcagaatactgacttcttagtaggggtctggtaaacactgggccccttttcccttctgctctaccctgcaaatcttttcctctttctaactgcctctgcatttggaaggggtcaagactcgtttcatagttttttgggggattaaaaaatgattagaagcagatggtgagaagaaaatagaaagtatggagcaaataagaaatgtgggaagagaagagggcaaatggtaaggcagctctcggagctggcacgttctttctctctggaccagagcaagccagagcctctcagtcatcttcacgggctggttgacaaggactcctcacgttagcgtgcacacgaagaacctgggaccttgttcaatgcagatcctgatacagcagatctgaggtgaatttctagcaagctccctggtgacgctggtgctgctggtccatagaccacaaagcaaggagctcgaagacatagataccaaaagttacaggggaaaacggacaaagccaccagctggcagttgatgcaggtatcagaagcaagtgggcctcggaggggccagatgcctctctcctcacactgaccgtgagagcgagtgctcctcatcaacaacgtggggccaggcttgagtcagcagcactgactttatgtgacctagtgcagctcgccagcccacgctgatgtgtgttaatggagggggtgccccttataggagggtggtgtgggctataatttcttctgcattctctgcctattgcttgaaggacagtgttgtcagcagtcaactgactgagcttgacttttcagcagtttttttaaacttcactgcagtgtttttggacacagctatgtcagaaatctatttccccttctcagagaccaggaagctcttgaggtacaagctcttattaagcagaaaattttaaagtggttttccttctccttttcttgggtctgctttcttggggcaaacagaatacgagaagccagcttagaaattgcatgggtccttcctgcattttgtgagaaaatggtggcctcctatatttcttccctgacaggttactgtgggccaccagcctccttggtgacttctgttttgcagatggggaatttgttgattgtagtgagtacgctgtgtgcggcagaaaggattctgtcacctacagagagctagggaagcgcccaggctgaggaaacccaccccttcgaagcagccatccataggtagcctgggggtcttttcacaagacagccctagccccagttcatgggagttggaacaatggtgggtccaatggtggatgaatagtttattcacatgcatcccaggagatttgtgtgaagagggtgacagagagttgcttcttttaaaaaaaatgtattaagggctatgtaaataaaaagaagaaattaagttgtaacagtaacaataatagctatcttttattgagcatttactatatgctacatgttttacatgtacatgaagtccttataaagaatacaattacatatgttaatatgtgattatatacagaaaattgtatcagaattatatctacatatataaaaataaaataaaatctcattttaccattgagggatctgagatttagagcatttaatttatttaagatctcacagctggtaagcagccaagtcttgggtttgaatcccatccagcaaccaactagttctatgactttgaatgcaaaagatgatggcttttctcattattattacctagttagtctgagaaagagaaaactccattctggatggcccatttctgggtggattggtgctaggtttctcctggtcttggacgaggttgcacttttcagccgctcctgtgcacgtgtgtccgtgctctgaggtgggaggaaagctcaatgtgggtctgtgagtccagggcaggcaggagtcctggggactggaggttctctgcacttctgtttgatcttccctgcctgtctgtggcctctgcagtttaaacaatgactgtcacttaaacctcttctgaagagcttgaagtctggtccatgccttcagcccaccagcgtgtgttgagtacctgttgggtacacagctctgtgtctggtggaggggaaacaaagattaaaaagactgggccctgtcctccaacagctcaggttatttcatgcctgcattcggggcactgtcttacttggcctagtcccacacttgtccctcccaccccttgcttctctattttcaattcacttctgtttctacacacatcagtgatgcagtgtcctatgtacaggtgtgcctgggacagtcctggtttatgcctgttgtcccagcataatcattaatagttctctatttcactctcaagtgttccgatttggatggcaccctatttattgagtgctcattgtgtgccagacactgtgctgggcccggggcagatggagactcgtaagccataaccgctgcctcccaggagctagtctgctggggcatccgttctgaataccatgacttggcaagtgaagcattcccatgccttccagactcctggctctgcctgtgtgaaacgtactccatttccagagccagctgccgagctttttcccctgggctgactttccaccaccctgacctgcgattcctctctgctaaccctcctctcaccgttctccccagggtgggctgtgggccttctggtgctgagctccctcacatctgagctgtcttagcaccttctttccgcctgtatttgtgttacttggatatttgtgttttatcttctgtaccagagcataggttattttaaagcagggagcttatggcattcaacactgtcaccctgggaataggacccccaaaacactttatttctcaaataaatgatggagtaggttccagcgttgtttcttccttgctgtccatttctaaggatgagtaaagagttaacgtattgaacttgaaaggagagatttttttccctcttgtaataaatcaaacttttctgaatctggaaaagtgatggatgaaactatgtgagcacacacacacacacacatatacaccccataaccattttgaggtcatttaataagggattgctttctggataatctcgctccttgggtataaatctaatgtgaaagggcaggggtcagatatttaccccaaagggttggtgtgaggataaaatgaggcattgcttttaaagtgctaagctcagcccactgaaaaatacgcaaatgcatcagaagagtcctctgtaaatccactgagctggaatttccaagcaggtgtccttgctgcctcttgttagccttttgtgagttaattctttgtttaataacaaagagctgccagatggtaattttggaggctcagatacactctgttgcacgtgcctgtccagcttacttaaaatatgtcagaaagaatgagggaatgactcaaacaatttcaggaaatggttcaaggctgtgtaacctttaaggaaaaccacacggagccattaccttgtgttgaaaggcagctccctggctccctgggaggcctggtggcaagcagtgagacacttgatttaggtgaaggggggccccaaggcagtggtgcctcccttccttctgcccagaattgaggtgttgtccctacagtggaaactcaagagcagcactgtctgatagaaatataatgtggtcacatctgtaattgtaaatttccttttttttaaaattatgctttaacttctagggtacatgtgcacaacgtgcaggtttgttacataggtatacatgtgccatgttggcttgctgcagccatcaactcatcatttacattaggtatttctcctaatgctatccctcccccagcccgccaccccccgacaggccccggtgtgtgatgttccctgccctgtgtccaagtgatgtcattgttcaagtcccacctatgagtgagaacatgtagtgtttggttttctgtccttctgatggtttgctgagaatgatggtttccagcttcatccgtgtccctgcaaaggacatgaactcatccttttttatggctgcatagtattccatggtgtatatgtcccgcattttcttaatccagtctatcattgatggacatttggattggttccaagtctttgctattgtgaagagtgctccaataaacatatgtgtgcatgtgtctttatagtagcatgatttataatcctttgggtatatacccagtaatggaattgctggatcaaatggtgattctagttctaggtccttgaggaattgccacactgtcttccacaatggttgaacgaatttacactcccgccaacagtgtaaaagtgttcctatttctccacatcctctccagcatctgttgtttcctgactttttaatgatcaccattctaactggcatgagatggtatctcattgtggttttgatttgcatttctctgatgaccggtgatgatgagcatttttttttctagtagccacattgaaaaagttaaacaggtaaaactaatttcaataacatatatcagtttgctagagctgccataatgaagaccacagacttgtggtttatatgaacagaaatgtatttgcccacagttctggaggttggaagtccaggatcaggtgtccacaggtttggtttctcctgaggcctctcttcttggcttgtagatgactgccttttccctgtgtccccgcatggtctttcctctgtactcatatctctggggtttctgtgtgtccacatttcctcctattctaaggactccggtcagattggattagggcacaccctgagggcctcgttttaatttaatcaacccctttaaaggcccagtctccaaatacagccccattctgaggtactgggagttaggactttaacacaggaattttgggggaacacagttcagcgcataaaaatgtatattatttagtccaatatagccaaaatgttattatttcaacataaaatcaataaaatgttaatgaaatatttgccttctttcctgtactagggctttgaagtctggtgtgaatattagccccattttatgatctcattaggcacacgtgggtagtggtgaccgtatcagacagtgcaggtctagtgtcgaacctcctaatctcttgggagaccttgggattgtcgtaaggaggcctgagtgaattcataaaacatatgcagttcctgaatcaactaataagtaaaagtataccttttatcacctgaggttctggtaaatattttggtattataaaggttgctttcacacttacaaaagttaagaagcatggttctgactttcctaaactggggtttctagagcccaagctccattagcatggtgatgacggcctgcaaaatctttccagcatttcagaaagcctggtgggatcacaggggttgccattcagctactgacaaggtcagcatcattgctttcagctggcgttttagtacagtttttctggtgaccttgtgctgatcaaactttccgcgtggctttttatgacactgtaacaattactggggtcatgcctggagaggtggcccacagttcatgcacaggctcgagtacaagccttccggggactcatctctcagccctgttattattctcagggatttggagggtgcagaggtagatgaagtaagcaagcactattgtgcttcctgtgttgaagtcagggaataagaatttcctctgtgccacaaataatgctccccacctgtatagaatgcctgggaaatgcaacactggccatccttcagctcttctgcttacagctgttgtgctggtgggtctcctcctattctcagagcagagagccacgaatggggcactcggggccgtgacaggcatcccttagctctggccttctggttgtgggcagactctgctgtgtccggcagcccatccagcgttggatggcatcagcaacctgaaagccctttcttaggctgaaccagagtctacctccatgtaatcacacactcccctcctatttctgccccggagcacctacagatatctgtctgtctgtccccatccccactgcctacttcctccagactcagcatcctgagttcctttgggttactagttcattttggaacttattccactattgaattatccgtattctttggttttatacctttattcctctttagttgaccttttagatacttttctaaccatgccccctccccgctgccccgaaagatcagggaaaataagaagaaattcaaacccttgttttgctcctcatcagcgacagtggtagggaagatgcccacggcacggaggttcagtggttgttttcattctttcctgttagccagtttcctcaaattggtcagtataatcctacctcttggagcgatagctggctggattcttctgccattttggcagttatatattggtctggatttaaaagtgatgtttattccatagctctcctgaatctgacatttgttcctctttcatcctatacttccctgggcatgatacccttctttccatcagctgtgttggagaaatgtggcatgtggcagatgtatccttgcttgtttaattaatgagccaaacagtccagaaacttaggttacaaccaaggtagtctggcaagaaatatacatgaattcaaagaggtttgggataattttattaatgataaaaccataaagaactcagaaaatattttaagatgcttggcatcaggaactatttcatttgtctccatatccccagcaccacgcagagtaattgacattgactaattgcccaataaatgttcactgaatgttaggagaagctggagtatttccaaaatgaacatatgctcaagatattctactagaagtttacaatgttatcttttacatttagattagtgatccattttgagttaatttttgtgtgttgtccaggatagtttcaaacagttgtgcaaaacaattctgtttgttggttatcatgggtagactaatacctgtcagatcatataacccgacagtcagctggaaacacttggtcacatgagattgcctatctacattttaaatttggcttcagagggagcagccagcaactcccttcaaccccctaaattttggattgtcctaatgaaatcttggactgaagcagtacatttttaaccaggctttctcaggagatttggttcggctggcactcagcccacactttgcttaactctgagcaaaggtgtccgtgggtggataatcccacctccccattctggatgtgccagcacttttcctactcatccccagttatggaatgtctaattctttctcattttctcctgtcactaccatgctgcagtgagcatcttgggtcacctaactattaattctggaggacagattccagccgtggctttgctgggtcaatgttacagccatttatgtcccctcagatgttgggttggtcctggatgctgccctgtaactccatcacacccatctgaagtcctgcctggtaggcagcagacactgggtgtggcttggtttctcatacctttttatttcagtccctggtgtttttgtcatcttgtgtggcagtggcagtgctccagctgatcatttttatgggacagtccttccttgatgagacccagatccctgtcacttgacaacataaagaatattattcttcataccagcatttcccaaagcattttttcaaaggatagtaacgacttttatgtcaaaaaacaaaacaaaattttgaattcaaattaattttggaacataattgaatttaacgcaggctttttattgcaggacttcatggagctttagaagcccaggcacgcaaggaggatgcactgtttggcatttcctaaatgtacttgaccacggaacaccatttttctcctgaggtttaggaaatggtgctatgatatagattagttttctatgaataacttggctttatgccttcatataccttttctctctactcatgtagaaactcttcttcagcttcatgttttaataatggaagaacttagtgatgtttcatatgtagagatttttctctaggtccttctcatcgataagacctgtttcaagatatggcaagccctagttctgatctctggggtcctcaccatttatagacttccattagtcctgttgtgacttaattgttttgttatatttttggtggcctcctacactatggaagactttctgaaagcccatatctcatgctaaatttagctggatttttaacagccttgattgattgctggtcttaatggaagaaaatgtgatcctttctcttcctcccttgtcattaaattattactaatctatgaccagaggaagcagccactgcatacgtgggtgtatttttaaaaattgtgacacatcatcaagatggatatacttgcccctttaattcaacaggcacctgttgaatgcctgtgcatgcaaacatgatgctgggctgagccctggggcttcccctgaagagctttggagcccacagcagaactcccagccaggctcatccaccactacagccacaaccatccctacctggagaaaggggctaaaagaagcccatgggattaacagacattctgaaacaccaacccttaggaaaggagtagaaatgggagttgggattaaaagcagaggtgaggttaaagggtttgaacaaaatgggcctgatcttgggcttctgaagtcctgtatagtgtaagtgctgacctgagggcctgtggctctcctgtagtgagggaggatccaactggagtatgacttccacctctgcatggccagcctggtgacgtgaagcacatttcttatgtcaggttcccagtttcctcttctgtaaaatggaggcagcatgggattgtaatgaggattaatggagctcatttacctgaacgccccagagggtgcttagcaaatactttatgcttcttgtgggtccattactttcccttgcctgtttttttagggaccctggagtgttaccttggcttctgattaaaagctaggttggcagatgcaagcacacatgcctcctatagtgttgtcctagactggggtggtgttagtggtcaggcaaataattgatcactctgtgttctcaagacaagcaatgggtaagaagacaaggccacggaggtcaaagatacagaaagataattgccatatatgctatgcagccagtgcccctacctcatgtgattgtagagtggttcttacactagggtggcatagaatcacctgaagggcttgtttaaacagatcatgggtggtgggtacagcatttcaggtgcggaagatgaaaggttctggaggtggatggtggtgatggttgcagaataatgaaaatgtacttaatgccatagaactggacacttgaaaatggtgaaagtgatacatcttatattgctctccctgccccatcacaaatagattgctaggctcactccttatagattctgattctgtacctctgaggtggaccttaagagtctgcatttgtaacattcccacgtgatgctgctggtctagggaccccagtgtggaacccttgctgactgggttgggagtgacgttgggaactgtttcgccagaaatactggggacccttgagtggtaatggaattggttgtatattttagtatgatagttcttatagatgataaagacctcagaaaaatctcactatgtccatgcccaagagttccaccatgagcacatgccttgagggcagtgaccctggctcctattgtctctgtctctctatatctataacttttaatcttgaaatagtttaagattcataagaagttataactcataagaagttttaactcataaaaagtcaaaatagtacaatagtccccccttatccattgggaatacattctaagacccctagtagatgcctgaaactgtgggtagtcctgaaccctttatctgctgttttttcaatctgataactgagacagctagtaagggattaatgggtagtagtgtaatagcatggatgtgccggacaaaggtgtgattcccatcctgggcagtatggcatgagatttcatcacactactcagaatagcatgcagtttaaaacttgtgaggatgaggggaactactctatggaaagattcaggtaccctttacccggcttttcccaatgataacatcttacatatacatagtacattatcaaaagtaggaaactgttattggtttaatactatacattcttttaaaagagtgctcaactcaagattaggaatctatttttcaactaccattagccccactttggcaaggccaggtgggataagtgctggggctcctatggtgggtgtgctgcagtcttcagcagagcttggctacagaggagaaagatctaaactggaccaatttcatatggtcattgcctctggcttgtggctgatcatcttgttctttggaattgactgtctcatgaaatagtgagtttcttgtcaccagagagatttaagcaagagccatggaatccctgtccccagcactgagaaggaacatgaaccatgtattccctgaatgtcttattccttaaaaatcctgtgattctatcaattgttttgttagagtttgtggctgacattgattacactatgagtcatgtgacattccatgttgatgtagttgccaaaatgctcgccttcctgggttctgctttcattagtttgagagaggagctgagccacagaaaaggggctggagtctgctagattaatgaagatttgggatgtgtagtctgttttcacactgctgataaagacatacccgagattgggtaaattataaagaacaagaggtttaatgaacgcacagttccacatgactggggaagccttgcaatcatagcagaaagcgaaaggcacgtcttacatggatggtggcaggcaaagagagagaacttgtgcaggggaactcctctttataaaaccatcagatctcatgagacttactcactatcatgagaactgcatgggaaagacccatccccatgattcaactacctcccactgggtccctcccatgacagtgagaattgtggtagctacaattcaagatgagatttgggtggggacacagccaagccatatcattccgccccggccccttccaaatatcatctcatcacattccaaaaccaatcatgccttcccaacagtcccccaaagtcttaactcatttcagcattaactcaaaagtccacagtccaaagtctcatatgagacaaggcaagtcccttccacctatgagcttttaaaattaaaagcaagttagttacttcctagatacaatgggggtataggcataaggtaaatacactcattccaaatgggaaaaattggtcaaaactaaaggctaaatgcccccatgcaagtccaaaacccagcggggaagtcaaatcttaaagctccaaaatgatctccttttacttcatgtctcacatctgggtcatgctgatgcaaaagataggctcccatggacttgggcagctctgcgtctgtggctttgcagggtatagcaccccacctggctgctttcactggctggcattgagtatctgtggcttttccaggttcatggcacaagcagttggtggatctaccattctagggtctggaggatgggggccgtcttctcacagctccactaggcagtgccccagcaggagttctgtgtggaggctctgaccccacatttcccttccacactgtcctagcagaggttctttatgagggcccccgtgagggccccactcctgcagcagatttctgcctgggcatccaggcatttccatgcatcctctgaaatctaggcagaggttcccaaaccttaattcttgactttgtgcaagctgccaaggcttggggcttgtgccctctgaagcaacagctcaagctgtaccttggccccttttagccatggctggagtggctgggacacagggcaccaagtccctaggctgcacagagcagggggaccccaggcctggcccatgaaaccattttttcctcctaggcctccaggcctgtgataggaggggctgccatgaagacttctgacatcccctggagacattttccccattgtcatggcgattaacatttggctcctcagtacttatgcaaatttttgcagccagcttgaatttctcctcagaaaatggatttttcttttctatcgcattgtcaggccacaaattttccaaactttaatattctgttttctttttaaaactgaatgaatttaacagcacccaagtcacatcttgaatgctttgctgcttagaaatttcttccaccagataccctaagtcatctccctcaagttcaaagttccacaaacctctagagcaggggcaaaatgccaccagtctctttgctaaaacagcaagaatcacctttactccagttcccaacaaattcctcatctccctctgagaccacctcagcctagatttcgttgtccctattattatcagcattttggtcaaagccattcaacaagtctctaggaagttccaaactttctcacatttcctgtcttcttctgaaccctccaaactgttccaacctctgcctgttacccaatttcaaagtcgcttccacattttcagatatcttcacagcaatagccccctcctggtaccaatttactgtattagtccgttttcacactgctgataaagacaacaataccccactcctggtaccaatttactgtattagtccatttttacactgctgatagacactgagactgggtaaattacacagaaaaagaggtttaatggactcacagttccatgtggctggggaggcctcacaatcatggtagaaagcaaagacatgtcttacatgggtggcagcaggcaagagagagaacttgtgctggggaactcctcattataaaaccattagatcacatgagacttattcactttcatgaagacagcacaggaaatacctgtccccatgattcagttacctcccactgggtccttcccatgatagtgagaattgtggaagctacaattcaagatgagatttggatggggacacagccaaaccatatcatgggggtagagttgagggaaggagagaacattccagggataggaaatagcacatgcaaaggtcctgtggcatggcctttatgtgtaaaggagatattgataaaccttggtatgaaagactgtaggtctctgggtgcaaagtaatggctgagcatgaagctgaattagacttggccactagcttactttgctgttgacagaatgttggtacagattgagcatccttaatctgaaaatctgaaatctgaaatgtcccaaaatctgaaactttttgagtgctgacatgacaccacaagtggaaattctacaccttacctcatgtgatgagtcacagttaaaacttttatttcatgccccaaattatttcaaatattgtataaagttacctttataggtcatgtgtagaaggtgtatataaacataaatgaatatgaagtttagcctttagtcccatcctcaaagtatctctttattatatggagatatttcaaaatctgaaaaaatccaaaatctgaaagacttctggtcccttatatttcaattaagggatatgcaacgtgtacttctgcagctgccttgagaatgcatatcattgaataatgttagtgggaggttttaaactatctgaagatcacacaactgtgagagcccagctcccctgaaatgcgtagggttggtcagtgattttgctatgcgccaaagcagctgccttgatccctcagagccccggcatttctgcccggggtttggccacccctggccttggctgacttctcatggatgcagcaaaaacccagtaggatgcacctctcaagtggttggcagcttttactggacagctttagagtcctgtgggttattctggttgttgctattcttaaatattgagtgtccaaaagattcgtgaactgcatctcagctgggtgggaccctttgggacaggagtaggggaataatgccgtcgttaactgcaaagaggagttttgggaccaggttgtcttataggtttattttgaacaactgataggcttggtattgctggaagtggatagatttgggttgcctgtgtctagcaggtggcttccttttccagtatgttgcccactggtctcatctatcagactcacttgagagtatttcattattcatctaataaaggagtatgtgagattcccagaggaggaggatctacttctgtacttgacctgggtgaggaccactgggaacatttgcacctttcaccattgcaaactttgacatgtgagagtttccagaaatacagagattcttattttaatcctttttctttttaactgcagaagggaaataataatgggatagaataactgcagggagtagagagatgagaaaacattagaaaaaatagtacagaagtagagctggatgagaatccaagttatgagaacctattgatgagaggcatgcagaaataaaaagcccaaattcagtgatctaaatcagggctcagatgaggctgtttgtattgcacggtaggaatatatccagaaacagtgggccttttataaattaagcctgccattctccaattgcttaagacactgaggcccatcaggccagaaacatatgacccactttttctgagaaggaactttccctttaggagtggtaatttagaagaaaagaacaagcccaatgaatagtcccttatgggaggcatctcagcagaggccctttttgggggcaggagggattgcatagcaatactgcctacccagagttgttgttcccaggctagggtccaactcagggcagggagatctactggaggcagcgtatcacacactagttgtccaagagatggagagagagtgcaaaatctgagctgtgcttatgggaagctcggagtctcacaaaactacacccatgctgcccatggtttatgtttaatgaatgaaatgatgattaagataggacaattggacaaaaaggctgggccttcttaggtgggtattgagtgggaagtgattcaagaggccagacattctgtctggacattagctggaagtggggctggacaagatgaactagagccctcttgtggtcccatcattcaggcctgtagctttcatttgagaccagtggttcttaaacttttgcagggatcagaatcacctggaggacttgctaaagcacaaattgctgggccccaccccagcgtttctgattcagtgggtctggggttgggactaggagtgcatttcaaagcactttctggagatattgatgctgctggtcctgggaccacactctgagatacagtaatctagaccatgaaggaggtctggatcctggggagggaatccgctttctgctttcttaggcactaggaaggcaaggagatacttggggctggaaggtggcaggggagcatggaagggaggagtccttgtccatcgtgtctcaccatctgaggagctgtcatcctttattcatcctgcccttctgcttgccctcagtctcagaaattccaaaagacagcttatgaccctgcatttttggttaaagaaaggagggaactgaactgtctgctctatgaattctgggctagtggggatcatggggattttgtaaattattttggtagcccgttgagttttgtctcaggatttcagcggaatccaaaccatgtgacatggaccattatcattcagctgccacctcctggatcctgccctgtaaacatgcccaggggtctctgaggatggacgcgtgtcattcacacaccaagtgtgttagagacaacagaaaaccttgtttttttcctgtgttctggtgaaagtcttttctgtctttccctttgtttcttcgagggagcttgagtggcaggattattattaagagtactttttaagttcccaacaattagataggaaatgaactgaatgggagttcacattttatcttcaggaaaatgaccgcaagaaggccttactgtggggtggttaagagcatggcctggctttggaatgcctggattgggaatccttgttttgtcacatcatcgctgtgtgatcctaagccagtgatgtgacctccctgcacttcaatttcctcacctctaaagttgggataatactacaacttatttagtaggattgctgtaaggaccaaataagataatatagctcatgcagttagaattggacctgtcacttacagatagaaggcaatacattttagttcttactgtaagactgagacatccaaagacgtctcatactgtaatgtgtgatatttatgtatatgctttttaaggactacaatccttagtttcctacctactcaaggttatgttttgtagatgctaacagtgtacattctagagaaaatcagctggagggaggaaaatggtacagttctaaaattctttaagcctcgtttaattttttacctgttactgctttcatcatcacctctcactctcattttctaataagcctgaaaagcatgatggagtcataaatcatgtctgtaaaatgaagatgtgtagactttggtaagatctcacatgtgatgttaataacaataccttacatatctggcctcacacttcacttaaactgtcccatttaatccctgaagtggtctcattagcttctgttagtcccattttacagtttgtacagtggagacttcagagaagaacctggcccaggctccacaggcagttaatgacagagctgggatttttttttgtggaggaataggggagacttttctggtaaagaccagaaaacctgctagacaaattctaaaagagccataacactcagagcggggattttaacttcatcttctgcttcagggaccacattgttcccagtgtgtttaaacacctggctggtttttcacttggggttctcattcagattcgtgattctgtttactgagagatgatgtcccagttactctagctctgtaacaaatgactccaaaacttggggctgtgaaataatcattttattttgctcatggattctgtgggttattcagactcagtgttccatgatatttggggcctcagcaggggtgattcaaccacaggagctagagtcccctggggtgtctttgcccacgtgtcccacaggtgcatggttaggacagggacctcagatgggctgtcatccagaacacctacgtgtggcctctcaatgtggtctttctgcctgggctgacttgggtttcctcagagcatggcaacctgattcctagtgagatttccgagagagtgcggttgtctggcacttctgtgatctggcaatagcttcaaggaaggaaatatatttttacattgaaagaagagaatatgagccatgtgtgccaggtacggggagccacctgtgaagatcctgagtagaggcttaggtcactgtggacacagtggcagcagtggacaaggacaagggatgccgggtcatgcattcaccccacaaatattccatctatctctgaactaggcagaatgagcagggcaccaatctaatggctcttctggataatcacttcacatgggaatcctaggactccatattatattcttatcctgttgaaaatttgaccttttaaagatttatttatatttagctcaggccttaaaaattccatgtactatctaaaaagggaaaagttcatcccagtcaatgtcctgtcttgcttatgtttaagttggataggaagaaaaaaatccacaccaggagaagattggttgtaaaagtttattttacatttatgtgaagtttatttttggttctgatattcttcatagggtagatatttcttttaagactgttaatagtgtatttcctttttatttgccactccccaccaaaataaaccctcttttatttttgaatcagcttcatatcttcagaacgtccaactttaaataatggttggagaagctccaggttaagtagagagtaaaatcctattgctttctgacctttgggttaggatcaagtgtggtgtaataaaatatcagtcccaagagtcacctttgctgatttttttcctattattctttcctgttattccatattcatgcaggtcttgcagccaaggattgttacattaagatccaatctgaaattaaaacttatggttttaaccaataagctataaagctgttgaactcccactgggatgtagttaccttttcctaaacttcctgcattgtctccttttagccccacagttgatttcttattgagcctttggaaagttccttgccgtttcacagccatttcccgtcagagtggggaatattgactgtgcaaaccacttaaggtcacaggcaccacagctgtgtttcttctttgcagaaggggggtttctttgggtggggctgtgctcagcccttccgggtggtgaaggtctgaggtcacactgggagagcaggtccatatcgggattggggctccagcaggatcagaatgacttcacccagacttctggacctggaactcattctcagaaccttccagaagaccctgccctggaattgctttcaagggtctttttcatctgtgtacagagtatatttccttggaggcagctttgctgaaggccccttgagtcaagggtaatagggtgggagcagctatacacagttgcatttcagtgtttgatgataaaatggtgtccgttggtgagcatcttggtggtgaggaagtttatacgaccacagatgcttctcaccccaaggtacccgtgccctgtgctgctggtgccactcatcctagggcattcctgcttggcagtagcagattctagattgtcctgtttgctggtttgggggctgcaggggtctgcagagtgccgcaaggaggaggagtcccagatcactggttgaccttcagcgggcatttaacagcatattccatcaggcctcacctactagtgttttgttgaggctgctgtgtaactttgactttctctgctgtctcctatttaagagtaaataaaggtagtgacagtcacaaaaatagcatcaatgatgacaactagcgtttactgagtgctgactatacccaggcaccattctaacctctttacccaagttgtctctgctagtcctcaccacagccctgggaagtgtgtgctgtcatatacccatgaagaaactgaggccaagaaaggaaagcagctctgcccaaggtgttataagcagagagcaccgagacaggacccaagcccaatttgtgttgactggggaatcagtactcagttctcttagtctttggctgttttgttgagtgcccaggtcatcctggtagaagggagacagtgacccacgtgaaaaaggatggctacagatgcatggctgcatggctgtgcgtcatccaccctggagtatctgcttgccaaaaatagggctacctgcaaaatgctttgagcactgtggaaaccagccgttacaactccaaacgtttatttttctgataataggtcaaggttttcataattgagttttaggggggctaattttagactttctgaaaatcagtctcaagaaacaaaacccagagtcaagtaaaaggatgcttttggaactgatgattctcagaagaagccatgaagggctcggccataaccccgggaaagctcactggccagcagcctggagccagtggagcttcaggtggctttaattcttccctggatgctggtggtctccagagacacaggggtaaacaggtcagcgtccttgtcctcaagggcgtcatcctccagggaggacatagctggtaatgacaaaatgtgggccagcgccttcttgcagctgggcacacagggctaggggaactgagaggagaaaaggatgaatttggccttggcttggagcagccttttaacagaaacacgcgtaactttcctgcagatgcacttcctgtgaatgaagagtcttgatatatatttttctttaacaagagaaagccaggcttttgattaataatttatatgtcaatgttgggatcttcattttgttatgagagatttcagttacaacagtgtgaggtgggtggtcaggaaacattccccctgggctcactttttgcttagaaaagtcctgatggagaggttgaggtgggaagagagtgagggggaagactccatggagcatgacaggcatgctgtgcctgccacagccaagcatggaggtcccaaccataatgtgtttttgagacaggatctggctctatcgcccaggctggaatgcagtggtgcaatcttggctcactgcaacctccgcctcccagctcaagccatcctccctcagcctcccgagtacctgggactacaggcgcaccaccaccatgcctgcctaattttttgcattttttgcagaggcaggggtttcgccatgttgctcaggctggtgtcgaactcaagtgatccacctacctcggcctcccaaagtgctgggattacaggcatgagccaccacactccacctccaaccacaattcttgttttaaaaaatgaaaatagagtgaaacagaaatggtagaatcaagtcaccttgctcattcacagtcatgtgtggctaggacaccatgtggtccagtctgacacaggctgatcctttcccctcaggacccatccttggggtcgtccagtccttgggctctgttcctctgatgtggcacaggtggtcagtggggcagggaagacagaaagatgagggccacatccacagaagtcatttccttcctgtggtacagacatgacaccaccctgtgggatgaatggggattcccatgtttgctagttacatatggccaagcccttcagcctttctgccccacttccagtttctttcttgggtgggaatgccttgagcctcagttaattgtttgagttttcttgagtataaaaggaatcctggctgggcattgagtgaatacaatcataaaacccaaatgatgctgttggcctcatctgagctgagagtggtgttggcaccttcatagctgacatcaaatggatctccaagcccaaacactaacagtggaaccagctattgctgcttctggtgtatcatccaaatgggttttcccagccatcttctggtgcatttctaacatacccttaaaaggcataaaaaagtggcatagatgatggctggaaagattaagttctttctggtggcttctttaattttggaataaccagccttccttcaacccccttacatgcattagaaacttctgaactgtttttgttctgtttttaattaggttgtggtacaagaggagcaattaataaaaccttccatttccacatctactgtgaaactctgtgacttcttcccgtgtgatgatggctaagtgcgcagaacatgtgaaatttaagtagatttgtggaaacagaaacacatttttatttagtcgtgagcgtcacttggagtataaatagagccctttatgattcgtgtgctggtctttcttcctggagggcttcagtattatctcatgctgtcatctttatgttgtattggaaaaatctgggattctttttcccttggtcattatttgctttttaaaaaataatgtagttttaaagaattcttgctatttaatctcaagcccaaacatggtttttagtgaggaactgatacttaataaagtttgatatttttagttctagaaagaattgttttggggggtgggaggctgcagttgagaggtacaagaaatgttcaatgaggggaagacactctactgtggttccatttgctctttgaaaacttgtgtttctgttggaaagaaaggtttgattttggaagttttaaatgtactgcatgatgttgctaaattttagttcgttgctgggaagttttggatgagctcatttcataaggatttatgtgccttataggccagtgtggggtaaggggtggagaagcttgcctccttcagaagggtcttcattcctagagggatatggaatgacccactgctttttggtgggaaacgtaaaggccagtcagcttttggatgaattttcaaggaagacagcagctgtccatcttcagtcttgacttgccattcccttaggagttccttcctttcacccatctttttctccccatggcttggccatgccacagtggtccctcggcttcaacagtcttgcttgcttacatctactaactgggcaagagagaccattctcccattggccctggaccaccactctgatttggatttagatgggctcaggaattttgtttggaatccttttggccttaaacaaaataatgatgagagaaatctgcctcccataagtcataatctcagcaggctcctgtgtctgagctatttctgtatccaggtccccaagagggctacagggaaaacttcatcatgatgggagggaagaaagaaggtaaagtcctaagatgtttgcttcctattccttgtaaggtttagccatgtatagtcatgtgccagtcacctagggctgagaaaggggagcaagcagagagggagaagaggaagaagccaaatgagatggttcgtaattgattagtggaagttaaatcatgttaaggataggaggcttgtcccctccatcatgatttagtatatcatccttcccaagagaagttttgagaacttgtcctctggtatccaggaaatggcctccccagcagtgtgcatagtcccagggaagccgtctcatgagcccctccttctcttgactcctctcctaatggtcacatggtgccaccactctttcaagccaagtcaaattgcatgcagcagaaaacccaaataagtttatgcagtagaggtttattctcacaccgaagtaattcagcattggtatggtggctccatggacttcaaggatcaaggatcctttcctctttctgttccaccatcctcagaacatggcttccagtttcaaagttaccttatggcccaatgtggctgttggagctccagccatcacatccaaattccagataggaaaaagaaggaagagagaagattacaaaagaaaattatctcccagctaatttgtctttatttatggagttttcctggaagcctcacattatggtttctgcttgtatcttcttgaccacctcttctccaggggagactagaaaatgtcttttaggtaggcatattgtagattggaataaagttgagtttggttaaaagggaaaagtagagaatggatattggttaggcatatagtctctgccatggtctagaatatatgaagaacctcatgtgtgaaccttaatatattctgccaaatattctgtttataatatctaaccctcctatcagatcctaggccatttggaagccaggagcttatcctctcctctttgtatcaagccaggggcccacatgttggagttatagcccatctttgttcaattgattcagattcagcccttgcctcccatatccctcaccatggatatgcagttataaatgatttcttgttaagcatttttaaaaggttaacttcttcccagagagcttttacataattatccatttaatgtgtttttaatgataaagaatctaatagttatcaataatgttggaaaagtaattctaggcatgaaaattagcagtatggtacatatgaagtacataccaagtactacctgattccagatattaggaaaacaagacagaagggtttcaccactagtcagtatcagtagattgttggggagaaatctttatgaaaaatgccacttttcactctttttttcaagtttgaactgactgtggaaagatgggagatgtctgagaaaacttgtgtcagtacttcatgtttgtaaaaggacagggaatccttctgaaaatctagttacataaatttatgttccaccacaagaaaaatcagtggatggctggaaggcggggctttcccttttgctctggaagggaaggaaactctgacagccagacttctcagtcggaaagtgtctttggtgagccttactatgtgactggctgattcactttgtccgctaagtcttgggagaggtgatgtaaccagggactgcaacttctagggaaaggggaaaaatcactgttggccccaccctctagcattggaagcttaacagggctttggcccacagcacatggaagtttgagctgtgttttgtaattcttttttaaatgttcgccagagcatccattattcttcctcattttctcttctcctcttccctccttttcttctttcttaccttttctcttttttatcctggatgtgctcctgtatggccattctaaatcaactcaggtctgacctttggaaatacgtacagtaataaggaatcctaggggcttcctgctgtatttctgtttttgaatttgattaacatgagctaagaggttgagtagaaagaacttggactttggtgtccaaaagacacgggtatgaattctgactctaccattactggctctgtgactctggacgagttgctttacttctctgactctctagaatctcacctggaacttgaggttaattcctgcttcaaagcgttgttaggaagattgaacaaaataatgtgtgaaggaaaacccagcgagagggatgaagagcagagtgtgctgggctacataggctaaactaagaagtttggattttatttacagtgctctgggaagcagggaagtgacctgatattgtagatattttcaaaaaatcactctgggcctgtggagtgaatggaggacaggagctggagtggaagcagatagcccagctaggaggcaagaacagtggacaagacggctggactagtgtggtcacagagggaacagacggaagcagtgattcttgagaacttttggaggtaaagacactaggagtagctgaagtcttagatgtgaaaaagggagggaaagagaacactcaaacatggatcttaggttgggtcttgagcgcgtgattggtgaggactgtttgacagtgtagcccaggactgtgcatggggatgacacccacaagatgttggctggctggctggattcatgactatctggaggaaagagagaatgcgtgttcttaggccatgttggatgctgaatgcagtgggacagacccggttctatttcttgctttgaagagattgtgttccaattatctgccctgtttagatggcagcttccagaatcaagttggtcagttttgagcaagatctggaaagcaagacaatgtctcaaaagcatcaggacccctgatatccaccttgttaacaccgtagatgacttcggtgccctccctgcagccgtctgctttaattgtcagaacaaagtgaaagcgaactcagagtgggacttgggatgggctttggaactgagcagcattctcaaagctgggtgctgtagtggcatgactattacaggtggggccaggaccccacttccacaaaattcaattggatacatctggtaggaggtgttcacctggaaatctgggtcttaaaccactttgagaaacactgtcctggaggtaagcagcccctgttctggttctttttcttccactttttaaaaaggaaatcagtttggtggcaaaatctccccttcctgtccataattcagactacgacagcaattagaggcaggcagcctcccctccaaggagaaagaaaccctccacgtgttttatgagtatattcctaataatgacaatagcagcaaacaaacaccatagtggtgatttcatactcatgaaattattgtcatggagttagagcctagataaaagtgtttggcaagtctctaaagcatatttcaagagaaaaaggaggccagaatttatagaatctaaaaatagcagttgaagtgcagctgtgtttagcttgtcagagaacctgttgagtcaagatgggcaggggattttatttctctggccctgaggtcatttgtcttgtttaagaaggggcagcaaacatttccaaatagggattgacttttaaggggaggaagatggctaaatgtatatggtatttcttgttttctgctcttactcttcctacctccaaccccattccaaatttcctcttaagaaaaggaaggagagtttgtttttctcagtagagtaagtagtgactgcctaggtggcaggattttggatggtagtggtgatgttacttattgatggcacatttgatgactgttagtccatggagtggtgggggtagactaactatctggtcttagtgggttctgtacaatcccattaagttgaaggaataaacctgtagttggagaaataacagtgtgacttctccaagactgattggctgacttttggaccctctttgtcccatttctagtcaggaattatgtcttctactgttccacaacccacaaaagaagatgtctgttccacttctggcctaagcaatcctcaagcctctatacttaacaacattggaatgtcaccatcttaaaacttgtcaaccagtaggccttcaaacctcctgccctttaatatttattgaaaccttggtggaaatgaattctgtttttggtggagtgcgtgaagttatttccctccattagtttgtaggccagaggttgaaaactagtggcccgcaggctgagtcttcctcaccgtcccactttgcttgcctggcaaagtgttaacctatacaattgccaatattggaaaactgggatactttgtttacaaatctttatttctggattctcctgggttgctctaatatatattcttggtttagatttcttttctggagaggtgtccccagactgctgtgcataggtccttgtcctcccagagtagctcacctgtgggtcatgatgagaaatagccactgtattttatttgaggataataagaaaggggttaaataaattgtatgttgagcacctagaaaacatatgcatgtgcatgatgagcaccctgtaagcattagctattattgctatcatcatcagcatgtttaatgtattttctgttgagggttccattgaggacattgttcatgacataacccaatgtcttatgaggcctcatgaaagacatgtctgtcagatctcagttccagaaaatagctgtccttcttctgaattactggttcatctgtaccttactcatgcccccaatcttatttctatctttgcactagctttgcagaagctcagaggcaactatgtagttcatgtctagcaggaggacttggattcgatttgttgatcccttggtttcacatgccataatttccttgcttctctacttttctcacttattttgttgtgagcattattgtaagcagccttaaatcctgttggaacaaggctgggtgtaaattaaaaaacaaatcaagcatccattcctctgagaggttatataatcactgagaataggcttccacatcaggacaggtttcatgtcttagccttgggactacatgttttctctttcccttctggacactactgacctctcattgtcatgttggacttgattctatcagttgtgctcatgctttcccttgaatctagataacctgtaacttctgttacagaatgagatggcttatttccctgggtagactgactgtattagtcagctattgccacataacaaactgccccacaactccatggcacacatcaagaagcatttatgttctcatggatctgtgggatggttggacagttctgctgcaggtctgcacgttggctggggaagctgttctccatgtctcttatctttctagaaccagttggctactggggcaggttcttctcatggtgatggcaaaaatgcaagaggggcatgcagaaacatgtgagacctcttaaggggtaggctcagaactggcactatcacttctgccctcattccattggccagagcaagtcatgaggcccaatccatcagtagagtggggaaatagagtagaaatagatcagcctctagtgagaggaaccttagagtcaatgacaaagggtaggagtaccaggtggtgggtagggggcagctgataagtaatgcagtctagcctgtaatcccagcactttgggaggccaaggcaggtggatcatgaggtcaagagattgagaccatcctggccaatgcgatgaaaccccatctctactaaaaatacaaaatttatctgggcatggtggcatgtatctgtagtcccagctactcgggaggctgagtcaggagaattgcttgaactcgggagacggaggttgcagtgagccaagactgcgccactgcactccagcctgggcaacagagtgagactccatctcaaataataataatattattattaataataatacagtcgatcacaggcagtgtaattatttgaagaccataaggttgggcatacagcatagagtatctagcccttagtggctatgttggctattctctacttcccctctccagatccattctccaccattatccctcctgctttgtgcccttgggaggctgaccttcccctctgccttttagttgggttcagtcagaggggagcactggaaaaagagggtggaagagtggccagccatagtgaccatggctctctacggaaggccatagcttctgtcaggtggttagttctaataacttaggggttccagtgaccactccccaccttgctccttccgacctagggcattaatggctccctgctttgccacaggggtctcttttaaactgaccccccttactgttgtaaatagtcccttcagtgaattctttttgtctccctggttgaaggaaacatctgcttctggccaggaccatcatggatacagtaggtgctcaataagtgcatggttgattagcaggcctccttgtttttcctctcctctggcctctacatcactaaatggtcacttctcttctagcctgaagagcccatggaatgtcagcttgggaatccctccctctttccccataacttgtccaaccaccatccctctcccaagaacctggcacagtaaattcattagagcgaattcaaataaataaggttttacttttcttctttgggatttcttagcatgcccgttgggacaattagggagggattctttcaagtacaacattttctctagcaattatgggggttttatctcccagatgtgatttatgccatattacactccaagaagggaacatgaagaatgtttgtggctaaaaaagtctcaacacaaggaaactacaggtgaaacgtaacaatagtaattgccttactttatttgcgaaggggtggtgaacactaatatgcctgactccatagagcagtgtatttggttttcttaagcaggaagaagggggcccccccccaattttaatttactgaatgagtttaagaaccatggtgtatttcccaagcttcgctagtgaagatggtattttgttaaaaattgagattcccattgatccagatccagttgggcctgggaatctgttttcaacgtgtatcctgagtcatatttgggaagcactgggctctgcttatgattctcacgttctggtctgtgactgaggagatgtgccatgatgagagtgatgatggtgatggtggcagacaagagcatgtcacatttagaaatactgtaactggttgctgaggttttacatatattccttctgagcttgttttgtctaatattgcctgtgccaacagtattttaccagaattgaatgaaaagaaaggtaccagcagatttttttagatgttctaattgataccagaagcaaagacgtagaaaccgtcatgttataaacatgaaagccccaagcaaacagcctttagcccaccctttgagaaccactacatgacttcttgataagattctttcaactttaccctatgcctggatcatgaaagaggtgtttctagaaagctctgcaaaggactttctctgacagacggctctaggcagggggaagctctgactaactgatctctggagaggaacacagatgttccctcctaaaaaaggacatgctggccttgctttcttacaggtcacgaagtctcttttaggaatgccatttggcatttcaagtttctgcagcagttctgcagaaagccatgcctagaaaatttataattactctgataccagatggctttgcggccttcagtatcaaatgcattgtgattgtgctatgagaattttggggggaaaattccaaactttattaattattgtattggggaaaacatcatgttattgaattttaattagagttgctgggcagcctgggctgccttttaacttacgggtcacctggttattgcctgtgaggctcactgaggaaatgtcttgctggcaaagctgagttcgctcagaatgtggactgttccatttttctgttgtccaacacttgctttgtttgtgacatttagctccttttcttcctttccatcccaaatccacaccctttcttctgtcttttgcaaaatctatgacactgttgaatgaataatataagcccaaggacttggagggatgagagctgtgatgcccacatgttttagtgttggcatgtttccctcatttttggggatgccttgggttgaagctgatttttcagcatccctggtttagcatatgttgcattatgtatctgggaaagtagcatatctattttctcattttgcattacaatagcatctagtaacattcaagcctcaattaattgaaccaataattattatattaaaaatggtatgtatgccccagggcagaggttaggctatggtgggcatttgagaccttagggccatagaccccgaaacatgcattctccagaactgagtatgcaactgtttgctttcgaccttacagcacaggctttgggagaaaacagttacgttcaggtcctaactccagtaatgaatttcaagcttcttgttattgtttttcttcctgaaagacaaagggagttttatgccatggtattttgaggacaatgttgaatcaattgttatcaaatgggaagatttctgaatgctgaatagtttgtaatatccttcaaaaaaccaaaccaagaacccacccacccattcaccatttatctctccatttgtccacccacccattacccacccatccatccattcacccatccatttcaacattcaccagttcctacaaggtactgagtactgcatttatttgctaggggtgcaaaaataaagtctaataataataataaccatcatttattgagaacctactatgtgttgagcagtttccaatcttcaaagcagttttgtgatgtaggaattatgttctccgttttatgagagaacagaagctaatttacttgcctgggtcaccaggcagtcaaggcggagcaggcctgaggcatccttgcaacattagaaccagaacaacatttcattcttttatgttaaacggactctcctgcctggacccaggcccacgttagcatccagagtggcatgcagtggcagaattggagctggaacagccctcatttgttgtcttctctccttgggaaatcttcctgctatcagtgaaaaagggagagggatcagctcttgtttcttggctttgctctttacagcctcttagaaacttgagttctatctggattcatcgtgtcatttgatggtacaggagtacaaatggaggtccacttagcgaatatctaaatatttaaagattacaaatcaaggtaactgttcagtaaactgtgttccatcctaccttgacaaatatacctttataacaacttggaagccctaggttgaattttgatttctcaggcctctcagagtttagtgtagaaatggatggcttggggagagccagcccccagcccacccccccacttccctttccatctgactccatcccgcatggcaatgggccttctgtgcatgcgtgtgtggacacccatccaagcttcgtccaccccctccccacagaggctgcccttggacctcaggtagggtacactcactcatggtgcactttacagtgcaggggacaaaccctggagtagagcccaacatggaccctgaaggaggacttagggctgttggggcagggatttctgttgtcctgggcacacagagcatatctgcaagagggagatgtggagactgaccttggtctcacaaactcattgccccttgcaaagaaataaccaggagggtctcctgagaatggggttcagagtaagggcccctcttgcctgggtcttacccagggtgataccatttctgccaagtcagaggatgaaagggacttcggcggaagccatatgacccacctctgtcattttagggagactgagcatggctggtaaatctcagtgatggctggagccctgggggtccttagtttcccagcaagtgccctgtcctgctcttgcctttctgagcatcatcctcgtggcattctggagcatgaggacccaaggctgggtctgagtggatgactgtagttacgtacacaggctctgctgcagggacaggattacagaagatgtttacacaaagctgtagctttggaaacaggctgtggtgcatatcttagcagccccactgaccagcttggtgatttttgttcaactggagccttggcttcctcgtctagaaattggagataaaatggtatctgtaggtagagttgtgtaggtggaagatgagatgtttgtagaaatcttcatacagcacttggctttcccaaagggaacatcagcgaattgtagccactgtgactggagctgctactattgttcaccaggtgtcctggaccccactgagaagacgctgccattcgttcattcactgattcacccactcaaatattcatagagcacctatcatgtgcaagtactattctggtagcatgggacttaccagtgaacaagagaagcaaaattccatgccatagtggagctaacatcctagcaggtagaggcagagataaaccataaacataattaacatggagatatagaacatatggaatatagagtatggaaacacgaaagctgataagtgctatggaaaaaggtggataagggaaaggggtttggttgacccaaggtgggctgtaattttaaatagggtggttagggtaggcctcatgaaagaggtttttaatcaagaacttgaaggaggtaaggggagagaaccatgtggagggatctgggagaagagcattccaggcagcggaaacagccggtgcaaaggccctgaggcaggagtgcctgttgttccagggacagtcaggaggccagtgtgtctagagcagaatgagggtgtaggtattaagagacgaggtcagagacatgacagaggcctgaccgtgtagggcctagtagaccattgaaaggacttggcttttactcattgcaaagtacggaggggacaaatgacatgaccttctgcatctcctcccacgccttgggcccacaggctgcctctgcactgttagtcctccctgacttcctgccccaggctcactgcccccatccatgttgcacacccctctctacctgcagccgccatcccctaacaggtagaggtgtgccctgggtccactccctcaagtcccagctgcattaccagccaaggatgtgatgcatagtattctggagctcctttttaaaaaggagttacattgctttgggagttcaggacacaggcagcctgggggtgcttgcttcatttctgaaaaagcaggttgtggccaccctttcatgagccttgactctactgggctctccctgctccccatggagcctcatgctgtcctcaggccaccctagccccctgttctcctggctggctttatcccgctgagcagtgggacagaggacaggaagatgagaggaagatattccagagctgggtggagagtcagggtggagtagagctgtgtgagggtgtgcatgagggagccaacaggaaggagggctgggttcttgttctctgaccaattcccagtcatggctctcccatggggtttcacagctcagtccgaagacacattgttcctgtgcatggtgtagccaagcccaaatatttagctacggccacaccagcccttgttctgcttataactgtggtgtagacctcagtccagacaccctccaagagatacccaccctgccccttggcactggcttgggcggccttgtctggtgctggaaggctctcttgggttctttgccaaagttcagatgtccccctttcccactctgtgggtgggccctagtgggggatggatgagggctaaggcatgctttacccctggctcccaggcacagagatgagggtggcctctgggtcagagggcttcctgttgagtcagagcctccagccgatatgcctactgtcccacccctactccacatagatgcagggcaccctgcagctttgtttcaggaggaactctgccagtggaaaccccatgtccttagcgcagccctgggggttatcagggtggctcagatgcaggaagtcctcgcctctgctgtcctgctctgccccaccctgtcctgcagaggggaggccctgcccatgggagagtctgcctccactgggcagtgctggcctggaggaaacttccatgccacccctcctgcccctgggctccagggctctcgatttttggggtaaacagaggtgctgggctctgctgaggataagctttgtgatctgggaaggatccctttctcctcattttttccccacctccttttcatcatgtctgtgtgaaaacgaaagctattgtttatgtaaaaggaccatttgcctaatgtccctggaatttatttgctggagcattttccattttcatattcagtttagaccttggctgaagtagggaggttatgtaactgggatggaacaaatctcattggcatctggggaccctagtgtaccccacccttagccattcctgcagtggactgagtgcccccctggctgtatattcaagtcgcctctgtggctgccagagttggggagctggggagctggagtgatagagaaggagttggcagcatttagaatggagtcaggaggaagatttctctggggggttggattcatagatctgctttggggctgtctcctcctcctcagctgtagacctcgggggtccagactttccttgcacacaaagcctaggcctttcctatcagcctgtctgtggaccttagccaacagcctgagcctcactgcttgagccttggctggattagggaaatgtctctggcactttccttcttggctgtctgtggaacctgtctctacattctaacccatccccagcagcactggccttgagggccatgtttctacccctgattcccagcctgagcgccttgggtttctcctcagaagccttgtctgggtctgcatggaattactttgacaaaggatgggatgtttttctaggttatgagggcctggacatttgcctgcctggggttttaaaagaaggcaaatatatagagtgggttttggagccctgaacttagtcatgggtggataggggtgggctgaggagggggtgcaacctctgccttccctccccacgcccccatattctgagatggtagagaaccctttcattcctccagcctgtctctttcatccctctatggactgagacatctccctttacaccagttttttacttaaacatgcttattagcctccattaagaaaaaggtaaccctgtgtatacctgtattaacacaatgctaactgctgcaacaaaccctcagttttcaattacttgacctactagatgtttgttcattgctcatgtgtcagtcaaataaggctattcctcgttgaaggtagcttcctccacgtggtgattctgggactgcagttgctttccattgctgctgctgcaattccttaggacctccaggatttctgcctcctgggggcaggaggagaaagaagcagtggagaaggcacacccaccccttaaacactccagcctagaaatgacccacatcccttctaccgactttccattggtgggaactagtcacatggccacagccggcctcagaggaggctgggaaatgtgggtccaggctgggcaccaccttgggaatgactccacatatcagtggtaggagatggagaggagggggtgtacttgggaaacggcgaggtcaagtcagcagggtggattgagaatatgtagggggacgaagccaggagtccaaggaccccttgggtttctggtttggagaacagggtggatggtgcctctgaaggcaatggagttaacaggaagatggacgatgctgagagggaaggctcatctgtcaagtgcccagcaggggtgggtgctgtaagaatgttttgtgaatgcaggaatgaggagaaacagtagtgaatgaacttgagtcccttctgccaaccccttgcagctatagtggagaaaaactgtttggtagctgtactccatagcctgaaaccatagcacctgatgaaattggaccaatctgttttcaaatacaaagctagtagttagaataaccagggggaaaaaagcataatcagtagccccatgtctttgcacaggctgccataaaaaaaggtacagttgtttctcagtatgcatgggagattggttccaggattcccaatggataccaaaattcatagatgctcaagtccctgatataaggtggcatcgtatttgtatataacctacatatatcctcctgtatactttaaattatctctagattacttataatacctacaacaatgtcaatgctatgtaaatagttgttatactgtattttgggttttttgttgtattgttatttttattgtttttttcctgaatatttttgatctgtggttggttgaatccatggatgtggaacccatagatacagagggctgactatcccataaattgggtgggttacacaacagaaattaatttgctcacagttttggaggctgaaagcccacaatcaaggtgccagcatagttggtgtgtggtgtgggctctcttcctggcttagagacggccaccttcgtgctatgtcctcacatggcagggagagagagggagaaagctctctagtgtctcttcttatataccatcatgaaggctatgacctcctctaaaccgaattatatcctgaaaggcccatcacagtgggagttagggcttaaaaatgtgaatgtggtgttggaggacacaattcagtccacggcatccagtggcgatgtctccccaggcatagagtcctcttctgtgttgggtattgtctctctaagctgcggggaaagggaaggcagcagattggtgtcctggcccatccacttcaggtgagaaggatgcctgctgtcctcgtgtggacacaacttcctctgctctccttggccttgccttggcctctttgctttaggatatgatgcccagaagggctcgaaactggagtctgaccaggggcaagcaggctgcctcttgctcctccccagaaagggagagccagctgagggtgacaccttgggctgcagccacaggccactttgccactgggctcacccacgctgctgctgccacacgtggggccaagggtgacaaggctgccagggagcctgggatcggagttccagggccatctgagctctgggtcagcagcagtcattggagcagggatctggggaggcttttcacgtgggggttgttgagataggggtctggccccattcctgcctgactggcagtcttcattaatgtacgtttataccaggagcaagtggagctggggaggggactcacatctctgtctgtgggaagcagggcagagtgagggagagtatggcctgctttctagctgatatctccccttgctctcagcaagctcctctgcctcttcctttccttctggtaaagcataaggagaggactcaacagtaaggactaatatttgacagtgaggagcagatagagttttttaggcaggggtcactgttaaggaagtttgtattttttttttaacttccaaataaagcttgaagtgtctgagaggctgcataacagaggtgaagggcacagacttgggagccccatggccaggatttgaatctgaactcttaggcaggtccctgaactgctcagccctcagtttcccatctgtaaatggtgataacagtaccttcctaaggtcattatgaggactaaatgagtaaacattgatacagtgctaacaacgcttaatagagtacttacaacacttcacttaataagtgccatatggtgggtgttaaatatatattttggggaacggggtctcgctatgttgcccaggctagagcgcagtaactattcacaggcacagtcagagcccactacagcctccaactcctgggctcaagcagtcctccttcctcagcttcccaagtagctgggactacaggcatgtaccattgcacccagctaaatttttaaaaattaagtcttgttgaagagtgagtagaaaccagagtggtgataatttctggttctccctagtcatctccctcaagaatttcccagttacttctcctggaagatccgcttccttgttttgttgtttttgtttttgtttttgtttttttttgactttgagacaggatctcactctgacacccaggcgggagtgcagtggtacagtctccgctcactgcagcctcaacagcccaggcccaagtgatcctcccacctcagctttccaggtagctgggcagtgtcagcagctctcctatggccagctccaccaccaggtcagacagtacccttggcaacctgtggaccaggctggggaagaagaaaatctaggaagaaaaggccacacaaggaagaagtgcagatggcaggggattccggtggccagggaccagatgggagtccgaaagctacacagagcaaacaaccaaaattgaaagcaaacagactctgagttgagaaacctgttctccctatccagagcatacaattcagaaaatgccggaacagcataaacactgcaaaacaaatccagctatgtaatccctttattttagtaattagaggtggcactgggaatgctggtaacagtggagtttgactcagatccccttgacctcacttggcttttcctccatgttccaacaacttgttaagtctgcttctccattccattcctttcccggcgtggtgtttgggtttgtaggcaggatggccatgtatgcacaaagaaagctttggggcagtttcctgccacccagtttttatgaacattctctttgccccatgtgtggcagcagaaggcaatccagccctcagcctggaccgccgaccttgtgtgtttgtctccctctgtgcctaggcccgagaggccattagaagccccatttgtgtgtctcagcatggcaggaaggtcaaaccgctgcttcctggttggaaatggtttcttcattgattcatcaggtcagtcaagcatttactgagcacccactggagccagcattgtgcaaggtgctaggaatacagtgatgaggaaaagcagacatagaccttacccttctgaaagttccactaaaaatcaaataactgtgaacaaatgtccccttcctgctgtgatacctgccataaagaaacatgttactattaaagtataaccagatactcacatgtgacattctcttgttggttttccctgagtgcaaaagaggtggtgagtctttctaaatcctgagtcaagatgcttgaccacttattaggacttggacccttagttttggacccttagttttggacccttagtcccttatcaacatcgaaggtacagaaggattgacatcagagaggcccaggaagtttgacattggagagaggcgtttttggagaaggctgatgggctggggggtgttttccgacctgagccccttggaggagagaaaagggtgttcttcctccagcccagagaaaggaggagaccagacaggtctagctcctgagagctagcctgactttcttccagagtcttggagagcacaaagatgtgtgttgatgtacagcttaaaggggagttaatggagccctgagaatgtcctgctcccccggaggaggacatatgagtgcatctcagggtgaaagctggctaggagctatttaaaaggggttgtaccttaggtgaccctagggagaggtgatgggaccatacccaaaacacaaggggtctggggccagcggaggagaccttgttccctcttgggagttgcaggggagtgtcccaatgctcaggaagctccagggaaccttcagtgtgcctgaaaaaaagtcaacctggaatacccaccaagctaagggaggtcagcgtgcaatgccacaaagccacagaagtctctagagcgactcagctttaaacagctgccatggccagagaaaagccaacacccaaagacaccagttccaactaggtgtggcttctcctcccctcctctcctcccctcaaaaggtgttctaagcagctgctgggaaagggggtgagaggaagtgactgcagcttttttatctcccacttcccaccctctagcaaccttcaaagcctgaagtagggccaagttggaagaggcgaggaagtttaactttaaatgaaatttggagtttttcactaatacgcaggactggtcattttgatactgaatgggattattctggagattaaagcaatggaaagacttttcatgatctaagagtgatccaagagatagtgggacctgctcaaggtttcatccaggaggccagggagaaagggccaacctcagtatctaagggttaagggtgtgcaagagagtgcaatcagtattgcatttcagcagatcagccaagctgcaggataggtgacagatatgaaacgataaatgtggaggcagggagaccaggtaagaagtctgcggtggtctaatggtggaggtgaagagaagagggcaggctgcagaaaaggcaggatacgaggtagaactcccacagtttcctcatctctattgtacatagtaatcagggtctaacatagcttccctttcccacctacgacctatgaggtgcacctgtccgtagtaagtactcagtaaatgactggtgaatgaatgtgttttaaataaggtatatagtgagaaaagtgagcattggagtctatttcagttatgtgttacaataataatgctgcagaacaaactcaaaacctcagtggcatataatacaaagcatatagtttgtgcagctgggattagcagtggcttggctagctggctctgctgatttgggcagggcttgttcatatagctaggggtcagctagctgttggttatctagactggcattggctggggtgactggggcaactcagcaccgctccatgcatatctcactgtccaacaggccagcctgggcatattcacgtggagactgagaagcacgagaaggcagaattgggcccttgataagatcatcctaacacagaggcagatgtagatttgaaccctatttgcaacagtcactaatcatgtgatcttcggtgatttattttacactttgtggcttaatgtctttatctgtaaaatggggctaggaaaatttatctcactgggtagtcaggattacataagagtaataacatctcattcccactataccatcctgagagggtaaataattctgcctatgacgcaggtatagaaataaaaaagactatgaaaagattaaaaagagctcaaatgaagggaagataattctaggcagaagaaagagcatgttcaaaggctgtgtgagtgaagaggtgggagagtgtgctgaaaggtgggcagaagcctctctgccctgggggaggggatggtgccagggagctctaattgtattttgctggcactggggagccatggaaatttctgtaggaagggagagatttattttattccacaaacatttatttggcacctatgatgtgcaaggtattctttaagatgcttgggagacagtagtgattaatcaatgtccagtgggagagtcaggggggtcaggaagatcttggcacagaatgaggtcagagtgagagaggtcaagattggctggccaggggtattagccctgagatacactgctgctctatgggattttgcccctcattcacaagcagagggcctacccttaggccccaagtgtgtcaagccccctctgcttacaaaactttatttttcacaaccaaaggtggttcataatggtgggctgaggaggaagcaactgaagtaggggaagctcagaagtctctgagggtccttcccaccaggaatctccccacttgaacctaaggctgggacactttggcatgtgtgttttaaaggatccgtgggtttgtggggagggctgcaccagtgaccagttaagcccagtgggtgatgcctttcctttgttacttttcatgcagacatctggaaagaatttgtcaagaattataataaagaataccacggaatgaaagcaaatgtggtgagaagcagagttgccttaagactgagaagccagcaggaatggctgctgctaagaacctcattcttataggaaggattcagttctttccctgagcaacagaagtgcataggtgcacggcatagtgtgtcagttagcatttgctgagtaacaaaccttcctcaaatttaatggcttaacacaacagccatttattattgtgtataagtctctgggttagctggatagttctgctgatctgggtggggcgtggctgattttggctgggctcactcatgtgttagggttcagcttgcaggctggctggaggctggctcagtcagatgttttagagttggctgaggtgacagtgtggctgggccaatgcctatcatcatccagcaggctggcctgggcttgtttacatggttaggaggttctacaagtgagagtggaagtaggcaaggccttttgaggcatgggcttcagaagtggcatgatgtcatttcttacacattctcttggccaaagtaagttcaagggatgggaaaatagcctcttcctgatgatgggaggagctactgtatcatcttttcatgacacatatgtagggacaggtagaacattgtggtcatatgcagtggactgagcccatgggctttggagtcacatggggctctcaagccatgattctttacttaaccttcatctataaaatgaaaacactgatagaatctatctcacaagatcattttgaggtaaatgcacatgtacctaatgcatagtaaattctcagtagaaaataacattttatgtattttgcatgtttctcataaactgattgtgcattctaattatttagtttggaaaatgtagtctctgtaggtttacccttccctgaggcagtaggggagatcatcacctctgtaatggtataatatgaactcaggagttgagattcgtaaagcagtaaggaatgcatagtcagctatactggaaatttgggaaagggaaatggactatgtgggaaagcgggactcttatccttgcagaagtcactatgaaatgaggctttcagtaaacagaagatgggcatttcatcctttctcattactgagccttcctcaagacctccttaacatcctaacattataaatacaataattttagaaattacttagtcaataaaaaataagcacttattgtatacgagactctgttctaggagccagagatacagaggaataaggaattaaggtatttctcccatattcaaggacttcagtttcattacctgtccagaaaactatgagaaccacccatcacctctggttatagattcttaagtgggatgtcaagccccttccctaatgatctcagtttaacctgctgtcctattcctctgtggcctattcctgtgctacactcgagccaaggtggcctcttccctagccccacacatactctttgtttttccattcttccaagcaggcccggagaaggaatgggctccacgatgcagggcccgcggtagagaacagccaggcagagcagggggcctggctggatgtggccagcatctgcaggggttcagcattgagatatgacactgtcacctccatctcaagaagcccttacggatgcctcccttcccttcatgactcactgtgatctacaactcctcagagccagccttaaagtggtctgtggatcagtctcatctccccactggagctccatgggcagaaagcactctttctcttctgcctacaacatcctcctcccatcggtatgcaccccttcctaggagccccacaggcaatgacaggaacccccaaccccatgtgtgcacatatacacattcccacatgtgtggggaatgagaggctacatagcctgctccatcctcttcttttaacctgcaattactgggtgaaaagagtaggatatagtaaaatgcaaatgctagtttagtaaatggcataaagacattgaagtgtccctggacatcagtcacgtggctgtggaagggagacttagggtgtggctttccccatggaccatggtgggtctttgggatccctctcttccccaccccagtcctttaaagacccaccagcgactttgtgagattctagactcctttccctcgtacctcctagccttattggatggaaaagagggaacagtggttcctttctttctgccacgcctccaccttccattggagactcctatttctccctccgtgacatctttgctgaacagaacagctcttaaaccagaccttatctgttccatgggtgcagaagggtgcaatgtgaacagaaacagcaagtctctggaaaagagctccttcagctgcaaagaacacagaggtcaggaggaataaagctaatgagagagcagagagtcctttgtctccccaggtgttattcccagagggcaactagggaaaatggagatggggtataaacatctgaattcactgttaaacactccatgaactgttgataattccctagaagcagcatattcctgaggtagcttcatatgatctccagaagcaacttacatgtagacatttttctgagaattccagaaagaatattgataattttcagacaccatggcttccacgcctcatcaacatgagcagtattagtctttatctctgacatcaatcaaacttgaacaccatcagcatgggctttaatgaaattctcacatatgtatcagaacttgtattttttcctttagtcagtgtcttgatccatttgtgttgctgtaaaggagtacctgaggctgggtaatttataaagaaaagatgtgtattcggctcatggttctgcagggtgtacaagaagcatgatgccaggcatccgctttgggtgagggcgtcaggctgattctactcatggtggaaggagaaggggagccatcgtgtggagatcacatggtgagagaggaagcaagcggggagtggaggtgccaggctctttttaacaaccagctgttgtaggagcacagtgagaactgactcactacctagagaatggcaccaagccattcacaatggatccgtccccatgacccaagcacctcccatcagacccacctccaacactggagatcagatttcagagtgagacttggtggggccaaacaaatcatattcaaaccatagcaattagaatcttaaaatcaaaattgatggctttatttttctaaaaatgggaaaatatctccaaaacattgttcaaaaacaaaacaaaacaaaacaaaaatgtttgttcttatatcccatcagtttattcaactaacattcactgtggactttttataaggcagtaactgttttatgaataggagatataaaactgggtgaaacagtgaggttcctggccactgtattgtaataatagaggcacatataccaaagagctaaaatacaggcagcaaactctagggactgaagtaaatttccttaatttaatgaaatgtatcaagcagaaacccacaataagcatcatacttaaaggattcatttgaatttttttatttatttttattaaatcagatatacttttctagtttttttaatttttattttttgcatttcttgatcatttcaaagtgaggtcagttacagagtgaatgggttcatcctgtcattgtaaataacagtttttcgtttaataatggcattttgtattaccaagaccttgcttcacattaggtgttttgtatacattatctcatttaatcaaaaccagcactctatatcatgggtgccaccattcctctgatttttgctaaggaggaaactgaggttcaaaaagggtaaataagttgtccaagaccacacagccattgtttggcagagctggggcaaaggtctatactgctgcaaagcttgtgatttttggctactaccctctaatgttctgtgagggtggaacacctaacctagaatttccctgtggatcactcacccccaatgatggcatgtcttgctctggacccatgatataatgatctggatacagccaaagtcactaagcacgctacaccctagcctttcaattcctttattacttcatggagaatcatgtatttcagccactcaagtatctttaaggtctaggccttatcgaatggggtttagtcactcagtacagtctgccctttgtactcatgagttcagcattcatggatttgaagaactgtggggtgaaaatattccaaaaaaatggatggttgcatctgtactgaacatatacagacttttttcaatatttcctaaacaataaagtatagcaatgatttacatattatttacattgtattgggtattataagtaatctagagattaaagtatataggaggatgtgtgtatgttatatgcaaattctacaccattttacatcaaggacttgtgtgttcttggggtttggtgtcagggtggtcctggaaccagttccccatggacattgaggaatgactgtgcttcccctacccaacagaagtggttctcccgtcaggttataatagggaagggatgtgtgatctttcctgagaactgaggcatgctattaagctttaaatggagcatctctaagtttccttaccaaaaagtaatcagacaaagggccatgtggcaagagctcttgcttcaccaaacacgtagtgatggacccccctatacccagtgtgccagacatcatcatgagatgtaactcctttcacatatctcttcccttgccagaggaaggaactgaggctcagaaaggttcaattcctcacccaaaggtttccaacccaaggtttctgacctggagccctgctctttcctccacaccctgctgccattattttgtcttgttgggctggggaagggcaaagagggtgcccactgctggatgaaagaagcagctacattcccattcaaggtgtgctgagcccagtcctaactgctcaagtctttcttaggtcttatgatggaactgaaaagcaggctacctattttatccaggaagcagacagaggatacggatgggcaagcacttctatcagatgctggttctgttgtaagacatcatcaaggttcctccaacccctgctcctcatcacactgcacagccctttggcagagacagggagaagcttgttgtttgagacatctggagttagaaagtatctgagctttaaatggagaaggagtggggagaaactgacagtgaagtgtagacatgaggcttagagagatgctaactaagtagtcatgagtcgaatctcccatttagtcagacacatttttctagtttttctagttttctacccttcaaaatactttgtgttaaactcaattacagagatagatccttccattcatcaagtgaattttagaagccacacctttgggtgggtcttaaaagcagttcatgggaatctataggctattgtgtataactggagggtagcagaaaacaagttccttgtgagatcagacacatgagctaaacatttaggaaaaccttacagaagcaaatctttaacggaagggtttccacactgagggccttgtgttgcttttgggaatggtgtagaaatcacgtgcttagtcttgaattatgattcacctttactgaatgtcccttctcttttctttactcactgtcgaacaggaacccaaaggatgtagtttttggcagatgtcctttgtagggttcagtatttctcactcacccctttaagaccctaaagggagagttattaatagtttcagaaagttgagggaaatcatgcagaggttctcagatgttcagagaggcttcctctccccttccatgaaagttctaaggctcatgggtgaggcctaagaaaggcatgtcagttgtctatcaagttcattagtttattcagcttatttctgaagcttttgatgggccggctattcagaggtcaatgaaatagacatgagtactcttcacagaccttaccgtctaataggaatgatagcaagtgaatgtataataaataaataattaggggttgattgttacgagtgctatgaggggaatagccagggtgacatgtttgagaaggggtcagtactgctaagtgttggtcagggaagcattgcaggcagagggaacagcaaatgcccatggtttggaggcaggaatggtgttccaagagtagtagggagcctcgggactagagtttggaggatgagcggggagagtgggaggagatagtgggaaagtctgtggagccagttccctgaggggcctggtgggccatgctcagtgggggtttcatttgacgagccatgggaaggcttccagcaatgggggatgtggttttacttgtaccttaagaagatcacactgggtcttgtttggagaatggacaggaaaggagcaggagagcaagcagagagtctgaggggcaagaaatgccctgtcctcccagcagactggagcgaattctaattctgcctctgctacttcattcctatgcaactttgggcaggtttcctaatctctctgcctctcaactgttcacccctcataaaatgaggacaagtattttctcatgtggtttctaggacaaataagtattcgtaaagtcctctataaacttgggccatatgcttatctgagctataatatgattcatattgaaaggagggggactcctgcaatgttgggaaaacgactcagctgcccctatataaggaatatgttattacagtccgagactaaaaagatgcttttgtttctttactgccatcagtgtctctctaagggagggcggctggttaaaaatcacatggtgtgggcatttataggggtaataacttgaaatgattaaaccctttttttttaaagcttcatgtctctgttctccatctgtaggtggtgcatgagtatgatatagtgtgcatgtgtgacatgctgcgagtgtgaggaatgccagagggagacccacgaaactgccctgcaggcagaaggccacatgctctcagcaccagtcagtggtgctcgctagtccggcagattgctgtattcttgcaccctgtaccacaacattgttaggataaagtttcataagtcttatatggctttgaacaaagcaagtctatttttcatcatagtatgggttatttagaattcatatgttatgaggaaatacactgtttcaaatgcagttttctttgtggtgtctcagcagatactgagttttgctgccctgtcatccaagagggcctcaaggtgcccagagagaccaactgaaaaatgttcactggaacggagctgcaatggtggaaacgttctgtgtgtgccctgttcagtacagcagccactgcgcggctgctgagcccttgaattgtggctatcagggtagaagaactgatttttaatatattgaattatgagtcatttaaatttaaagagcacagctgtattggacagcacagctgtagaaggatgttttctctcatggaaaaccccaactctgagccccaggggtcctatggatccatgagctcacagactcccctaacgtccatgaagatcatcaccaggatttgagggaatgctgtggtgcatactttgtgttggacagttatgggggattgcttttgccgtctcagcatttcaccgctgtcctcggtatgagattatggtgatgttgaatgggggtcattagaaggctgtccacagaggggatcagcccccctcaatgaccactactccgagcatgggctttcttctgtttgatctcgttgggccctcagctgtgactgtggagaacagcaagtcctcagtgagagtatttgtcacttcctactcttggtgtttaatatcatccctctggcacagatgcttgaaaatcaatggtttcttgacacatcttggcttgtgtgaggggccataacaatagcagggctcatggctcctttttttttttttttttttttttaaagagatagggttttactctgtcacccaggcaggcaggggtgcaatagagtgatcatagttcactgtaacctcgaactccaggtctcaagggatcctcctgcctcagtctcctgagtaactggatctatacacatgtgcccccgtacctggctaatgtggcttcctttatgttcagcaaggaactctcagtgtttgtccatttccttaggaacatgagtgtttttggaaggcctttgatgagtggcagttgggtggatggatgagctaatacatccatcatcctatctcaggaggatgcttggatttgtgtttagaaattgggtaactcagttgttcatggaggaaaaagttgaacattactcaagtgcagatagggaaacagtgtaagaacaaaaaactttttttctatctacaagtgaggaaaaaaatattgacagtgtgcccaagcttcatggtaggatgggtgttaattgggaatggcatgtaattctcttctggaatccagtgtctgggcaagtcctgcctctcagattaaggcaccagcattcagcataagagggtcctgcctctcagattaaggcaccagcattcagcataagagggagtaattgacattctacatggcaaaagacccttgaaagataacagatgaatgtctcatggccagtagcttggtttttttgcatggtgtagatttagaatataacttttacagggaagaaaggggttaaaatgtctggtgccatctgtcacagtaatgagttgtgcaaagcccaatgaaccttgtagaaacaacatcgtgcccagaaatagcctagacctcagagtgacatcagggggcagggacctgatagatgtggtcctgcaaaaggaccgaaggttcttctttaacaattcaaattgaataggaaccatttttaatttgggggtaactccgtcttcaccattaatggccattcttcaaagctactttcattcctgtgagggatggccagacacgagaaagccaagcagggattttcagttacaggtgagcatccgatctgcagccagggctttttctaccgggcacatctttgtgcgcagcctggtttgagctgatctgcacataaacaggcactctgggtgtggatgggggcatctgtgtactctttatggctatatttccagaatatgcttttaaagactgtggtcacatttaccttggttagggaagatagtgacttataaaaacctcaaacatttatgtttccctttccaatataaaaagtgttaataatttacccacttaaaaggttaagatcaaagagatcataaacacacatgaatactatttcaggaacataaaattcagctatttctactaacagaaagtgagtttatgggataccaatgcaaacaaacatagatttagtggaaaatgactcaaccaagtaagatttacaaaacaaacaaaactgttttcatcatctttggttgtagttttataaagaatgctggttcatggactccagacacttcattgaaactgtgtgaatcattttaaacaggtttgtccttgggccccagatagtacattggcatttgtgaatcattttagatgagtttgtcctcagtacaaatcgtgctgtgtttaaagttcttggagacacttctctcttccaataaaaggcttttactagatgtttcagtgacataaagttgaagacataaatactgttttatattgtaagcaggaccaactcttttatggtgtgttttatacgtctagaggatttttgttgttgttgtttctttgaggttttctctgaaacttcagattaaggtagtccttgaagtggaggctattaagacctagtgttatctgtttcagggaggtgggggactaggtggactgatggaccccagaactccagattccttgcactggaagctggtgttttgtgtttggaagagcctctgccctctgtgtcatgctgcagtaaagtatgggtcaacatccccaaaatgtgtgactcgcccaaattaagtggtgtcatactctgatccttcttccactgaacatcacattcttcatgagaatcacaccattgtcctctgtctgccctgcctgtgagacgggccatgctctatgcttgcccgcctcttccatcaggaacactcacacagtcattctcctcacataccccactctcatctgctgcccctcacacctgcccttctatagaatgttctaccctttaatagggaagggtttcttcttcctatgaatttttacctcactttgtgtctttttaggtttgtattggaactatttgcaaacaggtcttggcttatctaaagaaaaattgtaagctccccatgacgcaagacagtatcttatttacctttgaaaacctcatcacactctgccctgctcagagtacaatctaaataaaagtctattgaatgactgaagtagagtttcttttttaacacttatatgcacattcttgtgacaggcacagtgaaagatttatcaaggaatgacatggtccccacccatgacactgttaaatccataatttgtgatgcattgtttttagttatctagtgctgctgaacaaaccactccaaacttaatgatgtaaaacaacagcaattttatcatgctcacagacattgtgggcaaggaattcgggacagggcacattggggatggctggtctctgctccatgatgcctaggacctcagctgggagagacttgaacagttgggggctggtgaatccatgtctaagcttcttcattcacatgcctgtcaccttggcagcatggcctagaagcctgggcttagctgggcctgagacccccagcattctcttcaaggttggggaattggaccctacatttgatgggagaattagccagttcatgttgcagaagagcatgtggagtcggagatactttacaagcatctatggaaaatacagtctgaagtgaatgcccaaatgagtggcaccaacactgattattactgggtgacagaggcacatggagaaaatgtcatgagggaggaaatgctgggatttgccttgacctctggctgggggacggggagggatgagaggtccaaggcaagatggataagtgggaataagcagccttgttttggggaaaaagagggacagacctagaatggctggctgggtgaaatggcttgttgtgtctcctaaattagattttacatttttgagggcagagctacttaatattgtatttaccccagaggaagattatttttttcattctctaaattgtttaattaaaactcatagttcatgttaaatttgttcaaactttccatctaatggtgaggtggtaaaggaaataaaacttaccaaaatagaagagggagaaatgaaaaggaaatatgatcaatgatttctgttctttttacttcctacttgcaaagactctggaaatgtaatgatggttcagagtgttctgctataaatcctaacagcttaaacaatctcctgggatcatattggcaaactctaagatgatacaagtatagacttagtttgtctgagcccgaggttcagtgtttggagaaaaataatacctatgtcgagataatatcagataacctataaaagcaggtagcccagtcatgcacattggtgatcaatcaatgttagctgaatccaaatattacgagtgcagatgctgaaaggaacaaaaggaaatctcactcagtcatccatctgccagtatttccaccctttcccgcaaagaggagctcagtgtctgtctctgttattgcatcaggatctcacattatccagtaaacccaaatgctgtaggtaagagatgtaataggtggtatttattaagtggttttaataaagttttgtggataggtatgacaccatttcttttgagcttaaagatgcttaaaatagctaaggttaaaaatgagggaagatctgaaaagaaaaacagtaaagagatgtgagatgtaaacactgaaaggaagtaagggtagagcaaaaaaaaagtaaagcatcaggtaaatatttaataaaatgtttatacatgtatattgactgtaggtgtagggttagtctattgaataaagctgcctttcttaggaatggtggtctcaaaatgcaccagtgccttcctattggctgaatgtccacttctgttctatgcactgtgctaaagggtggacatgctgagatgagtgtgagtggcctctgcaccaaagagttcagtctaattctgggggttggggataaatatgttagccagtaaatgccatttattgctttagatgtcatctcagaaggataaggagcagtggggacaggaggagcaagccatctcctgggggagtcaagaaagatgaggacagagagagaatgtcccttggatccaatatggtggccattagtgaccttgttaaaaccagtaggaatggggtggcaagaaggagagtagaacagactataagaaagaatgagttttgatgaaagtattggaattttgatgaccttttttattacaggtttgggagcaactactttcttcactctctaaactgcaaatcattcagggtaattgtgctggttcagttagcccccaagctgagaagacaggcccactgtggtttgagtaacttggaaatcttgtggggtcagtgttttgactctcttcattttggtcatggttcaggattttcacacaccactaaggtctaggggaagcttctcagctttctggataccctctcagggctcatgaagtggcaggcctgccctgggaaggtcaggattcttctgtaaaagcagagaacactgcatggagcccagagagcccactctctgcgctcttcccttcctatgggctcacacggggaaacagatgctttcctataactctgagcactgaagcagctttgctctgccttggccgaaacatctatccaggaccaaattcttaaaaccccaggggccctggggtgattttcagcccaggccctgaacctgtcataaaatgtaatggatgatatatttttaactgctgagaccagagagttcacataacctatgaagactgaaacaacataatgtttctgcagttttgaagcatttcaaaaaccagaggatggtctctctcattaggcattactagtaagacaaaagttcttaaccatttctgtgcgtggacgcctttggccgttgggaagcgcacgtggatcctttctcagaatatgcttttacatacatagaataaaatacatagaattacaaagaaattcagttatactgaaatggagttatcaaaatttttaaagaccactttatgatataataatataccagctttttcttgatgcatgaaataagaagatctacagacattttgagtactgttaagcataaacaatatttcaaggtgtctacaactataatatagtgtgtaatatctcagatttctatcgacggtagagtcacaggtctttctaatacttttgtggtttgatgcctacattttataatggaaggaaatgctaaatttcagttagaggttaataaaaataaagaaggaaaattcttttcctctatctaaatccacagatgccctgaattctcttcgaggttaagaacttctggtttaagatatgcttttggttgacagtagtaaaacaagccaaaagaagttgaccatttatgtgatgtgcagtaataaattagcaattcagagttgaggagctcattactaatctgtggatagtcctaatcccagcccttttctttctgagctttgccttttgtaaatctcagtgcttcacacacatcagacaaagatattttgtgagtggctctaaaaatgggggcaaaacatgaccctgaggaggcctggggctgatctgagccttaagacttatttgtggagaccttgtgctgttctttttttttttttttaattatactttaagttttagggtacatgtgcacaacgtgcaggtttgttacatatgtattcatgtgccatgttggtgtgctgcacccattaactcgtcatttatcattaagtatatctcctaatgctatccctcccccagccccccaccccacaacagtccccagtatgtgatgttccccttcctgtgtccatgtgttctcattgttcaattcccacatatgagtgagaacatgcggtgtttggttttttgtccttgcgatagtttgctgagaatgatggttttcagcttcatccatgtccctacaaaggacatgaagtcatcattttttatggctgcatagtattccatggtgtatatgtgtcacattttcttaatccagtctatcattgttggacatttgggttggttccaagtctttgctattgtgaatagtgccacaataaacatacgtgtgcatgtgtctttatagcaacatgatttataatcctttgggtatatacccagtaatgggatggctgggtcaaatggtatttctagttctagatctgtgaggaatcaccacactgacttccacaatggttgaactagtttacaatcccaccaacagtgtaaaagtgttcttatctctccacatcctctccagcacctgttgtttcctgactttttaatgatcaccattctaactggtgtgagatggtatctcattgtggttttgatttgcatttctctgatggccactgatgatgagcattgtttcatgtgtcttttggctgcataaatgtcttcttttgagaagtgtctgttgatatcctttgcccacttgttgatggggttgtttgttttcttcttgtaaatttgtttgagttcattgtagattctggatattagccctttgtcagatgagtagattgcaaaaattttctcccattctgtaggttgcctgttcactctgatggtagtttcttttgctgtgcagaagctctttagttcaattagatcccatttgtcaattttggctgttgttgccattgcttttggtgttttagacatgaagtccttgcccatgcctatgtcctgaatggtgttgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgttttcgtcaggtttgtcaaagatcagatagttgtagatatgcggcattatttctgagggctctgttctgttccattgatctatatctctgtttcggtaccagtaccatgctgtttggttactgtagccttgtagtatagtttgaagtcaggtagcgtgatgcctccggttttgttcttttggcttaggattgacttggcgatgcgggctcttttttggttccatatgaacttgaaagtagtttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaggaggtccttcacatcccttgtaagttggattcctaggtattttattctctttgaagcaattgtgaatgggagttcactcatgatttggctctctgtttgtctgttattggtgtataagaatgcttgtgatttttgcacattgattttgcatcctgagactttgctgaagttgcttatcagcttaaggagattttgggctgagatgatggagttttctagatatacaatcatgtcatctgcaaacagggacaatttgacttcctcttttcctaattgaataccctttatttccttctcctgcctgattgccctggccagaacttccaacactatgttgaataggagtggtgggagagggcatccctgtgttgtgccagttttcaaagggaatgcttccagtttttgcccattcagtatgatattggctgtgcgtttgtcatagatagctcttgttattttgagataggtcccatcaatacctaatccattgagagtttttagcatgaagcattgttgaattttgtcaaaggccttttctgcatctattgagataatcatgtggtttttgtcgctggttctgtttatatgctggattatgtttattgatttgcgtatgttgaaccagccttgcatcccagggatgaagcccacttgatcatggtggataaggcttttgatgtgctgctggattcggtttgccagtattttattgaggatttttacatcgatgttcatcagggatactggtctaaaattctcttttttggttgtgtctctgccaggctttggtatcaggatgatgctggcctcataaaatgaattgggaggattccctctttttctgttgattggaatagtttcagaaggaatggtcccagctcctccttgtacctctggtagaattcggctgtgaatccatctggtcctggatgttgtttggttggtaagctattaattgttgcctcaatttcagagcctgttattggtctattcagagattcaacttcttcctggtttagtcttgggagggtgtatgtgtcgaggaatgtatccatttcttctagattttctagtttatttgcgtagaggtgtttatagtattctctgatggtagtttgtatttctgtgggatcggtggtgatatcccctttatcattttttattgtgtctatttgattcttctctcttttcttcattagtcttgctagcggtctatcaattttgttgatcttttcaaaaaaacagctcctggattcattgatttttttgaagggtttttgtgtctctgtttccttcagttctgctctgatcttggttatttcttgccttctgctagcttttgaatgtgtttgctcttgcttctctagttcttttaattgtgatgttaggttgtcaattttagatctttcctgctttctcttgtgggcatttagtgctgtaaatttccctctacacactgctttgaattgtgtcccagagattctggtatgttgtgtctttgttctcattggtttcaaagaacatctttatttctgccttcattttgttatgtacccagtagtcattcaggagcaggttgttcagtttccatgtagttgagcggttttgagtgaatttcttaatcctgagttctagtttgattgcactgtggtctgagagacagcttgttataatttctgttcttttacatttgctgaggagagctttacttccaactatgtggtcagttttggaacaggtgtggtgtggtgctgaaaagaatgtatattctgttgatttggggtggagagttctgtagatgtctattaggtccacttggtgcagagctgagttcaattcctggatatctttgttaactttctgtctcgttgatctgtctaatgttgacagtggggtgttaaagtctcccattatattgtgtgggagtctgagtctctttgtaggtcactaagggcttgctttatgaatctgggtgctcctgtattgggtgcatatatatttaggatagttagctcttcttgttgaattgatccctttaccattatgtaatggccttctttgtctcttctgatctttgttggtttaaagtctgttttatcagagactaggattgcaacccctgccattttttgttttccgtttgcttggtagatcttcctccatccctttattttgagcctatgtgtgtctctgcacgtgagatgggtctgctgaatacagcacactgatgggtcttgactctttatccaatttgccagtctgtcttttaattggagcatttagcccatttacatttaaggttaatattgttatgtgtgaatttgatcctgtcattaggatgttagctggttattttgctcattagttgatgcagtttcttcctagccttgatggtctttacaatttggcatgtttttgcagtggctggtaatggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgcaaattcttttctttaagaatgttgaatattggcccccactcccatctggcttgtagggtttctgctgagagatccactgttagtctgatgggcttccctttgtgggtaacccgacctttctctctggctgcccttaacattttttccttcatttcagctttggtgaatctgacaattatgtgtcttagagttgctcttctcgaggagtatctttgtggcattctctgtatttcctgaatttgaatgttggcctgccttgctagactggggaagttctcctggataatatcctgcagagtgttttccaacttggttccattttccccgccactttcaggtacaccaatcagacgtagatttggtcttttcacatagtcccatatttcttggaggctttgttcgtttctttttattcttttttctctaaacttctcttcttgcttcatttcattcatttgatcttccttcactgatatcctttcttctagttgatcgaattggctactgaggcttgggcattcgtcacgtagttctcgtgccatggttttcagctccatcaggtcttttaaggacttctctgcattggttattctagttagccattcatctaatttttttcaaggtttttaacttctttgccatgggttcaaacttcctcctttagctcagagtagtttgatcgtctgaagccttcttctctgaactcatcaaagtcattctccatccagctttgttccgttgctggtgaggagctgcgttcctttggaggaggagaggcactctcatttttagagtttccagtttttctgctctgttttttccccatctttgtggttttatgtacctttggtctttgatgatggtgatgtacagatggggttttggtgtggatgtgctttctgtttgttaggtttccttctaacagtcaggaccctcagctgcaggtctgttggagtttgccagaggtccactccagaccctgtttgcctgggtatcagcagcggagctnnnnnnnnnnnnnnnnnnnnaacagtggatattggtgaacagcaaatgtagctgcctgatcattcctctggaagttttgtctcagaggagtacctggccgtgtgaggtgtcagtctgcccctactcggggatgcctcccagttaggctactcgggggccagggacccacttgaggaggcagtctgtccattctcagatctcaagctgcctgctgggagaaccactactctcttcaaagctgtcagacagggacatttaagtctgcagaggtttctgctgccttttgtttggctatcccctacccccagaggtggagtctacagaggcaggcagacctccttgagctccggtaggctccactcagttcgagcttctcagccactttgttaacctactcaagccttggcgatggtgggcgcccctcccccagccttgctgctgccttgcagtttgatctcagactgctgtgctagcaatgagcaaggctccgtgggcgtaggactctccgagctaggcacgggatataatctcctcgtgtgctgtttgctaagactgttggaaaagcgcagtattagggtaggagtgacccgattttccaggtgccatctgtcacccctttctttgactaggaaagggaatgccctgaccccttgtgcttcccaggtgaggtgatgcctcgccctgcttcggctcacgcttggtgtgctgcacccactgtcctgcacccactgtctgacactccccagtgaggtgaacccagtacctcagttggaaatgcagaaatcgcccgtcttctgtgtcactcatgctgggagcagtagactggagctgttcctatttggccgtcttcgctgttatttttaagaataaattttaaaaggacaaagtaaaactccaagttgaacttaatggcaaggaagtgtcaaaatgagactctgcatgtaactccccatgcctctccactactgatatggatctgcctggtccacatcatcctggagtgctagggtgaccctagcactgtatccagctcttctcacctctttaggaattttaagcccacaaattaagtatggaatttattacatggtatcttgcatttcagaagcagaatctgagatggggatttttgccagagatttattgggggagtgctctcagaagtgaggaaaacagaaagggacagagaaaaaaatgttgagtaaggatgtggtctcaggaaaagtctagcctcagcctgatcccgtgcagaagctctggagcagagcttatcccacccagcagcaagggggatggggtgttatcctgctgcatctgccagctagggaatggggcaggtattagttttctaggccacttcaaaaattacaaatttagcagcttaaaacagcataaagttactatctcacagtttttgtcagttaggagtctgagcatggcctgcttagcgtttcacaaggccgtactcaaggtgccagccagatcttttatgcggcttggggtcttgctccaggctctcatggccgttgctggaattcactcctgcagctgtggagcccagggtgacttgcttcttcaagactagcagaagactctttttgctgcttctagtctcttagctcagccttccagtctcttagctcagccttccagtctcttagctcactgctctccaaggattcttgacacttgcactccaacccactctgggtcagaagctattcctccctgtgaaaggggtcacttgagtaggccaattcacgccatcctttctgattcactcaattgagctgattcagaactttaattacatctgcaaactcccctcacctttgccatttaatgtaacatcacaggagtgagaaccatcatatgtccagtccttcctaccctcaaagggagaagattatacaggggcatgggtcactggcatcattttaggattctgcctgtcacagggcgtcacttgcaggcttcgctggaggagatggctcctgtcacccaagggcagttctcctgagaaagttgtgggcataagcaatgcatgtagcggctagggcactgaggtcccgtgacctggttccagcctgctctccttccctgtccatagtccctccctgcccctcccccgtgatcttgccccacagacctttctcaggtggcggtggtgatggtgttgtaggggcaactggcttttttagagtgtcaggagctctccaaggtgcttgacatccatttctctaatcttcacaacaagcatgcaaggttgattctgtcatcccattttacatctgagaaaacaagctcagagagagtaagtaaagtggccaaggttgcagtttgcaagaaatggagcttggaccccctctgaccttgaactggctgacatcaaagttgtcgctttgcctggtcctgtcacctctcttcctcagatgtctagtgtttattagacctccatagtatcttcaccaactgagaaggtgccccatcagcctgaggaactcccagggtcacccctctacaaggattcttgacacttgcacttctacccactctgggtcagaagctattcttccctcattggattgccaccattcttgtaagggcaccttctctgcaccacagttttttgctcacactcctcctatttttctcttctcagcttccctatgcctcatgatgccaggcataaggcacacagcaaccaagtgttggcagaaggcaaattatatggtttggctgtgtccccacccaaatctcatcttgaattttagctcttataattcccacatgctgtgggagggacctggtgggagataattgaatcatgggggtgattttccccatactgttcttatggtagtgaataagtctcatgaggtctgatgcttttataaggggaaactcctttcacttggctctcattctctcttgtctgctgccatgtaagatgtgccttttgccttccaccatggttgtgaggcctccccagccatatggaactgtgagtccattaaacctcttttactttataaattacccagttttgggtatgtctttatcagcagcatgagaacagactaatacaccaattgaggttcctccagagaattaacaaaatgtccatgcactctttcgttgttcccccatacccacagacctgccatccctggccctgcctggatgccggtacctggccactgctgctatattccatgcttttggacaagagcatgttcagtattgtccaggagacccagggagctcaagacagagctgagatccagttcctacagccacagttaacaccccagcccccgacacacacacagacttttcaatgcaaaatcaaaccattcccaaatatccagctacatattgttttacctttgaagagaaaaaagcatcagtggggttatgtgattttcatagatgaacaatttttgcaaatatgttaattgaagagtaattggtgctttcttgaccctcctgagcactgatgcttgccaaagggttatacatttcagactaatgatgatatccattactatatgtgcaattgcttataaactaatatatagtcatattaaaatctctaatctgattgagaaattttcagaaacaaggtacactgattttctcaccacttatttcctgctctcatgacagaatttctggagttctttgaattcacctggtttttggagctctgtcaagtcaatatttataactgaactagttcaaacagttcaagcattgtctcttcctttctggttgaagttctgtcttagaagactgttgtagtcagctgtgcttgtcataaagttttgtttaaaattattttagaattttcttctttggctttaatttaaatttttgtttgtttacttttttttttttttttccccggctcactgcaagctccacctcccaggttcacaccattctcctgcctcagcctcccaagcagctgggactacaggcgcccgccaccaggcctggctaatttttttgtattttttagtagagacagggtttcaccgtgttagccaggatggtctcgatcttctgacctcatgatccacctgcctcggcctcccaaagtgctgggattagaggtgtgagccaccgtgcccagccttgtttactttttaatttataggattgtaaatgaaactatacttggcctcagtttattctctgggaaataggttcttgctacaggtacagtttataataaggatttatttcataatagggagctttttatagattttaatatcatagttgccatttaaaaaattgtattaaaggccgggcgcagtggcttatatctgcaatcccagcattttgggaggccaaggcgggtagatcacctgagattaggagtttgagatcagcctggccaacatggtgaaaaccccgtctctactaaaaatacaaaaaattagctgggcgtggtggtgtgtgcctgaattcccagctactctggaggctggggcaggagaatcacttgaacctgggaggcagagattgcaatgagctgagattgcgccactgcactgcacagagtgaaactctgtcaaaaaaaaaatgcattaaaaatggtaatgatcaccatttattgcttgcctacagtatgtcagtcattatacaaggtatattttataattataaatattatttattatctgattacaaatatgttataccttgcactgtgtcctgtatgtctgttatgtttatttctgaattttccttcctttttcctctccatgctttgatctggatatttcctattgagagaatacactgaggcccagtgtgatttcattcacaatcctataaattaaaaagcaaacaacttctgggtcactggtcgtcttttctgctgtgttcaatctccagtaaaatatgtcagcaccttaaccactgtcctctgcctggtttcttagtctcacagccccgtgctgctgtagaattggcagatgccttgaggacaattgtggcgtacagtaaacatacctcaatatacttatttctgtttgggattttcgcccctcaagtcctcattgcgttattagccctgagctcttaagttttgtcttcacagagtcataagacttccagaaattcagcttagaaactcaagaacttagctttttagccactgcttcactttcagtttcatagcctctcatcccacactgcttacaaatctggaaacacctcaagggaaaagtgcccataaatgttggggttacctccacattctttccttctctttgggaccctatactctgaagtcctggctgtcttgatagttagttccctgataactttatatatttttaatttttttaaatgaacctggcatttcaaacataagttccatgataattttaaacaggggtgtgtgtgtgtatgtgtgtgtgtgtgtgtctgtgtgtgtgtgtgtgtgtgtgtccagcttttcgagttgtccgtgggaggacggtttcagtaagttactctatcattactggaaatgcaaaatcctgttttcttttaaaagagtcttcaagctgatgaaaattttaaagtagcttataacattttaactgtgatcttatttattatgagtatagagataaaggaaaaggcatcccacttctgaagatttctcgtttctaggagtgtctacaagattatcataggtgaaagtagggttggatgcagagaaatagtaagaaaggatggaggatggaggggataaaaagatcacatgtttggtgaatcctcttttaaaaacacttagaagattttccctaaactaattatctggcttaatgctaactgcttatttgctgaccttctgctttatttacaaatttaaagtggggccaacccttcctgttttcctttaatttaccccggcagctgctggttagctaaggaagaaaaaaaacccttttttttttttttttttttttaatggagacaagcagcaattaggtaggcttctaggtcaggtggccagttaggggtgccagggttcccaggtccagctttcttcgggtcatagagtgagggtgggaatcaagtcactcagatatttctcccgaattgaaatgcgtgtcttcctttggctgggcagatgaggtcccctcttctccatctctgctgctgggtcctggtgcaagcccttactctctttccactaaacccatgtggcagcctcctccttagcctgtttctccccagtcctgcacccatcagtccactgccacacggcagctacagggacctttctagaacacagcctcctgctgcctccatgttggcctccctgcccctgtcagagggatttttatttattttatttatttatttttgagacagagtcttgctctgtcacccaggctggagtgcagtagtgtgattgcagctcactgcacctccgcctcctgggttcaagcaattctcctgcctcagcctcctgagtagctgggattataggcgtgctccaccacgcccggctaatttttgtatttttagtagagatggggtttcaccacgttggccaggctggtctcaaacttctgacctcaggtcatccgccttcctcagcctcttaaggtgctgggattacagacgtgagccaccatgcccagccaagagggacttttctataacagcctctaggatcatgctacccccttcccagctctccctagcttttaagatcacataacctgcaaagtgccctgagatctggttctgcatgaatcttctctaccctattgctgcctatcaacttgacttcccacctttgggagtcagatgcagtccgctggacagcccatgccctctccatgtggctataccacccctgccttgcccctgctctctgcctgatgtcctactgtcttttgactgtgcccaggggcatttcctctgggaagcctgccagccctcagtctgaacctttgggtccccaaagcctcccctgtcctggtatgtgttgcactgcgttgtcatctcttgtctgtttcccctgagactcattattccctgaaggtctttcatctctgtttccctgtggcccagcacattgcctggcataaagtaagcacccaataaatttcagatggagcatatgttaagttccctataaaacctcagctgctgcaaattctgccaccagcctgggtgttctcctctgtggggactccttcagttttcagagacaggagactcccatagatttttagcaggaaaaggtagattcttgccttttagtctgtcagaatgacactttattagatgctttagaactgcagaagcttcaattttagaattttcagtttgtagcgttattttttttaagcagtaaaatttcagcgactatggtctgtgccagagccctaagcctctttctccatcctaaggagtttctctgcttaattgcagtgctgagctcagggaagctgcatatccaaaaatgaaaaggaaaccgctaaattgtgctgctacttttcctttgcagctcagataaaacaggcccagtgtgggaagaaggggctgtccttttgggggtgttggcctgtttctaattgctgcaccctcctctgcctccacccatgcctcagtgtggtttgggtcccttctgcccagagctactgggacatgtaataagaagctgcttttcagacttcttaattaaaataggttccggcagccattgccaggaagcagcattcgcacccctacatgtccaaatgcattactcatccaaaataagatatgccacgactcaggtttccctccttagccaccatggcttgaatggctgcatttagaaacagcccttacttcaagcccctatttcttaattatttgtcacttattcgcattcatccttgtgtgtgaaacatttttcccctcaccctatatgctgttatgtaaacaagtaattttttaggatgatgtcagaacctgatgtagttggggtggttttaaaatagtattttatggacagcaagaaaagtagttttgcttctggtttcacttgctagctttgggatggagggacatttatttgagcttctgcacctctgtgatcttgtctataaaacggggggcaatggctggtgctgtggctcacacttttaatcccagcactttgggaagatgaggcagaagaatcacttgaggccaggagttcaagaccaccttgggcaacatagtgagaccccatctctacaaaataaaaaataaataaaagaaataaaagaatgaaagttagctaggcatggtagtatccaactgtagtcccagctactcaggaggctgaggcaggaagattgcttgagcttaagagttcaaggctgcagtgagctatgattgtcccacttctgggaaacagagcaagactctgtctcaaaaaaaaagtggaaggtgggggtcaataatctgccagctcaggtattgtaaggattaagaaagacagtgtctgtgaagagcttggcccagtctctggaacacatttggtagccaggaaatagtaaatgacttctgtttccctacccccatcttcacctcctcccctagaataacaacatcataactgacttatttcatcattaaggatttaaatgcaaaaccttaagatagtcagccttagggaaacactgaagaatttatttttaaacacataaagattgcattcattcatccttctccacaccgcgggcagtcttcaaattctggttagcagagtcagcgggcagggaggatctggatcctggggttgtgtgctttgctcccagaggacatgagtatcaaaggtctgccccgatatctggagttcaagaggcgttttctggaaacaatttgtccaaaggctcccctatcactctcttggagaagtcctgtgttttatttatgctgaatgattgaatctattcccagccgaatgttttcctgaacaccagtaaaaatcatctgccagtcactcgggctcccaccccgggagtcatctgtcccctttgcctggtctcccatgcctcacagctcagcagccacaggcatggccatatctgcctctcttgcccttgccactccacttcatcatggccgtctcctctctggggctgctgcgggagatttccagtctgccctccagtgtctctgcatgcattctactcacctcctctccccccgcagccccgaggaactctgaagaaacacaagcttctgtggccccgtacacgtaggactaccaccgcttacttggaggcagtggcagtaaaaacggaaacaacaaacaaaacagaataaaatcctctttaactttgtttaacttggtgtcccatgcagtctatttaatttcagactcttatttaccccagtcctagggaactgaggttcataggaccaatctgggtgaatgctgctacagtttgtggatgggctgctccccatttgcttgttcaggtagctttgagcccaaacattggtcagcaagggcatccatatagtgacatgctgtatgtcatcaaaaagaaggtgttcctgacatagacaatttccagaatatatgctaagtgactaaagcaaagtgcagcatgagatgccaccatgtgctgcagatgcttggactggatggatacctaagtacccccaaactggcaggcacatctgcctctggggaagggggctgggtgtcggggaggggtgggagcaaattcctccccgtgtgcctcctggggcctttagaacctctacttctttgaacacagtgctactctgctccaaacgcccccaaacttcacacagagagtagtatgaagtcctcatctctgcacttgtggccctgaggttggcctcagcctgcccgcccagcttctcttctcattcttccctgctgccactctcctgtctccccagggactcggctgtttgagccactttcctttgacacgtctcagacttgccctgctccacttggaagtccttggagcagcccacacgcacccccgccgagctcactgtctcagaatgtgggaccacctaccagctttactcctgcgtctaactctaacttgtgagattgtgggggccagagtccccaggaggcagtgacgctgtgtgcagaaaagccaagagctccagggctgaacagatgtgactgaaaatctttaccagccatgtgccctggggaactgagcctttcatttcccctttccttttctgtatattggaggataacaagccttcactcacagggcgtgggtgtgtttctcatctccttgcagcacctagcacagtacctggcatctcatatgttcagggcatgtttgctctcctcccttcctttcccatcgtgactgtcaatcgactgttcccttggggcttgagattcttggattccaaaggaaagaacacagggccaggagtcagaatttcatccttgcctccgctgatgtctaattctgggataacgctgggccactcagtctttggattccctgccctaacacaaaatccatatttatctcaatgcaaaagagatgtggtcatcgaaacactgaatgcaaagggttagcagagtgagcacagatgttctcccatttgccaactggtttctaagaatatttggaggatgagtaaagtaatgtcttccatatgctcaagagaagatgatttagcaccatgcaaggtagagaaggagagcccccacccatcaacagaatgaccttggacaagacactagctgccctaggcctcaattacctcatttaaaatatgaaagtcataaaaccctacctcacgagggtgattgtgaggattatatgaggcaattcatgtagaaggtctttgtaaactgtgaaatgctctacgactgtcagccaggattagtagttaatgcacgtatttgtttattgtttcagcggagggtgcaggacgtcatcagcccgatcgtgtttgaagcagcctacagcctcagtgagcatgtgactggagaggaggagagggaactgccgcctctgacaccagttctccgctggaaaaagggacaaaagattgcccaaaagaatcaggtcagaaccttaaagctcatactcagcacccaaggtggcagctgcacagagcagaaataatggcccaaaagttgagagagccgtgggcctggctgctcaggagaccgcagccaggacacacctcctctctgggtctcccttttctgatctgcaaaatgataaaataaacagtcttaggggttacttgtgactactgtgggacttaaacactttcagacaattctcaggctgttagaagttacaatcccctcgagttcgtgaactggctggccacttggtccctgaacttgcctctgttcctagactgttttcagagcttagattggtggatagtaggtgcttaatgaatgttttattggtgggagaatgagtgaggtgaagaagcaagaatggtagcttgctgaattggcagttgagttacagaatgctcaacccaagagtccctggaaaccagagcactggggcaagtacaggtggtccacactcatcagattctgggatgtgcggctgtgtagagaagctttagtgcgatgggtgtatcactcgtatgaagtaggagtgagcctgtgcctgattttgtgcagcagcgctggccagctctgaggcgtgcagcactgagtgcggtgcaggaatatgcaaggaatctgcaatcccaagtctgtttcaaatcttttcttgaaacccaagatcaccacagattcagaaccctgtggaagatcaggaaaaactgtgggctaacccagcctcctaggcagggttggggcaaagctgtggaaccacctttcacagtgcttcagaccactgtaagtgtaggggaaaactagcagattgtgacccatgccttgtagattagagttgtagactgaaccacagagaagggtttgggatttgagatatccatccaggtgttcacgtaagtgctgagatttttaccaaggcatcgcattatctcccaaagcctctttcccatcatcctaagtggggttccctagaagcagagcctgagaaagggaattgggaacacatggtctaatgatgctgtgctcttagggaaaacctgtaaaggaaaggcatgggggctcaaaatggttgtggtctcagataaagtctggctgagggactctggaacaaaaattacaccaaagagttgtcctcaccttgaggcaagaggggcttcccttttgtgccccatatcattcagccattgactggctgtgggggggaagggaagtgtaaccctccttgaaaggagatcccctcagctgaggatggttctctagagaagaatgcagatgtgagccataagcagcctacacacacatcagccaggagatgggccacagttcacagtgcccactacacatcaaaacacaccctctggggaatgctgccaagaggttttgatttaaaacacgaaccttctttcacaacacaagtgccccaggagagtggcctgtaagtcccactggccattgatacttggaacaggccctgggggagtgagggaggacacgtggtgtctaagcaggtgggcagagtagatgggctggccttactctgaggtgtggagaaggctagagaagagtagaagataaggtgaagaggcagggcaggaagctgatggcttctgccttgactgggaagtacagacctgggtcccctcctgacagggaagtggggagaagaggttggcctggggacacagtaaagcatggtattatggtaacttctacataattggtctctagttctagaattattctgctttctaaggtcaaatcttactggactgataaacttacccatacttgggttacggaagttacccagactcggggtcctgggaagaatttcagggtcctctgtgcttatttgtttctgaattgacccagtgaggtagtcatctaccctgtccagcatcttgctagcctggacatactttccacagtgaacctatctctcattcctgcaagtctgtcagtggcacagatgtggactttctttagtgaaaagcatcttggaacctttactgacatttttagatttaagcagcccaatcaaagccagagatggagggacagattagtattgaaatgatgttcttggtcacttctggttccagatggccaaccaagcacaaatgttgatgtctgtgccttctggtaccccattgcaatgattataaatgagtagatcggaacagggaggacaacactgtgaaagaaaggcatcagctaataataagagtccagtaattttctggtatgagtgaagtaaatggaagagtgttagtgggtgaacttgaactgtacatggaagagctggcttcctgcctacccagggaacagagaagctgcagccacagccaggccaacagttacagagggggccagagtaagaagtgggactgcaagtggtggtggtattgagggaggtcagtgaaatgtgaaggttggtatgaagaagggttagagttgacttttcaccattgtccccacccctacaggcttcaggcatgcagaatagcaagcagccaggcatcgccttctctaaagtgttaagtaaactgtttaagatagtgtgggcgacctcgttctcagagaaaagaaagccttacttctggcatttgaagtcaccaacgtaagagctagctttctctcccacaatccacccaaacactttcacagattttctactcagtccttttaccttagtttgaaatatgaatggacaaccaaggaaacccaagattgaggaatatttggtgcatgaaaggaaaggctaaaataaaccaggagaataactaacttaaaaggaaacaaatgatttagggaatataagagattattttaaaaaattttaaaaatgcaacaccttaatgtctatgcagtagacccaaggagatttaggaatatattccattcttttcattttctaatggatgggattctgttcctttttaaagggaggaatgaaaggcaagggaagtgttcttaaaaattaaaaatatatttgcagcaccaaaaactcagtggaagtattagaagacaatggtaaataatttcccaatggaagtgctaaaagacaagtagaaaagaaagctaaagaataaatttacggggtcctatatctccaagtaataagaatactagaaagtaagaataccagtaataagaaaagagaaagaagggggagaaaattatgtaataatagaatagcatgtttcagagttaaagagggagactattttttaaaattggtgtaaacaacaatttacaatcaaaataaaccaaaattatcatagacacatcattttgaaatgtcagtgcttcaaagacaaagggaaaattctaaatgtttcgagggcaaagaatgcaggaatgttgatcatggaggataagtcagcttacaacagaatgagagtcagactgagtagtccattagactttttataagcaagattagaaactaaactatgatgaaataaaggcttcaatgttctgagggaaaatgattttgaaattagaattttgttttcagccacacaatcaaagtatgtggtaaaaataaagtcacttttcagataagcaagaacccagaaagtttacctccctagtaactcttccaaggaaattatcttgtacttcaacaaaacaaaaatgacaaccagaaggagcaagatgtgggatacaagaaactctggaactaactctcaaaagtctaatgacaagaaatcccaggatgataactgcagcaagtctaaaaagcagccaagtctattgagaagaggagatcaattaacttccagaagaatgaagctaagcaatagaatgatgagcaagtggcaaatattcagtatatagtgcagattgaatatgtttcttttatgggtaagaaaaaaataaaagcattcaagacctctcagaaaaatagaaataagataattacctgtacagattctccttgactcacgatggggttatgtcccaataaacccatcatgaattaaaaatattgtcagttgaaaatgtatttaatacacctaacctgctgaatatcattgcctagcctaccttaaatgtgttcagaacacttacattagcctacagttgggcaaaagtcatctaacacaaagcttattttacaataaagtgttgaatatctcatgtaatgtattgaacactatactgaaaatgaaaaacaaaatggttgtatgggtactcaccattaacacacacagctgaaagcacactggacctaaagaatatttgaactaaaattaactgctggattatggggctactagtgtaacagggtcatccatttctctctcttctgatgagtctcaagaatagctggtagaagccactgcggtattaacactcgttgatggcttagcaggcatggtgttctgtagaaagctatcagttgtttaccctcctaatcctataactgactgggacctgcagctcactcccactgcccagcatcacaggaagtattgtaccacatattgctaccctgggaaaagcttttgaaataaaaaatttgaaatatggtttctactgacatgcatactaccttcacaccattgtgaagtcaaaaaatcgtaggttgaaccattatnnnnnnnnnnnnnnnnnnnnttaaaatataaaacaaattaaaatgtgataaaataaccagttataactatcagatgttttttgtaagcctcatggtaaccacaaggcaaaaacctatagtaatacaaaaataaaaataaaaaagcaaagtaaccaaaccataccactagagaaaatcacttgaccacaaaggaagatagcaagaaaggaagaaaggaacaaaggatctacaaaacaactagaaaacaacaaaattgcagtagtaagtccttacttatcaataattatcttaaatgtaaatggattaaactctccaatcaaaagacatggagtggttaaatggatttaaaaaaaaaaaaacaaaaaacaagacctaactatatgctgcttataagagactcacttcacctgtaaggacacacataaaatgaaagcaaagggatgaaaaaaattctatgcaaatggaaaccaacacagagcaggagtagactttaagtcaaaaatagactttaagtcaaaaactgtaaaaacagacgaagatcattatacaatgataaagggatcagttcagcaagaggacataacaattgtaaatatatatgcacccaacaccagagaaactaaatatataaagcaaatattaatagatcttatgagagagttagattgcagtacattaatattagggaatttcagtaccccactttctgcaatggacagatcatccagacagaaaatcaataaggaaacatcagacttaaactacactctagaataaatacgtctaacagacatatacacaacagtccatccaacagcgacagaatacacattcttctcaactgcacatggaacactctccaggatggatcacatagtaggccacaaaataaatcttaataaatttagccttgaaatatcaagtatcttttctgaccacaatggtataaaacttgaaataattaacaggaggaacttcagaaaattcacaaatacgtggaaattaaataacatggtcctgaatgaccattgggttaatgaaataattcaaagggaaatttaagaatttcttaagacaaatgaaaatggaaacacagcatacaaaaacttaaaatgtggtaggattttgagtaagtagaagagtataaagaagaatgttgatcctagaaatattctatctgaagtagaagttgaatattcctggactttaactttgcaactgtagaggaggatgtataatcatgacacttgtcttggctcaactgtgagcaataatcatgaaccataataaaattagcactatttattggttttcaatatttataattaagccaaaatcagagctatggtgatagcataaaatgcaaatgtcattaaacttgattatataaaggtaaaagtagaataagataagttttcttaatatcttaatcttttaaattgatgagtcaagagattgcaaaacttgatgaaacaggaaatcactgttggcttaaaattgcagaggtcatcagtagagcaacacttcctaaagtgtgattcctgaaccagcagcatcaacctctcttgggattttgtgagaaatgaaaattgtttttattttattttattttattttatttttttcctaaatttcttatttccttctctttttttaaagttttattattattatactttaagttttagggtacatgtgcacaacgtgcaggtttgttacatatgtatacatgtgccatgttggtgtgctgcacccattaactagtcatttagcattaggtatatctcctaatgctatcccacccccctcccccaaccccacaaccgtccccggtgtgtgatgttccccttcctgtgtccatgtgttctcattgttcaattcccacctatgagtgagaacatgcagtgtttggtttttttgtccttgcgatagtttgctgagaatgatggtttccagtttcatccatgtccctacaaaggacacgaagtcatcattttttatggctgcatagtattccatggtgtatatgtgccacattttcttaatccagtctatcgttgttggacatttaggttggttccaagtctttgctattgtgaatagtgctgctataaacatacatgtgcatgtgtctttatagcagcatgatttataatcctttgggtatatacccagtaatgggatggctgggtcaaatggcatttctggttctagatccctgaggaatcgccatattgacttccacaatggttgaactagttgacagtcccaccaacagtgtaaaagtgttcctatttctccacatcctctccagcacctgttgtttcctgactttttaatgatcaccattctaactggtgtgagatggtatctcattgtggttttgatttgcatttctctgatggccactgatgatgagcatttcttcatgtgttttttggctgcataaatgtcttcttttgagaaatgtctgttcatatccctcacccactttttgatggggttgtttgtttttttcttgtaaatttgtttgagttcattgtagattctggatattagccctttgtcagatgagtaggttgcagaaattttctcccattctgtaggttgcctgttcactctgatggtagtttcttttgctgtgcagaagctctttagtttaattagatcccatttatcaattttggcttatgttgccattgcttttggtgatttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcgttatttctgagggctctgttctgttccattggtctatatctctgttttggtaccagtaccatgctgttttggttactgtagccttgtagtataatttaaagtcaggtagcgtgacgcctccagctttgttcttttggcttaggattgacttggcgatgcgggctcttttttggttccatatgaacttgaaagtagttttttccaattctgtgaagaaagtcattggtagcttgatggggatggcattgaatctataaattaccttgggcagtatggccattttcacgatattgattcttcctacctacgagcatggaatgttcttccgtttgtttgtatcctcttttatttcattgagcagtggtttgtagttctccttgaggaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagagtttgctgaagttgcttatcagcttgaggagatatggggctgagacgaaggggttttctacatatacaatcatgtcatctgcaaagagggacaatttgagaaaattcttgggcccaccccagacccactgaatcagaagctgatggggtgggccccagcaaactatgtttttgtttttgtttttgtttttgtttttgtgttttgagacaaagaatcctctgtcacacaggctggagtgcagtgacaggaactcggcccactgtaacctccacctcccaggttcaagtgattctcctgcctcagcctcctgagtagctaggattacaggtgcacgccactatgcctggccaatttttgtatgtttagtagagacaagttttcactatgttggccaggctggtcttgaactcctgacctcaggtgatctgtccgccttgacctcccaaagtgttgggattacaggtgtgagccaccgtgcccggccagcaatccgtgttttaacaagatggctgggtgattctcatgcagctaaagtatgagaactgatacagtagaggagttaaactaataatttgcccatcaaaattatggaggtgaaggagtggggatcgttatgtgagataaattcctgtctatcatggaaggaatttagtaaaataatgtctagatctgataaatcaacgagtagtagtatcagcatgttttctagagatatggaaataatcatcaaaagaaacataaacggacgtgggtaataatgagtaataatggttgcccctggagaggaggactcagtatggcgaggtatgtggcagggggttattatttttctaaccatgtgattctttggttgaaattaaaataaaagaaaaaattgttcttagattgggaagattgtccaggagcctgagagaagttctgggagagcagttctttcttattgtccttttcctgattatggggaaaaaaaaaaaaaaaaaaaagataatcttccagatgttggctcagtttgaggaggaggaaagattctgagagtgaggcccactgcaggaagcagagctgatctttaacctgtgtatatatacacaacagtttgacacagagcatctcacctctttcataggaaggaataaattcatcagaactctctaggtcatgttgccagataacattagggttccactactttaaatgccttgatctcttcactgagcccatgttggtacccaggactatacagaagggtggatcaaatcatgatgaccttttagagttggggtctgcccccactgatggcctaattaaagtggaatcgctgcacagactgtgtgtgtaacatggagatagtgaccagtacatgttaagtacaggcttactgattaatctgaggctttttgctatgagttaggaatgtgcaggacaggcaggagaccaagccttccctctatagggtacatagtcctgggagaagacgggttccaggatagggctttggcactaggctctggtgagtgaatagtgggattgctgctaatgctgagattggattgggattctgggcgctctggggacggtggagcttgaatgctacaagcctccgtacatacagcctgatgggcacacattgcaccttcaaaatttaaggaaagcaaagacctgcatctgtctcatcagaaagggaggcatatttgatagcaggaaaaagacaacctttttttcattaaccagaggagtattttaaaagactataaagctggaagcaattcaattgtgtgtctactttatgtaagacctcgatgaaaaaataaatcattgctgccttcattggagtcacagacagtccaggaataatttacaaagtgagatttagattagtgtgtaagaatttcactgcagaggccacttctggctgaggagaagatgttctatggagaaagggagaattggccagagccttaaaggtggagtaggatttgggtcctcagggaatggaggggctgatggatgctaaaggtctctcacgtggctgaatatctagtgagggaaaggggagaggccatctggactggagattcagtcatgcagtctgaagccacttgttcactggctgaggagttggatgtgattctacggtggacagaccatggcatattttgcagtttggggagatcgtagatgtgcctcagggagattggtgtgcctgggtatggggaggccagttaagaaagagcttgttgcaggggcctttgcaggtgagtccctggggagtctgtgtgataccccccagagagttgactcctaattaattgctagttggtctcagctgctgaaacagagggtatggaactaaatgaaacaatcatgggaagtcctggctggtctgtgtgctgggaagggagcaatgctgtccttggactggtcacctgaaggtcctttatccctcctcctcagctgagcataccaatggtgatgacagaggccctgtcttcaatccctgtacacagaatagcgctctgaaaattataactcttctcacgcttcatcagcaggcccccaaagagacctggctacagcagggcttccaggtctttcactgcggtaggcagaatggccccccaaagatgtccatgccctaatttctggagcctgtgatttggatacgttacatggcaaaagggactttgcagttgtaattaaggtgatggacttccaaatggggagaggagcctggattttccaggtgggtccaatctagtcacacgagcccttaatagcagcaaacttcctccagctggaggtgggaggaatgaggcggaataggaggtcagagagacttgaagcatgcctttgctgatgttgaagatggagtatgtgatgtgacgagaatgtggacaaccttaaggggctgggagaggcttccaggtgactgtctgcaaggaaacggggcctcagtcctacaaccacacagaaccaggtgcttccaaaaacccgaacaaagctggaagtggattctcccccagggcctctagataatcgtccagaccagctgacaccttgatttcggcctgtagaacctggagcagacccagacaacccaccgacctctgacttacagaactgtgagataatagatttgtgttattttgagcagctgaactccggtaacttattactgcagcaatagaaaataatagacacacaatacagcccacacctccagaaccccggggcttctttcctccctgggctctctggggaaggagcacaggctgtgcagtgagatcagggccctggcccagagcactcaccctttagagcctgtttcctcacctgtcactgggggtgccatcggctgctctgcctgcctctgggtggtggtgggattacatgagggaaatgtgagaagcccggaaatgatgaggcagcactggatcctgctgttcccttcctgggaagccggcttcctggtgttgtgaggagaggatgaggccgtcatgggagcaggtctgacctgggctctgaggaagcaggtgctctgctgcctttccacatcctttcctctgaggggggtcccgtctctgcaggcccgtgggtgggctccccggtgggacgcaatggcaccatcttaggcaggagtccccaactcctggatcagtaccagtccggccacacagcatgaggtgggcagcgggccagcgagtgttaccgcctgagcgcccctcctgtcagatgagcagaggcattagattctcacaggaacatgaaccctacacatgtgagggatctagattgtgccgaaaccatcccgccccctccaccgtccgttcatggaaaaattatctttcacaaaactggtccctggtgccataaaggttggagaacactggtctaagggttctggcaggctctcagatgaacctctctggatctttagggtgtctggccctcacgtgtcaggcccaaagatgcctgttagtctgtcgcagagggagaagatctggggaggacccatataaccagaactcgggagccagccgcaccaccatgagcccagatagcatgagtcccttctcttttctccatctctgctgccattccctaggccaggccaccatcatttgtcacctagaccaggtcacatccctgcataacctcctcccgctgaggagctcccttccccctcagaagaaaatccggacacatgctaaggcccacgagagcctgtacagtggggctcctgcctcgccagcgccacccgcatactgcattcccaccaccctcaaacttaccaggcctctgcctgcctcaggccctttgcatatgctgatacctcatctagaaagcactttgccatgcttttcccgtggccagctcttcattttttaggtctcagcctaaatgttgcctcctcaaagaaccattctcccactaccctgtatttcctgactcagctgcctttctttgttttgacacagggtctcattctgtcacttaggctggagtgcagtggtgtgatcatggctcactgcagcctcgactttccaggctcaagtgatcctcccacctcagcctcccaagtagctgggaccactggtgtgtgccaccacgcctggctatttaaaaaaaaaaatttttttttctggacacagggtttccccatgttgcccaggctggtcttgaactcctaggctcaaggaatcctcctgcctcagcctccctaagtgctgggattacaggcatgagccaccgtgcgtggccttagctgcctatttgattccttcgtgacatctaacagaacgtgttatttcgtctacttgttattgtatttacctctctagaatggaagcccagtgagggaagggatctattttatcttatttgctattgatccgcaacacctggcagagaacctggcctatagtggatgcttagtaaatagtaaatagttgaaagagcccttctggaagaacacaaggctagttcctttggcaaaaattgggcatcatatcagagcttcttcactagcagattcagcagagctataaaattaaaagaaatgtgttctgtaatccctctgggaattccccacgggcaagagagcatgatgtgtgatttgcagtgacatatctataccacggtatgtttgtagtgactacttttcaaaagacaagatggaggatatacagctggtgaaagaaaaggtgtcggctttgttgagaagtcttactttgttgtctttcaagtgaaaagtgagctattttagtctaatggtaatttttaactatgttgaagccatacactttgggtctccattgtgctggaaatcgtcactacagctcctcccaccccacacccctcaatgcatgcatataggaatatagctcatgctatggaaatccactgtttgcacagcctggacattaggtaatagtttcccggctgaggtgcccagctggcttaacatgccattatttacagctctaaggtttattttcattattatatttaaacgtctctgcagaaggaatggaaggctaagagggtgggagagtagaagaggagagggagaagagtcactccagacgtcagaaccagacaggctcctgagaccgtgcaaactgggggatttcagattgcacacttggagtcagggcagcagtttggctcagcaggaggggaaaggggtgttagaggaaaaggctcctgccctccaatgttgtttgacccagatcaaccctactcttatgggtatcagcttctgggtaaatactcttttcaaagagggcaccatggcagaacacatgtgaaaaccatctagtttgaagtatgtgtgagaaaaacaactaattcacccttctcactgaccagtggagaagtctggccttatctgtctgtctcaggcttcttctccaaggttaaccccaacgggaaaggagaggggactcatcaaaggttagaccatgtcctgaagtgacctgttgaatttgcaaaacttctttttcagtgttatgttttatttttgcaatttttgtggggggaaaatgcattctaggcttctgaaaccctttttagaagaaaatcatggtttcctcaaactcttcaagcttattgagttttcttctgtattatcctgtcctattgaaaaccttgtgcaaaagtatgtgtggggtgagaggtgtttaaacacacccggtggacagtgtctggctggggaggaaacgttagcctctcttttcttatcttatgagataatttaggaaatcaagtacaaggcccttgctgtgtgcacttatacctggagccttatttaggggatgttcttgcagatagatggggagaagtcttgctgggatcctctctggttttaaggcattttttttctcactcccagttgcctgcccatgtctggtttagcagcttttagaaacgtggctggcatccttttttcttttctctgacagcaccagcccctttatttgaacttcctagctgttttctgcctcttctgactaattaacagcaactaaaaaagaaaaatgaaacatagaacacaaaaaattccagggtgaaaaaggagaatttctagtcctggggtgcaaaagtccctagaagagagttttgagctgaaatgaaaagttgtgattatagagagacatgaaatgtgtcccataaaaggccacctagtcccaggcagatccaggaagagcactgggctgggagtcccatggggccagggcctcaccaagcagtcagccctgctcagttatcacaggggttgaactggattgcctaaatgatgcctttagatggatggaactggagtccattatcttaagtgaaacaactcagacacagaaagacaaataccacatgttctcgtttataagtgggagctaaataatgtgtccacatagaagcagattgtgggatgatggacaatggaggggtggggaagttggagctgggtggatgatgggaggttgcttgttgggtgcaatgtgcattggcccagtgatggatgcaccaaaggccctgactttgccatgacagaatatatcaatgtggcaaaactgcacttgtatcccatgaatatataccatgtttttaaaaatgttgcctttgggcagaggggataattctgcaaactgcagagccatggagtaaaaaaaacacccaagatagcagaacttgtcatttctagtttttccacaggaccataaagcaaaattggtgccgggtttgtatttaaagggaaaccaagagggtttttttatccttccatggtttcaaaatctggaaggacaatttgtacagaccctgagatagaaggattcctcagctttaatttcatgaacgatttgcctttcattgattcttgaggatatgaatgttttagaaagcaacagtgtatgccttgattttaagaggcaatgagccttttccttccttcgtttaggcatggggctgaatggagctgaaattcctgcactcttataacgtgccacatgaagggcagttttggattctgggaaaacagcccattgaaacagaattgggagggagaaacctcttacactcaggtcatggtatttatatgaatacaaaaaaaaatttaaatactgtgctaggtgctgggggttataaacatgaattacatgattagggcctctggaaacttgtgtggggctatagaaggaacaccagttcagaaatgtcactcctgtcatccagacaggatgcttcaccataggggcagagaccttctgctaagtcataccgcatatcaagaaatatattgctaggccaggcacggtggctcacgcgtgtaatcccagcagtttgggaggctgagacgggcagatcacttgagatcaggaattagagaccagcctggcaacatggggaaaccccatctctactaaaaacacaaaaattagcggggcatggtggtacgtgcctgtaatcctagctactcaggaggctgaggcacgagacttgaacccaggaggtagaggttgcagttagccaagatcgtgccactgcactccagcttgggcgacagaacaagactcatctcaaaaaaaaaatgcattgatcaaatcagcttaaaaatagccttcttgtttgctcttcttggtgtgggattattcagtccaattcttctactttttttaggcctcagcatgggatttggttgtcatatcaaccctataaacagtgttgaatccatgtcaataattgtattttttaaaagcaaatatcaccaagtccaagaaactgatcctcctctgaacatgatagctggactaggctaagaatcctatttcctgttagatcagaagtgaagattttctggtacagatttgggtgggagaaatgagctacccttcccaaggccttagcacctagatgacatcctctctgaagtcaccctcagccaggagcggacactgagctgctatttctgaatcacatgtccccaaagctgccctggccttggtgaccatggcactgtaagagaagcacagccagccccagcgtccttactctgactcagaggaaaatgcaacttgagctggattcattgaaatcttttttttcctggcctgaaggaaatgaagaaacatagccaaatattctaaaacaggattcaacaaacagcccataggccaaatccaccactgcctgtttttgtaaataaagttttattggaacacatctatgcccattcccttatgtattatctatggctgcttttgctctacaacagcagagttgagtagtgtgactgagaccgtatagcctacaagcccaaaacatatactgtctcacccttttcagaaaaagttgccagccttgttctaaaagaagtagagtaaggatttagtgagaagctggagaaaatattttcaaagacaactgtattctccagggaaacctgagatgaagaccaaggtgaggaaggagccagcagagaaatcgagtccatgaggctgaggaggccactggatgtccagtcttcagctctctgaagcctgagacaggaaacagttgtctcccgagagaaaggtttgaacctcctttaactagggaggaataagagatgatggcttcttagatctgtttacatttgctggaaaaacttcttccagggaaataactagacagggctttggccaactagcaggtgaagtctggagggaggtggaagagactgcttccaagctgggttccgatttgtctgattgaagcagccaagcttgtgtttgccagaggacttaggaggatgtggataaaatcaggctgaggcctttttttaaaggcccaagctggagctattgggattgttccctcagaggaaaatcaggagtttgggccattggcttcatggagaacctgtactttgtaccaaggagaagtcatttctacttggtttttgaaactgcattgtcatctagtattccaaggctttagtctgtccaccctcctgctccagagagatgcctttcagttccttaggaaacaaattggccatttgcccaaagagactaatccaggactagaacacaggcactgagtttcaacctcaggctccccagtgcgtgactcaggtctcttgattccatggtgtattgtttttttacctattaaacaattgcattcctagcctatggaaggtcttacctaagccaagactttggcagggattggattgtgcagcccatttttgttaatagcattgcccaagttagggaaggccattaggttggctgagtattctggtattctattgctgcataacaaactctgaaatttagtagcttaaaataacatttattttgttcatgaatttgatttcattgttttttaatgtatgtaaggtatataaaatgatgttttgatgtacatttacatagtgaaatggctactatggtcaagcaaatgaacatatccattgcctaacatagtttttttttttttttgatagtaagagcacttggaatctactttattgtcaaatttccagtatataatacaatattgtcaacatagtcatcacgctatacattcaatctctaaattttttcatgctacctaaccaaaactttgtacctttgaccaacatctccccattccctactccctaccccctccccgacccctggtaactatcagagtttcactttctggttctgtgtatttaacttgtttagattccgcaataagtgagatcatacaatatttttctttctttttgtgacttgtttcacttagcataatgtcctccagtttcatccatgttatcaaaaatggcaggatctcctttttaaaggctgaataatattccattgtatgtttatatatgtgtatatatatatatgtgtgtgtgtgtagtatatatacatatatacacaccacaatttctttatccattcacctgttgacaaacacttaggttgattccatgtcttagctgttgtgaataatgctgcaatgaacatggaaatgcaaatatttctatgaggtactgatttcattctctttgagtatatacccagaagaggaattgcagggtcatatagtagttctatttttattttttttgaggaacctccatacttttttcataatggctgtaccaatttacattcctaccaacaatgtataagggttcccttttctccatgccctcactaacactttttatctcttgtcgtttttatagtagccatcctaactgttgtgaggtgatatttcattgtgacttcgatttgaatttccctgatgattagtgatgtggatatttcagcagaaaccttgcaggtcagaagagagtggggtgatatattcaaagtattgatggaaacagtgcctcatacctgtaatcacaacactttgggaggctgaagcaggaagatcacttgagcctaggagtttgagactagcctgggcaacataatgagaccttgtctttacaaaaaataaacagaaaattatccaggcatggtggcatgtggctgtagttccagctacttgggaggctgaggtaggaggatcgcttgagcccaggaggtagaggctgcagtgagccaagatgatgccactgcactgcagcctgggtgacagagtgagaccctgtctctaataaattaataaaataaaatttaaaaaccctactagccaacaatactatacccagtaaacctgtgcttctcaagttgaaatgaaaggacactaaatagcacaagagagcataataaagaaggaaactcgttggtaaaggtaagtatatggacaaaatcagaacactatattactataaaggtgatgagtaaatagcttttatgtctatgaagaaagttaaaagacaaaagtattttaaaaaccattataagtattaactaaattatgttaatgggtacataatataaatagatataaactgaggcatcaatagcatgtaacttggggggagcagagggaaaatcagagtttttatgcaagtaaagttacattgtgaacttataacagactgttacaaattatttcgtgtaagctcctggtaaccaccaagaaaatacctatggaagttatatatataaaaaaagaaaggaatcaaaacctatcgatacaaaaaaaaaaaagaaacaaaacaaaagaaaaccgcaagggagaaaaagagggacaaaagaacaagacacatagaaaatagtcaccaaaatggcaatagtaaatctgtctctatatttactttaaatgtaaaaagactaaccttcccaataaaaagatacagcatgactgaatagattattaaaaaaaacaacaacaaccaggatcaaactgtatgctgtctacaagaagctcacttttagattcaaggacacacagagagatggaaaaaggtagtccatgcaaataccaaccaaaagagagcaggagtggttaatacttatatcaacaaaatagactttaattcaaaaactgtctctagagacaaaggtcatttcttaatgacaaagggtcaattcaacaggaagacataacaattataaatgcacccagcatcagagcacctaagtatatacaacactgacagatctgcaaggagaaattgatagcactataataataggagatttcagtaccccactctcaataatggataggacatctagacagaaaatcagtaaagaagcagtagacttgaacaactggacctgtgtaacaaatggacctagctggcatatacagaactgttcagccaacagtggaagaacattcatttttctcaagtagccatggaacattctccaggatagatcacatattaggtcacaaaacaaatcttagcaaatttcagatcgaaatcataccaagtatcttttccaaccacaatggaatgaaactagaaatcagtaacagcaagaaaatgggaaaattgtttgtgaattcatttgtgaatttgcaatttggcagagcttgatcaacacagctctctgttccatataatgtctatcagctggggcaactcaatgggattggaggacatctctgaggttttcactgtcatggtgactcacgtagcctgcaagttgatgtggcagtcagtgtctcctgtgagcctctgcatggacagcttgtgtttcttgcagagtggctaaattctaagaacaaatgccccaagaaaattaggaggaagctctattgctttttatgacctagtctcagaagtcacatagtgtcacttccactgtagccaaaagtccacccagattccaggtaagggagcattagaccccacctctctatgggagtagtttcaaagtcacattgtaaggagtgccatcatcgagatattgttgcattgatttttggaaaataatttacctgcacagaggtaaattcacatcaattctttgtctccttatttcaccatccattaatgtttgtttgtttgtttgttttgagatggagttttgttcttattgcccaggctggagtgcaatggttggtctcggctcactgcaccctctctctcctgggttcaagcaattctcctgcctcagcctcccaagtagctgggattacaggcacccaccaccacacccggctaatttttgcatttttagtagagacagggtttcaccaagttggccaggctggtctcaaactcctgacttcaggtgatcacccgcctcagcctcccaaagtgctgggattacaggtgtgagccaccatgcctggccccaccatccacacccagccccaccatccattaattaagcttcatggtgttcactcagtcacactgttgtcgctctcatttgccaatgttaaatagtgatgcacagtgcctaagacaaaatcgctatcactgcaagctcctacccctggctaaatgctaatctggatttatgggacagtgacgagtgctattattttcattttataaatgaggaaactgagtcctggagggaagaaaagtcaattttcttaatgtaatacaattaaaataggattacactttgaatttccttatttcttaactagtattttatctttccatgattgtgcttaattttatcttatcagtacaagcactcatataacctgtagggatatttgtgtacatgtgcatgtgtgcatatacacacacgcactgtgtgtgtgtatatgtcaaactcagtgcttgcctttgttggatggaaattcagcagcactggaggactagacagctagaaaagccagtttcagggacaggaaatagtagagttcaaggaaaagttaggacaaggaaaatgagtctttacaaagcaaccaattcctcgtgagaagtctttgcatctcacatggctaagagacagtactttggttaggggcctggagctttggttttgatgaacagtgtgctggtattggctctaagctggggcatccaccatttggctccccatttgagtggtcactctgtctctcagagcaatgtgtggtctttcggtgttgataaagcagcaactacatgccaggccctaagggcaggcacagaggcaagcaagaccagtacagtgccccctgcaatcctcttgggacatcattttagcaggggagactaccattgaacatgtaatgataaaattgattagttatgattgagatgagcagtaggaggaaaaagtgtgtggaactgtgagagctcacgatgggcctgaacttgcccagggactcagagaagtggtctggatttgcttgttgaagggtgagaggacatgtactaggtgaaccagctggaggaatctggggatccacttgtggggaggccctgggtgggaagttgtaaggacaaccagagtgatagctggcatgagaaagccagggtgacagaggtgaggagggcacatgccagatctggcagcctgcatgtcaccagatggatttaggtcacatcctgttcttccgttctcacctctttcacctccatctccacctccacctctaccccttcacctctccatgcctcacaaagttggactgtcttgcctgtgagacaggaaaggcatgtgtgatgaggggactgtacactaggggccagtccaggttttgtgagacctgaggcttatatagtagagggtggggtcttgaaggaaaaaaaaaaaaggtgaaattatgaagacaaagtttgtgcaaggcttccctaggggccatgtcagctggggacctctaagctgaagtttcactagtgtggtggggaagctccctttggcaccttccctctgtcctcaaagctcataaagcccacctttcatcttgcctgagacgttcatgccatccttacacccacttcctcctgttttcttcttagttaagatggcaaagaaagagcaaatatattgaaatctcctggaaatttggctctctccttgaccccagtagtgtccaaaagaacacaggaatttcctctttttgcccaagacttccatgatattttccctgataatcaaggaagggagtgttggctgggacacttttttcttttggaaatgtggcaggggaatatgaattttcataggcgaaattactctgtctggtcgagtctagactgttcgttggccagcacgtttgctggcgcccacactgacactctgaggtgctgcctggacttattctctgggcagggaagaaataacctggaactacattttggggaaaaaactcacgaacatgagcagtgacaaggaagaagtttaataatgagtaaattacaactaaaagttgtcaacaggctcttctctccaaattccactgaaatgagcaaagccatctaacagtagtgaagagtctctgtcatctggaacttggggaagctactgtccatagatctgaaatgtcagagaggttgagacagattgaggggaagactaacaagccctccatggaccgtagaagaaagccctaacccctctccaaatgctgctgctgatctcctggcaagcctccacagataggcccaggcccaggcacagccagcaagctctctggaaatatttgggttttgacatgccaagacttggccccagtaagggctgggtggggctttggctgttgaggcccagtcttggttagagaaaaggcactgtgtccctgttaactgctggctgccccaccaacaaactggaaagaatctcccccagtctgttgtgattccctcagcctgatggcctaattgcctttgccttttcctgttaatactgacaattcaatacagtcccattgctcaggcagaacctatttcatatataaatttcctgcatccccaaggcagagcaaatagggggaaatgaccaaactataatctgagagttctttactcaactggattatcattcatctaagagcatctgaaagacagtctcacacaagcaaagactgaaaggacatccaccaccacgtacctctcttgaaaaaactgcttggagaagcacttcagtagactagggaatgaatcaaataagtaatgcactgacaaaatcaaaaccacagttgacttaggcttccttggagcttggaagaaccccttcccacgctggagagctggctttttggaggtgggagtagaagccctgaggggctcaggggaggaattcccactgatttgcaagaaaggaattggccactgtgtactcgtttgccactcaatcctgccctaaccttcctctcctgtctttctcacagactgtttttgaaaggaattgccgttcagaggactgtgccgcagacctgcagcttcagggtaaactgctgctctccaggtatgtcggtgtttccttcagagcattgttctcaggctcctttttcttgaccccaggtcccaaacctgaatgtgcagatttccccactgaagaggataaacagagttgatgggttacagtaatattctgtggttttaaaaaaatgtatgttacaaaataattataacaaaagctttgttgggaagattgtttaggtttttttgtgtgttgattgcaattccacatatctcacaatgtagcttgtatttctaatttctatgagtatttgaggggtggctattttatgcttgctgattgtattaagttgaatcatatgaaattgccaatatttgaacttttggacaatttcatatgtatgattcatcctattattaaataaaggtttatgccctcctgcctccacacacacacacacacacacacacacacacacacacacacactagtgtatgttttaacaagtaacatttctgtggcaggagagggctgaaggagaggggcaggctgccctgatccaagtgagcagatagtctccttattgtttcagggtttcctcccgcactacatgaatcccccaaggctaaaggtgaaccgtacagcggccttctgtttcctctttgccaaccttttattttagacttcatttaggatgaaggtgctggtcctgatcatttagcctcatttcacagaatggcttccttttgaaacagttccttctgaaagactgttttagccttggggccagaaacccctctattagttttattaccatttctgaaaaacagtcactagttttggtagttatttttcaaaatgcatagtgtatcccttacttaaaactatgagagttaagtttggatgaaatgacatgaatatactattatgaaccagtgcctacactaggacattttttttattgttatactttaagttccaggatacatgtgccgaacgtgcaggtttgttacataggtatacacatgccatggtggtttgctgcacccatcaacctgtcatctacattaggtatttctcctaatgctatccctcccctaaccccccacccctgacaggccccggtgtgtgatattcccctccctgtgtccctgtgttgtcattgttcaactcccacttatgactaagaacatgcagcatttggttttctgttcttgtgttaatttgctgagaataatggtttacaccttcatccatgtccctgcaaaggacatgaactcatccttttttatggctgcatagtgttctatggtgtatctgtgccacattttctttatccagtctatcattgatgggcatttgggttggttctaagtctttgctattgtaaagagtgctgcaataaacatatgtgtgcatgtgtctttatagtagaatgattcataatcctttgggtatgtatacccagtaatggatggctgggtcaaatggtatttctggttctaaatccttgaggaattgccacactgttttccacaatagttgaactaatttacactcccaccaacagtgtaaaagcattcctatttctccacatcctctccagcacctggttgttttcttgactttttaaatgattgccattctaactggcgtgacatggtatctcattgtggttttgatttgcatttctgtaatgaccaatgatgatgagcattttttcttatatttgttggccgcataaatgtcttcttttgagaagtgtctgttcatatctttcgcctactttttgatggggttgttttttttcttgtaaatttgttttagttctttgtagattctggatattagccctttgtcagatggatagattgcaaaaattttctcccattctgtaggttgcctgttcactctgatgatagtttcttttgctgtgcagaagctctttagtttagttagatcccatttatcaattctggcttttgttgccattgcttttggtgttttagtcatgaagtctttgcccatgcctatgtcctgaatggtattgcctaggttttcttctagagtttttatggttttaggtcttacgtttaactctttaatccatcttgagttaatttttgtataaagtgtaaggaaagggtccagtttcagttttctgcatatggctaaccagttttcccaacaccatttattaagtagggaatcctttccccattgcttgtttttgtcaggtttgtcaaagatcagatgattgtagatgtgtggtgttatttctaggcctctgttctgttccattggtctatatctctgttttggtaccagtaccatgctgttttggttactgtggccttgtagtatagtttgaagtcaggtagcatgatgcctccagctttgttcttttggcttaggattgccttggctatagggattcttttttggttccatatgaaatttaaagtagttttttctaattccatgaagaaagtcagttatagcttgatggggattgcattgactctataaattactttgagcagtatggccattttcacgatattgattctttgtttccatgagcacagactgttttttcatttgtttgtgtcctcccttatttccttgagcagtggtttgtagttctcttgaagaggtccttcacatctcttgtaagttggattcctaggtattttattctgtttgtagcaattgtgaatgggagttcactcatgatttggctctctgtttgtctattattggtgtacaggaatgcttgtgatttttgcacattgattttgtatcctgagactgctgaagttgcttatcagcttaaggagattttgggctgagactatggggttttctaaatatacaatcatgttgtctgcaaacagagacaatttgacttcctcttttcctatttgaataccctttttttccttctcttgcctgattgccctggccagaacttccaatactatgttgaataggagtgatgagcgagggcatccttgtcttgtgccagttttcagagggaatgcttccagcttttgcccattcagtatgatattggctgtgggtttgtcataaacagctcttatttttttgagatatgttccatcaatacctggtttattgagagtttttagcatgaaggggtgttgaattttgttgaagcccttttctgcatctattgagataatcatgtgtttttttttcattggttctgtttatgtgatggattatgtttattgatttgcatatgttgaaccagccttgcatcccagggatgaagccgacttgattgtggtggataaactttttgatgtgcggctggattcagtttgccagtattttattgaggattttagcattgatgttcatcagggatattgacatgaaattttcctttttcgttgtgtctctgccaggttttggtatcagatgatgctggcctcataaaatgagttagggaggagtccctcttgttctattgaatggaatagtttcagaaggaatgataccagatcctctttgtacctctggtagaattcagttgtgaatccgcctggtcctgggctttttttggttggtaggctattaattactacctcaattttagaactcgtttttggtctactcagggattcgacttcttcctggtttagttttgggagggtgtatgtgtccaggaatttatccatttcttctagattttctagtttatttgcatagaagtgtttatagtattctctgatggtagtttgtatttctgtaggattggtggtaatatcccctttatcattttttgttgtttctgtttgattctctgttttcttctttattagtgtggctagtggtctcttttgttgatcttttcaaaaaaaaaaaaaccagctcctggatttgtttattttttttttgaagggtttttcatgtctctatctccttcagttctgttctgatcttaattatctcttgtcttctgctagcttttgaatttgtttgctcttacttctctagttcttttaattatgaagttagggtgtcaattttagatctttcctgctttctcctgtgggcatttagtgctataaattttcctctaaacactgctttaggtgtgtcccagcaattctggtatgttgtgtctttgttctcattggtttcaaagaacttatttatttctgccttaatttcattatttacccagtagtcattcaggaggccattgttcagtttccatgtagttgtgcagttttgagtgagtttcttaatcttgagttctaatttgatttcactgtggtctgagagactgttatgatttctgttcttttgcatttgctgaggagtgttttacttccaattacatggtcaattttagaataagtgtgatgaggtactgagaagaatgtatattctgctgatttggggtggaaagttctgtagatgtctgttaggtctgcttggtccagaactgagttcaagttctgaatatccttgttaattttctgtctcatgatctaatatttgacagtggagtgttaaagtctcccactattattgtgtgggagtctaagtctctttgtaggtctctaagaacttgctttatgaatctgtgtgctcctgtattgggtgcatatatattgatgatagttagctcttcttgttgcatgatcccttcaccattatgtaatgccattctttatgtttttttgatctttgttgatttaaagtctgttttatcagagactaggattgcaacccctactctcttttgctttccatttgcttggtaaatattctaccatccctttattttgagcctatatgtgtctttgcacatgaaatgggtctcctgaatacagcacactgatgggtcttgactcttcatccaatttgccagtctgtgtcttttaattgggtcatttagcccatttacatttaaggttaatattgttatgtgtgaatttgaccctttcattatgatgctagccaattattttgcccattaattgatgcagcttcttcatagtgttgatggtctttacaatttggcgtgtttttgcagtggctggtactggtttttcctttccatgtttagtgcttccttcgggagctcttgtaaggcaggcctggtggtgacaaaatctcagagcatttgcttctctgtaaaaaagtttcttcttcgcttatgaagcttagtttggctggatatgaaattctggtttgaaaattcttaaagaatgttgaatattggcccccactctctgctggcttgtagggtttctgcggaaagattcactgttagtctgatgggcttccctttgtgggtaacccaacctttctctctggctgcccttaacattttttccttcatttcaaccttggtgaatctgatgattatgtgtcttgaggttggtcttcctgaggagtatctctgtagtgttctctgtatttcctgaatttgaatgttagcctgtctttctaggttggggaagttctcctggataatatcctgaagagtgttttccaacttggttccattctcctcatcactttcagatacaccaatcaaatgtaggtttggtcttttcacttagtcccattatttcttggaggctttgttcatttcttttcattcttttttctctaatcttgtcctcatgctttatttcattaagttgattttcagtctctgatatcctttcttctgcttgatcgatttggctgttgatacttgtgtatgcttcatgaagttctcgtgctgtgtttgtcagctccattgggtcatttatgttcttctctaaactggttattttagtttgcaatttctgtagcctgttttcaaggttcttagcatccttgaattgggttagaacatgctcctttagctcagaggagtttgttattacccactttctgaagcttacttctgtcaattcatcagactcattctccatccagttttgttcccttgctggtgaggagttgtgatcctttggaggagaagaggcattctgatttttggaattttcaacctttttgtgctagtttttcctcatcttcatggatttatctacctttggtctttatgttggtgactttcagatggggtttctgtatggacgtacactagtacattttaacttatgatggcacatgatctttcattcatcaaaggaaagtaatactaagattccttttcttcagtttgagtttactggaggaagatgatgtaacacacacacacacacacacacacgcacacacacacacacaaatagtcctccaaaccacttaaatattaattagcattacttttacttagggcaatagtggtagattaaaatagcacacgttttgccaagcttacaaaattacttaaaactcatggcatggatattagaattgtttcacattagtacgaaggacctcctgggattattagaggaactgactttaaagaagtttcataaatttgcagctcattaattttaattttaaataggccttccacaaagtgttttagggaaaaaataacaagaaacaaaaatatatggatttgttttgtcttgaggcagactggaaatgctggaaatttattttggatcgtagaaaaacttcatgtggtgggaaaatgttcacttgctccaaggtcaggtattaagttagcaaagtcctaatgcttttgctacccattagtggatgatcaaatccatctctattgaattgtgcttttcttatattaagatgtaaaattcaaggctcagtatagcacctggtggctaaagctgcctccactgccccagtctggcctttcaagtgtggtcagagctagttatcctctgtgggcccagtaatcaataatgcttgaacaactagtgtggtggccaggacccagtccccccatatgtatcagctaccaattgccacaaaaaaggctgaataaaaaagtcaccccaaaactcgatgatatgaacagcaatcactgattcccatggattttcaggtcagctggcccaggctggactcagctggaccttggctgatttgtccatgcatctgggttcagcagagggtaggttctaggcttgggtgacaccattcagctctactccctgtgtctttcattttttctttggaaccagtggacaagcctgggcatattctcacagcataacagaggtacaagaaggcatgcagaaatgtgcaatgactcttaaggcctgggctcagaactggtgcacttttcctccagccttattctattggccacagcaagtcacatggccaaacccaaagtcaagggacaggaagttagtgagaggaattacaaagccacacagcaaagggcctgagtataaggaggaggtgaagacttgggacccataatgcaattgactatactatataaacagcaaggtagccctgtctcttatcctgatgccttgttgttatcagggctatttcagtctttattgcaatgccgtctctctggaattcagacatgagatctggagactgggtgagaagattttctgaacctcagaaacaatgcctttggaccgaagctctcagcctcttaggttgggttatttctcagaggacccctggcctctcaaaatagccttttggccgaatcctccattaaagaaaccttcgttgtacttttgggcccatagctgttctcacaggaaccatcagagaaatgttcattgatacttagataacaaacctgtggttcagttatatgggatttatccagacctttggatgttcactcttcagagccagggacaatgtgagggaagatacaatcagttaagtgctagtggaaaccagggtctgaatttggttggcaaaggcatagtggctccaagcagaggtaaactgctttggttatcattgagctctcttgattcattcttctctgggatggaatgtgccctcctttcttgttcaagccaggcaagtgctaggcactgggctgcagaagtgagcagtatgtgagccctgctctcctgctgtgagcagagcaagaggctgggagatagtggtaccacacagtgagtgctaggtgggttactccagggctctggagcagcttccaagaggtggtgttgagaggaatgaggactcacgcattccgagcagagggaaaatgtgagcagaagtatggagaacaggactcccatgaagatctgcaggtgtctggaatgaaggaggcagtcaggagaacacagtgagagacagggaaggagaaagggagagaaaccagattgtggaacacttatgagtctggacttcatcttgaagccagtgggagtacagccaagttgtagtgtaagtgcttttaacctaacaagaatacagccagggggccaggcgcagtggctgtgcctgtaatcccagcactttgggcggctgaggcagatggattgcttgagctcaggagtttgagactagcctgggcaacatgtcaaaactccgtctctaaaaaaacatacaaaaattagccaggcgtggcagcaagcgcctctagtcccagctactcgggaggctgaggtgggaggatcacttgagcctgggaagcagaggttgcaatgagctgagatggcaccactgcactccagcctgggtgaccgggggcaaaaaaataataataataatgcagctgggcacactccaggagccagggtggggaagggagaggagaacattgagatggtataggtcattttaccctctattcctctcagtgaaagtacgttccagcttgagttttgagtttgctcctctctccaaccataacagttcctgcttccctgccttgggtaggtctgtggggcagctgcccttcatctcagtgcaggagcagccttttcagggttggacttatgagagatgttgtgctgatttccaccatggtgcccccctcccagggcttcacaagggcaacttggacacaatttttgctttccgtgatgtctttagaacttagctctcctgttagccgtgaccttactcactgtacgaaaagtcgaagcaaaggggtcacagagaaagatttctctgatgactgtgtagacagttggtccatggtgttgtggctggaggcctctgaatacccaccagactgaggagcctttgtcttaagacagagggaaggacatctgggagtgattgtgtcacccagagtggccagagatcaagccataggaaatgctgtctgtgaccaggattcatggatgtttttattttcctctctggagagcatgaattctggcaggcctgtgatctcttaaaacaatcaactcttcaattagaagttcatgatctttaatgggcttgagtccagttccaaaacaggccattgtcaaaacgtccaggaacagggatgaaacttgtttaaaagtttctattaagcaggactgaaaattccatttgtaaaaggatgcaactatgttttgtctttttgaatactcacagtacctaagaaagcatcacatatgataaagaaaaagactatggcaagtgagctttaaaaaaattctttttttgatgcattccatcagaaatcagtggaacatttcattgctgtctggctagccaactccgataaaataaggacttttaagggagatggaaagacacagcaggatatctgtaaagccagaatcatctggtggcaacatataattgtcctatggttgtaaccttgatagtgctgttaccatgggggttgggtggtggggcgaagtgcatttcccaaaactgttggctagctgagggatgagagctccatccatgaaaaccagtcttccagaggaggatccccaaacccagagagctatttagagtttgaaacaaattgttctccttctcaaaagtggcagaatggttagaatcatcaactgcacagcctaggtcagaagtgaagtttgtcctgttttatgaagggaaagacacccttgtttagtgagcactgaccaagcactagataccccactgaatactccatatacataaaagcactgaagtatcttaccagctgcataaccttgagcaagttgcttaacatctctgcctgttttctcctctgtgaaatggggaaaataacagcagcaccttataaggttattttgcatattaattaattaatacatatccaagtgcttctaaaagtgcttagcatataaggaaacactcagtagtgaaaactagcattattatttcatttaatcctcaacaacactgagaataaatattcttatactctttttactgaggcggtgcagaggctcaggaaggccaggttacttgctcaaggctcatgttgtatgggaaagttaaagcttggaatgtctgattctacatcgcgctctcctcctgtacattggcttctgttgtctctgggttcagctatcagctggctctagaccagaggtactaaggctagagaccttgggtaaaaagtcttcctctctttgaaagccccaatccagagaggaggtagatgggcaaaaaatccaccagcaaagatagctgccatccctcccctccattctccccatgtgctgtctgacctggaggccttgttcaatagcttttcctcctggagacacaagcaatctgtcctgctgggtcagtggcagtccttgcattgagtcagcacattcttttttttttttttttttttttagacggagtttcgctcttgttgcccaggctggcaatggcacaatctcagctcaccataacctccacctcccgggctcaagcgattctcctgcctcagcctcccgagtagctggtgttacaggcatgcaccaccatgcctggctaattttctatttttagtaaagacagggtttctccatgttggtcaggctggtctcgagcttcccatcttggcctcccaaaatgttgggattacaggcatgaaccaccgcgcctggccgagtcagcacattctttatctatgtaggttgcattttctctccttggagagcctcagattcaatggtgagcttatggctggcatgccagcagtttcctaaaatgtaatatcatcactattattgttattatatgagggaaggtgaataggaactcatcagaaacctggaaaatgttgtcagaacattagccgtgtaatttttttccccttcattgtctgcaccagctctgaagaaaaaatgcagaagtttgttgatttggagtagctggcttttttttttttttttttagatggagttttgctcttgtcacccaggctggagtagagtggtgtgatctcagctcgctgcaaccttctccgcctgggttcaagcgattctcctgcctcagcctcccgagtagctgggattacaggtacccaccatcatgcccagctaatttttgtatttttttagtagagatggggtttcaccatgttgtccaggctagtctcgaactcctgacctcaggtgatccacccaccttggcctcccaaagtgctgggattacaggtgtgagccactgtgcctggcctagctggctttaatggttgctgtttctggaatctctggctataggaatggatttctcaatggtatattcttgaaagaaaggcaaaatgctcaaccaaatggaactttttgaataagagttgacagattgctcatccttgccctcctcagaacaagtgtttgccgtttctctgatgtgggccttctttttttttccgaaaaagtctcactttgttgcccaggctggagtacagtggcgctatcttggctcactacaatttccacctcccaggttccagtgattctcctgcctcactcagcctcctgagtagctgggattataggcgcccaccaccatgcccagctaatttttatattttttagtagagatggggtttcaccatattggccaggcgggtctcgaaatcctgatctcaagcaatccacctgccttggcctcccaaagtgctgggattacaggcgtgagccaccgtgcccagcctgatgtgggctttctaggagggggcagcagatgcctctcctcacatcccagccacgcatcaaggatgaatggacatgtgggtgtcttccgtgggagttacctggcggagggtgggatttaggccccagggaaggtgaggagcagtgtaagggacagtcacactctgggaaagacatcgaagggtgacatgcccttccagagagcccagcttctgttcacctgatgagaggtgacacaatgctacggtgttcattcgtttgacaaatgtggatggagcacttgctatgggtatgccagacctggtggaaatagacacataatgctgcatcacaatgctcccagtctagaaggggagacacacatgaaaacaggtatcactaactatagtcatgatcacgatgggaatatgagggagttccccggaagcacaagggaggcagcactctacatggtctgaggttgagttctcctagaagcagaccatgagacaaggatttgagtgcaaataattgagtgagcagtgcaggaaatgaagaagtaaggaagtacacagggaagcctgcggtgaggatgtgccatagcacttgtatatcagttacttactgctgtaacaaatcaccccagaactccatgacttaaaccagccaccatttgtttagctcctgattctgtggccagctgttgaggctaggctcagctgtttgggtcttctggtctcatttgggccccctcttgcatctgcaggcaacctcgggttggttgggtgcctggctgttggtttgtggttcgctggcgttcctccgcatggtctctcctcctccagcaggctagcccaggattactcttacagtgtggccagggcccaaaatggagagcagcagtgcactagacctcatgaggcctagttccagagcaaatatattctcacttttgctacattctgttgatcaaagcaaatgtcacagggtcgcatggaaataaactctgcttcctgatgggaggagctgcaaagtcacatggcaaagggtgtgatccagagaggctgtcaatcagtgcatcatcccctgctcccacagtggatgattggcactttgtcctgcagggaaacgtacctcttggaatgactatatctgagaagtgaaggagctggagtgtttgtaccccaattcctgagattcactggttgagggctactctgggttaggtgggtggggacagttagctccctggcacttgcatccttgtctagctatgggaaaaggcccttagatacaaaaatgcagacactggcagctgaaagtcagcaaaagcattggggtcagggtggggagtgtgggaggggatggcagggacatggatgatatctcctgtacccgctttcttaaagactctcagttgatgaatttattctgaaattccaacaggagtatcatatcaccttttgacatggaggcttcttcccattagcttcctaggaatactttcatttcatgttttgccaaacacccaacattctccagtactatgataactattctctattgcattcgtctggacccttttttccccttcactagcaagcataacaatatattattgcacacatgcagaagggcatttggctttacagcaaacctatgaaccatgtatagggctccaagttttgttcccattcgctgaggacagcagcaaaggcagataagggatgtgtccacagcacgtccacaggcagagaggataagatccctgagccctgcatcatcctgggagtgacgtgggccaagcctagccatgcagcagaactctgtgtttcttaggagccctggctccagcgcagctcaggcgtaagcacaacccatgactctgggatgcccctcaattgtcttacaaagtaactcaggcattgatgtggggtagagacaagcccagcacacaagttcttccaggttgggggattttatgtgtgtacttggagccagagcatttctggtgcagaataggaagctgacagacagggattagagtcacttatctgaggtcaaaaaaattaaatagcagaggcaggagaaacacctggtgggaggctccaaagcctgatattctagcaatttgacccatgggccctcactttaaataaccattgcagcttggggaacctggcctgtctttaggtggaaacaagttttggaaattcctcctattgcagaaagcatttgatttgcagtttcctgaatgcgaggctccaagtgtagggaccgccacccaaggacgtttttctctgttgggcagactcaaagcactgaggggagcttttcagggcccaccatacatgagcaacagatagctctccctacagataccatatttcagggacagccccttccctcctgagcagacactggctgagattttccagcttcgactttctagatggtgagaggatggggatgctcagagggacagtgaaggcactgaggcagtaactgtggcaaccatagaagaggctggccacgtgctcatagcggccttcctcctgagacacccgggaaggctgagtctacctcacaggtgtgcctgataaaatttttttgggcagtgttttccttggcttccaaacatagccatccattggaggttttatgtggaagcatctttccagcaggcacaatgacatggctatttcccttgtgactggacgcaaggaaaggatctatgaagagaatgtagccccgaatccctcccttctctcaacttggagcagacagggagccatgtgtggtttccttgctaagatttttgcagtttattctgtgtggctgtgtgtgttggtcccttgccaataatcctagactcacccatcccggcacaggcttgttactgtgggccaagccaaattctgaagcagcgcagttgtttgttgtctgaactcagtcttccccaacacatacttttcttgttgtcctgcacacaccctctcatcagcacccctcccaagtttgttctgagccacctgatataacctcaggtgaacaagaaggctgccctgtggctcttcacggatgaaaagccaaaggcagctgtggcttcgctttgtccccagtagtcactggccacggtgagacctgggtttaacatgacctgcccataaatcagtttgctgcaattgcagtgagagggaaggtaccttgtagaaaacctctagattttatgagcttgtttccctgactgcattccagagccacgtgtgagacttgggtttaacgtgacctgtccgtaaatcattttgctgaaattgcagtgagagggaaggtaccaggtagagaacctctagattttatgagcttgcttccctgactccattccaggtgatcttgatccaaaaatgacgaggctgggtggttgccattggtgtcacacccacatcccttgctgtgcaggtgcactgctcccagctgctgtgctggctgctagctgctcacagtggcccgtcctttggtctggaaagtcacccttgccctgcctgggagggtgacttgttagccaatggctggctgatttggggtgtggattaactccctggtgcagtttatgctgcacagctccccttggtgtctggttgaggctagattccccctgtgcccacagccttggtccactcctgccctgtccctgccccagcctggttccctggctcgccaacagatccctggatctctgccacaagctctggcttccagggaagggagcctatcctgagatgcggtagaacctcatgttttatttatctgctcttagatctcctgtccgggcaggctgattgctttttaggattccaagtttcaaaaggaaatcaaatccaatgtatttatcagacattagtgggagagaaaaaaaaacagttgctcattggctttttatttgccctcttggaattgcagaggattttgttatttttatatttaaaaaccagacttgtggagtaatgtgtgggagaccccttcaggctggtccaggggactttgtgtctttagagattgctctggacacctcttccactgaggctttgtttttaaagaggactttccagacccaagggaatggaagggggctcccttgagagaaatggctttcatacaaaatgtccttactggtggggaactgaagacaggtacagtccttactgcataaggggacagatgatgttcagttacagtcataagcctttctcaccaggagcactggactctcctttaagaaagttttctgtgataatgagatttgaactggaagaaatgctgttctttcagttaacagttgtgttttttccaagaaaaaaaagaaatacaaatgttaaaacttttttttttttttctggtgctaaagaacaatttcacctcctaagccaagaaggaaaaaattctcatctaaaccgccaggcttaaaggtggctccttgtcagtcctgaggtggtagaattgaggtgaatgaagtcaaccacagtttctaatgtcttcttatatgccttcagaaacaccatgctcacctttcctcctgctgtcctaggctgagcctgccatccctccttccctctgtccatcacagcctccccttagggtcattaactcagtccctaccactcaccttcccataggacaggtgttcttaacctggagtctatgtcctcttgctgatctgtgaacccggataaggaaatgattgcattttgttttcactaacttcacactgaaatttaacatcatattcaattatgaatgtaggaaacagactacagtaatattaccaggacctgtgactctgtcccaaatagaaatcacaggtattgtcaaatcaagttagagttattgcagatatttcaaactaccatttacattcatccctccttcagagttatagcattagatttacctccagatctttttatttaatatgttttttttaaagcatattgctaaactacacatttgtgctctcccctttcccatagggctacctcacctcccaggagaaaagattcaaaatctaggagattcataatttcaatatattccattgcttgtgactatttatggccgtatttggttcctgagctagaaacagaaaagttatggccatgacagaattacttgtcaagggactatgatggccctgctaacctgggctttcttgagctgtctgccccgctagctttgatgaaatgcacatacactgcttgcattttctgtgcaatggccaagtgtaacaggcagcacacatgtggcagatcgtagcagcgggcccttgccgggtcaagtcatacatcgctgcacaccggggctgtcttaggacattggacctccgagcagcctgcagatcttgggaattcctctgccccctaaagtattctttgtctttaatccagttgttacagtgagtgaacctgatttgttccagatgtcctaagatttagtgattccggaaactactcctaaagtcaaggctgatgaggatttgaattcctctgttagctgggaaccagcagttcttttcacagttaaacagatgaggcaggaggagggagactgagctgccttgagggacagggaggggcccactgactggcttatttgccttgttagaaagaggatggcctttgaagcaaatatcgattctaccactacatggctggggccaaagtcagctgggcagggacatggacgtgctattttttttaaagtaatacatatttaccttaattatctgaatgttgttgctagggaaaccactattttggctcagatcatcttagtaaatgcttttttctctcactttttgagcataaaactggcccaggtgggtacctatgagggaggtggaggtatttctggcttcctataagtgagtttttcaaaccagaaattcagtcccaggaatgatttccctgacccactgtaaattttaattgaggtgcgttacaggggtgcactatgatctctctctggagttaataaccatatggatctgttttgcctgattagaagggatttctaaagcatgatgagatggggaagcacaattcaaactacatggcatagtaactcactcccagaggaagttaaaacatgtatacatacatatagaatgttctgtttaatattattggtttatgcagtatttgaatatataaatatgaatataaagccacgtacagttatggatttaaaacaaaagcagaacttaattaatgttgctgtttggatttttttcaagtgtatttgaatgcagacaagtatccagatagatgctagtggaagtctgggacaagctgtataagggtatcaacccagggttcagctggagctgggccagactactaggttgtgtatttagagaaactagggcaggactgctggagaagaagctgagtggtgccaaggtagggcagtgatatggtttggctgtgtccccacctaaatctcgtcttgaattgtagctcccgtaattcccacatgttgtggcaggaacccggtgggaggtaaataaatcatgggggcgggtctttcctgtgttgttcttgtaatagtgaataagtctcacgagatctgatggttttataaaggggagttcccctgcacacactctcttgcctgccaccatgtaagacgtgactttgcttctcattcaccttccgccatggttgtgaggcctccccagccatgtggaactgtgagtcaattaaacctctttcctttataaattacccagtctcaagtatatctttattagcagtatgagaacaggctaatacaggcgggataggcacacctgagaaggaggacagggtcagataaggtggtaagctttgaacagaagaaagcgtatcataggggatgttgagcttgttgggatgaggagcatccaatgggctagagcaggtggtttagggctgaggctgtaaaccacaggggattacctatgtttatctggggcaagttgcaggataaccacaggacaagactagtagttggacagaaataccaatttttattattctagaatagattaaaatataaaataaaattagattttctctaatatatttagaattgaacctttttgggtacaatattcttttttagtatttcttggtgatttttttttttacaacaaaaaatagagcaatacctttcttggttagtaaaataaatccctaaatatttgccacaatctctagaatcttctaaatcaggaaattttaatgattttcacagcagtgaaaattgatattcatattctaaataattccatgtttcactgaaatctgcaggaatcgaaaacaataggcagtcactaactaaaatgggacagcaagacagaaacagtttcctatccctgtaggaaagagaaatctcggagctttcattgcatgaaaaccgactccattttagtacctcgttgcactttaggctttccttgtccagagttctcacacatgacagtgagctccaactacaacctattccaagctgagagtaatggactgagaatctgaaaacatgacacatcaatccattccccacctttcccctgtgagactcaaaaaaacatttcccaggctcccttgcagataagcttcttgggaagttcagccagtggcatcactggtgtgagattggagaaagggaggaggagaaaagtcagggtgtttctcctcaactccactcactttaagcagcatctctggcagtagctacttctcctccaccgtcttagctccctcttggcagtcccagtcccagtcacaatcacaacacctcctccctcagtccctccaactctaagggtgtcagcagttgcttctgatctcagcttttccttatcttaccttgtttgctcttctggttcttttcacacctttgtacctggttccccattttaatcccttctatgaactacctggcatgggttctgctttcctctctggactctgactaatacatagtgggtttgaatcctggtactgccactagttactaaataagttattaagttgtctaccttatttagtcctcaatgtctttgcaaaatggggaggaggttggtctgtaatgaattctgagatcccttgaagctttgaaaatccgtgagtctctaaattttgatctcataatacatattcatgaaatgagtgtatttttctagctccattacagagatagtttttattatttgctttctaggacatggccttagccttcataatactgtttgtttacagatttcatgaaggcatttaccctggcattgtaccactaaaggctgatgttggcggcattattcttaggagacatagaaatgttgtggttttgagaatgggcttttatattatttggcgtagattattaaagaacagttacctgtgtcatgaaggagaggcccccagactggcactttgaatgcaaattcttctgtgacaaatccaggggactttggaataactctcagatatggcagtagacttaactgtaaaagctcccagcccacagaggtgagcagaggctgaggagtaaacaccataccaacattctgggacaaaatagcctgaatgctgttgtaccttggaaatgcaatagcagctgccttcctaggtggggaagctgagagcagcctcttacaggagtgcatgccctatagacagaggctcatgaacttgtgcttgctgacatgtatatcttcttcagttggtccctagtgagtctacccaaagtgaattgcactggggaaattcagaaatatacacccctcagattcaacaagggtggtatcttgtgtgtttcctttaagttataccagtttatggcaggggcaatgttcaaaatagttaagaacctgcacagcatgagcacacctacctttaagaacagttgccagtcatagagaactggtacagctcccctggtgcaacccactgatggtcagtctggggccaggggtgtctttggtcacccacacccacatttggctggactgtgaggcctgggacttgaaccacatcagtagaaattgaggctatggcacctgggatgtctccttgtgacagttacgcaagaaggaaagtgaacagaatgtggatcccaagggttgggtagggtttgtccagagccttgggtcctttccagaaggagcttgggcccctgtaattcagagatattcagattaactgatctggtctcctgccagtgacaggcctcactcactggaccattctcctattcagaaagctgacataggatcctgtagcaggaatgatcagtgctggctgcatcccttttatatttatgtgctatgctggtatgcagctactagtaactatatctctttgccttttctgcctaccaagtatcttgccagaggtactgggagtagatgtgcagccccccgcctttgcagtagccctcaaccaatgactgactagagtggacacgtaaatattccctcatcccacaaatgggataactctgttctgctcatgtgttgcacagtttcccagagctccccagcaagattaagttccaggtgctcagggagctgactggcttgatgttgctgcctttgctggttgcctgtccttctgtgtctcactctaccccttccctactggtgttttatggaaccacctctggaataaacaacttgctttcaaacctgtctccagctctgcatctgggggcgcctgcactgacattctttattccctagatctgtgtggcttgctacttttttctcccaccacatcacaggtaatgaatgaggctcatttgcacaacatacaactttggacatcagattttggtgaaactcaaaattacttggtgagaaagaaaagcacacatatgttacgctttttttttcagcatttcacaatattcactaaagcattttataagcaagtgagttgtaggagctaaatatgatcaatttttaaaaactactttttttttttttttttttgagatggaatcttgctcttttgccagactggagtgcagtggtgtgatctcggctcactgcaatttctgcctcccgggttccagccattctcctgcctcagcctcctaagtagctgggactacaggtgtgcaccaccacacccagctgatttttgtatttttagtagagacagggtttcaccatgttggccaggatggtctcaatctcttgatctcatgatccacccgccttggcctcccaaagtgctgggattacaggcatgagtcatcacgcccggcccaaaactatttactttcatttttacccaaatttatttcccctggacgtctacttcacaagcagtaacataagcaagtatgtatcattaaagatttatcacaaatcaaccatattatatcgtaagtaaagtaaaactggtgaaacaaatttaatgcagtatatcccaaaagtaattatttgagcatgtaatcaatattaaaacaactgtggagatttttacatctttgagtatctgctgtctttgaaaactcatgtgtatgttaaacttaattcagaccagccacattttaagcgctcaaatgccacatgttatctgtagcaaccatatggggcagctctggtctagcacatgaacttcagagttgtcccactcaataggcaagggagctggggtaattatacagcagttcccatcagtcattgagggttgctgcagagcatgtcagaggcttaattcttaggcactttcctggcctgcagaaaaaagccctctgacaaagagatggggatactgactagatagaactgcagtctgtgcaggttacacagtgataagaccccaggtggaaccacttatagctgactacattttttaatatcttcactttggtgttttattattgtcaaattacttgcaataatgtatcttaagttggtcactcaagaaaacttggttaaattcatgggcctagaagatcaacatcaaatctttgtcttcaagacctaagggaatctggatgtgccctacacatatctacttgcctctcgctaatctttctgctaagagtgtccttctcctgcccctttccatgttatttctgcccaccttcatcctctgatcatgtttatttttctctctggctggaatgtactccctgtttttctgcccatcaataggcagagcattttacaagcaagtgagttttaggatcattctttcagatgtggctcaattgctacctgtctctggaagcttcatgtaataacttcagtcaacagtgatatcttttccctgagtttctcttgccccttgatcttcacctgttcctttggcaggtcttatcaacttcatggtttatttcctgggtaattcatttaccagcatgcattcaggaggtgcctgacagtcctcacttattccctgtagcttaattaacaccgtctcttaattcttcatgttataatcaatttatttggtattttttgctcatatctctcatagaaagacaacagatgagcaattttggttttatggtttactcatgtttgtaattttaaactctgaaaattgaaaagctttgatagttgtcaacaaagtacccagaaagaaggttgcccatgagagtggctaaagacatctagagtcatctcaaatgcctccacaaatttcaaagaaaattgtcaagagaaaagttaagcacctcagtagcatttgtaaagagatgacaccttatgttctaaatattctcccagtattctaaaatattctaaatgctaaggaaataaacacaattttatttataatcttatagccaagtatgtttcatatacattgatactatttagttgcatttttatatgctttaggagcaatgggaaaggcaaaggagcactgactggaccaggggttagagctctgcccttgtctgctgagtggccttggggaagtcatttaactgtctgcctttatctgcaaaatggtgacccaaatgggcccccttccagctgtcaaattccatgtctgattttatgatgtctgccctttttaagaatgggaagcattgtttgtgatttcacattgcaggggctatttacatgtatgatttgcatcattgattttatgatacattgttgagagtatctgtgatttttttggaagctgaatccttactgagggcatgctgcccctagttatgatattgctcctaggaagaataaaatctgcttcacaatgtcctttttggtatgatttccatgattgagaaaactggggattgtatgtgtagtacatctggtttatccacttgtctgtccatggacactttgggttgtgtctacccttggctactgtgaatagtgctgctatgaacatgggggaacaaatgtctctttgagttcctgctttcagttcactgggtaataaacccaaaagtataatttttgggttatatgacaattctatgtttaattattttgagaaatgttcatattgttttccaagcagccactcgattttacgttcctaccaacagtgcacaagggtttcaatttctccacattcttgacaattcttgtcttctgtttttttgatagttgccatcctaatagtcatgaagtgggaaaaaatagtttttaaaaagtaacagatggataaacaactaagagaaagaaggaaggagtgaaggatggacggatggacagacttggctgccctatactattatcctagtcatcattgttaaatatagttgtggttggtagatacaataccgataataataatgatggtgtaatgagaatttttttaatgcaaatatagttggatgcatttgattaacacttgtgctagcctttactcaggctagatttatgatggcagcaaaagaaaaggtcatggtttttatgtctaagacttaaggaaaatctaagtgatccaacagaatattattaagcaccatccaaaaaattatctggatagaagaggaaatttttgctttagttgccttagtgattcagcatatgtggttgatatggaaatgtattgcatttacccaacaaggaactttgaatggtaatcctaatgtacagtgatgaatgaggacagaaaacaagttctacagagattttctggcttgacacagctgccaagatgtcatcagtaacatcttccattgagtatagtgaatgaattggtgctaaacttaagtacaaacccaataacgcagtcaaaaaaaagccagctgctataagatatacttgggtaggatttttaataacaaatgagcaatatattttcagcaggctatatatatgctgtaagataagctttatagaagcagtacactttgtatcttatgttgactactaataatgattttcatttaaaagcacagcaaagagatccatgtacaaagtaatataacccacttaaaagactgcacaagcaaattaaaataaatggggaaatttctcagggaataaaatttcttgaagattagaaacactgttcctcaataaataagcacccctggaatgtttagcacaaaaactctatgcttgatcgttttactatttcagcaggactgtcagagaggttggtctttgtggagtcctgttcctttcaggtgtttgtaaactttcttgccaaagcccttcccgactgagatggagttgatattagagccatggctgggacaaccttcatgccaaaggaggtgtgctgctagttgcaactcagaccctgcatggcccgggtgacctcagttgggtgggttcccctttctggggctcaacttcttcatctgtaaaatgtgaagggggagctgatgatctgttgtggggatgtcatggatgttcattcattcaagtgttcactgaacacctgctaggagagaccaacctctctgacagtcctgctgaaagatgaaaacaatcaggcacggggtttttatgctgaacattccacggtgcttagttatttattgaagaagaatctttctgatattcaaggaattttattccctgagaaattatgtgccaggcactactctgtcactaggagttcaacgataagcaaagccagagaagggtcctacccctgatgtttagattctagtaggggatagacagtcctcaaccaaaaagccccacaaacaaatgcataaccacaacttcgataagtgccatgaagggttgatggggcacatggggggtggggggctcataatgggaggatttatttcacctaggcagggagatcaggaaggatcccctggggacatgatagtcagggggctggagaatgtgggttatgttggagaggaatgagttttgaagggataggagttgctgggttctcataccagcacagcgtcttctctctcttcatctcaatttcctcatctctctaatatgggcctaatatcaagaccctttctcagtgttgtgaggtttcagaaggatgacatatttgacaacacccaatatcatgctggcacatcacattttcatttcatttctaaaaataactttggaagcagagatatgctgttttagtcaaagacttttttagctttggagaaagaatgaaaccccagctttgagactcctctaaaaaaaatctgagttcacattctgccctggaagttgcctggctgcttcccttaatcacagagccttgtttgaatcacttgactttgaaatcccaggaatgactttgctgtgtgattaagtgacagaggcccaaggtttggggattggcagaagtttagatgtccctggcctgatcccttaccctttacatataaggaaaggaagctgatcacatgaacaactaaactggaatgaggaggcagcccctcctccatggtcctgggctcatctatactgtctccctgccaaatattccatggaaaccttggacactgtctgatgtcaggactacttatgaatgcctgtccacttccttctcaagataaagctaggttagcactctctcataactcaagcctgaggtttattcttttaatcttccaaaagcaaacagaagaacagaaataacctatccactgtttaagattaaaatggccaacaataataaataattgccacaatagcttgagatcagggtcttaatttattggaggccgttcaagaatttgcagctcttaagttaatttttcacatcttgtttggatcctcagagcccgtgcttccaaagcaaggccatcatatttctcattgcacatgttattcttgttgatgtgccagacatgcaggagagtgaggtcctctcttcacagatgggtaatgaggattccacccccccagaaattagtatttcaaagtatttttgcctatggagattttgaagagttctcttcttttgcatggtgtattagctgtattaatggttgcaaacaagaaaaacgtatgctggttaatttaagcagaaaaggaatttattaaaaggatgtggggtggttcagagcatagacaagaaggctggggaaccaacacaggcaggaaacagaggaggcaagtcttagtccagggttccacctctgggccctttactcctctgtagctacttcagatgatccctggtgtctctgtgcaaccctcaaaatttgtagccctgggtgggagcatctgttctcacatcgctgccacttgatcacccttagatcacatgatttcacttaggcaagtgcccacaccctagtgatcaagaagaggggaaagagagggtctgccccctttctgctgatgtgccgccccacctatcttgagattcccccaaaacacgaggatgtcaggatgctgagtggccaaaaataacaaccgttcattatacaaacccttatatccttaattacgtcttccattaactggttatccgattaaaactggccactcacatggatttattttgttcaaaggtcgcatcacacaataatcatcagtctctcatgcatcttcatccttgtcatcttcagcctcagccttatcaccgttctcatcctagccccgttcactcacccctgtcctgggcccccatttccctccatctcctcacctctcaaacgttcacctctttctcctccaactcccagtctttcaccctacttctatttcactacaaaatagaagcaatcacagaggaattcccgcatgttcctaccacccatctactaatgcatcttcagctcacctccagccaggcgagaacagtcattcatcagaccccagcaattgttgcctgtcgtgttttcattaattgttgcctctctaatggatcattcccattagcttgcaaatatgctatgataattcccatcttaataaaaaagagcaaaaaaactccctggagcccacttcccccaccagctaccatccaatttctctgttctcctttagagaaaaactcctccaaatagttgtctgtcctcattgcttccatttgttctcctcctacatctctgaaactctctccagttaggctttcctcccatcgtgccacttcagcagttcttatcaaggtcaccagtgacctccagaaggctgattccaatggccagttctaattattcccattgttctggcctgtctgccatattggacaaaattgatccttcctttcttgagactgtcctctgtgaccatgtggatgactcctctctcgattttcctcttccttctctagccatgcttttccagtcttgttggctgacacctcctcatcttcaactcctaaatgtgagtcctcatttctatctatactcatttcctagtgatcgtttctagtctgtcccaaatgtatcctagcccagacccctccttcaactccagactcatgcatccacctgcctcaaaatctcctttaaaacccaataggcatttggattttctctgctgaaccttctcaacccagtctttcccatctcaataaatgacaacttttctcttctagttattgaatccaaaatccttgaagcagtccttgactcctcttttcctaacacccttcatccagtccatgagaaaaatctgttggcatgacctttgaaatgtgtccagaatatgaccccttctcaccccctcagctgccatcaccctggccttcacgttcatcttctcacacctggattgtcacaagagcctcctactcaggccccctgttcctctcctggccactccacagaccgttcacatcatagccaatgcgagcctcctttaaacactaacgtcaagtcacgctgctcctctgctcagagccctgaaggggcttccgagggtcaaaccaaggtccctgtgctggccctcaaggccctgtgggatctgctgccccaactccctcagtccctctgagctcaatccttcctgctctctttatcactcctctccagctgcactgacctccttgctgttacctgcacatgccaggcacacgcccacctcaggacttctcctttgctagtccccacataccgtgtttcttgctccccttctttcttcgggtttgtactgagaagtcacctcatcagtgagacttccctgatcaccttattgtaaattgcaccccacctcccttgtaagtctggcatgttctatcttccttaccctttgtaagttttctccacagttcttaccacaatctgacagacatatttgcttctttctatgtgtgttttctctctccctgaagctaccaggactctgttttctttgctgctacttccctagcacggagtagtggctggcacatggtaggcactcagaaataaccgcatgaattcatgtacaaatgaatcccacgcttaggttgttaagtgccttatagtttttgaagtttgatgtacaagatttcatgtgagcctctaaacagtctagtgagttaggcaaggtagaaccctgtgctttacatgaggaagctgaggccctagagctaactgattgcccaaggacacatggctagttaatggggctcctggaacttgtagttctgatctcggtttctgccccccaccttcaactaccccctgtgcctcatgttatattagtgtaggcctcagggcattcattgctgtctatttttcgttacagtatggatgagaaaaccctgtatctagctttgggggctgtgaagaacatctccctaaacatctctatctccaacctcggagatgatgcctatgatgccaacgtgtccttcaatgtttcccgggagctcttcttcatcaacatgtggcagaaggtaaggagggcatccctgtaaaaagagcagttgttccatctggtgcgcttgctgactttcattattgcctggaataggcaatgattctacaagcactaatcctttctgtggactatcatttagaatgattagaacttttttcttcctgggcttagaaaacatgttggtatagccaaagaagcagccgtaaatgcccacagagtgccagagaagtgtctgtatttatgtagtctcccatcccttctctcttgtggaatcctctccctatggttttacatctggccccttcttggagatgatacagttgctgtctccagcacacacatgttctagagaattccagttttaggtcagtagttgtgaaagtaagggcagatcactgcttgtcgtgttagttattatgtatgatgtacttgatgtttctagtagagggtcactgctttggcctgtgctttggattatttatttatttattttttgagacaagtctcgctctgtcacccaggctggagtgcagtgccacaatctcggctcactgcaacctccacctcctgagttcaagtgatcctcccacctcatcctcccgagtagctgggactacaggtgtgcacctggctaatttttgtattttttggtagagacagggttttgccatgttggccaggctggtctggaaatcctgacctcaagtgatccgcctgcctcagcctcccaaagtgctgggattacaggtgtgacccaccgcccctggccttcctaacatatttgagtgaattgaggtagttaaattatttccacaaattgagtgagtttttttagagtaaattaatttgaatgaagtgaagtttatatagcatgactcaaaggtacagtgctggtattctcccctacccataatcatcccgagtgtaccacctctcagaggaagtgaacaggcttccctgcagacaacaagggggaacaagtggacaaaagtcgactctgctctacccagtgttgctctaactgctgatagctgttcagctgggactgcttgcagctttttaatatttacagcattgaacggggttgccttgttctttatgttaaaatggaaccaaaatcactttctgtggaaaaccttcactctgcccaccgatgagcactgggcatacattgagcaggtcaacggcgtttgttcaggcacatattctgtggcctcaatagtgttgacaggtttgtgccaagcctgcccagcttaggggacagctgaaatgctcagagccaccaacagtagaggcactccaaaactttccaagaagtcatctcagattccctgctgcttcatagcttttaggagctccagggttgagggaggccacaaaagcaatcaaggactgcaggaggggtgtgctttccatccactttctatattctaaaaattaccgctggattaagcccagtcaagagagaaccaagtatctgtatggttcaagtatcgctggccacacacacagtatcttttacagaatcgcatgtgctgtgatgccatctccctgtgcagggtgggttggtaggtgggggaaaggggcttccttggggatttgatctgtggaactcatctctgtggtaactgaaaagatgtaattggcaactggctcattacattacacagatttctctcactcaggacccatgcgagaaatttccttccagcctcatttaagctatttccagacttagaaatagctgtccctttgcctgagaattttggcttgtttttaccttgtgactgactaggcttcattctctttattggctgctagaaagctcagagctgaccccactctgtcagtatataggacttagtcttactattttataaactcactagcctcctgtatcttgctttgctccccctttaccatgcttttctttttagcttggagattgcataatattctaccatatggatatactgtggatttaccttaaaaattcctcttattctgtatttaggttattcccagtttctatattaagtaaaattgtgagaaatgtcttttatggagattagtaccagtaaatgatcatatccttagctctataacttttcagagggtgtgaagtcacatttttgaccacctactatacaccagggactttttgcatctcgtccgcatcccctcttcactgcatgaggcacaatgtgtgtgaattattggaggagcactctcaggagaagaggggcgagggagcagggaggggcaggggatgggctgggagggatgtgctgtcgggtcaaagctagccttggtctgatttatgggctgggaagaggtggggaagccctggagcataaatcactctgcagaattgtccccccttgaagctgctggggacagcatcattttctacccctgtatcgtcattggccactggagggacgcaggcgtggtgagtagcctcccaagcatgctggacaaggaggctctaggaagtcaaagacaatgtgcctgggaaggccacaggtacaagccattggccactgtagctggccatgggaaaaatgggagcacatcattttgatctctttgccattgaattccagcaacctttgaaacctttgtcacaaggaaccctaggtttcagttcgacagaaacttgacaaagcatcaggctcttcgggacgtggtgagtgttagctccagagtggtgatggagcagggaggtatcttgtagctgctgtggaggcagggccagccagaaacgcagatgggcaagacgaccctcagggtggcaggaaaaggaagggaaaagaaacagaaactacccttccaggactccagccacgctgcaaggttgataaacagcggatgtaaatggcatcacccagcaccgggtaggattctgacaggacccagtggctagtgaggggcaccaggagagcccccccaacctgcttaacaacccacaggcctaacaggaccaacatgggcctgtgaaatattctaatgggtaaactaagaaaagcatgactaagatacagagggaaagcataagttttaaaaagattattaatagaaaacaaaagtaaattttacagagcatctactttttgatgaaagtcaaaaaaaatgaacaaagtggaagatcagacagtagaacaatagactgtatgaaaatggaatggactgggaggcaagcaaaaataaatgttatggatgggataaagaaatgttacaatgaaaccaggaaatcagtggcagaattaaaatatgttatagtcaggaaagagcagaatcagcagaacagaaaattgatttaatgatgcggaggtgtttttgagaggctctgagaattcagagaaaaagaacaaagcaataaaaaaggatgacatgaggactatattgtggaaggtagaaactggaaaacagcaaagagaaaatggttccagaataattggaacagaagccattccttagacagcaaaggaggatctccatttcctgaaatgggtgcagcagacaccaggcaaaaatatttaaaacattttaatgtctacaaatagcttcatgaaatttttaattttaaggatatgaaaatgatactattaacacttagcagaaaacaaagaaaccagtttctacagacttttctgtaacattaatgtccaaaattagaacagtatattccattgtgaattttaaattcaacacacagccaacttgccctccattgtgacgtcaaaataaagatatactcagatatatgagaattcataggctattacctcttccagtttggatttccccaaaagcataccctgatacaatgatacaggtacaggtagtttatttgggggtgggcgatctcagtgttgagtttagacaggaaagagaggaaagacaggaaggcgtgcatttataagcaggttactgccgtaggcaccttgggcttgtcttcctcagaccctccaagagactgtgtgtaacaaacctcacatccacttcactccaggatgaggaagctgctggaggaccgatcccccagctcctgtcattcatcatggagaaccattccctgggcatgaactctctggcacttccagccttctctaagtaggtccacactgcctggggccaggaagcaactcaggcagaaagatgtgggaagcctttgacctggaggggcatggcttcaggtgaccagaactgtggctggttctggggaatgtgagcgaggtgctggccacatctgctatagtaaccatgagagcttcctgaaaagtagttatttactgataaactactcaagaatacaaaagtagttgaataaaaagtgtgccacagccaaataagcatagaatgaagcaaaacaatttttataaatatttacaatagtaagcaaatgtaaaaaaaagtattgccatggtaaatgcataatttaaaagattaataaaaataatcccataatctcagttataccaataacaatttgagaagaaagttgacattgtgactcctctgcttcactttcttcaggaaggagttcagactcctcagctcctcatgagaggccgtcctgagcctggtcctgcctgcctgcctttctccccagacccctggctcaccatgcccccacatactcacttgaatcagtcgccacttaataccaaagctgcctttacccaggaatcacccccaccccccatttttgtttaatgaactactatgtccttaaatctcagcttagggagcccgtgtgcaggctcctcacctggctgcacaggatctgtccacagaatagatggatggatggatggatgggtgggtgggtggctgaatggttagataggtaggtaggtagatgactggctgggtgactgggtggatgagtgggtggatagttatgtggataggtgagtggggatggctggctgggtggatgagtgggtatgtgggtggatgggcaggtgagtggatgactggctgggtggatgggtgtgtgagtggatggctggctgggtggatgagtggatgggtgagtggatggctggctgggtggatgggtgggcgggtaggtggatggatgattattcattttgtgcaaagttacagagactcaaggcccaggcctccaaggttacctatcttctctgtcatcacacagtccattagttatgtattagcttctaagactgaatacaaaatatcccctgcaatggatttttctgtcttctaatgcaaaactactttcatagatttattctggattattttttcctttgagggaaggctgcttataaaaacatggggtacacatggatgaccatctgctggcttttttctctcctaaataaagctaacttgaaaacacattataaaagagggcttaatttgttggtggctactctgctggctggcgtgtgctgtccagccagagcacagggtattatggccagcaactgggtttcctcaggggcaggcccagtgcaccgtgttgcctgccgggcaaggaaccagcaaagcctcactacagagtgacaattcctggggtgccctgtgggagcagtgagagggagctcctggggccggggggtgctgcatggttaaaaaggagcataaggaagaatagataaccactgcatcacaccagggtcaccattcacactgggttccatgtaaacgacacctccacagaatataatgtgagtggtgtccctggagatgtacagctctatggccctggagtcaaggtaaagcctcattttaattttttgccctggagccgtttggcacaaaggactttggctcttcttgcctttgtcaaacagccatgaatttgtttggacagcagttgttgaatgcctgctaaatgctagggactgttccagccacaaggagacacaaagatctagtccctgctcccagggagctcatggcctattggggccaaaggcatgtcagtaagcaattaaagcacaaggtgccagctgctctacagaggtgctgaaacgttgtttgaagcacagatatgacaaggtgaagcaagtcattaccacagtggctagtgccatgttggacagaatccttggataagtgcttaaggtacatggatgagcctccaaaggatctgatgtcagctgattcctacattgcagagctagggtgggtggaatgagtcagtttatttggctggtgaaggaggaacctaggttggagcagggatgagagggtagaagagagcaaaggaggaggggcaggagagaacccggtaggatggaaagaggctgcccatgttgaacaaagggccagtaacatttctggtggcagggagatgtcaggacattttagaaatctgatgcctgctgttacaggcctgtcaggactttaccactcataggttctaagaaatctcccctccccacctcattctgttttgtttttagcccattctggatttctgcactcatgcatgcctcatgtgaccagggataggcagggagaaaaactcaaggggctggggttatgtgtacatcttcatggtattgactgttatggcatgcatggaaacagacctggacatgaaaggataagcttcaagccaggtgcatgagggctcccagctgacttttgggtgcaaacaggatgcaacagcttgccacagagtgatagaggaggccatgctaggagagaagggagaacaagcagggcaggcaccctggcccgactcttacacacagtgtgagatgctctcttggtttgggtctcccagatggcgaggaattcagggaaatttctttatttgggagatgcaagaaataatggtagggggttgaagtgatatagtagggaggtgaaacaatggtagggaggtgaagttatataggcaggaggcagtgaatgaaaagtgagctgttaaaccaactactacagtgggcaatggggcttattcctgcagggcaacactaggaagagtaagggagctgggggttttatactcctttccccaagtgtcaagaattgaggtctcctggggctatttatattctccagtactcctgccctcccatatgcatggcaggagagacctacatggttttggaaaaatgctcttgggtgcagagatgccgtaatatagcccctggcagctggaagtgggctggagcaccctgagagtgcaagtaatgtggtcagggctcaccagcctctgccagagaggcccacaggattagaagtatctctaacctgagcacctcactttctagactcctagaagttgtgggttggtctgatagagcctcgctgaggttcttatacaagatctagtagcatacacctcacagtgtgcaggagttgggtgaggcaggtgtggtatgtgggtgaagaggaccagggtggggcaggaggaagcagtgaagacagtgggaagatggagggttccagcttcacccacagggcagcaggctcacagcagcattcagtggttgccaggtgggagtgaggcccagcacactctattttctaataaaaccgagagatcttatgactttggcagctaattaaaatgttttctgaacatcgtatgagccaaacaaaacatgtccagtgaccacctccagcctgcaggccaccagcctgtgacctccagcctggctgttttccgtatgttctagtccggatctgcatttctggtagaactagtctgtctgcagccttactgtgtttcatgttctccccttggcaacagataaattagtcaaagagatgagagtttggggcttcaagtgtccgagtgtctggggaaggagaggagtggagagggtcaaccggaatgtagtgtccatggaatttttagaactcatgatgttttgaaaactatttgctggctggaatatttgtacttcacagtgattgcaagaagcagctaaactggagtttgaattttagaagctgctagaagtaaaataacaggcaaccagtgtgaaatagagggaaagtgtagctttggtgaccagcagatgcagagttgagattccaactctgtttcttgtggccagtgtggccttggctcaagggtcttctctctgtgcctcagtttctttctctataaagtgggattgtgccaaggattaaatgagtcctacaccatcatgtacagtcccacttgtatatgatgggtactaccatggtagtcccgactctgccacacatgagcttatactttatagctcattcatttactcagaagagatatactgatcacctacttcagaccaagattaaatgctgagggggaagaggaaaataaggcaagaatataaaacatagaatgtatgtcagggggtgataactcttccttttaagccaaaaattatcagtcattgtcttaatgaaggattgagagagagagagagtgtgtgtgtgtgtgtgtgtgtgtgtgtgtgtctacatactgtaaaaaaaaatagagacagtgttaaactgacatctcttaatttaatgagttgcttgtacttaagaaaataaaattatatgaaaattaatgtgaagcagtaaatataggtcagtcaataaatgtctgtgttggcttttgtgactcctgattttattaaaataatgcttgttgattttttttttcccatttacttaccattttgcttaagtattggagtttttggtttagggatattgactttttaaaaccaagatatataattgttcaaatatgtgatgcacgtaatacataatagcgaagtttagataatgaggagaataatgccctccaaaaacaatggcagggggctaggtcctgactctttcagactgggcagggaggcatctggcccaaagggctggaggagtgcggtatgggattcagactttttatcaggtaggcagtaagtgaggtcttgactgagagaacagagaacgaagaacagaggctagagacatcttagaggaagaacaaagaaacagtgctgacaggccaggaaggtcagagactcagtgttgggactgctggaagaaagacaagtgaggaagaggggtgattgtgaactcagcagggagaacccagatcctctactcctgatcatgctctagcgcacagagcactgtaagctcgtgaggaatgtgcttcgtacctggcatcggttggccataagtcactgaatttggctaataagatgttgcattgtctctgatctccttgagagactgagatagatggataggccctaggtccttatttcctccatgggagggtattgtgggaggggtgatgatgttcgaagggaagctcatttttgctgtttctaaggagtataatttgagttccaaattaaactggtcttccaagttggggtttggaggcagtaaagcaccaggtcaactttcaaggctttcagtggctaattttttatgacagaaggcatcgagggcttgtaagtttgtttttcttatcaagtgattcttcagattatatctacctttaccacagaaagggtggtccctttctttcaggagtggttctctcttcactttcaaggcaaaccgctcaagatggcaccaggtgataaaacagatccacttgctaatctggatagagcaggaaggacttaaacatttatgtgtttgtatacctttatttgagggagtgctttggcctgtttttagacagaaggttccatacagaaactgcatctgggcaggagaacaaagcaaattgtgttacagccgggaaaccaagcattgagcaacagaatggttcttaggcagaagtgagcctcatccctcagtgctgggacagattacagccttccttcactgccgctttcattcagcgcagggactgattttcattgtgttctgctttctctggtgtctcttgtcaagttaatagtagcctcaagtaaaattcaacccttagatgtttatagtcatcttggcctggccattaagatgatgaatgaacttgctgcttgccctggtaagagagccctgagggtggatgccgatacttagaaaataataagtcttttccgcccccttcctgtctttaatccagtgccccaagccccctggtgactttaccttgaacttcctgtataacgccaggtagaaaagcctcacctggctggaagcccactcgaggctctaacacaacagcaagctctttatcttgctttgttggtcttccccatccgcttatcagatggaaactcggcattcctcagagacccttcagtgtttctcagttgcttctgcaggcccttcccttcctccttgagaggacaagagaaggtggcggggagcaggcacccccagcctgtgtttgtatttcctcacctggattacctgtggcccttgcatcagggagagcccagccttgagtgaaactgcctgggagacaggctgggcgcttcctgcggcagtcggcagtgaggaagtggtggagaaacgcagatgtccatttcaaatcacaaggcggcttcagtattccgccgcggggctcagctttcacgtatatgaaaagcttcatttgtgtattcactgcgtttggaaggaaggctatgttttgctttagaaatgtcaacagagctgtagttacgacaaggatcaattaagaaggacgtttcccagagccgcaagacttgagtgaatctgtggggggaatttagaaaacatgtgttaaacctctagatttctttttttctaactaactgcaaaacagcaatttaataatttcctcttttaaggggaaaggggggagtcttggattttaaatcttcctaaagcagcacagcatctcttgaaaagaaagccatgaaagactactaagctaaggcgaataaaataaaattttcaaaaatcgagaacttcagtgtcctagtctgggtttccctgagcagatcctgagatgagggctcacatgcaagtggttcataaaggatgtgtttccgggggaagacaggtagggagtggagagacgcaggacagggcaggactgaaactcaggcagggtccctcagagcgtggcctcagcctgatgctgcaagggggatcagaggtgtgagttacgccaaggtactgttccatctccagcttaggaagctgagttttgttctcccgtaaacaccagtcattggttaagggccacttagggaggaataagtggtagaaagtggtcctaggcactttccacccaggggtgaagtgtagacagtggggcttcaatagcttaagggcagaagaagacccacggttctggctcttggagccaaacgaagactgaagccacagtgtgcatgtaaagggagtccaaggagcattgggtggggcattgaaattgtttgctacagtcggtttaccttcaactggtttccttcttgttctgaaggatatattacaagcatattgacaaaagtctttgaactcttgaggtgtttgtatgatattctgtgtcagttgcacatgggatgtttctaccagcatctgaattggggaattgacatatacagatgcccgtggaatttaacagagaatgtgaatgtacggctacagtccgtcaccatccagcttgccagggctgtcatttcatccttttgaggccaggcttacagacagtctgggcttccactgcccccatgctctgcctgtgatgtgtggtggcctctggcattgttgtaactcaggcacctgagcataactagtgagcctgtcctgctctcccaagcaagtctgtgtttaaaatcagttaggaatatgttgggctgcatgtaacagaaaagccaccttttttagcagctgatccttgtgagacttttatttttctttggtaataataaaataagaaatgggcatttcagggctagtatgcacctgtgtggtacccacaggaaccccattccttctgtctttcctctcagcctgtcttcataggggttttcatctccatactccaaggctgggctttccctgatggtgctttttggtttccgcttccaacactacagctgcattccaagcaagaaggagaaggacaaagggcaaaaggtctgcctccttttaaagagctttcctaaagctccacttgacattttccacatatatctcattggccagcaccatgccacaaggtggggtggcaaatgaattttctcagctgggcacattgctactctagacagagtcagagttgtgtttattgggaggaagggaagagtggccattgggaagcaccagcagagtcagcagggcagagacctgagagaggtagtttgtgagtgtgtatccctgagatacgtagcagaactggggaaggactgcccagtgagtctactcccttcagtatttgtcagatcctgctcaattataagatgatctttatctgtccgccttatctatcttcactgacgtgtatttcttattttcacaaaatgaagccatttcaacgatgttgtcaatgtgtttggatttctgtccttcaacagaggtgccacagctccatactaggtcaatccatgcaataaagaccaagttccagaacccctgtccttcagaccatttggtatatataatttccaggcccttcttcactgttctgtttatcactccctgtgctgtctctagtttggcatcttcctttttaaaatagaacccaggcttgaactgcaattcaaccagcccagcatagttattattgtcccgagtctaaacatgatatttctgttaatgtggtagccacagcacaattctatttattcttgaggcattccctcttttattttcttggtctttttgtgttatttggaagtgtaatcatgtcatttatacccttgctactcgaatatggtccatgaaccagcatggtgacgtcacctgggagtgtgttagaaatgcagaatctcaggccgcagccctccggggtcaggatatgcattttaacaagatcgttgggtatctgtatgaaaatgaaaaattgaaaccagggcgagatatccagggcctcagaggaaaatctcaaaatggtcagggaggtcccttcttagagatgagaaagtcactcagaggctgccatggcctaagactgagacaaagagaatatgtctgtatacaactaaagaaaaagagaaaaggttcgctgggccagagagtggctagagactcgattgtactcagacttgctgtattaccaacaggtaatgtacaggacagtcatgacctacacctggctaaatccagtagtcatttttcagtcttctttctggacccgtcagcatctattagtacaaataacgactacttctgttattattattattattattattattattattattattattatactttaagttctagggtacatgtgcacaacgtgcaggtttgttacataggtatacatgtgccatgttggtttgctgcacccattaactcatcatttacattagatatttctcctaatgctgtccctccccttgcccccaaccccacgacaggcccccatgtgtgatgttccccttcttgtgtccaagtgttctcattgttcaattcccacctatgagtgagaacatggggtgtttggttttctatccttgtgatagtttgctcagaatgatggtttccagcttcatccatgtccctgcaaaggacatgaactcatccctttttatggctacatagtattccatggtgtatatgtgccacattttcttaatctagtctattattgatggacatttgggttggttccaagtttttgctattggaaatagtgctgcaataaacatacgtgtgcatgttctttatagcagcatgatttataatcctttgggtatacacccaataatgggatggctgggtcaaatggtgtttctagttctagatgaatcaccacactgtcttccacaatggttgaactagttgacagtccccaccaacagtgtaaaagcattcctatttctccacatcctctcagcatctgtggtttcctgactttttaatgattgccattctaactggtgtgagatgatatcttattgtggttttgatttgcatttctctgatggccagtgatgatgagcattttttcatgtgtcttttggctgcataaatgtcttcttttgagaagtgtctgttcatatcctttgcccacttttggatggcattgtttgttttttttcttgtacatttgtttaagttctttgtagattctggatattagccctttgtcagatgggtagattgcaaaaattttctcccattttgtaggttgcctgttcactctgatggtagtttcctttgctgtgcagaagctctttagtttaattagatcccatttgtcaattttggcttttgttgccattgcttttggtgttttagacatgaagtccttgcctatgcctatgtcctgaatgatattgcctaggttttcttctagggtttttatggttttaggtctaacatctaagtttttaatctatcttgaattaatttttgtataaggtgtaaggaagagatcccgttttccatcatatgaatatgccacaatatgttttctccattatcctgatgatggacattgaagttgtttctggttttatcttttgtgaataaggatactaagaacatttttataccagttttcgtgtgcatgttttttttcatttattgagtaaatgctagtgagtgtaggtgctggctcaaagggtcactgtttagctttattagaaactgccaaatagcttttcaaagtggttctgccttttacaccctcaccagcaatgtataagagtttgagttggtccccatccttgtatattcagtattgtcagtcatttttattttagccattctggtgtgtaattgtgtttctttgtgatttagagctgcatctcccatatgactaataaacacgttttcacgtgcccctcagccattgggacacttattttagcctgttcaagtcttctgcactcccttcttctggggatacttttcttctcctgtgctgtggtacactcctcaccccaattcttctcactcgccactccttttctgcttcctttgttggggtctccttatcttgccaacctttcaacattggagagcctcagggtgcggtcctgagaatgcttttcttctgtgtatacgcattccctggatgaactggtcaagtctcataacttcatatcatggacatgctgacaactcccaaattttcccctccagcccagagctcactcctgaactccagcgttgggtaccaaattgcctgtttggcctctccacttgctgtctaacacatttctcacacttaagatgtccaaaatgagttcctgatcctcctgacacctgttccatttgtaggaaacagtaactccatccttcttggctctcccttttctctcatacaccacatctatttctcaaacaccctgttggctgatcctacagagtatctcataatccagccagttctcaccatcaccattggttccatcttggtccaagtcaccatcgtcttttgcctcattattgattggcaatagccttcttcataattggtttccgtgcttccacctttacctcttacactcctcctcttacactcctttgctcagaagtctccagtggcttctcatctcattgtaaagcttagttttttataatacctctaaggccctagaagatctgaccccgttgctgcctctctgaacatgtgtcctgtcactttcttccttgtagcctcagtggcctccttctgttccttgaaacacactaagcttatccctgcctcagggcgttgacactggctcttcccttaaataggcacatagcccactccccatttccttcttgtctgtgcttaaatgtcacctgattagaaatatcctactactccaaacaccctatctgtcctctttatcttgcttttctctatagaacctatgaccatctggcatactatttttttgttttgttttcttgaaacagagtctccctctgtcacccagactggagtgcagtggcatgatcttggctcactgcaacctccgcctccctggttcaagcaattctcctcctcaacctcccaagtagctgggattataggtgcatgctaccatgctcagctaattttttgtctttttagtagagatggggtttcaccatgttggctaggctggtctcgaattcctggcctcaagtgatcctccctccttggcctcccaaagtgctgggatgacaggtgtgagccactgcacctagccggacatactatttgtttgttgctggttgtcttagtcctcctaccggaattaggttaggtttctacatataatatgcaatgacttttttgagacaaggtctcactctgttgcccaggatagagtgcagtgacatgatcttggctcactgcaacctccacctcccaggctcaagcgatcctcccagcctccggagtagttgggaatacaggcatgcaccaccacacctgggtaatttttgtattttctgtagagatgggggttttgccatgttgcccaggctggtcttgaactcctgagctcaagtgatccacccacctcagcctcccaaagtgctggagattacagagtgagccaccacacccggcctggaatgactttttattcattgattcatacctagtaactgcagcagtgcctggatgtgtggtaggatctcaatctttgttgaataaactaatggatggtgggcaaataaatggatagaagatgggtatatctatctttctctgtactttatgagcactctttcaattattgttttatattacaccagtaatttttaagtagtgttaaaaactagtaaacaatgtaggggtttggagaaaaatgctaattccttatctcccggaaaagggaaaccatcaggaatcagaaatggagaaatgcttcccccacctggtgattgcatcttgctgtatgggatcaggcctgaaaagtgagttaagtctgttggtgctggaactcatcactgaggaacagcctatgtctgtgccttcaggggtgacagacagtggaccaaggccatgcctgcatattcctccctggacccctcattcaaagccagaatctctttcctgccagagcagtcctttgtccacatgggtttctgcagtagcccaagtttgcaggcccttgatagggctggagtgtgagctgtaatcctatgggcttgaaataatctctgctatgggctctttaaaataaccccaagtaacactcatgtcttatttaggtatccccagaagcaaaccctgagataagaattcaagtgtaaagtacctgtagtttgtttgggaggtgaagatagggggatatattaggaagtgagacagagaaaagaaaacaggagaaaaggacagagtgtcaagccagccacaactatgggcagctgggcttactcccactggggaaccctgggtccacagagcaagctccttggggttcttctgcctgcgtggtgaggagtctggggcctttatccacctgctcccagcagctgttgattgagggctgctcctgaaggcattaagatcttgacacttctggcctgttgtttgcaggggcagagcagttttatgacaagaaaaagtcctcaggtgaaaaaatgcaggtgtcagcaggtggagacacagggcaggggatctggaggaacatcagtggggtctgcgacaacctgtgaccacctcacagacaaggtgacttctggcttctcagtgactcagccacacttctctttttcactcactcttctttctggtcctcactaagacaaaatacagaatacagagcagcagttcacgggctatagcatttgaggagattaaatacaggcctccaaccacacaggccatctggaagctttggcctccagatgaggacataacgaggtcatctctgctttcagggagctctcagagtctcaggaacagatgtacatggtccatcagagtgtggctcagggcccagggtgggttggggaaaaggtgagttatttagcattggaggagcctgtttgtagccatggctgccaacatgcatgagccacttagaagggcttagggtggtgagggtacaggtctacctgtgaagctgagtgatagtcacggtaattacagtcacctactatagcctcacaatgagccattataaaaatgaggaaactggggctccagaaagatttctcagccccaggacggtgcagccaggaaatatcatagctgggatttgagcccagcttgtctggacactgagcctgtgttttgcacactatgcacacacttctcccagatgaagatttgccttcatccaaggggaatgtctgtgtgagacagtggcagcctctgatgggttcctgccgattggcaaggtggttagagctgtgtattgagaggtcttctccaaggtatcagtttttctctgggagggttaaagaaggaccttgcaaagcccatggcctttgaatagagagctctgttctgtttgcagtgactcccctcaaaaggcagaatgcaattctctaaagggaaaaaaaaatgaggtggctgctctctggggttaagcagagaaaaccgtcaggcaggagaggtggggctgtatttgagagggtgggagtggcccaggagacctcacggtacagtcagctgcaggagaggagctgctaaccctcatcttaagaatatcactctcttgacaatcacagttgggaaatgtgtaatctcagggtgcctccttgcccgggcatcttcattataaaagcttagtctttctaaatgcagccaagctctcctctgacaagagatgtgagaattccgttgacactcactgaccacctagaaaccagagacccagaaacccaaaggtgggtcacatggtcgccctgtccctggggaatgcacaggaaaagagctctgcctcccggaaggttccaggtgttggggtaaatagagatcctgctgctgcctctactcccttactggtctccctggggacatatttgaacatattttactcataaattctcatctcagggtctgtttctaaccagacctaaaacagacaggtcccccccttttttaatcagtaactttggtttattacagcagaaacttcccaaattactgatctgaccaattagatatgttttaatttttttatgaccggaatcttttccttcaaatgaacctgtttggattctcttatctgtgcaatacaacctaatgtaagtctactttgtaagtatttgttctgagattatttgttctgaaggaggcccaatccagttcagttaaatctgaagtttttgatcaattgggttgctgagattacaactttctttttcattaactattagtacttaaaatattgacatgctaagtttttagtcttctcttttttgacctataaaaaaggtcaattatatcttaaaagtttcaccttctatttggctattgtgtatcattctttaaatatctggctgggttcaacttgctaagattttatttagtatatttgtatctatagtcataaacaagatttctctgtaattttctttcttgtcaggttttggtgtcagatttctgctagtgtttgcaaaaataagcagaaagcttgcacttttctctgttctctgaagacatacaaccaacatagttgcaacagcaggcagtgagagctgacccttactgagagcttgtttatgtgccagaggctgctcaacactttttattaacgtgtttaaccctcacagcaacccagtgaggtatgtgcagttaccatctcagttttcctgatgaggaaaccatggcttagcaagcttaaggaggtgactcaacttccttagtgagtggtggggctgggattcaggcacaggcaggctggtacttaatctctctcctacaaataccagcttccttggtgagtattggggctggggttcaggcacaggcaggctgactccagtgtgctctaatgcatcttctttgcataaagaggcttatttacatgtcttttggggtatgctggctgctcacgtggctttgtagacattaccctctggagtgccaggtgctttgtgaattagatctttcttattacatcacggccagttttttgtggaggggggcaatgggcaaggaagcattgatgaattttctgagacagctgcgatttgtctaaacaaggcttttccttcagtacccaaggattctggcacacagacccagctccccaccagcctcccctggaatgagctttcctgaggtgcccgcgtgtctccactccaggtcctggaaagctggcagcagcctcactcttgggttttcctctctggaattaatttgtccccaagtgaactcaaataaaaggaagagcacctatgagagctttgcctttgactggggctgggaaggtggaaatagcatggtctatcctgttttctcatttgcccgttgagcactgaacgactggaagtagagtatgatgtgaagtcttaccctttgtgagtcagggggcttgggctgtctgcacacactgtctccaactccaccaccaccatccaactcaggcccaatatcactgggaaaaacccagatcccctacagaaatacaacaccggtgacttgctggatgctggtggctttgtgctattggcatggtgggtctgaaactcttgtagacaccaaagaaattggtaggttatggaatgattgattatatcctgtgtcagctggaatcctgcgacatgttctagtttcctagtgtgcagagtacaatgtgggcaatgctgggttgtagaacatctgtgattttcatgggataaaagcccttatttttgttttgttttattttaagtcaaaagcaatttctaccagtaagagactgaatgaataacaggaagccccttgtttgcatggttcagaactaggcattgcaaagataaccatttactctgatttcagaggtctaaaggtgttagttcccctcttagaagtaccaaacttacaaatgggaaagtggatgcttagaatggcatgaatgttggctggcttgatcatgagtgggatcacgatggcattcactctttcattcagcaaagttatgtgttaacaggtattaagtataccgttatcatttttccttactttagaagataagccaaaaaatttgaccttaatgaaaatagaggatttttaatggagatcagaattttcacttataaaagtaccatttacacatttcgtcactgctgacagtcattagctagtggatagatccaagctttaaatctgaatcttgtcataggaggatggaagctcaagttgttaaaggcctaaaaggttgcatgttacatatagaacaaggccctgggaaaggaaatggtctgttgaaagtcacaaggccaaatggcataccaggtttttggtccttgtttaagaaaaccaaatgtaggttcagaatagtttcttctttcttccacgtctctgaaagtccagcttcgtgtgggagagctctgaggccctctcccagccctcgtttttcagctcggggttaccacgtgtattccgtgaaatgctctacctgctttctgtatcggctttctagccagttgcagtgtacaatattagttttggctttgggaaatgaggtttctttgacttggctggaagtatacagcaaccattttatttttcttgtgcctcatgaattaatagggcagtgagaggaaagagcatgcatactgagcatctgagcttttttaaagcaacgattcacccagctttctagtataaaaaacttcctctggcccaccccgagcaaaccctcattcactgctcagtcctcccatttgttcatctggaaagaaggaatgttctagtggggccaggccccatgtggtatcttccttttctgaagtcatccattcattctcttcctggtggggacttaaggttggaggcagcaaaaagtggaaagactggtagatagtctgtcagctctgtggggtgggtgtgccatttggggggaaatgaaaccagaggaagtttggctttgcagagtgaggacccaggcaagttcattttttacactctggttccatctccttccccctgcacacatgagtcagctcccaggaggaccccgtgtccttgactcttccttgctgtctcttcaagctatcaatatgccctctctctatcttctccctctggaattctccctttccgtctcagttggactatctggactttttgattctgcttcttcccaaagtgctcttttcagtccattgtttttcctgagatgtaatgactcaagggtaaatggtacctgtcagttgcaacgcctgaaaccatagatgcataggtgcaggtggtttatttgagtagcgccccagaaagtaagaaagaaggaagaaaaggagggtatgtctttgaggtcactgccattggtgctaagacttttttgagaagcatatagaaagtcacctagaaatgcttacctataggacaggagactggagcactcacgccccagctccaatcccaggttgttaagggccacctccaaggaatggattgtcctgccctggccaggggtgtcattgagtttgggtgccctcagaatgctactgaagatggtacaaagctgaaatcatcagagttgggccagaaagaagtgacacagaacatctaaggcatatcataaaccatttctgaccctgatctcggaacaggatcccagaacagttcaacctgtaattgctttctgacatttgagcaaaagcatcagtagctcttctcatgaccacaatcagtttactaggatttttccataggctcaaagaaaagacagtctatgttctaagtacagatgaagaagtaaaagtttgtgttctggaggggtggggcttcaatctagaccttgcctctttctgatcactgttcttgacactggatctaaattaagaaaaacattaaatctaaaaatgtctaaaaagttaggacatttaacctatactatacaagaagttatcagctaagcaaataaaatccagactttgaaaaaggtaaataaggaactgatttactttaatcacaagttccttctgcttacaaaatgattcatactgaaatttttaaaaaatttcttaacagagtttagtgcaattcacataaaaaatgtacttcagtaatttgcaaatatttacttaaggatttagtaatttagtaatgtttagtaattttttcaacaagttcttttctgtttaagtgggttctcagaagtggttgcaccttcagcaggcaaggaaaatatttatttgaagacgtttatgaaacacctcccttgtttttattatgtttgtgttcttcttatatttctttttatttgcagtaccctcaagtactttgaaggtttggggacagtaaataaaattgatggccattttttgtcatgcatcttctgaattggtatgtttttctgtgttcagaatgtcattcctcagcccccaggggacataagtacaaagtgaaatgaggcgatgtcaggatcacctgtgcacattctgcttctctccaggccctggcttctcttctttccggtagatgaacttgagcacatgatctcaccacttggagcctagtaaaatccatgctactgttctgcaattgttcttttattctttctctctactaatgttttcacctatggatgtcagttctacttctccttggggctttaactaaaaaggaagaattgtctgtggcttcttagaaagtggtgtgtggacaggcaagggctgccctgcccttggctggcagcacaggctctgcaaagggggtgggtgagtgaccacatcatcatggctaccccttcccgagtgcttcctgtgggctaggcagggcccaggtagctcaaaggtgttcccatttgttcttcacagcagctctgaattcattagcataacaaaccacccccaaatctagtgggcttaatacagcaatcatttctatttgctcataactctaggggttagctaggcagtttttcagttctgggccaggctcggctgttcttggccaaccttactcatgtgtctgtggttagctgcaggtcagctggaacccaaatgttgtctggaacaaggggagtgatttagctagtggctctcatccccagcaggctggcccaggctcctgtagggttccaaaagagtgagtagaagttccaaggctttttgaaatctaggcctggaacagacagcatcatttctgctgcattctgttggtgagagcaagtcatgatttcagctcaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggacagctccccacacaacaaggaattatccaacaatgcacaggacagctccccacacaacaaggaattatccaacaatgcacaggacagctccccacacagcaaggaattatccaacaatgcacaggacagctccccacacagcaaggaattatccaacaatgcacaggacagctccccacacagcaaggaattatccaacaatgcacaggacagctccccacacaacaaggaattatccaacaatgcacaggacagctccccacacaacaaggaattatccaacaatgcacaggacagctccccacacaacaaggaattatccaacaatgcacaggacagctccccacacaacaaggaattatccaacatgcacaggacagctctccacacaacaaagaattatccaacaatgcacaggacagctccccatacaacaaagaattatccagccccaatgccaacagcattgaggctgagaaaccctggattatccctttttacacatgagatgagggtcttacaggtcttctaagtggtggagcctaggtttaatcccatttccgtactcttcagcactcactgtgctagtatccctctcaggcgtatgaatacgtcaagccacttcagcatgatggcgtttaagttttagcttgtctacaaagcagcacaatacagtggttaagagtagggttttgtcaccagactttctggcttaaatctgctcccatcccagcaccacttaatatgtgttgtaccttgggcaagttcaatgatgtctctgccttggccttagttttcttcttcttttttttaatgctgcctcaattacagaacagatgcctaagttttcttatctgtgagactgagctaagaataatgttgaccttataaatttgttgcaaagattaaattagacattcatgtaaagcacttaggaccatacctgagacatagtagcctttagttatttttgtctaattcttctttccctgatacagtgcccaccataaatccccagtcatggtgctgacctggcatgtgaagctggctgggaggaaagagatttttctctcccagcaaagtagtaaacaggctctctcaagcattcatccatctggggagcttggcacacaggacagatcctttctcttaagtgtcccaaggccaaccctgaaccatggaagccttcatttaccatcagtttttctttcaaaacttctgcaagggcataaaaatgggggactaaatagggaccaaataagtgagtccatgctttggaaatgatgacctgagagtgtgaggaaggggagagccaggagctgagtggcagcattgcgggagggctcttcctcccttggttggcagatgggcgggtgtgactgaggctcaccatgggtggactgagcagacgcctgccctcacacacaaccccatgctttcagaagaaggcgtcagacctccttgtatgggaacatcatcaccttcacgctttgtctttaatttgagaagcttatgtggaaggaaacagcacattcttgtgagaagataggttttggaaagtccggagtagacagcatgaatccagggtttctaaagtataccctctccatgcttgctactcaggaagcagaggcaggagaatcgcttgaacccaagaggcggaagttgcagtgagccaagatagcgccactgcactccagcctgggtgacaagcgcgaaactctgtgaaactttcattctgacagtaggaagaggaaaagactctggctgactccttgtgatagagcaaaccaagttgagtgttgtatttacttttctggatttattttcacaaatattcagctcagaatgtgccagggaggggaggaacacaggagctgtattggccacagccatgtgcgtcatcccaggggacacttatgtgagccctgtggagcaggaattgttattcccatcttacaggggtgacagcttagctcagaaagcttgcagtttgctccacgttacaaagctagtaagtagcagagctgagattggaacccccgtccgtctaatggcaatgcttcctcttttgctattctgcctcacaattaaatggagtaggacctgatccccgacatcgagaaactgacggtgttgtcaagaaataaatatcccccccccacacacataaatagagaacaataaaagataacgtcggaggatgaacccacgagcgtggtttgtgtgggaggatgtcttgatcctgggctcgcagggctgtccgctgaacatgacagttatcctggcttcacagtaacctttcagaggtgctctgagtcctgaacatcggagatagattctttatctggggagtgactacataatttaaccatttgttattttttattttatcagactgggatcctttaggagctgaaagggacagtatgaataattagccctaggacaacaggcagaaaccgggactgccccaggcagttaagatgcatggtgaccccacttaatggccaaaatacaaggaaggcttggtgtctccgcagcttcctgaagagggaatgaggggcaaggctctggcctcgcagccagctgagggagcgcttctctttccactgtctgattctgggtctctgcttcctcatctggatagcagccctaacacccactgtattagttatctgttgctgtgtcacaaatcacatgtcaaaacctagtagcttaaaacaacattgattagccctcatagtgggttggggattccagagtggttctggctcgaggtctcttatgagactgcagtcaggatgttggctggggatgcagttgtctgaaggctccactggaggatctgcttcccttgtggcccctcgcttggctggctgttggccacaggccacagagcactcaggaccaaggactggagtggtggaaccctcgtccttcattaacacaagcagggcaggaggatgagggtttgtacctgctgttggcaggggggcctcagttcttcagttcttctccatatgggtccctccaacaggtagctcaagtgttccaccatgtagtgactgactttccccaatgaaaccatccaggagagcaagaactgggcagaagctcgcctttccatgacctctcagaagtcacatagcatcacttctgccacattctgtttttcaaaatcgagccactaagtctggcctacattcaaggggaggagaatcatagctcactgtaaccttgaactcttgggctcaagtaatccttccacctcagcctctggagtagctgggactatagtcacgtgccaccacgtcctgctcattttttaatttttcgtagagatggtgtcttgctgtgttgcccaggctggcctcaaactcctggcctcaagtgaccctcccacctgagcctctcacagtgctaggattataggtgtgagccagtgcaccttgcctaggcttcacctttcaaagggaggagtgtcaaataatttgtgaacatattttaaaaccactgtacttagggtcaatgttctacacttataagttaagtaccatgtgtaaagtgcctgcagcagtacctggcacccattaaaaacagaatcttggccctccagagtccagcagctgcacttctgaatgctggtgggcacggacggggtttgatgtccagtaagcctgagcagccctgcaaatacagatgagcccaagtcacctgtacagttggggcctgaggaagttaggtcagttctgaggctcccccagatgtgggacactcctcacggacaagttcagtgttgtatttacttttctggatttattttcacaaatattcagcttagaatgtgccagggaggggaggaacatacctcctatgcggcaggagctgtattgggcacagccacgagtgtcatcccagggaactcatgtgagccctgtggagcaggctctgagcctcccccagatgtgggacactcctcaagggtttccaggtgaccacagagggtcccacctcagtgtggacatttccatgtgtcctcctgaaaccctctggtgagcatccccacccaccctttggtgtctggagccatggtggctggttgtccttcccacttaggggaaccaggcctcagaactacagctcagaggcctactctgtgggctgtccttttttctagggccttgattaaatttgcttctctgaacactgtgaggtatctgtacttgttttaactcttctagtgacagcaatagaaaacctaaattggtgtaggtaaaagagaatgtagggttttgcaaactgaaagtacctggggttggcttcgaccacagcttctggttggacctctggaagttgtcatagtgtctctttctctctctccatctgtcagcttctcttcctccttttggcttcgttctcaaacaggctctctgtcccttcagggtggcaaaatggttgccaggctacagtaaataaataatctcatttcctaaaagttcttgcaaaaatgtcatagagtctgattggtccaattgagttaagcctgggtcgcatgcccacctcctaacgggttgggagtgaggtggagtggggaggggatggctccccagagggaagggtagatggatgtgggtggcaagaaacatgtctgccatggtattgttatcctcatttaccaatgaagtgttggcactcagagcaggcaagtagcttggccagagtctcacagataatagcaggtgcagaccgtcatcctcctgccccactagtgttgatgaaggacgagggtctcacctttccagtccttggtcctgagtgctctgtggccatcttccacttaaagctctaggacagaccagcagctctggaagtgactggattaaaaccccaccaactgaagacagtggcgtgggatgatggctcgctgatgggagacagaatttctgtctctcctgtcagaagccctttgaagaactcagctgtctggacaacaaaagtgggagcttttgttgtctagaagttcatgtgacctttcctttcaccttttagtgctgcctaagtgtaagatttaagcacagcattcttttcccatgtgtcatttttcagcagttaaaaatccatcagctgaggccacacaaagttggcactccctcctccaccaaccctcagctaaaaggttcagtggaagggactgatgctgtctccagatgcagactggggccatggattgagccacagagggaggagggaggagggtctcaaattaaaaagacaagaaacaaacaatctccccaaataagcagaaagtctgagcgtggaactgagctggttggagctggggagggggtgcgggaggtactttcagcactccctcgtgagatcatggaacagggcaggaaatctgaacctgctgccaaagaaaactcgctttgccttttgtaaaaagcctgtcgagctttcttcacaagggagctgctggtggggactcacaaatgggcatgctgcctgccagcaagggtctcctggccagccctaaaggcccgggctgctctgcttacagccacacggctgtttctgagctgaggatgaccctccaggtggctgagattccctccaatctttttatttctggttgggaaaccctacacagaccagtgtctgtctcacggtttaaaaggctgcatgcaaaacatttcctcccctggtagaaatgctgcattgagccacagccctccctctgcagcctgtgcagtgtcaaggggacagtggctgcatgatgatgtgcctagcagggtgtcccccatcaggacagtcacaggggtggaacaaatgcaggagccatggagccaaactgaactgggttggaatcccagtttcagccacttaatagttacatggatattgccaagtagcctgagttctcagaggcttgatatcctcatctgtaaggtgggaagtataagacctacctcacggtgtcagtgttaaataagacagggcaaaatgatgaaggtactctgtaaatgtatgtccattccttcctcctcctctgggttccttttcagcacttcctcaccacagcaccattcttaagttttctagccccatttattttagaaggggaactggaggcagcttggagggaggtaacatctggatgtcgcagtgacagctggtggctggtgaggagtccacaggtcaggggcaacgggccctgcagacttctcagcatcccctgctcagaaggggctctcagagtccatgggctcagcaggctgattcttcccctctcctatgagaccatcctccatgtgggtcccatccaggaagctgcttccctcccaagggaaggaagccaccagtgtttctagaatctacatcagtgccactcaaagcgtggtctcctgaccactagcatccacaccagctggggcctggtcagaaaaacaaccgtgggctcctccccagacctattgagtcaaactctgggggtagtcccagcagtctgtgttttagcaagcctccatgactcgaatgtgtgccacagttggagagccactgtgctacgggcaggttatcccagagcaaaggaaggaaaacctcctctgcacaatgcactctgaaggccccactgaatacgggcatctgtgaggcagcatgggacctgatcactctaccatatatagctgttgtgtgaccttggaaagttccctcaccctctctgggtctctgtgtcctcatctgcaaaatggaacaatcataatactggattgaggatgagaagcatcaatctgttcatcctagcaaaatgtttagcaaaatgccacgtgttcagagctcaggacaggttagctccatcctgttaatgttgaggcagcccacccaggttaagggtctcattctgagagtggctttggacagcttgagaatctacaactgtaggtgacagagcaaagaaaactcttgaaaagtttctcttagagcctaatagcaataaccattaccatggtggcagccaccagagtaactcattatatcattccagcaacgctgtgggttaggagttactatctgtatttttacagggaggtacttaaggcaccacttgataagtggtagagccaagtcagtttgaaaaaaacataatcattgtgcaatgacaatttgagacattttcagggtcccagttccatcccctaggaatctgtaaagaggagagtggcttcaacctgctgttcagggcctctgccctcattccctggaggctggtttggacagtgtgagaggcatccttcccaaagcagacaaagagaaaacacatgggaatggtaattaaatgagtccatgtttaaggggcacttaagtggattaaaatcaatatgtagtcacataagtctgctaagccatccttaatgtttggcgggtggatttctttgtttaaaaaatcctggtttgcttgaaactggctgccccattgaagcatgagataggacgagagattcccaggacctggaagaccacttgctcagagtctgaaatgtttacactgcctctgactggcatctctataccagaaaggagaagagggggactagatgtttttgtgtgatagtctctttcctgctatcttaggctgagttccctaaaacaaaatcctgagatgagacatcatgtaaaaataatttgttaggaagtgttctcaggggaatgggaagtagagcttcaaagggaaggaggccaaacaaggatgtgatatcaagcaaagtccccaggagacagaaagaaggtgggtgactttggcaccgtctaaagtataggtcacatctcactgtcccaatcagggacaaaagagcatggctgaggattcccccaaggggatgtgaattctcaagcacttccatctctccatgttcatgcaaagaaggtgccaggagccccgtggccatcctcccacaaaagacacacaggtggtggcatctggggggtcaatgtgcatggttgtgcatggtagagacccctggatggagctccatgatgtgggatttacatcccgcccatactctgctgtgagagagatggtatgcagccagtccagccatctgaagcagaacgaaaaaatggtatggaaagcaaggcacctgaaaaaattttcaaagggagaaaaagaatgagcaaaactatcctgtagaggagagagacattgaaaatgacatatacagacacagaaaaggttgctcagtcaacaacttctgcaggctcaaagcatgggaagtaatcagtaaatggccaatttatctctccctcacagccaagccaactcctaacataattggaagtttaatatattccaacaagttcagaacaagcatactagatcttaaggcaatctcatggccctgcagctcatcctttttttcaaagaaattaattttcaaaaaatgactctattgagattgaatttagatcttatccattgccataaccaaaagcaacccttactatttgtgtgtgcaagtcgttttaaacagctggcccattaactgaaaaatgtcaaaaacaaatataggagaaaagtaagataatcttggaaggcaaagcctgtctccctatattgttcttaaaaatacaaaagggacacataacttcatcatttaattatattaggaggtccgtcattcagtgctcttgtaaaactgtcttgcccttgttctaattgcgtattgatcaccgaggttcttggcatcgggcttttctttgatgtgtgcatgatcagaacacactaagagacagcctgtgtgctccttcctgtcctcgtgggcatttcctaaagcttcagccctaagctggtatatgtttctctgttacatcaactgccaaggcaattactttacatctgatatttaatggaaaagcttctgaggacagggctatactcacatacctccacacctggcacagtagatgagctcactatctgttgaataagttcgtgacagaacagaagttctactgcagccacaaaggcctattcacagtctttaagcctgatgaagttctgaataagtaaacccttagctacatcaggcagtttatgaatggtgttttttgttactgtcatttgtaatagcttttgacctatgtgtttgtattagtccgttttcacactgctataacgaactacccgagactgggcaatttatgaagaaagaggtttaactgattgacagttccacaggcttcacaggaagcacgactaggaggcctcaggaaacttacaatcacggcagaaggtgaacggaagcaagaaccttcttcacatggtggcaggagagaagggggctggtgggggagtgccacacacttttaaaccttcagatctcatgagaactcactcactatcacaagaacaataaggggaaaatccacctccatgatccagtcaccttccaccagatccctccttaaattcaacatgagatttgggtagggacacaaatccagaccatatcagtgtgcaaatgatgagctaattttcccactaaagtaagcactggtatggtacatagtatgactatggtagtccagtattggattccataatttaaataactagtagactttttagttagttgaaaggtaaaacaatggtaataacaatgagctgtaaaatacgacctgtggggtgggaatggggacagccaatgcttctctggtaaagggaggccagtttcagcccctggtgcaacagcacccccatgcattcatcatgtgagatgataagtgtctttccttgaaccagttcttcttcttcctcctaggctgggaacttctccttggagacagcaggaactgtgttacaaaggcatatggcccaacaaaggacactgaggctactcagtaattattaaatgagagcatgaacaaaggaatgtaagatgtaacagaaaacatacgtgtctcacacatgagaattattgtgtagaagctgtttcccatttgagacaaaataagaaacacttgttgaacgagtagatgggcttcctctgggagcacagcaggtaggcacccatgttggagccagccatggtctgcagagttcatttctctgagtccctgccccagaggcacatgacataggaggctccagacaactgactcaaagacagagaggaccataataccagggttcctcagtcctcaccagcataagaatcccagagaaggcattttttttctcacatactctaggtctcaatctcttaacttcaaaaatggcagtggctacattagctcttgggaccagtgtttcaaaggctagtgtagaacacttgcctcagatgattcaagatccaggtttcctgactctgcttctgctgtaaagaatcccactctggaggctggggcctgcaatctgcatctttaacaagcccaccagagaatttcaatgcagtttcacttttgagggtttttaacttgattgtccatcagaaccacctggggagctttcagcaaatgcatgccgacgccacatgcattgattctgcggccacacagaggggcctgcatctgggtcttttttacaaagcttttcataggattgtcatcgtcacctttccagcactgttatgcaaattggagagactcatgccaaggtgaagggcttggtgagagcagccaggtcttctatgcagtgatcagcctgcacagctgggtgtggcatctctggctcccaggtggttccagtgcacacccccagttaagaaccaatgaagaatgttgcttgttaacaacctttgaaggctttttagcaaaaacaaagtgtcatattgggattcatctgtggcagtttgcagaacatatcaggggagagaggtgtgtgcaaggcatccaccaggaggccgttttgtgctggtctaggtaagaggagattggagctgacctgttgaagcaacaaagagaaagggaggaaggatcatcctagaagtggataccagttctttaagaagagtcctgagatgtacccaggagtagcaaagtggatgtgccaacccgagggaagagattagtaagctgctgccccctgagacagggctccatgagctgacaggttgatctgtggagatacactctgaaggtgctagactaggaagaggtcctctcaggccccatcccttcatcttcagccaaaggaagttcagcagtagctgcccctggcctctgttctcagtccacagctccaccagcccagttgcttgtgcagagggagaggatgtgggagagatgctgtcaacaccctccatgtcccctccacccaccctggaggccgcctatgacagttcgccataggcgaactgtttctctggttaggaactttctctggctacaggagtgtgctgcacccgagtcaggagggctggaagtgcaggatagttaacgtccccagtacagttttctaccaaggagagaccggtgagatggatagatgccccagctttctcacccgttgatgacacacttcactaccctctcctggagctccctgagatcactgcccatacaaactaattgcaccccaatgcttgtcccaaagtctgctcagataagggccgtgtgaatagacaggtcttcagttccagaaaagtgtatactcacacaggaaatatctctcaaataacatgggcagtgtatatgttatttttctggagggcagagggcatcatgaggaaggtggtcttcgtggggtgaatatcatgtttcctccagggagggctcagtgacatggagcagtgcttctcaaatgtccatgttcacagaggttagcttctaactcatcaggtctagggtggggcctgagaatctgcatttctaacagtgagcatgtccagggaccacactttgagtagcaagaccttcacagcttcaagttgcaaaccagttttgaatgagcagagtagaagggggtttgtaggtgagaaggaactcttcaccatgagtacatttctatgaagatttctggccaggattttagtaagtacctgagccccttcaaacatttgactcccgcataaccttttcatccaaacaccattcatgagttgtttttatgccatgaggttaaattctttcctatcatttcaggggaggtccccacttgttgagttttccgtcagcctataaggcaaaggaaaagagtgatagaaaataaaaataacttgattcattagatggaattcaacttgaattcttagtttgttgactaagaatttgcagcctccgaggaaattttttttaattgaagaaaaactaatttttaaaaatctgaaaataattcgtttgtgactatttaacagaaggaaaaacttcctgagtgagcatcaaatactttaattacttcttaggcttcagaagggatggcttgctagtctttgtactttgggctttctgttacgactggttgacttagatttatttgtttatttagcttcttaatttcatatcctgtggtcctgaagaggacaatcaccaggatttaggggagtgtttttgtctttattcactttggaaaaatgtaaagattagtcctaagcagggttgattcaccgcactacagagggacacgttaggaacgagacagcttattcaagtgcttttgaatttgtattggttttttaaaatgtaagattatttttacttattttaaatctttcaaagcacttttttcctcagggccaagtggactctttgggaggagacctcgccgtctccatttgatcacataattgcttctgatgccagccagtctgcaactgccagtgattggcacagggttatttcatgtgcacttcaatcaaatttcttttcttgcctttttttttttttttttttttttttaagaaaaaatctcactgtggcacccaggctggagtgcagtggtgcaatcatatctcactgcaaccttcaattcctgggcctgtgatcttcccacctcaactcccaagtagctgggaccacaggtgtgtgccaccacctctggctaatttttatttttgttgagacagggtcttactatgttgtctaggctggccttgaactcctggcctcaagtgaacctcctgccttggcctcccaaaatgccgggattacaggtgtgagccatccatacctggcctccaaatttcactacctaacttgggagaggaattttgcattagcagttacatggttcatctgcctcaaacatttgttttgactctagcttttgcttgtttcacttttttaagcttggaaagaacaaacttagaatagtgtaggccttggcttccacatggatgttttgacaaaatttcaaggaagcaactggctttgtagtgctttctttgtcctgcttctccaaattccccaagtgcatgggtaatcacctctggttccctcggagtgttcgtggccagctccttcccagccttgccagcccattgtctgcatttggcatctgcgctggagtcactgtgtgctccagttccttaaggatacttttagtttatctgatctgtgctccacacctcttcagactccatttccatgaatgttttgggagaggtgaggaagaaaccttttctgctcattgttgcgcgttccccaccccaggccccgtctgatctattcttacatcacaactaaaaatattcttaaaaatgtgaatcagatggtatgactcccctgctcagaaccctccagtgccttccctctgtacttggaaccaagtccaaactcctgatgagcagcagggctccgcatggcctggcctttcatctgttgcttcccaaacgtgtggcctctggttggtttctggaactcaccatgcctttccccacacatgctggttcttctgccagggacactcttcactctcccttcatgtgcttagccccttcttagcttgcaggtctcagctaaatggtacctcctcaaaagggccttccctccacctataccaggtataatgctgtttgcctccttcagaatgcctctcacaggctgtgattactttaaacagattcgttgagatatagttcagatgccatgcaattaacccttttaatgtatacaattcagtgggtttgagtatattttcagagttgtgcatctattgccagagtcaattttagaacatttcattacctcaaaaagaaccaccatacttcttagctgtcgtaccccttcccctatttccaccagccaaaggcaaccagaaatctactttctttctctctagatttgcctattctggacattgtgtataagtggaatcatttatatgaaatggagccagtcctttgtgactggcttctgtcacttagcgtaatgttttcagagttcatttgtttgtggcatatgtcatacttcattctttttcatggctgaataatattccattgtatggatataccacattgtgtttattcattcatcagttgctggacattagattgtttccagtttttggctattacaaattatgctgctatcaatatttgtgtacacatttttgtgtgggctcatgtttttatttctcttgggtacatacctaagagtgggattgctgggttacatggtaacttatatttcactgttaagaaactgccaggctgcttttcaaagccactatactattttacattcccatcagtagtatgtaatggttccagtttgtccacatctagtccagcatttgttattgtttgtctttttgattgtagccattctaatgagtaggaagtagcatctctttgtggttttgatttagatttccctgaaggttaatgatgttgagcatcttttcatgtgattattggccatctgtatgtattttttggaaaaactattcagatcctttacccatttgatagttaggttacttatctttttattattgagctgcaagactttttaaaaatgtatcctaaagttcctattagacatatgatttaaaatattctcatcctgtggattttttcactttcttaatggtgtcctttgaaacacatgagttttaaattttgatgatatccagattatccagttttttttgctacttttgtaattattattattatttttattattattatttgaggcagagtctcgatgtgtcacccaggatgaaatgcagtagtgcgatctcggctcactgcaatctccgcctgctgggttcaattgatccttccacctcagcctcccaagtagctggggctacagatgtgtgctactacaactgggctaatttttgtgtttttagtagagacagggttttgttatgttggccaggctggtcacaaactcctggccccaagtgatccacctgccttggcctcccaaggtgctgggattacaggcatgagacactgtgccctgccagttatttttcatttccttttgaattttttgtttttgccatctccccgtgtaggctgcatgtgctgcgacggcagcgctgtgtttgccattgtagccccatcccctagaacagggcgtgatatagggcagcggtcagtgaatagctcttcagtgagttagtaaacaaagtggttctcaaaatgtaaaattcttccttgactcactaagcaaccttctgattgcaactgctttccctttttggcctccaagacaggaattctctggccctgctgacaggagccccatgttgcacagggcaactatgtcactcattggaaattaacatgtctgccctctgacttcagtatttctcccaggagcagaggatggaagttcttcacagctggatctgctgtatcattcagaagctggcttcagagcctgtgtagctggaagcctcgggctcacatcaaggaagggaatgccactcagcctctgggcacacagctgcaacttcccctggtgctgtctctcttggtgctaccctatactagccttgtcctgaaacatctaccccattcatttcaccctctctgctactatgtcactgcctctcccatcacagtattccacccaaatgaggcaaattcttatcctttcaagacctaccctagagtcaccttttttgatatatttgcttttttatttactccaccaggcaaagagggtggcaccctgctatgagctcttggaacaatttatttataagttccttatagcctggatcgtattcaaccaatagtttttccccctctattaaaatgcgttaatttggagtctttgcttactaaatgctgtctcctttttttttgagacagagtttcgctcttgttgcccagcctagagtgcaatggtgcaaactcggcttactgcaacctctgcctcctgggtccaagcgattctcctgcctcagcctcccaagtagctgggattacaggcatctgcccaccacgcccagctaattttttgtatttttattagagacggagtttcaccatgttggccaggctggtctcaaacgcctgacctcaggtgatccacccacctcagcctcccaaattgctgggattacagtcgtgagccactgagcccggtcaaaatcccttcttacctgtcatttgtattctccccattctgtgtctgacatcttgtaggtgtttgttagatgattggtgagtgaattaatgaatgtacagatggatgatgtataagtcctttcagagggaaactttgagtatgttaagaccccaggaaggcttatacttgatctttgtatccagaatgttgccaacattctggatacaaagaaaagcaccctctctgtgacttctcagatcccatctgcctctgatctttcatgacccctgctggattgactacatgagcctctttcagaagtttgactagcaaatcaacaaaacagttcaccctctgcatctctgctcagggatcaacaggagtgcttgcttatgtggcttcattccagtgggaggttcatattttcttagttatgtatcatgtagtcttccttgattcaagagtaccatgacttgtgtttgttctgactccaggactatccatgagtaaccctcagccaagagtgtatcatcagggcctgagcaagtggcaggagacaaggtatagtgtgaatctagtacatggaagagaatgtcttgacagctggggtctgtaattcatatgctgttcaaatgacaggccttttccccacacctgtgtgtattcaaagcaccatgtcatgttctgtagggagataggcaggggagttgggtcaggagaaggaagttaagattgaaggagaacatgcagaggagctttgggaaggaatgtgcccggctcacatcctggctccatcatttaccaactgggaaaccctgggcaagtgatataacttcacattccagtttcctcctcataaaaatggaaataaagagaaggtgtacatagagtttttagataatggatttaaaacactacctggcacacagtaaaccattactaagtagaggctatgtactccatcctacacgcatcagcagtggcagtccagcaatactcctataaggcacatgttatgacttcattttactggtaaggaactggaggcttagagaaaggatggttaatttgcctgacaacacattgctggtatatatctgagccaataatcaaaattgggacactaatgccaaaggttttacaatttctatgctgcaggctcaggtgtttttcttcatgggtaggaactttatggctcaagcccgaaggattcccctctgggaatacgactgttctggtaaggttcaagctgactcatcattgagtgctgctaataaagtgtttgctgagaatgttttctgttaactcattgagccaggttattaagaacctgtgctcacctctgacacctcagttgattggggaatttgggatgaagtgcttccaaaatttatttgaattctaaattaactaagtgagttaacgtggaagccgcttttaccagcccacaagggtcacgcttgttgtgtctggaagaaggaaagggtcttagaggaacacaaattgccagactgacagtcagatatggagacaccagggtcatcttcagtttaacaaacacatgtcagaactagaaagttggaagtgagacttcaaactctacctagcattgagcataagcaggtcactgaccacaaagatattctgttcccaaagagcaccatattcgtggtcaagtaaggccagagtctagactgacatcaaatgcttgtatgattgggaggaaggagcccgaaggccaaagaggctcactaatttcattattcgattcttccaaccactgcacgttacaaacagggctgtagcctgggtctactggccaagcttccggggctgggacaggcaaggtatgtctggatgagagaaggtctttgccaagacaagcatctcttgtgccaggcagaccagcaaatgagctgcttcttgcagccccttctttggcatctcccataagccaaggcctattcatttaataaatgcagactcaggagctactaagtgccaggctcggtgccagacactgagaatacggaaatgagtacgcataaatcaagtgtgcttttcatcactgtgtttttaaaaatgttaactgatgatttcctgatcctgagagtaatgtgcagatgctccttgaactatgttggggttatgtcctgataaacccatagttagttgaaaatatcataagttgaaaatgcatttaatacactcagcctacgaaacatcatagcttagcctagcctacttaaacatgcttagaacagttccattaacctacagttgggcagaatcatctggcaacacagccctccatagagtatcgattgtttaccctggtgatgatgtggctgacgaggtgctacagctcgctgcgctggccagcatcttgagagtattgtacagctttctaccactttccactgaatacctattgtttttacaccatcagaaagttgaaaaatcttaagtagaaccatcataagtcagggactatctgtatggtagtagaaatttttaattgaatcttctgtaatcttcagcaagaaaccctgagaatattgaacgtctttgccagacaaggaaaagtgggactggggaaaaggccagttatgtgaatcctcttaaaatagggtctaaaattttataataaaaatgtattttaaaagttttgattgagactttgcctgaaatgtgaaactgaaaattacgaaattaggtttattttatcctgcatttattcagtggcactcaaaacattgtaattataattgtcaaagatatcttagaccaaaggcaaaagattatttgctttattagagtctttaaaataacagtgccctaacttctgaaacaaaagaaggaattgagtgctggataggcagcttttgaatgtgaattttcctactatttcataagataacatcctttgcttcatattttgtctggttttcggtacaatcacaaaaggatcattttaacaatggtcacttttttctaagggcttctcttgatcttttttatttaaatctttgtcttctgaagcatcttaaagtagtatccaggagaattttgactccttcaacagttaactgatctaactctgccagatccagatttatcagtggttttgcagtggttttatccatttttcaacatcactttcattgatttcatgaaagtctgcatcttttagagcaagatttctgcttcactctgtatttgatttgcattgtattgtagtcagataatcagatgtctgcactagcagtcagggacattagatagacagtttgctcactggtccgcgttcccagtcagctaagagtctcataaccatcagccttgataaatgctaatgttaagttctctaagttaaagccagtgtaggcaatgattggaacttggaagcaatcagagcacagaagaagcctggtccctggaatctctcccatatgcatcctggtggataccaagtgcctggcagaagtcataggcaactcccaaccagagcgctctccactgacatgttgcttagagctggggacagcttagattagccatatctccccaaaatttgtatttttaattgaattgattttttaaattgaatccattttaaacatgggattttatttttatttaaagaattaccttgtgggtatgtctgtgactcttgggtgcctgcctggctgccaagaagacatgtggctccatgatgactctgctttttaaggttatgccctgggcatgatctgaaaccaggagaacaaagtgggtactggtgttgccttgaatgaagtgctcccctaatgggggaagccttgcaacctttataaactgcagtcaggactgttttctcttccttagtatggatttaaacaagaatcataaacacgtgagctttctcctcatcctccttttgttgcctctccccacctgggagcaaatgcctaggactttccaagtggttctcggtgccagcagcctcataagggaagagtattatctgagttcaggttcatcagaagcagcacccgagatggactctcatgaaggggatttattggggcaagaggagcgaagggagcagaatgaggaggggaagaaaccaaacaggcatgtgggctcagctggagtctgcttcacccagtcctatgggagctctggaacattaattgtacaacagagttggtcttgtcttgaggcaaaggggacatccttgggtacccacatcaatcagaggctacggaatgcttttggggaaggtgtcataacctcccaggcaaagcgactccattcaagctgttgtacttatctagtaaggggttctgagtggagcaccaccagcatccacacaaggagtggtactgcttgccaaagcccatgctctgatacacctctgggcctccttggaaatcacagtagtagaagagaggggtatagaattaaaaacatttggtcagggcagttgacatggccagtataaacagctatgttggtgctgacaggcagcagaagggtaatccatgacatcccttcctgtaacaccatcccggagcacatgagtcatgaaccataagctcagctctcttgttcctagagatgatgtctttggtttactcttttggcctgtcctcaccaagatccaaccagaattttgaaatttttatttgactgagtaaggtggaagagagaccagaaatagttaaataaatgctgatataaatgttacgttctagcatttgggaattaacaaaaataaggtagctgagcagcttttgaatgatcaaaagtactgttgtcttaggtcaaagctaattaaactgaggtttcctcgagttccagagtacatttttgaagacatttatttcacacatgcaaaaactgaagaagtctttggggcaataaatctttttgatttcttttttttttttttttttttttgagacagagtcttgctctgtcaccaggctggagtgcagtggtgcgatctcggctcactgcaacctccacctcccaggttcaagtgattctcctgccgcagccttctgagtagctgggactacaggcatgcaccaccacacccagctaatttttatatttgtagtagaaacagggtttcaccatgttggccaggatggtctcaatttcttgacctcgtgaaccgcctgcctcggcctcccagagtgctgggattacaggcatgagccacagcgcccagccaataaatctttacttcaagaacagacctttgacttaaaattaaagcttctctcctggtttgaaaggaattcccagtgaggtattgggcattacaagagaaactggaaacagagttaggtaagcatgtaatatatgtatatgtgtatgtgtgagatacacacacacacatacacttatatatatttgcttatcctgggacactcttgagactaattataccagaatgacagaaatgaaccaggaccgtccccaggaaaccaagagaactaaagtcatccaagactttggcttgctgcctctgatgtccacaggccaattagccaggatttagggtagtgtctacttgggacagttgtgggtgttgcttctggcaggaggaatatgaggaagaagatggtagggaaaggccatctatggtgaatcattaatgccatgcagttcttgagacagcatttgagaaattattctctggttttccttattgaaattgccaatgcctgttctctaggttctaagagcagccctcacacttgccatcacacagctatgtaaacacctatgtctctgctgggaggtccccacctcttctgaactctgagctctacgaggacagcgattaacatctctcagatatgttctctcagtgctgaaatgtggtgtgtgatacgacaactcagctacccagtgcatgctcagggcgcgttctgaatcctgtgccatttgcatgttacatacatgagcttgccatccatgagtgtttggggacaagacagaggaagaaaaccttgggggaagggctaaggaaaggtgctccttgacagtgaggacaacttaaacagaggtgtgaacataagagcaggcagggtgtgtgtagaatagtagcatatacgtgccacggggcaggggtggaagaaccacaacagaacaggatgggccaaaatggaagctgggatcttaagatttgagactttattctgtttgcagtggggacagacatattttaagaagcttcctctggcagccagccaaatggactgaaggggaaggaaagctcatagcagcagctaccaaacatcattatccggcagaatcactaattttatcactcaataattttatgtattaaaaatgctcatcccagaccctgcagtctctgtgtctactcagaaaagactcatgctgtgcaattagagtgtggcccaggaatctgcattttatttatttatttattttttagacggagtctcgcactctcgcccaggctggagtgcagtggcaccatctctgctcactgcaagctccgcctcccgggttcacgccattctcctgcctcaaccttaaagaggctcccaaggtgatactaacgctggcgatcctgggtctctgtgtgaataacactggctaagagcacagagagatgttagaaaactaatcatcattgagatcagttatatccgagactggatgctgaaaagatatattagagtttagttttatatttatatatctcttatcttttgtttaattgtatttgggcttttaggggttttgtttcattgctattttctaagtaagagtgtattgatgtttaacaaacaaacaaaaatatacaagttattaagttcccagctcaatgaactttcacaaaatgatcaaacctgtgtaacctgcactcagaactgccttccacttattccataattactgtcttgatttctagccccatagattatttaccttttatcacctttatttttggtgcatttgataatgttcataatatattagaataataagatatgtataattggataatttaagtagatatattatggtaaatgctcacatgtttttaccagttggacacaaaataaaaatgtttttcatccacctgtctagatgccttgaaatgttagtctgagctgagatgtgagtcctggaaattggaggacctctgtaccttctcttccaaaatctgtaaacatactgtttccgcttggcagtcttgatttgctttcagtgactctgagaagccctgtggtttgtgaagagcctcttggctttcctttgaccttggttggaagccatgtgcccaggtggaaagacagcagttccctacagcctttctcttctgtttctctcaagtcgctgtgtgcagagtccagcctaagctggctacacttggaaacctctcctcacccttgtaccctccccacaccctggggagacttgctggtggacagcccagccctcactgcttcaggctttaggaagaaaccctctcttttcttggtgtgattttcttagagtttgtctttcctgaaccaccaagatctgaaaaggcaggattagggtgtgggcttaggagaaaggggccaagaagatgacagggttgccttttcatccaaaccttaggaggtctccagctcagccatggcccagcccacctcaccaggactgccctagggtttgaacccaaagcattagttaggaatgaagagtggttttgtcctcttacctgtcttcccagggaacccatgaaaaagtgggcagctggaagggggctggagacggcctggtcagggcatctcgtcccactggtgcctaccgtctgagcactgctctgaaggactcgattgccccgtggagcctgctcccacacacctgccttttgtgcagccggcccatctgttggtgctttttctttcaggaggagatgggcatctcctgtgagctgctggaatcggacttcctcaaatgcagcgtgggatttcctttcatgaggtcaaagtcaaaggtaagggacacagacgggacccttcctcagcagcaggcccccagcccttccaccagccactgattccgccgcctccctgaggtgaggagtcctcccaccccctgcctcccatagcagctggggcggccactgaagccctgacatgctcctgtccctggctgtgtacaccggggtatactccggaggggctgcatcatatggtctttctcttcgattcacatgatgtaccccaaatgtgaaagtgaaggacacaccacagcctctgcactttagcacgtgccatttagttgaccttcctaaaataattttttttctgagacattctgtgcctctttgagtcccctagacaacacagaagaagatgtggtctgtcacctatagtcctgtcattcccttgggtgctcacagttttctgaagagaactctcaaaattctcaaaacataaatacctgtatcccacttcatttttaagaagagtaaagaaattaagtcactttggtattggtatggagacagattttctaagttcaaatagtatactacagcatcttcagacattcatggaacattgtagtatgtgccatcattataaggagatacaaacataggtaaaaagatgtggtgattggaggcaaaactagaatctaaaagaccaagtctgcctttggaaatggaagctattttccctgccatgaacagagtgagactccgtctcacaaaaaaaaaaaaaaaaaaaaaaaaaaaagtgaaagcttcatccttttctcctgcctgggtcatacactcagatcattttaatctccaaggctctttggtcccagtatctagtagctatttgtaaaccaatggtgagaatattctggtgagggagaagacttggtcatttcttagcaaatcacttgaacccataagccccattgaatgcacctcgatcttggactttccagccttcagaactgtgagaaataaatgtttaaaccacccaagctagggtaatttgtgatagaatcccaaactgactagggcaaaaaggtaataactttctcactgttagggtcaatgttgttcagtgctgtgttcacatatcacccaagataatctcatgaaccacctaaaataatcttagtgtaccactcccagtgtgaacatactgtgatttgggtaacactgccccaaacaaatggtgttcaccatatacatatcaggcacgtgtgggaatgtgggaggaacccctgggtaggggttataggaccaggctctaccacaaactgtgtgatcttggcgaaaccacagtggccaagtggccaagtggcccatgactcctcggatttttttctgcctctcttcctcattctgtccacattcaccccaggaggagggaaacctcaataagtgtctgcccttggaaaatggattacatgtggatggcagagtacaggccaagtcccattagactccaggtagggtgagggtggagataaaggaggacgaccacaatccatggacactattgcctatagtaatgtatgtggcacatctgcacacaaatttaattaaaatcttttgagtaacagataataggcttaactggaaaacttgcaacagtttccatttcattttaaactccagcctatatcacatatcagacctaagatgtgtctttctctctctagtggagtgttacattttgtcaaatttttgtttgtttgagagggagtctctctctgtcgcccaggctggagtgcagtggcgcaatcttggctcactgcaacctccgcctcccaggttcaagggattctcctgcctcagcctccctggtagctgggattacaggtgcccaccaccatgcccagctaattttttgtgtgtttttagtagagacaggtttcactgtgttggccaggctggtcttgaactcctgacctcaagtgatctgcccacctaggtctcccaaagtgctgggattacaggcgtgagccaccgtgcccagccaacatttattagatagagcccacagaagtatgaacattggaatgttggttgttttcccagctggtaatgctaccactttcctcccacatacagatgctgggacctgaagcaagactgactaaacctggggattggggggcatgggagcagagggtgattccctggagaaagcccaacaagtcacccagcagagacggggctccccgtatccgcagcccagcgtgcactcccatgtccttccaaccctgagggtcctcaggctccaggccacatgctaagcctcatggctatactttggcttaccttggatggccatgtatttctctctctcacagcctgcccagtttctgacattctgttcttccaggcctccatccctgattttggcttctcacccaattcttttgcctgtcatctcactgtgctctttaatgtttttaatttaattcagatctcctcccagtgctgactctacaccagtcaagaccctgcctctctcttccttcttgtcctcttcccgccctgtctccatgcctgccccccaccccacagtaagctgaccagtcccacagcaacagaaatttctgtctagaaagagatgtccatgttcactgtagatgatggtccattgtaatggaccaatgtccgttgctttcaggaaacattcagtagaattcagtgttgcaaatattagaccattgcctagaattcaccataatggaacccaaaggtttagacattgtataagttataggctctcaaaatttgatgaaatttaagaaccgttttgtccaacctcctttttttattgaaatgcaaagacagtatcttagccaagatcacagtcagtttgtggtggaacctggtcctgtgacccctacccaagggttcctcccacattctcacacatgcctgacatgtatatggtgaacaccatttacttagggcagtgccccctactcacaggatgttcaccactaagtggtacactagataattttagatggttcatgaaattatcgtgggtgatacgtggacgcagcactgaacaacattgaccctaacagtgacccttttcaccttagtcagttcagtcatctataacaaattaccctgggctgggtggtttaaacaacagacatgtatttctcacagttcttaaggctgagaagttcaaggtcatggtcccggcagattcagttcctggcgagagttctcttcctggttcataaacagaaccttctctatgtgtgcccatctggctttcccttggtgtgtgtgcatggagagagagagatctctttgtcttctcttcttctgagtgcactaattccatcatgaaggcctcaccctcatctaaacctaagtaccttccaaagaccccatctccacataccatcacataggggggttaggccttccacatattaatttgaggagtggcggggggacacaaacattcagcgcataagacttttcaatagtcttccaatcctagccacactcaggagaacgtctccaatcctgctagcacatctttaacacttctctatcaccagcaaatctcccttttcaacaaagatggagtagaccttaggctcagaggcttccaaaggcaacagagttcagcattgctctgttttcattgtgttcatttttacaactaccttctctttttggcaagtgatcctggattcccatctatgacagtgatataaattgttcttttaaaacaatctttaaactaaaagagtaaggcaacaaaaatatgaacaaatatcccaggtgatgtaatttgcagatgtggcagaaattgaaaagatggtatgtgagtgaaacttagaaagtcccggttaaagagtgtaaacgcatcacttcctaaggagagcctcggtggcggaacaggagcagcaggtctctggccagagtatgtgtcaggcttggttttactgttaaagctgtgactttggcctgacagtcagaaagctatacataaaactaaagcttatcatgcaaatgagcttccagaggtcataaactgcagaagatggaagagaacagtttaagtttggaatgcctgctgatgccaaataccacttcctttttcactagtatgaattcagcgtgatctttgatacaagccacctgtctggggaagaggaagttctcagcttcattgttactgctcagaggtaaggggggggtttaaacacttttttcaaagatgagagatttatgggaccaggaaaggatgtgtcctggttaagctttgatgaatcccaggatgctgaggaggaagaaatggttactcagtgataaagccttgagccgcaaagtggaattggatttcttggggatggtggttgcctagtgctgcttgcatagccgccactgcagattgaactgagaggaactgggcatcagccactcagaggtgatgattctacagctgaggagagacaggcccaggggggtgaggctctagtccaaggtcagttcccacttggctgtgtatttcccagatcagacagatgtcctctgcaaattgtctggctgggcccactgctgcttttggacatggtgctgtatcccttgatggagtgggcaggtcacctgcagcctgagggcctggctgagcctgttggcagaggccccaagagatgctactcaagagagggcttaatttggaagccaagtggatggataggaaaggggatcgtggggtggcagcttctcccctcagtagcatgtgcccgcccctctccaggatagccatgagtgcctgtgggggcttctggggagttacaagatgccttctccagggcagatccagcatgccttgaagcagcatctaggtagcacttggctggcagctccagtggagggaggggcgttcaggtgggtgaacagggagacacaagctttgattggggtggtggttggacacccaaggcaaccttttcattttcacttggaaatgatcttaaacttaacagaagtcttacaagaatagtgcaaggaactcctatataccctttacccagattcacccagtgttaacattttgcctcatctattttatcatcctctttctatataattttttttgttaaccatgtgaaagttgcagaaatcatgcctcttgattcataaatacttcagtgtgcattcccaagaatgaggctgttctcttaataaactgtagtatagttatcacattcaggaaattgaacattgacactatgctattagctaatccgcagtttatgttctgattatgccagttatcccaataatgtctttttagccgcttctttttactggtccacaagacttggttattttctattgacactattttcaagatcacataatttacatcacataaaacatgactgtgatctaatagaagcctatgcaaagcatagatagggtagacttcattcccattgcacaaaatccagaagggcttcagtggggaggtagcatttaaacagaggagtctgttttcaggctgaagcaacatgggcacggcagtgaggctgtccatggggcaagaagccctgttacacctgtgtaggtggtgggcacgagagtgtactggggattcgtgcaccttctcagaagaaggatggggagcacacaagcacagtgggaatggggctgaaagaggagcctgggcgctaaaccatgggggacaaaggtcacctagaaaatctgaactatatcctgatggcactgaggagccactgaaagtttttgaaaaggggagtggcacagtgcaacagcttggccccagagcatgaggttgatgaatttgataaggggcggcagatgcccattcaaacctgaaaattctcattctcttgccatttcttggatccacagaacactcgccattgttgggcagacccatcaatgtgctctcttggtccttccacacctgaggcagcctgtatgcctgggaaggaatgtgacatggaagagatttcccttgtcaaaatagaagacacttcctgcctccacctaattcagggctaatcataacagtcagagagggcagggaaccagtattgcaattgtgaaaggttcatttgttagaataacatgtccacacagcagcagtgctctggttttggatgcatattagaatcgcctggggagctttcaaaaatatcgatgcctgatctatccccagagaccctgaccctgcctctgcctggggtgagacctgggcaatggagttttcagaagggctcaccaaatgattctaatgagcagccaaggctaagaaccactatttataatcccttactctgtgctgggcacattttcactcagtaaatatttattgtgcaccttatatttaccagttgcagtgctaaatgctgggcacatgagaaaatgacagtaacctactaaattcaagaacaccccctatgtacattaacagtgctgcatagcttcaggaagccctaggatctgtagcttcaataatataaaaatttctagtttcttaaatcacaaatgttaagatgaccatattatcttctaagcacacaccagaatatttcagatgctcatttcttttcaggcattggtgaagatatggtctgactgccccggagggcacccacacacagcgcttgactccctgctatgacggaaagatccttaaagctccttatcttgaaaactacagttaaaatctcaattgttcctttcttccatcaccaccctttgaaggtctctttgcctacttgtagatttagggggacataacattgagactgagcagtttcttgaacctctcctctcagcagccaccagcctggcttttgcagaccactggaaagtatcccagctcattagcttttggaatgacgggaagccttttgatgtttgacgtctttatctcaactcttcaacttagctcattctggagcagtcacacgatgacagatgagacggttgggcctaagccggccaaacaaacggcagggcaagacctggcaggatgctggggtgggggcgggagtgggccaggatggtgttaacccatccacaggggagtcgcctttggcctgcccacagcagtgatcccaaggcttttgtcaccccttgggaaaggaaggacaaggaagtcaggctgtgtgggcacctgatcctgctgcttttgcaaactgtggatgcccctgagggactgatgtcaccccatgtaggaagacagatgaggagccagggcagagactgtggccctatggggtcagcgtcacacagcaccattgtttcagaacaataggagggagaaggagaggggatgtgagagctatttaagtgctgttgccattcagcacttgctggttgagagaggaaggcagtggggcagggcttggagggggcagagagagggcacagagcagacagggactcagcagatgttcagggaacggcgtggtggggaacagtcaggatgagctgagccagcctcagcaggtctaggggactcttttcttccgcccatgcagggtgaacttgggaaccaactgtgaatgtaggttcaagaacatgtacccaagagccacgcattttcccaaggaataatgatcacaattcctattagaaatttaataaagtaataaagggaaactaggtcttctctctcttcctcctgttccttctcctcccttcttcttttgctcctcttccttctcgctcccaaatctggcatcaggagcaggagtcacagctgagagagccctagtttgaagtctgactgagctggttggaatctcagctctggtttgcaggggggccttgggcagttacctgatttatctgacttgctccttacctgtcaaaggtgggtgctccatctccctctggggttgctctgaggtctcagtgaggccatgctgagaaatgcccggcatagtgcctggcacatagtagccacttaacagcatcaattccctcatgttcacctttccagaatgatctcacaagaatccccgttctgtgctttctcacccggaggccttatgtggatgtattttagaatcacctggggagctttcaaaaatatcgatgcctgatctacccccatagacttgctatagccagggtctatagcgagagcttccatgatgtttatagtggtaggtttggtcagggcctctttcctgggcttggctgtccatggatgatgggtggtcctttcaggtgagacatagctgctgaagtctagcaactccttcctggctgcaataccctaacttcattggtccattgttcgtggaacaggcacttacacaagtagcacacacagtaggtgccctgcccataacccctcagccctcacccttcccaatctatccgcaaactgggcagattccggctcccagcaccagccaccctgctgaggctttctctggccagagcccactcacttgcctgacaggcaggtgccagggggttcattccaccccacccccacccccagcagcagcaacagcagctctcaggagtcagtggataaaggcctggctcccatgccctcagctaggaagactgactctgcctcacagagtccccgcgagactgggccctggctgccgacagcacgaccctcctgtatggcatgcctttattgtctcctttcctttgctctctcccttctccactctccagtcctactggcatttcctggggccacctctcgaataaactacttacactcaaatctttgtgtggaacacaaccaagacaatagagtgcccttgatagatatgtacagggaccaaaaacagactgaaggcaatgaggtgccatctgcccttggagaatgtagagattcaactctaaagtggaacagagaaagcccactgctggacagctagtgttggccagcgttcattcattctcctctctctgcacagtggcaacacggagcgctctgaatccctgcatgacaacaccctcgtgctgatggtgccactgatgcacgaggtggacacgtccatcaccgggtgagtagcctggtcctgggttgccacaacacaggagtgccctccagtggaacactgtgcttctcatatttgcatgtgtagccagccaggagccaagggctgtgccacctccacttcctcccagccttgaaaagcaggatgaagctttagctgcagtaactcatacactcctccctccttgttttctcctctgtcccacctacccacccacctggtagataatctgagaagtttgatgacaagtttaagccccataatttctttgaacattccatatacctttatgtgcatatattctcatccgcccctagtccctccagaatgctgtatggtaacaagcagcatggctcctgggattaaaatctcagctggaagttgctgggccagagattatcaccagatgtgtctccagtcctggctcacaggaggaccactttctgattagctccacaggcagtgctggctttgcttgtttctgttaactccctctgcagagccagaggtggcttttcctgatgtctataatggtctggaatgggcagggaaccatcccatcggccacactgtctgtctgggtcaagtccacggtcattcagtgccgctggcattgttggaaagcaggaccctgggctgcagtctgtggagacctgaaacaacctgtgtcagttttcaaccaaagccccagcttggaaaaatgagaactccatttctttccagcttcagaaaacagagtgcatacctctttgatagtggaaaaaagatttacacaattagtttagatcaggtgaggacccactgaacccttgacccaaatgcaagctgaactttctggaggttcacagtttctaatttttcggttttcaagtgcttctgggtctcagccttgattagcagtagaaatgttgatcccttgcagggagagccatccctgcactagcccgcactgctgggagccagtggaatgagtctccaagcattcctgctcctgagcttttggcatttttggtcatgttttttaaacatgaggtactgatggaatatatttgcaaattagcatatttttgcctctgttcacagctctatttttaactgtatcatttatttacttgtctcatcaaaggcacagcaagaatatacccagaaccaagccctatccttggggacaaagagaaaacattctccccaccacccccagacacttgatcatgtaatcagtccttagaggaccttgttgggaggtgttaacagcccctgatgaagccatcagttaaacaaatgagtcaacctctgatctctccaggaacctaaaacagctcttgccatttggtaatgctgggaactcactaccttactaaaataatgcactaaacattgaaaatggatgagttgttgtctattcggacttagtctcaaaaatcttccattgttgtgtttaggtgagtgagtggcctccagcatctagaagtcgatatttgtctgggagtgtcagtcagagctttgtttcttctcaggaatgtgttcatataagcaacattgaaagcattgctgcaaactgagcttgaattcttctcacctcttatgtagcctccgaaatccaagggaaaatgctatcaatgaacggattcagctttcaaatgcctaacttctagtcatcttggcagtctgataaatttaagttttttaagtgaatttgtcatagagtggggtttaggatgccaaatacataactcatttatatttattttttaaaagcttatgatcatcttcttcaacccataaaacatttttcgaatgacaaaacagaaaatgtatacttttataatccagtttttaaaaagtcaaagctatgataatcttgtcatttcagaaaggtaatcccagtgcatatttctccatgcagcttattgacgtaacctaagatgagaagacactactattcatgcctggtcagaaagcacagactggctatgtaacagccccagcagggaagcactgggtgcaagacactggattaaattgagacaaatgtttgcttctcagaatggcagtgaccatgggtgcttgactgtgggtggggatgacagatttcatgctttcctctttcagaatcatgtctccaacctcctttgtatatggcgagtccgtggacgcagccaacttcattcagctggatgacctggagtgtcactttcagcccatcaatatcacccttcaggtacccactcctggagacctcctctgtccgtgggggctaacggaagggcacatgggatgtctctcctacagagggctaagctcttgtcaggagaaacccttctgtggttggctggtgtggtgtgtgtgtgagatctgtaaccacacacagaatgaatccttttcgatgcctggtactctgctgtgcaggcccctctgctttttcaggatttggaaggacaggtccacgtcatgaatgccagttttccccaagaagccctctgtgtggtggaggcctcagccaatgtcccagcccagatgaccccatgaggacccctttctgttctccatcattccccaccttctgggcagggctgcctcagaggatttgctgtgtcccttcctcctgagattttcttgccagctcatccaggagcccactcctcctgcaggggaacagcctttcggaagggcagttttataagaacagaggagtgtgagcccctgtgagcccccacgggaggcacgctgctccctcactgagccatggctggcttgcccaggcacacaggcatcatttccagcaagtccacttggtgtagactgtggacctcatgaaggacactgtttcttctcttagttgggggtcagcaaactttttctgaaaagagccatggggtaatttaggctttgtgggccatttggcctctgcagcatctattcaaccatacttctgtagttcaaaggcagccatagataacacagaaacaaaattttagttccttatagacaatgaaatttgaatttcgtataattttcacatcatgaaatgtaggcccaagcgagaaaggatatcctgaaggtcccagagctgggagaagccgggctggggccaagacctggcggcactggccggaccctgtgtggatgaagtgaaggagatgggcccaactcacccataggacacaacagtccatatctcctcactctctggttctacctcccagaactcttctctgcctcttgcgtccttccccatggagagatggtttcccactctggcattcactgctgtggctaaataataattattttctttccttgtggcctctcctaggtggacttaggggatgacaaataatgacagggtgagggtctagagaatgtggcagtaaaacatttgtgggctctgacaaacaatggtcttcctctccccagagtattctcccagcaacagactgcgaaaccatgatacataacacatgtccccagctcacagaggatgtgccttctgaccaactaagcccctgctgtcacaccctgctcttgatttacaggggagaaagggaaggatggggttagagcttgtttttgagacagtagagtgattgctgtgaacagcacctctgcatttctgaattgcttctcagagttattttatttttctcctttgcttttcgtaattgggtaggaaatagataaagacctgatgggtttatttcatcttagttgtttctactctttcctactcttatagttttgggggtgtcttgcaattaaagatgtagttcagaaaattatttagaagggttcaagtaacacagaccatgtaatgaagagggtatgagtgttgaaagaaggaaaagaagaacaggggttgcacagaatataccaaatgttcttatcaccctctggggaacaaaagaaagaaatctgagggtatgcagcttatccttccagttgtttctctgaaggtaatttttacagtgagtttaaagtttggtattcaggcaaatagttttcttcacatctgacctgaaataggactcaggctagagaatccagccctggggaatgagtgattggcatgtcccttagataaactcctccgtgatccattgcctcaggaagtgcacagcattcaatccagggttgagagagttgggtctgaaagattgatagtgtgtgccattgattagaaggagatccttctgtgctagcaaagcccactttttccttgagaattgtctgactacttatttattggtataatggttgttattgtggttgtcctgcaggaaggtcactaaccagcttggcagtgataatgaccagaaggtgaaaatactgtggaaggaggccaggaatacggagaaaatgtttctatatttccttattccagtaatattgttcctgaaggagaacataagactttccatatgaacagatttttctatgcttttaaaaatcggttattcaacaagctacataattgtttaaaggctccactgccattgtacacaggagaaaggcagaaatactagtcttgggcctgctttttacatttcatcatagtttttaaacagacacattaatttctcgacaataagaggcttttttggcatcaaaatttaaagcatttccccacctgaaaaacaatggccaaaaataatgcagatattacacatgaacatttgcagagaatccagtataaagacatttgttaaaaataaagatggtaatacaagctctcctgtcctcctggctctgatgagtgaaatagtgcaaatcagcatccttttcttcattgcttaccccattcatgcttgaaatgggatttcccagacatgccaggatgtttctttttaattctgtgcactcatgtttcacttcaaattagttatttcagctatggtcagatattccttccttttctatgtcttcaggttgtttggtgaatattgttcttttttgaatcaggagttggcaacccactcatctgctctatcagtttttatctatttattctttgaagtggaaccaactattgcagaaaaccaaagacacagttttctagggaagagctagctggagctagatcttcatacatcctgtcatgtgtgaagacctggtaagatttctggctttttgttggctctgcccttctgacctcaacttcagagttgcagattccctggattctctctctagtgcccaggccaccaagcagcatgtcattccttcctctctcctacttatcctttttaaacatttagttttaaattgacaaaacttatatattttatattttactcatctttttaaaaataacacctttattgagatatgattacataccttaaagttcacccatttaaagcatacaattcaattattttaatatgtttacacaattgtgaacctgtcatcatcatctagttgtagaatatttttaaatttttttcattttaatttttgtgagtacatggtaggtgtatatatttataggatacatgagatgttttgatacaggcatgcagtgcataataatcatgtaaaatgggggtatccatcccctcaagaaatcccttgtgtttcagacaatccaattatactcttttagttactttaaaatgtactattaaattattattgactatagtcaccctattgtgctatcaattgctaggtcttattctttcaatttttttaatccattaaccatccccaccaccccccgccacagccatccccccattatccttcccagcctctggttagcatccctctactctctgtctgcatgagttcaattgttttggttttgagttcaattgttttggttcaattttgtttgattttcacaaataagaacatgtgatgtttgtctttctatatctggcttatttctttccttttttttcttttttttttttgttttgttttgttttttgaggcagtgtctcactgtcactcaggctgctggagtgcagtggtgcagtctcagctcattgcagcctcaacctcctgggctcaagcaatcctcccacctcagcctcctgagtagctgggactagagttacacaccaccacgcctagctaattttttttgtggagagggggtcgggttttagatacggggtttcaccacgttgcccagctggtctcaaacatgcctgcctcccaaggcttattttacttagcataatgacctccagttccgtccttgttgttgcaaaattttggaacatttcaatcacccccaaaagaaatttcggccttttggccagaaccaccatcttccagtaattcgccaaaatgtcgaacacaaagggaaagaggaaaggcacctgatatatgttctctaggctttttagaaaacatggagttgtttttttggccacgtgtatgcaaatctataagaaaggtgacattatagacatcaagggaatgggtactgttcaaaaaggaaggccccgcaagtattaccatggctaaactgaaagagtctacggtgttacccagcatgctgttggcattgttataaacacacaagttaagggcaagattcttgccaagaaaattaatgtacgtattgagcacattaagcactctaagagccaagatagcttcctgaaacacgtgaaggaaaatgatcagaaaaagaaggaagctggcggcacagtagctcacgcctgtaatcctaacactttgggaggccgaggcaggcggatcacctgaggtcaggagtttgagaccaacctggccaacatggtgaaatcccgtctctactaaaatacaaaaattagccggggatggtggcagccacctgtaatcccagctactcaggaggctgaggcagggagaattgttcgaatccaggaggtggaagttgcagtgagccgaggttggcccactgcactccagcctgggcgacagagcaagactctgtcttaaaaaaaaaaaaaaaaaaaagaaggaagccaaacagaaagatacctgggtccaactgaagcaccagcctgcaccacccagagaagcacactttgtgagaaccaatgggaaggagcctgagctgctggaacctgttccctatgaattcatggcataataggtgtctaaaaaatgaaagacctctggactgtttaaaaaaaaaaagaaaaaagaaaaatccttaacccattgacatagcttcttgtattaatttcttattgctgctgtaacaaattactacaacatttgtggcttaaaacaacacaaatttgttatcttacagttctgaagaacagaagtccaaaatgggcctcgctgggctaaaaccaaagtatcagggcctgtgttcttgccagaggcaccaggggaaaatccacttcttgcctttgccagcctctaagggctgcctgcattctttggctcatggcccccttccatcttcaaagccagcaatggctggtcaagtcttaggatgttctctttctgatctgacttctgcctcttccctatataaggactcttgtgagtacaatgtgctcacctggataattcaagataccctctttattttgaggtcgcttgattagcaaccttaattccccctggccacataacattcacaggttccacagatgaggacatggacatctttggggggcctgtcatgctgcctgtcctactccctattcttcctgctccccagccctaggcaaccgctaatctactttctgtctctagagatctactcactttttttattcctctgcatattctgtttcttcctcgagtttcatgttcagctttttcctctccctccttgctcttactggtctctgtgacctccatctttttcctcatttctcaggaaatgattgacttctgaagacagaaaatggagaaatgctagggaaaacaagagaggcaaagttttatagaaccaaatgctgagacagaagaggggtacagttgtgcaagtgatgagctgcagattgcctggaaaccaaatcagctggctcatgtagtaaaaacagccctttctgtatattcgatcgcttggttttgggatgacccacttggtccttgagggcctcagttacctcaaactggcaaaggaaagaggttggaccagatctgtgggtctcaagtggtggttcctggaccagcagcagcagcatctcctgggaccatgttataaatatgaatctgccagccccaccctagacctactgagtcagaaactcggcatgacccccactccatacccccccaccaaaatgtgttttaacaagcccctcagatggttctgatgttttgctgaaatttgagaaccactggactagattatgatgtctgagttctcaccaagtgtaatagtctatgagtaaattcctatacatgtaaaaagaaaagttttagcaggaagaagacaaaatgctgaaagagaatatggtaatttcaaagtttgagatttttagatgcatgttagaagtgtttctattttgttgaaatttcccgtcattcagtagttcactttacttcaagttgtgaccttccagatccgaaccttagagtttctgtatgtgatttcaaagaatcttagaatatatattgcatgacaggaaatggaggtctgctattttccactgagacttgctgtgtgtgttccacacccacaggtctacaacactggcccaagcacccttccagggtcatctgtcagcatctctttccctaatcgactctcatctggtggtgcagagatgtttcatgtccaggaaatggtggtgagttctccatttgttttcactattgctttcagctttgagccagcccattcaaattttgtattccaccctaccctgacatccaccttgagggtttggaaaattcaactcattctaccctttggagacatatctggagaggccaggggacctgtgatacctgaatttctacattgagaccatttggttaatgctgtaagaagacctctttggagatggggaagagttaattacgaaccagctcctgggatggacttcgctggctctgggaacccccagcagcatctgcagttgcatgcgtctgaatgcattttgctgagtgcattttgcacagggaaagtgcctgcagtccatgttgagaggattgtgaaagcattgctctctataggggcacgtgaaggacattcagccaaagggacagtttttccatagatagcttgaaaatcagggcagcaaggcccatatggagcaggtgaatatctgagccgagagttgaagaggacacagcccacagggtggaggttcagaaaacattgtgtgatggtgacagtaatttctggcattgctgccctctgggtcatgtggactgaaaaccagacgcatgtgaatgttgaatgtagaacaggtcactcctcccgagatgccagctcagatgttaacatccctcatgatgttccattccagttccatggcatccccttgtctttgggctctgctgacccagcagaagaaagccgccagtgttccgcacctatgatgtactatggttggaacttagcatgaggtgaacaaaccacacaggcttctggctaccctcttaaatattattaaccatgctgaccatgccacatttccccagcatctaggagtgttctcttcctagagcatgctttctgagttgttcacgtgaacatctacagtgttgcaggagcctttttttttcctatgggcaaaatcatctattgaccaaaacaagacatttaagtcactcagattctgaaggtaccccaaaaccagggataccccttttcctctttactgatcatcgagccaaggaaaagccactggaagggacttgggctcacacttacaaatagctggcttgcatggaaggcattagaagtggtttcctgaagacctggacaactgcctggctatcgttctggctgagtggaccctcagatacccaagtggtgtgagctggctgcactctgttctttgggctctgagaaacaaatcctttggattttcaaaactatatttagaattttcataaagtctgtaacagacttggccctaggatggccaagtctccatctggatagcccagcctgtgatcaaaggctgtgggcatcttcatcgtatggaaaagtaaattcactggcacatctcactaagcaagtaggaaagctctctgtgttcttataaacgatcaccactgagcccagaatgacaacaagagtagaagcataaaagcgagtgcatgaggtgctgtagtgaagaggcgagagtccccagatacttgtttcagaggcccacagctggcacaccctctgccttaaagccctcggcaagggcctcctgtggctccgcccctcccttgctcagcagggcctgagaatgctcactgggtcaggtgtgattcagagctcatgacggtttccactttggccttatgggactttgaatggagcagggctttcattctggggatttgggtggcttggtgcaagtgaaattcagtcctattaggagaaaccagcactcattctctgtactgcactaggaggtgaccctttggcctggtggcattccctccccacccccactctcagccaccaccattccccaacctccaaaggctactgaacagctgggcaccagctggacatgttaagccaactgaagcagaaacagattataggcatggagggaaggctcatctgtcattcctctccacacccttgggaccctcaaattgtttctccctctctaacagtgcccttggtgtctgtattgcctgtgatcatcatccatagagcataatgaggatgggcttactcgccctatgggccctgggctgtcaccctacctacggacccacgtgtggcacagttttctgacttggttcagaattcatttagaagtctctggggctgcttctggggtccctgggcaggaccaacctgcctctagctttcaccaaagagtcttttgtgtttgcccaaagcatttcttgaggtccagctgtctgtaagtggagagtgtctggcttatatatgggaggtttttacggggagcctaatgaagtgtaaccactccaaactcccagccttggctcgtgatcttctttccttgtagctaatgtctctgagcccctctgctgtgcttgtatttaccttaaaaacagagccacggtggtggcctgaggaaagactatcaattttcactgcttcccacccacgggggttgtgtggaccctactctgacttcccacagcacagaaaaaaaaggaaacaggtcactgtggacctagtgtctgtccatcaggaagccaggttgtaatgatcatgaaaataatagaggggaagaatgacagacctttctagtctatctgaaatagcaaaattaccagtaacaaatcattcttgatttgttcacaaacactggctcagcaagtacctattacgtgccaggctccaaggagaggaataagtcccacatctgccccagaactcactgtcttgcaggaaacagatacataaaatgccattgtaataccgtataacaaatgcaataatggaggcatgcccagaccccaggatgctacaaaggttcagtgcttcacaaaggaacctcttcaagtcagggcttagaggatgtctagttcaccaagagaacaggtgaagaagagaacattccagatagaggaacagtcaccacttgtgagtgtatgatgagtatctgctgtgctgggagctacacccggttctccattctgtttgcctagctcttatacaaataggcaagagtaagtgttccgtatgccttctgcagatgtacagcagatagatattttggcagaatgacagagagtactgaaccacagtcatttcctctgtcagtttgtaaattaatcactcttcttgggtacatcgtgtgtgtgctgtagacctgaaccttcctacctgctgacttaggcatggagaaggccaagctccctgtttgatactagagtctaactacatgtcatggacattgtcagcaaaccacccttggcctgctgcaatgagcagtagctactgacctccctagcttacttttttccttctattggacagtcattctaaaaaactcacctgatttccaggaataaaatgagtgagccagacagcttatgggaggcaggctgtgtccacttgctccttagagatttctttttgaagtgaagatagatcatcttctcaatttttcagaacagacctgaaaaattgaaccacttcactttattgccattcttctgcagaggcgagccgtgtagcatagcccctgagcacaggtctaagattgcaccaagataacacatctgtcacaagcttcatggcttatgaagggaagagggtagtggtctttccaaagttaagttttactcacaatttctgaaggttcaatggaagagatgggagctttatctcagactgcaagcttcacttgatggagttaaaaacctgtatctgtgagcagctttctcacactggaggagaaggctttgggatttggctcttgttaatatgcaagaaggggaaaagtcagaaatgatagctaacagggagtgaagggctagaacttttattccaggtgaaagtactggatttttgaaagaactctagtgttagtccagaagagatataaaataaatatcgtaccattcattcctcctcctgcaaaaccaattgaaaatattggcctctctggcttgttgttttcttgctatggggcagtgattctaaagaactgacctgatttccaggaggtaaaattgtagggatgaatgataattttctaaggagatatatcaatgtctttgccatagggtaccattaggacattgacttcaatatggcatgaataccaacatctgttagaatattccaagttggtgccaggactcatattttagtaaactgtaaaatcttccctccccatgcttgtacagtagacagggctacccatgatgtacgatgggtatcccacaatgagtcagttgatgtgggaacttcaattaatttatagtgggactgctcacatccctatgaagaaaatatgcacctgatacatcactgaccataacaggagcttaaaattagacataaatggaggaatgaattgttttccccaaggatgacctggaggagcttcttaagttggggccatcaaatcagtcgatataatccaaagctaaagagtaaagaaattactcctgaataactgacccccccaaaaaaatgaataccatttattgctgtcccaaggctttaatagcctttttcatgtgctgtcaaatttaatccttatggcaccttcataaggtaagatcagcatcccaagttgaggaaccaagcttcaaggatttgcccaacctgacacagctgctaaaaagtagagctgggtttgtaaccaggtctgactccaaagttcacgtggttcccattgtgctgaattgcacactgctcctgaaagtgctgcccactccctaatcaccagaggcaggctcagtcaataggacagacagatgatgagtagacccccaagaatcacccaccagaggaggagcatcaacaccagggcagagaggcagcaaccgcaatcaaaagaactaataccagagggtgcagtaacaaggccaacagaaggcttctgaataagcaagactgatgtcttcagagcaatgcaaaaagacagtgtttccatgaaacagaataaactagagatttgtaaattcaagatattgatcattcaaatgaaacttcaatataagccatagagtagaataaatattaaagaataaagtaggggattcgaaacttggattttctgagaatgtattgcagaagaacaaaaaagccagttaaacttattcctttttttaaatagcaatctggaatgaaaatatcagatgatcataatataagagttagaagtcaagagagatggaaatgaaagcaagtcaagattcttgtcttggggggacaagtttatgtaccaattagctcaaggctttggtaaaataaatgtttaaatatgtaaaattttaagggcaacaaaaaacaatgtaggacatccaaaccactaaagaagaagaatttaaaacataattaaattcaaaacaatccaaaaggaaagaatttatgaagaaaaaaataaatgtataataagatggaagtaataaacctaaatatttcaataatcaaaataataattaatggattaaatgccctaaagacactctcagattagaattttaaaaatccaagtaccaaataacttgtaagaaatacaccttcaaagttacccagaatgtaaggcattcaaaaaaaaaaggcaaatattaacccaaagaaataaagtatagcaatattaacagcaaatgaagtataattaaagcccaaaacccacaaacattaaacagagcaaaagaaaatatatttcagagtgttaaagatttagtccactaagaatttgtaacataaatgaaattttatataaccaacaacacagctttaaccatagaaacacaaaaagaaattgacacattcacagtcattgcaagaaaatttattgctttcccctcaaaaatcatcacacaagtaggagtaaaataatgagtatttgaataatgcaactagagttgcgatcatttatatagagaccaagacagaatgagtcagaatgtctgattttcattactgctcccttgtttaccagctatggcaacctataggaagttaccttaactccccaatcttattttcctcatctgtaaaatgaactagtagtagtacctatctcacactgtaaggactgaagaaactaatttatatggagtaattaacagagatcctaacataaataagggaatgcacattcttttcaaatgtgaacatttacaaattattcaacatacaacaacacaaaaataagcatcaatggaatttttaaagtcaaagcagtagaagccacagtctctgaccacaatgcaataaacttggaagctaaaaacaaaaggttaggcaaacaaccaaccaaaaacaaatccacttgggaaattttaaacaccattcaaattaactttttagaaaaaaaagaaatcaaagttgaagggatgaacaaattagaagtgaaagacagtgagcggttgttcatatcaaaaccaatgggatttagacaaaaccaacacagaggaaaatgccactacttacatgtggaaaatagggaagactgaaaataagtgaactaaattgacaacataaaaactagacaagggacaatgaaataaacccaactcaaagaaagtaaaatgaaggtattattaaagacaaagcatatcctgaaatagaaaaaataataacaacaaaagtattccacattagcaaaatcaaaagctgtttttttgtccaaaaaaatagacaaacctgcagcaagcttcaacaagaaataaagaagagcgatgatgccaaaaaacaacactagaaatactttttaaagaagtaccatacttatatgaagatttaaaatttataacatcttttgagctgggcatggttggctcatgcctgtaatcccaggactttaggaggctaaggcaagaagatccttgagcctaggagttcaagaccagcccagacaaggaagtaagaccttgtctccacaaaaaataaaaaacaaattagccaggcatgtggcataaactacttgggaggctgaggtgggaggatcccttgagtccagaaggtcaaggctgcagtgagccatgttcacaccactgtactcaagccaggatgacagatcctgtctcaaaaaaacaaaaacaaaacaaaaaaatcttttcaattgtattcacacaaagataaaatctgaataaaatatgcatgaggttaaaaaaaaagtccaactagactatcttagaaaaaaatgtaaaagtagacaaagacctatatcttaaaaaaaatcaccgacccagatagctatataggcagattctagtaggctttcaaggaatggataattcttatgttaatataagctgttccagagagtagaaaaagataaagcaactcattccagaaaactaacatagccctggtacagaaaccagaaatggagagcgggcacactcacgcaaaaataggaagcagtgagccaaactcactttgaaaacagatacaaaagttctaaataaattgcaaattgagggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagatactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaattgcaaattgattcctattagaagaataatatagtctgggtaaaacaggatgtaatccaggaatgctaagttggttctccatgaggaaactgattaatataactcattatatattattattaataataaaaggattaaatgaaaaataaccaaatgataatcttgataagggtttctaaaaagttaaaaattaaattcaacatttatttatgatattttattacatttccagtaaggaaagcatagaagacttcctcaacttgacaaagaccctttgccagaaacctataggaaacttcaagctaagtgaggaacaggcatgagtccctgctagtgtctcttcagtttagttgtgttggaggccttaacaataaaaagaaatgatagcctttattcttaaaaaaaaaagtatcctattgtaaaaattgttattgtctccctaaaaaaatccaagagaatcaactgattggccctgaggacttgtgaatacagaaggtaagagctgaagctgactgtaaactgcctgatcttcaaatgctttccccagagacacacacagacccaccaactgagggtgaaaaccttcctagatcaagatgtttacatacagcctctgaccagtcactggctgatcactaagctgtgctgatccaggacagcccctacaaaaccaggcttaaaaataaaaacaagtgataaatatatatatacatatatatatacccacacacacacacacacacacacatatacccacatacatatatatgcatacatgcaatatatattttgccagcagaaacatcagaggctacacactccaggaaaaacagactccagagactatgtctaggcaagtcactaaacaaacaaaacaaaaaaaaagtaacaactacccctcaatgggaggggtaagaatccagaattgctacaatatattatctaaaatgtccaatttaaatacacacagacactgtatatatcatatatatttctcatgtgctatacaggaagaaaaaaacagttaataaaaactgaggaacccagatgttggatttaacaaagacttcaaagcagctattacaaatgtttaaagaactaaaatcagtttaaataaagtatgacagcaatgattcatcaaataaagaatatcagtaataatattgatgaataaattaaaataagtggaaattaaataaatgaataataaaatagatggaaattataagaaccaaggggaaattctggaattgaaagtaaaacatgggctgagcatggtggctcatgcctgtaatcccagcactttgggaggctgagttgggcatatcacctgaggtcaggagttggagaccagccaggccaacatggtgaaaccctgtctgtactaaaaatacacaaaacttagccaggtgtcgtgggcaggtgcctgtaatcccagctactcgggaggctgaggcaggagaatcgcttgaacccgggaagcagagattgcagtaagccgagatgtgccactgcactccagcctgaatgacagagcaagactccatctcaaaaaaaaaacaacaaataaataaaagaaagttaaacacctgactgggcacggtggctcatgcctgtaatcccagcactttgggaggctgaggcgggtgtgaggttaggagttcaagaccagcctggccaacatggtgaaaccccatctctaccaaaaatacaaaaaattagctgggagtggtggcagatgcctgtaatcccagctactcaggaggccgaggcaggagagtcgtctgtaatctcagctactcaggaggctgaggcaggagaattgcttgaacccaggaggcggaggttgcggtgagccgagatcacaccactgcacttcagcctgggcaaaagagtgagactctgtctcaatttaattaaaaaaaaaaaaaagcaaaacacctgaaatgaacaattcattagaggggctcaatagcatatttgagctgacacagaatcagtgaacttgaagctggattacagtacagattttccaatctgaagaacagaaggaaaaaagaataaaacacaagcaaaatggttgaagccccagaggcctttggtgtgctttgtgggacaccacaaagtttatcaagatatacacaattggagttgcagagaaagacgatagagaaaagagggcagaaaaaaaaatttgatgaaatatcgttccaaaacagtggcagtgtataaactcttcaataaatgatatgaagacaattggctatccatttgggaagaaattagagaaagcctgtacctcacagaaaaaaacaaacaaacaaaaaacaggtgaattaaagttagatgttaaaaaaaatatttgcagaactgaatattttcataatctttagatgggaagctcttcttcctaagcaagccataaaatcctgaaaccataaagaaaaaattaacaaatttaaacctataaaaatgttaaacttttatgtgatcaaaatacatcataagggaaaagatatttgggagaacatatttgcaacatgggtaacaaatagataatatataaattacttctacaaaataatgcagaaaagaccaaaaattataaaaatggttgaagttatatgaacaggaaattcacaaaagaagaaattttaggggctgggtgtggtggctcatgcctgtcatcccagcactttgggaggctgaagcaggaggatcacttgaggccaggagttcaaaaagaaattttaatagcaaataaacatatagaaagatgcctagcctcactggtaatcagagcaatgcaaacttaaaatgaggtttttctcctcattaaactggcaaaaatctaaaaaattgttaagatccattgttggttaagatgaagagaaatgagcactttcaaatactgctggtatgaaaggcaatttgacaataactaccaaaatttaaaatatgaatatcaacaattccacttttaggaacctgtctcaaaattttcacataatatatccaggagaaacttctaattttctgatagtaggtgtatattatcagggttctcagcataaatgttgacttctattttggtgaagcagaatataactttaataatgctcccttaggattctgagagaaagttgttagattcagaccaaaaagtatgaaatcttactaacttattacagataggtatagtgcagagatactgtatcaagtactttacaagaacaaattaatctaatcttcataataatttcttaaggaaattgaggcaaggaagagttagagggaaggccaaggtaaattggtaagtggctaagttgacgttcactcttaacagtggggttcactgtgaaataggagttcagcaggacttgtttctcaagacgcaggtcacagagaccccgctgataaagcaggatgtggtaaagaagccagctgaagacagccagaatcaagatggtgacactaatgataattcaccagcaccatgacaatttacagatgccatggcaactcctagaagttactctgtatgctctaaaaacagaaggaaccctgggttctgagaattcgcagcccctctcctgtaaaactcatgaataatccactccttttttagcatttaatcaagaaataaccattaaaataggcaagcagcagcccttggggctgtgttacctatggggtaaccaccttttatttctttactttcttaataaacttgctttcactttactctctgggcttcctcttgaattctttcctttaggaagccaacacccaccggccctcccaggccaaaccccaatttgggggttcatcctgccacaactgtacagtgtggggtcaaggggaacccttggtctttttcactgaaaaatcaactcagaaaaggcagattaataggagaaaaggcacacagatttatttaacttgtatacaggggaggcttcagaatgaagacccaatcccctggtaaggtacagaagcttatataccatcttgaggttatagaaagaatgcaggctcagagcatgaccacaaccaggttttaatggcaagacatgtcatgggggagagaaagaaggaggcttggctagcaaaggtggcattgttatgtagatgaagccttccaggtcataactcctagagagaatagatggtgaatttcttttcagacttgtaaaggtgtcagactcaatctgtcctagatctgggaaaggcctggaaagagaagggctggctgcattcaaggagattctctacaggtgcaaaatttccccacaagagacagttttgcaaggccacttctgtctgctggcccagcagcagccatttcaaacgatgtcaaagaaatctattttgggataaaacattttgatttcctttagccacttgcagggtcttgcgccatccttttgtctgggtgcgtagctgtccagcagctctagcactacctggaagttgaggcatggtcatgcagaactaaggccccacccaggcctgctgagtcagagccttcacttcagcaagatccccagggattcctttgtctgttcatatttaagaagccctggtctaaagcatgagacttaaatctctgctctcccattttcttatctgtaaaatggtgatgacagtcctcaccacaagaggctgttgtggggatatttttatacacatgttcattctttcaacaaatactttgcgcccagcatatgctaagcacctagtgcagagaggaaaacagacaaaaagtaatttccagccatcatgtagcttacattctggtggggaaagagtaataagtaaagcatatagtttattacatgatggtaaatgctctggagaaaaatttaaaaagcaagaggatagggattgggaaaggctgtaattttaaacggagtggtcagggacagtttcacggagacctttattcagaagttgcagggaccaaagctatcttacgggagtttgcaatgagaatttctttgcccatgaagtccttgccaagtctatgtcttttctgagaattctctcccccttgatttcagccctgtttgatttctgacctttgaaatgccagcccccatgctgccgttgtgtggggttccgactggacatccagaagtctccgtgtgtgttctcattagctttcactctgggggagttttctgccacaatgtgaatcacttattttgctggcagcagcagttgacagtgacactgatttttaaagcctgcacatttcacatcagaaaagtcctggattttatgacttagctatgcttagaggataattgcaacaagaagtctcccctgcagccagcttattggagctgagacttgtataagagccagacctggcactttaaacagcccagcaaataacccaaaacaaaaatgaacaatgcacatttttatctatgctgctcttccccatcatgaacacatgcttctttttttcctcgccttcaccctcaattttttttgtggaaattcaatggttgactgtaccaagccagctctctgggtgagaggttccttctaacaaggattagaaacccctctcatgtaggaagaggtggatttgggggattatatgatccaaccctctacctttggacagaatacaatcgagatgtctccccagtacacagaactgcttttccagcaagttctctttgttaagccattctggtatccctcaaatcccttgttatgactatccacaattctccatgccccatgaccctttcttagctaaaatgaaaaataattgcctagttccctcatgtagagaagttgagctattaccttgacttcccccttctcttccaaaaaagattacaattcctttaattttctttcccatcctagggtgtcctctttgctctctccatattctccaaataaaaattcaaaactgagcagcaaatcctgtgcctcttcatccaacccctcctcatcatgaatcattatcactcaggaagtaaggacctggtttaccatctgagaactttagtcctaataatttctctacaccaacttctagtcctaataatttatccgtataatgctcagaaacactccgagattctcagtaaaaaaaaaaaaaaaaaaaaaaaaaatcaaggaaatcttaatggccaaagccataggtccaaaacccggcgttccctcccacccaactttccaggccattttctccaatagcccctcatccctgaccttgtcttccagcctccctggaccatgaatgctgctgaaggctctcactttgtacttccctgggccccctgcccttgctagtgacttctcctcccctctggctgtggaaagctactcattcttcaagacccagttcatatgtcctctctgtcaaggcttcccagatgccttcacagatggccctgcctcagggcctttgcacctgcctttgctgagaacactgttccctccaatctttgcatagctggctccttcttattatgcagatctgagcccagagttcactttctcaataagtcttccctgaacactttacctaaagttgcaaacccccattactctctatctcatttgtatgttgttttcttcatagcacttgtcactatgtgaaattactctcttatcatcagtcttcttccacgagattaaaaacaccatgagagtaaagggcaaggtccttattttctgtgtatttgcagcatttggtgccgagaccatagtgagtggtcagacaaatgaaagaaatggctgcttccactctgttagtggcatcctcagacacacagtcaccccttgtatctcctggggattggctccaggacatccccccatctctacttgagatcgcccagtaggaatattttgaacaaattcctttaacccatggcagaggttgccttaatttcaatgtgagaataagaaggtgaaattttgaaataagagattgaattacttatcagaaacgaaagcttcttagagcaaatttaaactctacaaactttggtcagggatttgaacacatatttccttccccctcagtttctctcacacagacactgctgatctcagtaatggccctaaactttcttttctttttcttttgcattttcttctttctgcacatgtatgaatgcaagctgaatagtcaagttcctgaaatgggtcaggattaggtttgccttaaatctttttctcaacagaagccaaacacttaaaagaagggagatggctgattgaattctggaacaaaagttacattcctaggctcttggttaatttgagcttggctagagggagaaagcgtgtgtgtttctgtgcacaagttacactcaacacacaccctctggaaggtgggggtaagcttcagtcccgactgtccgtacagagtgtggttcagaggctgccctttaacctgtgtggccagagagaataaatcaagccagcagtgctgtctccctgctgactgaaggcgcccggccttatcaaggagcccaaatgtcttgtgctcacagctgctgtgacatctggaagcattaacactttgttgccagcatgtaggctagttgaatgccgatgcgtaggtgcctggtgttttctggtctgctacatgaataggcgtcaaaagttggtggtgaggagtttgcttacgttcattccttaaaagcaacatgacacagagccttgccatggcaggggtgatgggttgttaccaaagtcgataacaggaaatctcactgaggataaacagggctcatcggccattgccgagaaacacatggttctcatttaacctgccaaggactaattgtgtatgcttcggaagcgcaaaaacaggaaaacgcttttctgacatacaccccaagtttcttcagaccaaaaagaactgcctcaatgttgttagacgctgagaagtaatgatctccccagctgtcagggagccaacctcacttacttctctttaatctaaacttatgacctaaagcatatttcaggcctcccatgaagtccttgaaacttgagacttaatgaaggacactgaggtttcacttttcactgctctggtgtatgtactctcagaaaagcagtggaagaggttagatagatggtgatgtaggaatcatggcatccagaaaatgagtgtgatttaccctttgataaaagggaactaataaagcaatatatgcaggaaatgcagagacaacccagtgaataggtgtgctgctttagcctttaagggaagatgggtctgagcttcattctttaccttaagatgggtccaagagctagaaccagaatttaaacaagcagatacaattccaaggaccatgttttgtctcatatgggggctattcactcatttattacccaaatcaacagaccattctgcttccaaaatatttcattatctgtggaaggaaaacatttttggtatgcatgtcaagtgctcagataacatatttatgtatcgctttttcactaaagagaatctgaccgcatctggaaattcttttgtgtcactgcctctctcagactacttcccatctgtatcgctttaactccaataaaaggccatccccatgcctgggaaatgggctttgtctggggaacttgtctttctctgattacatgtaaattaattaaagcccatcccgttttacagggcagcctggtggtggtggcctgcactcttgactttccagcatgttggcctgtcacacgcaaaggaagagggaggaggggaggatgcaggggcattgttttagccaaaccctaaagctgatggaaatgaaatccactggcttttatcatgagaagtgaaattgttcatgaaataatggcagcctcatacagaggctgtgcattggattatactcaacctttcctctgaaacgttggtctggaggctttgcccctttattttcagtttcagatttgatctcagtaacaccctgaccttttcagactccataccacttttcacagggatgactgccttaagggatggggaaagggttagagaaagcaagtattttatttagaagacagttttcagttagaaagggagaagacatctagagttaaagttacgatcttttcctttctgtgcttaagtgatactaggtcattctttaacttcttgctccacctgctctatccccagctctgcaggtttggagtgggctgtcatgtgattttgtttacccgtttcggttcaaagacagaactctttatttgaacactgaagctagcagggactgtccaaagccagagcccctcatattagcctagcttatgttgttgtgatcatcagactgtttctgttttttggatttttgtccttaaataaacaccttggaaccactagctacacagaggggtaaatatcagaaaatccaaatttggtgcactaatgaacacggggtctcttttcacaaagcaaaagaccatcattcttcagaaggatctcccaaagaatgccattgaaaactcctcattaccttcaaatggggtgatgcacacacgagtagcatgaaattagccatgttcatattaaggagcaatctaagatcattattgctgtttctctggccttatattaaatagtgtcattgcaattgaaaaattagagtaaatgaacagagcctgtgagcatccaccctttgtaggttatcctgagtctgcattattacagggtcttgaaatgaatggtgatacgtgaaagtatttgtcctaggattcattaatattattatattttagtctttggtcaatatgaagaaatactcaatagtaaatcatagcaacatgatttaacatgagatataatttgaagggctctttaaggctgctaagcaaccatgaatcatggtttgcatttttctagatggataatatgaagctatcttatttatctttctagaactagacaccttaggtcaggctaatcaaccagctggtatcatttctcagttattgtatgactactatctttatttcaaaccctgaagtcctaaaattaatgtcaccacagccattgtagtatgtgttcagccgcctgtgccggaataggggcttactgtcttttgatgccttggttctcagagtaggcaatgggtaattgaattagcaaagtagacattcaaaacattctctgagttttcaaactcaaggagcgtgtgacttcagagaagcaggcgataagtcagggggtgggtcatgtttacccggttgccgtcagctgcgattggtgtaatatgatatggaaaagtggcccagggatgtaactgagaacataaagtcaatgaataacacagaaacgtgagttaacaggaaacacatgttattctaaaatgaacctaggtcccttttaacccaagccaattcaacaaacatagcttttagatcataccttttaggtttttttttttttacccaaaaaccacactggggatgactccagccgtggctcatggggaacactactgtcattcagtttgttcctctgctaatttaatcttccattttcctttgattggtgatgcacgcattcaaggggcatcaagccatggacactttggtgaccctccctatccttggaaccccagccagctgatggggttcgtactggtaaaatggcaaactggtagaggcatctatgcttctgcctgttaaaaatatactaataggccaggcgtggtggctcacacctgtaatcccagcattttgggaggccgaggtggacggatcatctgaggtcaggagtttgagaccagcctgaccaacatggtgaaaccccatctctactaaaaatacaaaattagccaggcatggtggcacacacccatcatcccagctactcgggaggctgaggcaggagaatcgcttgaacccggaaggcagaggttgtggtgagctgagattgcaccattgcactccagcctgagcaataagagcaaaactctgtctcaaaaaaaaaaaaaaaaagctaaaaatatcacataccaaagctgcaaattatttctttaattttgagcgacgttaatccacatgatctaaatcatacattctcacacattctcctacttcaaagctttccctggttcctattaccttctgggtaactacctccacccacgccatgtgtaagacttgtcacatgccctcctctgtgtccaggcccatctcccctgcctcagttctggccactgctacccagcattcatccagtgcttgacctgtgttgaactccttggctctctagactccagtctcaagtttgcccctctatgcttttgcacatgctgttctcttcctggaattcctttctccctcctccctttactcctgagaagttttctttatcctttgcgatctacctgcaatgccacttcctctgggtcagatatgagaggggctgacttcctggtggagggagaaatttgtagacaagatttataatctcattaggagctgtgctctgaggggctgcgaatggataaacagtgaggtggtggtcaggtggtgtttgggcttcagtatgtggaatagctactatgcagcctggtgcaaggaagatggagtgggacagagcatcctggtggggattttcgagatgtgcttctcagacatgacaggttacttaacctctctgggcctcagttttctcatctgtaaaaaggggtggaatttaaggagagcagaagttaaagcttatctgtcacatccctgataaatgtctctgtgctgctgttctagctggttgaacctcaaaaatgtcccagtttagacaataaattatatggtcacccttctgagagcagtaccctccacacatgggtgccgtaaggattcagcatatgccgttctctaacatactaatagcacctaatattgtattatttccattgatatctgaactcagtatagagatgggaccataagcgatttcccaggatgatgtgcttggagcatgacacttagaaaaaagatcagaggacttttctgcctcttcagtgttcaaacccaggcacagggactgtgtttggctgctctgtttggggccctgtgggaggaaacctgtgtcctctctcttgctctgagtcaacagacaactcttagaagtgcctgattgagcctacaacatggaaatgccatttcctccaagccgtttatctgaccacctcagcctggaaagtaacagctcttgacttcccttctccacctgggatcagatgacgacaacatttgaaacaaagggtctgctctctttctcagtatcacacctatggaatcagccctgattcacacttcaaacccactacttcatgaagcaaggtcttgccagatcccctagagtgaacaggggattctttatcctctcacaggcctggcaccgtggtagcttctgaccatgacagctcctttcactgaggctgacccagactctgccaccaagtgatggccactccttgggctcccacagccagggttcctgacagcttccccagtcaccaccatttcatggtttcagtttgcacaatgtcctctttggggtaaaggggaggacagatgccaacagaaaaccctcagtacctgccttggtagaatacagccttgtcactgtgtcctgcatcctcctgtccttgtttgggtgcctggtgaagtccttttgttcaaattctaatagccatggacctctgccagctcccagaggccctgagagataagcagccatgtcatgagaagcatttggactccggtagcctgggaaataaatgaggactgactgggcagagaagagcaagggggcgatggccacagagtccttagccagccaaggaaatgacattgttggtcattggccggggatgcttgggttgtctgcaacacatgaaaaaagcatcacgtccccttgactttgagcaaagagtgcggttaaaaccaagttgtgggaggatggatagtcagtaattgtttatctgtgtgatgagataaggtagtcccctgctgtaatgaaaatgcacagacagttcatgaagtgaggaattagcaactaaggacaacctgagtgactacatgggccaacatcctcatgtgtagatgaggaaactgaggccctggagacccaaactggcacggctgttagcaggcagagctagggctgaagccaggactattgagtattcatcaagagcgtctgtaccacagaacttcactggggcccggacatgaccttggacaagtcgctgaactcggggacctctgtttccttatctgtcagctgaggccacaaggactgcatgatctcgcagctgccttccagaaacaacattccagaatgctctgttccccccttccagcccaagagactgtgcagaataggcctcttctcagtcagcaggcacttttgtctcccatggtctaggcaggagtcatttttttttgctacagtggtggaaatgggtcaggctggagaatgctgaggtttccaggctagtggtttcttcctctgaccacagtaagaggaaaggaagctttccctccacctctactcctctgtgactcctgccccagccccatcctcagcttccacctaagaggtagtgcaggaaagtggtgataagcagatgtctgcagctgtgtgacgtgtgtcccagcccagttctgtggcctgctacctggggagcctctggttgtcattgggcctcctgttgcctctcagcttgcctccctctgtaaaatggggacagtaggccaggggctgtggctcacacctgtaatctcaacactttgggaggccaaggcaggtggatctcctgaggtcaggagttcaagaccagcctgaccaatatggtgaaaccccatctctactaaaaatccaaaaagcttagccaggcatggtggcgtgtgcctgtaattccagctactggggaggctgaggcaggagaattacttgaacccaggaggcagaggtttcagtgagccaagatcgcaccactgcactacagcctgggtaacagagcaagactccatctcaaaaaaaaaacaaaaatgtggggacagtaatagcacctgcttcagggaactgctgtgaggactgaatgttaatgtgtggaaagcaccgagagcctggcgtgcagtaagggccatgcaagtgttaggtgccgttgtcatggctgtcacattggtacctgttcaacacacttagaggaccgcctccctccaccttgatgacccttggtaggtactgagttcctgagttttagctgaggactgaaggtgtgactgcaataggattagctggtctgaatcagacttatgtagcaccaggcaaccttcaatctccttttgaaaggggaccaccctgaacctttcagaaaaacgttgctttccccgattgaagtgattcccatgtaaccacagtcgggagcacaactggccaagattttcattcaccgcagactcagtcctcatttcccctttccagatcccaccaggggcagatgaggtgtcacattgcatcacatcacgccatcgccattaccctgttcacaggccaccccagaaactcccggcgggagacagaaactaacttctgagctgtgactctgccccttggggttgacactgaggcttaggctgtttctcactcgcttgccctgcctttcccagctccctgcccctctccgctggcgtcttgtggccagatgacagtgctagctcttcacacctgaagcacattagcaacactggctgggctggagctctgctcccaagcttcctctccctgcctagaaacctgaagcaccgatgtgcagagcaaggaggaactctgctcccacgcctgattttaatgagggatggatgcatcctgcagggctcagaggttctgtttctctaaacccagaccaaatgtgtttgggtggccaggcctcgtaatctcagcagaggaatgtgcatgccacagggctgcagaaaacagtttccagcggtctgtcagcagatgtccactccagaagacagacagggaatttggagacctacaggctttggagtgaaaaagtgatggatattaagagcacaactacacacattcggattctcaaacgcccaataaacataaatattttccatccacaatgtactatatatgcctaaatatagggcaagccccaaatagcacatcctccatttccctaattagataaatttaactctctttttttttttgccaacttaataggaatcagaactatgattgcctttgaggtggggggagtgggcagtgggaattgactggcaagggactggtgggaactttctggagtgagagacaagttctgtactttcatgggggtggtagttactgggtgacataattcatcaaactgcaccctttagatctgtggattttaatgcctgtaaatttacctcaataaaaagaagtttggagaaatgaagaaataatcaactatctgtgtataatgtttaacttaatcatgtggttgaatgcttaaaattttataagaatgatatattaatctataatactcttcattcttatgtttcacacaataattttatccaagtgtgcatcttctgagattgatgggtttcatttctaagccacatttttagtcagcagtttaccagaatatatcatctacaatttgcctaatttatttgaaatgcagaacttcttgaatccatgttggtgctgaaatttgattggcacacaccaacgcccacttgcgtagcactgcagcagttgttttcctcatttgtcttgcaagtgaatattcatgctgctccccacatcaacagcttacgtattgctttctaaaatgggctttcaaatatttattgcaactttcaacaattgaacccaaggaataattaccaaatcttcattaaagctcattgcctccttcccattgtttccctctcgtgacctctaaaatcgtccaaacctgatgttgattgagatcatttcaggctagtgtgttttccccaaatgttgtcgttcaaataaagtaattgaggctgggtgcagtggctcatgcctataatcccagtgctttggaaggccaagacaggcagattgcttgagctaaggagttcgagaccagcctgggtaatgtggcaaaactctatctctaccaaaaaaaaaaaaaagaaaccagcaaaaaacaaaacaaaacaaaaactagccatgtgtggtggcatgtgcctatagtcccagctactcaggaggctgaggaaggaggatcacctgagcccaggaggttgaagctgcagtgagctggactactgtacttcagcctgggagacagagaccctgtctccaaaaaaaaaacaaaaaacaaaaaacaaaatttccaaattattagacacttaaattttaaaggacagtaagtcccaaactgtgagaaacttttataggcaacatcctcttttctaatagtttaacttgaggatataaaccttcaccttatttattttcagacatatatagtaaatcctggaatgtattcagatcaaagataaaatagagataaatttagcaaattttggtggtcttgttttataattcactattaatagattagcattgttagctttagtttatttgtgtagcaaaaactgaccaatagaatctaattaaactgaagagcttctacacagcaaaagagactatcaacagagtaaacagacaacctacagaatggaagaaaatatttgcaaactatgcatctgacgaaggtctgatctctgtcatctataagggacttaaatttgcaagaataaaacaactccattaaaaggagggcaaaggacatgaacagacacttttctaaagaagacatacctgcagacaacaagcatgtgaaaaactcagtatcactggtcattacagaaatgcaaatcaaaaccacggtgagataccatctcataccagtcagaatggctattattaaaaagtcaaaaattggcctggtgcggtggctcatgcctgtaatcccagcactttgggaggccgaggcgggcggatcatgaggtcaggagatggagaccatcctggctaacacggtgaaccccatatctactaaaaatacaaaaaaaaattagccgggcatggtggcaggtgcctgttgtcccagctactcgggaggctgaggcaggagaatggcttgaacccaggaggcggagcttgcagtgagccaagatcgcgccactgcactccagcctgggcaacagtgagcgactccatctcaaaaaaaaaaaaaagcaaaagtcaaaaatcaacagatgatggagaggttttggagaaaagagaatgcttatacactgttggtgggagtataaatgtgctcaaccattgtggaaagcagtgtggctattcctcaaagagctaaaagcagaactgccaattaacccagcatcccattactgggtatatatatacccaaatgaatataaatcattctaccgtaaagacacatgcacatgaatgttcattgcagcactgttcacaatagcaaagacatggaatcaacctaaatacccatcaaagacagattggataaagaaaatgttgtacagatataccatggaatactatgcagccataaaaaagaatgagatcatgccctttgcaggaacatggatggagctggaggccattatccctagcaaactaacacaggaacagaaaaccaaatatcacatgatctcaatgataagtgggagctaaattatgagaactcatgaacacaaagaagggaacaacagacactggagtctacttgagaatggaggttggaaggagggagaggagtagaaaaaataactattgggtactaggcttagtacctgggtgatgaaataatctgtaccaaaaacctccatgacacaagtttacctatataacacacctgcacatgtactcccaaacataaaataaaagttaaaaaaaaaccaacagcaaaaaaagtttttgttccctaccatgaataaaaagttgaaacattcttgaacaactatattttactcaagggcattatagacagggcaatttaacagatgcctgtggttagccatgggattgtaagcacaattctaaattatgaattactaattattaattttctggtttaacctcacatcctgtccagccttcagctacaaccagtgtgatatggtgatatataaagaagacttcatttttctaacagttcctcaatttaaacatcagaaagagtgctgttcttaaggaaatcatcaagaaagactaagcaccattgttttgtttctgatgttgctgtcactcagcaccgttgccattgctgtcagaagcaaaatcaaatcactcaccaagagctcggcaagcatgcaggtccccgtctggctcagggcagagactggtcagttatttttttggtagcaaaactctggctttagagttggaccatgagcagtcctgcttgctgctcattccctttctctagaaggacccctaaggagttttacagcaccgtgggggctttctagaatggttgaaaacctctggcagcagatcatccatcaggcttggtcccaagttccagacctgggttcttgactccatgactgttggccagtgacctaagttcagtctcattttcctcattcagacaagaattgcttgtaaggatgttcttaagtgtgctttcaaaaccatggagtataaggcttattttactccttaagtcttcctatttcctagtcacatctcatttgcatgttatatgccatctcatcaattattgggggacctaagatccacattttctattatttggccctgttgatgctacaacttctgcctttcagcttttcagccattgttctccacttcaaaatggacaaggaggaaaggtgaattggggttctaccactcctgcctctacaataagaggctccagcatcatgattcattcttgagaatgactcctctgacaggcctcttttcatttgcaggtgggccaagagaagggaaactgctctttccagaaaaacccaactccctgcatcatccctcaagaacaagaaaatatcttccacacaatatttgcttttttcacaaagtctggaagaaaagtcttggtaaggatttgtttagtggttggggtaacacgggtggtcctcactcggaagacaccagttttctatttgatatttattatttcctaaatctggttttaatcaatttgacttacaaaggcacagactgtggtcaactcctaattttcagtctgaggtttcaatcaaaatgttaaatttacattccaaatcctattacctggaaaagggataaatctttgcaacccaccaagcacaaagtaaaatgtttcttccactagaatgagtctaaacaagagtgattattcttgtgcaaacattttgggaaactgtttgataatatctactaaaacaaaacgtgtgtatcctatgacacagccattctactcttgagtatatccccaagaaaaatgagtacttgtgcttcccagaaaagacatgaaaaaggatgctcacagaaatgttaaaatagctgaaagctgagaacaatgcagatatccatcaataggagaataagtaagcaattgtggtatatccatacactggaatattacacagtaatgaaaaataacaaactactgctaatgaatgaatctcacagacagaatatattgagtggaagaagctagagacaaaagccacatattgtaatatttcacttatacgaagttcagaaatagcaaaaactaatcatgatgatagaggtcaagaaggtggttactttcagaggaatgtggatgggatggggcatgagggagcctgcttagatgctggaaatgtcctacatcctaatcagggtggtagtcctccaggtataaacacatgtaaaaatttttaaagacaggccaggcacggtggctcatgcctgtaataccagcacttagggaggctgagggggtggatcacctgaggtcaggagtttgagaccagcctggccaacatggtgaaaccctgtatctactaaaaatacaaaaattagctggatgtggtagtgggcgcctgtaatcccagctactagggaggctgaggcaggagaatcggttgaatcagggaggcagaggttgcagtgagccaagatcgtgccactgtactccagcctgggcaacagagcaagactctgtctcaaaaaaaaaaaaaaattataaagacacacacttcagatttgttctatttactatatttgttacacctccatttttaaaaagtgcaggtattgaagatggaatgacaatgcttttccaaagcctccttttttttatctttggttacatttctctaagctccttatttcagccctggcacatctcacctttatcatttcctttctcattcttttctcctgttggagaagggtgactgtttgccacttgaaaggttgggtttttttttttttttttttttttacttacatagtgagggtgatattgttgaaagcccttagacttgttagatgtagtgatacctagtgattttatagttacgactctgtctggctgaaaattttgccgtatagatgaaacatcatcaaggtatgtatacgcattttggaacctatcatataaaaaagaaaacttttgtaacttaaatttgggatttatgtttttggttttttgtttgtttgtttgttttgagatggagtcttgctctgtcgcccagggtggagtgcagtggcatgatctcggctcactgcagcttctgcctctcgggttcatgcagttctcccgcctcagcctccccagcagctgggactacaggcggccaccactatgcctggctaacttctgtattttttgtagagacagggtttcaccatgttggccaaactggtcttgaactcctgatctcaggtgacccccctacctcagcctcccgaagtgctgggattacaggcgtgagccactgcgcccagccgagatttacgtctctattgtaacttttgtgttttcttgaggaagtgtcacatgacttcttagccctcttatttacctacctaataaataggcatgaaagtatatttgccactacacaggtggaagtcacataatgtaggaaacgtgtctgtgttcaaaactcataagaatgctttcagaatgcaaaatttaagtttgtgggtttaaaaaaaaaaacaattatttctctttgtgaattcatccaattcttggtaggataaattagtgagctgttttctcccagttgcttgacttaaaggcatgctctggttcccactgggtgggaaatcccttgaatgccctctggtggcgagaaagaacgattgcatcttcttgtggatttcctctgcctggaattgccttagtcaccaagttcatggagcccactactctgtaaattgttgtggatttgtctttgttcttaattccattggaaatttttctgacttttcttctcaggactgtgaaaaaccaggaatttcttgcctaacagcacactgtaactttagtgctcttgctaaagaagaaagtcgtactatagacatttacatgctgctgaacacagaaatactgaaaaaggtaagccctaatgaaccgcacttgtggatgcatttagaagcatttgaattgttgacatctgattttgggtaaaaaaaaggaaaaaggaaagcatttgaattggtgtcctcatgacaatctggctgcccccccttttggctgtctacaagagactgtttttatttttatgtatttagggggtacaagtgcagacttcttatatgaatatattgtatcgtgatgaaatctgggcttttagtgtacccaatagtgaacatggtacccaataggtaacttttcaaccctcacccccctcccacattttggagtctccaatgtctgttaattccactctttatgcctatgggtacccattacttagctcccacttataagtgagaacatgcagtagttgactacttatgagttatttcacttagggaaatggacttcatttccatccatgttgctgcaaaagacataatttaattcttttttatggctgagtaatattccatggtgtgtgtgtgtgtgtatatatatatataccacattttctataaccagtcatccattcatggacacttaagttgattccctatctttgctgttgtgaatagtgctgcaataaacttaccagtgcaggtatattttttatacaatacttctttccctttgggtatatacccattagtgtgattgctggatggaatggcagttctatttttagttctttgagaaatctcgatactgcttttttgattgtactaatttatcttcccatcaacagtgtataagtgttcccttttctttgcatcctcaccaacatctgttgttgtagttgttgttgttgaactgtttagtaatagtctggctgccccttttgaaacttttccagcaagtgccattggtaattttgctggtagataatgccagggtaaaataccagacccttgctactcaaagtgtggtccgaggaccagcagcatcagcatcacctgagagtttcttagaaatgcagaatcctgggctccaccccagacttaataaatcggcatcttcatttttaacacattccccagggattttgtttggccatttaagtttctcatgctttagcttgcatcagaatcacctggagatcttgttcaaacacagattcctttggggtgcagtctgaggctctccagttgccacaagcacccaggtgatgccagtcctgcagtctagggacctcgctttggatgaaggttggctaaccttttctgtaaagggccagtggtaaatatttcaggctttgcaggccctacagtctcttgcaactgttcaactctgccattgtattgtgaaagcagccatagacaacactcaaataaatgggcatggctgtgatccagtaaaactttataaaaacaggcagagggccagatttgacccatgagtcctagtttaaatgacggtttgttttggtccaacttttgaacctcaggtcactttgctattatgagtttatcacaggtggttcattaaaaaaccacctcaaccagtgcatcggtggctcttgaagaatcatacaaatttcctatgatttattttaaggtgagagctgctgagaggccacttccaacaagttgctgtaaaaataattacatgtgaagataaaactaaatatgcatgttagcctcagagattccaattatttttctttagaaagactaaatgtgttaatctgtacaaacctatccacgtgtgaatgaataaccttagaaaagtcattctgtggttatttttaaataggcacagaggtaacacactgacctgagaggatgcaggcatcaggggatgtttttccattttcaatctgtagccgttacagccctcacacacctgaagagagctgtgcatagttctggtttctctggtttgctctggagggaaactggtttggggcaagttggactcacactgcagtgctttcttctccctttgtacctctccctttataaaggacagtgttggaggaggaccaggcctgacttagagcaccactggccatcctctgattccataagggaggctggaaaaccccacgtctggagaagtaccttcctgaaatgtgtccgcaggccaggctggaggactatgcctctgcatatgtacctgtcctgtttgtattcttcaaaaatggtgctgcagacagttttattgcctgtgccatacttgccactgtccatagagccctggtgacagcactggtggctgtaagccactctgatgtttcctttatcctcaacccagatggctgctgcttgcacttcagttatttgcacttaatcatgcacagctctgcagcctggttcttctgcttttctatcccggcagccagtggtgaccctttgccaaggaacatgtcccagtgactactgtccccatgggccagccaggccagtagagccgcaggcaagagagctgaaagctgtagggtgtcatatgaagccttcaaggctcattctccatgtgccctttcagcagaaaccaggagcacttccaggtgcagagaaaagcttagaacaaagttgacctggaagccagatggggccccagctgctcccagagcttcagttgccctgaagccagctacagcctcccttggggagtggagcccacatggctccaggcctcccgaaggatgtggagcagcgccagccttgtggtttgcctgggcctgcagtcgtgtttattttccttttgacctcaagatctggccccagacaagggaatttgaggttttactgttttgaccttaacaagttttcatttgaaatgtaggatctgatttttaaaatcactgtaggagccgggcgcagtggctcacgcctgtaatcccagcactttgggaggctgaggtgggcatatcacaaggtcaggaattcaagaccagcctggccaacatggtgaaaccccatctctactaaaaaatacaaaaattagcctggcatggtggtgggcacctgtagtctcagctactcgggaggctgaggcagaagaatcgcttgaacctgggaggtggaggttgcagtgagccaagatcgtgccattgcactccagcctgggcaacagagcgagactctgtctcaaaaaaaaaaaatcaccgtaggattcggatttttttggaagtattcttctttcagtctgtaaggcttttctcactgattctacaaccgtgggggcccatcctgtgccagactcctcgtctgcttggcctgtaacgttggcaattatcatcatcattatcgttattaatatccaagtttatttttatttattttaatgtttttatttaaaaaaatatttttagagacaggatcttgctctgtcacccagatgggagtacagtggctcaatcatagctcactgcagcctcaaactcctgggctcaagtgatcttcctgcctcagctagtcctcagctaggactgcaggcacatgctaccatgacaggtgaatttttttttaatcttttgtagagataggatgtttccccaggctggacttgacctcctagcctcaagtgatcctcccacttcagtctctcaaagtgctgggattacaggccttaaccatcgtgcctggcccaagattattgttattattcaagattgaaaatacagcatatcctgatacataaaaccccaactttataaaactgttaaattggtaaaagattatttgttgcttaaaattatttcttgcttaaagtgagttaactggagtaactcttttgaatgacaagcttcccaaaagcatttaaaatgtgtcttatggttgttttaagaaaagaatgataattggtgcataactcccaagtcacatatacagaccagggtccctgtgtgccccaggaaggtctttgtggtttctttggcagagatgagcaaagggtacccttggaactgttttctgtggagtcctctaccttcctgtttctttgagggtttaaccaaaggtggcatttaagtgtaagctccttgcatgacaggcaagctgggtagatgtaggtggggacaccacaggacaccttgcctgtggagcccctcctgccccacaggtagaatgttgaatgcactagttctctgctatctgtttccacgacagaagccaggctgcccttctgctccacaatcaacctgtaccactggcttgaggttctggcttctccccagaccacagtttttccagtccctgtcttcttccaaattctttctccatccctgttttggcgccattttctggttatctggatcagtgtctttgaatctgagcccacaggaagacctctgcctgcctctggctggggggtgattccagagtcttagctgtgctcccttatacccctgcccctttctccttaattcataagccagatatttaccccttccccatctctccatcaggcatcctctttcaatgtttaatggttttgattccaaaatgacttcatttaagagcaaagaaagagttaaaagcaactcatatgaagggtttgagggttgtggtcaaggcaggaagatgcctataaaatgtagatcagatgccttctgtggaatgccaggcctagatttgctctacacaattaaacagctttatttatcctcaactctttgtgaacatgtcaatatcaatatccaaatatctggctctaactgcttggaaaccacagcacacatcttgcgtgtgttgattactggcaaactccatcatttcccaccatccaccatgatctgcaaagaatccttaagagagaccctagtctgtgtttatgtgggtgcctgggatggagaggtatctagttcaatgataaaatttttgtctgggctacatggaatcatggaatttcagttctgcccagtccctctcaaggcccagccattatcatagaaaaatcttcaagtaagttgtgttgtttcttccacaggacagttcgtctgtcatccagttcatgtcccgcgccaaggtgaaggtggatcctgccctaagggtggtggaaatagctcatgggaacccagaagaggtgacggtgagtcagccaccccaggacagccctcctcagagggcaagggaagctgggtgacttggagacctggagctggaatttgagggtcaagacagtctctgagccaagatgttgggtttgtggcagacccaagactatgcctgccttggcttccaagccccccctggagaacttctgtggttcgttcttgtgatagcattgtcctttaggatgccatcattatgtgaatgtttcctgctatgattgtccaaagggaaaatggtctggaagtacacccacgtcaacagagttggatttccactgtggagccaggactatttatatctttcttagacctttcctaagacagaccacatctgccttacccgtcacattactccatgggtaaatactgtgttttggtttggtttggtttggtttttaagagacagggtctcactctgtcacccaggctggtgtgcagtcataactccctgtagccttgaatacctggcctcaagggatcctctcaccttagcctccagagtagctaggactacaggcacactaccatgcctaatttttaaattttttaaaatttttttgtcgggatagggttccacgatgttgctcaggctggtctcaaactcctggcttcaagcgatcctcctgcctcagcctcccaaaacactgagattacaggcaaacactgggtgttttaaaaacaagttgtttgaatgacttaaagagattacatccaaattgccaagacctagtaactgctctttaactatttaccacccccttctcctccataaagtgcagttggcaccaaggcctcagagacacgggagggtgtggcaaaccacgaggctgagagtggaggtgtgggagaggctggagggaagctatggccttggaattttattgccttttattgttgttcttgcaggagcaggggggttgaggggggttcatcctgtatttgacgcccacactcagatcccaggggagtagaggaggagacagcagccgatgcacttcttttgccagtgagctgtgcaatgatgctacctgtctgcttcccttctgtggaatttaccctctcttagaacagtcagtgttgctgtgacacatttacaaaagtgataagtttataatgattttgtgcttagaaactgttgttaatttactctctgacaacagtggagacaccacatgtcaaaatgtcagaatggggttcaaaccaaagactactcttacaagaccctggttgggaaagtttcatatagaaaataaatgctgggcaggcggatcatctgagatcaggagttcaagaccaacatggcgaaacgctgtctctactaaaaaatataaaaattagccagtcgtggtggtaggctcttgtaatcccagctacttgggaactgaggcaggagaatcacttgaaacccggaggcggaggttgcagtgagccaagatcatgccactctgctccagcctgggcaacggagtaagactccgtctcaaaaaaacaaaaaacaaacaaacaaacaaaaaaaaaaccaatagtaataatgcttaggacctcaataaaacttcagtcctgtccgtttttggtgagcaagagatgagaacatcagggagtctgggatgaaaatgaattcctgaatgagtgaggggttgggcattccctactcagtgaggagaatgagtgttccatgcagacttttatgctctacccacaagataagttgtccaagcactatttttgtttgtttgtttgtttctttgtttgtttgagacagggtcttgctttgtcacccaggctggagtgcactggtgcaatcatggctcactgcagcctccacctgttggctcaggccaggcactaattttaatgatagaaaccaaatggaatgatgctgggtcatttactacttagggtcagtttttctggcaggtcagatatttggagttggtgtttcccttttcttccctgccttctggccatttaactgctaattcagacctccacctgggaagtgaaaaagaaaagtggttccctgctcattgtcatagttctggtttaaaagttttatagaatgaaatacttgcccaacatgagaggtttagaatgttctggtaaaccacagtgttaataagtggaagctaatggaaatagctaacaggttttctacacgtagaatcccttgtgtagatgaaaaaaaaaaatcactgggcatattgccttccattataggactagactgtgggatccaggaaaatgttgcttaacatctcgttgttggattccaagtcatctgtactcccccaaaataccacttccattaattactgttccattttgagcactatggtgatattttcattatcaagagttcttgggaagaggccgagaggttttttttagcactcctaagaaaaaattaacacacatgggaattccacaatgccccttctccctcctttccatgactttgccttttcagtccatgagctacaatgaagttctacaatctgttgttctcaattttcctggcaggaaaaaaaaaatcttttctgagtaggaaggtttgcctttttagaacaaacacgttcttccctgcgtgattcttctgaatgcctggccttctgtcaactatcagtctgaaggggaatttccatagagcctcgccaccaaatttaaattaggcaaagtttcaaagattttagattaggcaccaaattgttatggccttggaaggaacaggaaatgtacttgcatttggtatcgagtgggggaggaaaacaatcagatttttaaccacataacgtgtgcacggtggtaaatttaactgatggagaaatcaagcaattttcctgtgatcttttttaataggagttttaaaatgcattttatattgagtagttatttcatgttttcttaaaacaattattgtattgaactaaaaataaactaggtagtttgttcacataacaaatctacattcaaagacatgcaaacaaattttccacttagtccatttttctgttctcagcattactacaaatgcctcattctgttatcacgttgaattcttcagcatcttctatatcatttccagggcatctctgggaagtagtgatgcctgtcttccctcagaagcacactgataaccccaatatacccacaattcacacttttttccttctctgaggtatgctgttttttgtcaaaacagaaaaaacacactactaggatatgaaaaacttcattctgggcctggttaggtcataaactacagaaccttaggtcatatattctcaccgggcgcttgtttctccactgcaaaaaataattcgtatttgcttggtcctttgtagtactttactgtttataaatgtagtacatttatcttcatgatgacccttaaatttaagtaaggtagtattatgctcattttatagaagaaattcaatctcaaagaggatacagtctcccaaagatcccacaagcagtaatatattaggcagagctaaactcacacactgtcactcaatatcctaatattggtacatgccatgctaataagtgtgctaaaatggatgaagcggcaatttctcaggtcccttccaatgatcctgtcctctgcttctacttgatattttttctctctttcaactagcattaacatccgaaactgtatatcatcaccacatttcatttaccatggttttttaatttaattattctttaaatttttctatttccatgttaaatccagagaaattgttactttttggaaagtttctactgctgcctgcctctgaaggccacgggacttacctgtttgtttgtcaaagcagaaatgcccaacattttgtaaacactaatttttttataactgtaaagatgattattccatacttaaaaccaattcaaaataaaataaatcctcaatacttcttattccctggggtagtaattttaattagattctattgattcattattttctcctgtgtgcctttatttgggaaatactgttagtttaccttgctatcgagtctctttccctaacaagaaaatgtcagccttacgagtcaggaaagcttttactttcactatcacatatgaagaatgaactaaacacctaacttggaaagtaaaacttaaatgagggattcaggacatttcccaaggggtcatctgaccaatttaagagttggtatgatgtgcctaaaatagcaaattaactcttctacttataataaaggtgcagatgtactgattagacatgctgacatgtacatataaaatatgcctaaaccaaattaaaagaaaacaaaatatattccatggcaatcttgaaaagtcagggagctcaatatatattaagagtatgcgctcagccaggcgcggtggctcacacctgtaatcctagcactttgggaggccaaggcgggtggaccacaaggtcaggagatcgagaccatcctggctaacgtggtgtaaccctgtctctactaaaaaatacaaaaaaaaaaaaaaatgagctgggtgtggtggcgggcgcctgtagtcccagctactcgggaggctgagacaggagaatggcgtgaacccagaaggcggagcttgcagtgagctgagatcacgccactgcactccagcctgggtgacagagtgagactccgtctcaaaaaaaaaaaaaaaaaaaaaaaaaaagactatgctctcacaatgagagcattaaacatttggtaattaacataatttaatatgccaaaaatgagaaaatagtcaggatgagggatgaggagtacacataggaaatttttgtgattttcttcattttgattgtattgctttcttgtcttcaggagggaagattttgacttcaaaagtaacaaaatatttaagaagggaattcacatctttctgttctaattggtattcttgcgctattttctcagcagtccatgtttctggataaagtttatgattgttaagaagtgtcagtgcttctacaatggaaattttgcctttgggaatgctcttaatatttatcatatcaaagtgatgacctttcagcaatctgaattcctttggctcttgatgtgtttcagcagcttttacctgcgcggaagacacaagatctttggaatcaacatacacatcttttagaaatggcagcagcttgtcatctttatgagcaatctctcccttaatttctggatagagactaatctgctctcacaggaggctgttggtagaggggtgcctgggagcaggagagggcttcatcttgctgatttcccattctgctcggttctctcggttggaatgcctgatcctgcgagtcactgcagcccccatctcataacatgatgccctcaggtttacgccacttgtgggaacactggcacaggaagcctccagggcgtctggagcatgcacacatgtcctgtgattctttatatcttttatttttatgccatggtacaagttgtgctttacagagcatttgggtgaataactagaaatatgccatagattcttgaggctttgcctggttcactaatgacaggctccagggcgtttctcagggagcgtgttagcatgtttctaggaccagccacatcagccagacctggctctgtacagacccaaacctgagaatgccatgtgagacctgtgtgactgcagaatcaaagtgctggttgcgaggtgccaattacatgttgaatttcatcttcaacccaactctacttacctttcagggagtgatgagtagggggcgagaggggaaaatgcagaaagtgttgtttgaggcccacagaaactataaagatgaagaacaggagaaacgtagttaatcatgccctggaaagctggcctgcagaaagaaaaggaatttatctctgagaaggccttcagaaagaaaatgagtaggctccggagacgttcatctgtcttcgtgcagccataaaaagttatcaggtgaggctgaggggtgaaggcgctttctctgatccctgaattggttactgaggcccacagaagaggaaaggacccctgaagccagaaactcccccaaggcaaatcaagactttatggaatcagctctgttactgcaagacatcccctcaaactcccgtctcagtctgtgtgagaagcgtgcatgaattcttgctattttcttgatattttcaaatagcagaatacatgataaacttgtaagtccacagatgagtcggtaagctgctgccatatggagcatgcaccaaagactgaggtctttggtgacagctggaaagactggctctgtctcatttcagcagaatcagaatggattcgaaggctatccagtggaagtgctcagaattgcgctggaaggctggagaaccagaccaaaaatcagagggatctggaaacctgagggctataggctgcgtccaggcgcaggaagtctggcatggtgtcctggacactggacacagctatccctggcttctctctacctcgtgctctggagtcaggcagaaacctttctactttctggagttgctgagaaggttcagtgataccagcatgaagctcctagaagaagggctggtgcatagctgctgctcagggtggcacagcccctccacagtcctgcccacatgtgagttgccccttcacaccactccctaacactgccctcaccaaagatgcaagcctggtatctcaaccagagaggcatctttcaacatggcaagcaagattactccaaaaaaatgccacttaccattcctttggtgtactgcttctagaggcaaagtttactgcttttactgtcatgaaatagactgtgacttgttatttatcatttatgtgaccaattatagttacaatcatgttccatgtgacaatagaatctttccccccttgaacctcacattatgctgagatgtaggatgaagaggagggttgttgaagggtcatcaccgcccccatcctatgccatcagcagtgggtggtgagtagttctttctcttcacccacctccccacatgtgagaattaagctctgaccatcaagaattgagaaaactctcggtatagttttccaaacacacgagtcatattttctaatggtcatcatttgcttatttgtttgatgaatatttattgagggcttgctaagagccaggcactgtgctaggcactggggactcgatggggaacaaaagagacatgatccgtgccctcccagagctggccgagggggcagcagtcagcaaggacgcaaacaagaattctatttccagttgaggttagtccccagggagtagcctgctttagattgggggtcgaggaatgtttctacaaggaagctgagactggcagatgagaaggaattcgcttgccaagcatgaggaagagtgtctcagttggggaggagagctgtatggagccccaaaaggcttggcctcttcaaggcactgaaagaccaggtagcaggaagctggttagcagtgaagagaaccatggtagacctaggcagggtccatgccaggtaacaccactgggcacttacaaaggaaagccattgaaagcttctgtttggagcagggaatggcatgatccagtgtatgttctttaaaaatcgtaggccactgtgtggatggtggattttaggggcaaaggtggaaataaggagctggttagaaggctgcgattttcacctggcaagaggtcagggtggcagaggagacagagcaagtggacagtatgtctatgtcagtgaaggtgcggtgaccggtgccactcacacgtaaggaatgcttatcctggagggctgggagtgatccagtgtcatctcgatgcaaagccccttgcacagcacatccacggtggcactctgttaatagtggctgtcattgcataaagagatggccaaggagatgaaccacatgaaaaatgagcctccttctccccaaatcctcaagtcctggtcagtttactctaaatcaaagtttccagtcgtcatgatgagtatgatcatcatcattattatttttaggcaacagaacccatttctaaattgaaatatgcttcagttgactcaggggtgaggttcctggaactccctcttggtggcttccataccccctcactggacccgtgggctctaaagaagccactgctatggaaagttgtattctcagaaggttgcccagtccatcaaaggctttcactagatgctagttatacccccagtaactatgaacaagatgaaatttttaccctcaagacttccacagccccaaacaggtcaacacacacacacacacacacacacacacacacacacacacacacacacgtgcacacacatcacacccctgcagcactgtatgcatacgtgcccagagtatctgtgctgaagaggtcaagacaggtttcacagaaggagtgacccccgaacaagtattgaaggaatttcccacgtggacaaggaagatcaggcattcaagatgaagtcagatggtgtcttgggctggattctcaagaagcagaccctgagatgagggcatcatgtaagcagtttatttagggagatgctcctaatgagacccagaaataaatgggacaggataggaaagaggagaagggaagcaagggtgagatttcagggaccatcttagctccaccctgatcttgacctcggagttggtcctgcctggaagcaggggagctggggtctcacactcctgtatctgccagtcattggttggggctgttccagaggtagtaaccccaagccactttaccctctaaaagtgaggcaggcctctagaagtgaaggcatgacaaacctgggggctgggcaggccaaatcaagagaggggacccaaaaggatctgggcagagaaccgagtcttggccacagatggaaatgttctgcactcagagcttgggtgctgtgctcagtgtgcgtgtccatgtcccattaagatgaatgacctcattgtgtgaggtgtgctcgaatctgctgaattcctgtgaagtgctaggcatgtgctatgattacctcctgtcactctgacatcacccctgtgaactaggcactacaacttccatcttctttggaacagaggctccgggagtgaaggagcctgctggatgccccacagccggtcagtggaagaggaatttctggccacagctctgcctgttggcgagccctgagtctcccttgaccccttacccctctggcctgtgctgtcctgtagcccagagcccacacacagagcaggtgggaggaatcgcattcctgggtggtagacagctgaccctctgtcttaggagtgacccttggctctaatggcctcaggagcacatcatgctcagacttatttggtggtcagttggctttggaactcttcccattgtgtcctggtccttaactagatgcacagatgtgcagtcaaggggagaatgaagactcctcgggattctccatcgcttgaggtaaatgagctccatccctctctctctcaagagcaatgtgaggattatggggagtagtagatagtaaacctctcagcatggtgcctggtgcatagtaagtactctacaaatgtgatccattaccagtaacaggaattagaaagcccagctcattcctctgcaaactctgacagagaaagggattttggaaacatgacacctggcaggcatggggcatgtttgacatctctgttcatcacagcacagacttacagtgccagtcttgccaaatgtacagtttattttctgttcatttatgtcgtctccataagtctccctgtgcctctgaactggcttgccttctaggctgagttctgagagccatctgaggcatggttctgctgaaaacatttattccagccccaaccaccctgtctccctcctccctcccccacacctgcactggctattagatggaatcagaatcgggtggaaatgtcatctcactgtcacagatgttattctctttccacttcttattttatataaattccttccttctattgagacaagtgtgtgatgttgactgcagagagcatcttgcccttgtcattgaccttcagctggcctaggtctggagttgaacctcctcttggatggtattgaccgagctgtccctccgtctctggaagccctccatccagcagaagcctgggtgagatgtactgccattgtgatcatattctcaggccttgtggagacatgggcattgccagctgttacagtaggcatatttgcattgatcagaacataaaagtttccagaaacacagaagtgaatcaaatagtgtggtttaggttcacccactgcctcagactggaagctggcttctggccactccatgacaccagcttggcaacctcaggtacgttaaattctacagaagcaggcagggtgccagtgtctggacctgtctcaaaggcctgtttgccctcctcaaaggcccccttgagacagatcctcatactccccattttcgtctgttttgttagtcagcgtccagtgtgtgagccctccagccagggtccgcaccaggccatcagccatcccttcactggccagagctcctgccttccccagctcagcctgctacgaccctcacagccactcccccaaaaccagcagacttctcctcctcctcagtcaatcttctcctttcacaccacctcctttcttactgaaagcgtggatctaacctggggaaaccatttcccccgcagccctctcacgggggctttttccttgtactcccacattcagttatctcttctgacctagattcattttgcagtgtactttgcaaaatgcaaatcacatcactgccctgctcaaaatcctccagtggcttctcattcctcttaaggtaaagcatggagatcttactgcagcctccagctcctgtctctccagcatatcatgaacatcttcccgctgcttcttgttcatcctgttggctccagttcactgtccaatggcagtgtctcacccttgccaagttcactcatgccaaagggggtttgcacatcatgttccctctccttggaatgatcttccctcccttgtttagctggtaaacttctgcttgtcctttcaccttcagctcaaatggctcctcagggaactctgttcactcccatgcctctatcatgaggatcttttatcatcatgaacttctcctttgtagcacttccacagttataatgatgcatttatttttctaattgactagtagtctctagaagctggaagttctgtgaaagcaaagactgcctgttttattcatcaatgaatttccacaatgtctagcacataggagatactgcagacacatttgttggttggttggatggatggatggatggatgaatggatggatggaacgacggacagacggatggacagagcagatggacaggttgattgacagatggataggtggtggatgggcggatggacagatggatggatggccaggactcccccaaaagatataacatttgcaaatatatttttgaaggagagagaaaataatcacactcagagactccacttcaaatcccacatctcttttgttgcaaactgagtcgtgttcatacttcatctgattttatagcagaaatgatgttgaatgtattaatttgtatattcatgaatcatataatgaatcagtgccttggttcaggtgacaggaatgcatgcattcatgtctttattgtatacaaatcacagtttactggagtccgtagacaggaagatttatcattaccttaaagagtgagaaggacctagaactgggactctgaagtatacagctgtggttttaaaactctgttttgttggagccatgggttcccttgagtttgttcagtgcagctgaggtcaggttagggaggaacagggcttagaaagaggggctgggtcaggtgcagtggctcacctgcagaactttgggaggctgaggcatgcagataacttcagcccagaagttcaagaccagcctgggcaacatggcaaaatcctatctctacaaataataataataataattagttggctgtggtggtgtttgcctgtagtcccagctacttgggaggctgaggtgggagaatcacttgagcccacctcaagtgattgaggctatagtataggttgaggctatagtaagccaagattgtaccacttcactccagtctaagcaacagagtgagaccctgtctccaaaaaataaaaacaaatgggggctgagtagtctgggttctagctgcccacctaagaagctccattgtatacactgggatgctataggaggttgaaaatcactatgtttccaagagctcagagaatgattaattctgctgaaaacaggagtaaggcaggcttcttgggaaagcagatattggagcagagtctctcctttaaaaaaataaaatggttttacttgcctttaaaatgctcaatttaaaaaatagtaaaacgtagaaaagagaaataatattcataatatcaaaaaaacacctgtttactttaaagggttcctactgtattgctgcaaagctgaagtcttctacgtattagataatctttttattttttattttttattttatttttttgagactcactgtgtcgctcaggctggagtgcagtggcacaatctcaggtcactgcagccttcacatcctagattcaagtgattacaggtgtgcgccaccacacctggctaatttttgtagagacggggtttcgccatgttggccaggctggcttgagctcctggcctcaagttgatccacccgccttggtctcccaaagtgctggaattacaggtgtgatccaccatacccaacctatttattttattttattttattttggacggggtcttgctctgtcacccaggctggagcgcagtggcacagttacagctcacttcagcctcgatatcccatgctcaaatgatcctcctgcctcagctccccaaatagctgggacgacagttgcatgccaccatgcccagctaatttctgtgtttttgtagagacaaggtctcactatgttacccaggctcatcttgaactcctaggctcaagcaaccctcccaccctggcctcccagagtgctgggattataggcatgagccagcatcttctgattttttaacttagcataataaacatcattttcccacattattactatgttttcaaaagtatctaaaatttggaaatcaggcaaaaagatgattacatatcctttcagtgtcatactggagcatcccctcgcccctttctactcaaagtgtggtccacagaccagcagcatcagcatcatgggggagattatttgaaatctaggctctcaggccccattctagactctaattcagaatctgcattttaatagagttcctcatgtgattcttatacacagtaaaatttgagaagcactggtggaggtcccaaattctgtaaagttacctattaacttacggaaggctgataagttataaatgactcttgccagtaaagataaaaatgatttctgtttgactgaaaatatcccaaaggttagaatttattgccttgtagggtattagccagttttgtatttgatttagtaatctgatttcagtaatttttttcctgtgactacacatttttttctggtctttttaaaactagctttgccaccctgctgacttcctcaataataaattaaataaatctttgccacgtattcactatatatttgtatgagaatcatgtttttaactttttgaaaattatgctttgacaaccagctttctgtcatcatttttaatagttctgtggtattctattttgtgattgaccatagtttacttatctattgccctaatgttagacacttaggatattgctaatttagtaccaatataaataattctgcagtgaacatctttgagcataaaactttttccgtattttatatttatttcctttgagtaagttttcaagtactgaattaatggatcaaagggtatgaacatttttattttattttttaattttttatttttttaagacagagtcttgctctttcacccaggctggaatgcagtggtgccaccttgactcactgcagcctccacctcccgggctcaagtgattctcctgcctcagcctcccaagtagctgggactacagacatacaccatcacacctggctgatttttgtatttttagtagacacgaggtttcaccatgttggccagactggtcaagtatgaacattttcagatgagcaataatgagcttgtcaaatggacaaggatggaagggcatttcaggaggcaagagcagcctgcagagaggctggggaccaccggtctcacagaggagaggcctctaactggctagaatgtaaatatgtgtcctgggagcagctggaaaggcaggaaggagaccagagtatgaaggccctggtgtcctgaattagatgctcagcctaaaggaaagtcatggatactgtaaaccgagaagtgacatgatgagacctgtgccttagaaaaacaactctatcagcaaggaggcctttccaagcctcctgaaatagtgctggtgagagaagacgagatgtgagccaggaggtacctgggatggaaacaagaggatggagagaaaagttgtttagaaaggtgtaggggcttaaccaaggatcacccagctcattggtggtgatgacgggacctgatcatcagtgcttcttgcctctccatgtcgtccatgctgctgttccttccttagagttttgttttttaatctaagatatgacttcctagagctacaggacactcagctcatcactcacagatgagtttgagagttgtgatgtgagagaacaggctctgccaaagcatggagcacgcatccaaggggatgaacagcatccctaaaaataataagagatgaagcccacattccggggaagtgacagggcattcttgtggaacttgacagactaaactgtagctgctactttaacctctgtgtccacaaaaccagacctccaacgtggcgttgctggtatgcagatttcagtgtccctaagaagccatctgggttagcacagggggctgggttttacagctaaccccgctgagctcagtgtctcagtctgattcatagtcaacaataaggtttagcagacttttctcacacccaggtgctttcacagaactgccacatttccctatcagaccgccatttcacagaggaagagaaagttggttgcctacggttgcaccaggaccagattaaagccagcgctcctccctctccatctttcctaacagttcctcacagttcatctgtacaagacaccatgagagattccaaatgcaggaagtgatttgatccacagctttttaagggcaggaacccaaagacatgagtctgtctgcctttaaagatgagagctgctcatttgaactagatagaaaatagtggatttaggatgacagacttcagagcccactctgtcctaccacctcctaccagtaaatgttcttccctgagaattgcctattatctgaaaattgctctttttaataaccccaagctggaaataatctccatgcctatcaataatagcatgaataaataaacagtggtatgtccacacagaggaatactgtacagcagtgagagtggacatgccacagcctggagcaatttcccaaacataacagtgagagaaagaaaccagatgcatgcctgtaatcccagcactttgggaggctgaagcaggtggatcacctgaggccaggagttcgaggccaggagttcgagaccagccaggccaacatggtgaaaccctgtctctatgaaaaatacaaaaatcagccgagtgtggtggcatgcgcctgtaatcccagcttcttgggaggctcagacaggagaattgcttgaacccaggaggcagaggttgcagtgagttgagattgccccaccgcactgcagcctgagcaacggagcaagactccgtctcaaaaaaagaaagaaaagaaaagagaaaagaaatgaaaccaggtactgtagttcatacatcatcattccattcatagcaaggacccaaagaagcaggtgatgctaatccaagctgttagacatccttggtgggggtggggactggaaggaagggggaagggagcttctagggagccggtcaccttctgtttcttgatctgagtgctggttacacacatgcatttagcatttggtatgtgaaaattcagcgagctatacacttaggatacctatacttttctctatgtatattcgacttcaataagtaatttttaaaaagtaaaaagagctgggagtggtggctcatgcctataatgccagcactttgggagctgaggcacaagaattgcttgaacccaggatgcagaggttgcagtgagctgagattgcaccactgcactccacctgggtgacagagagaaactctgtctcaaaaaataaaataaaaactaaaaagtagccagccatgcacaacctcaaaaaaaactccctacaatgatgctaacaggaacactccatttgtcaagggcggactctgtgccagatgctatgctggggactctgtgtgcattaccccttttcaatttctgggaaggcactgttctgctcctgtcttgcggatgagaaaactgaggctcagaaactgtggtggcctgtgtgtccatttgcctcatcccctggcacacgcacacactctcctaccccagctgcgggaatggaggcaatgaagtagaggtggtctcattttctttccttatcaccagggaagagccagtaagtaattcattcagttgacaggtagcctataaagaaggccactgtcaaccaggcactgcagtgtggtgatgacaagctcagatttgggggtttggggttggctaagagctgggttcaaatcgtgactgtgcatttgaactacacaatccagagcaaatatcctctctggacctccatgttcccctctgtaaaatgggtgtggaagacctcatagggctgttgtatgacttagacaagagattgcaaaaaaaagcataaactgacacagacaatattcaataagtgttagagagggatggaagccaggccctaaaaaggttaaataagcagtgctaggcattataacatcagtattgtgcccagtcactgcttgggcttgagcaaggggctggaccagtgggcttcagcgatcagtgaggcttcttgacagaggattgaactaggtttagaaaagactttcccaaaggggaatggacattccaaagagatggcaaagcttggagaaagacctgtggttggccagcctgtctggagccaaaggagagaatgactgcccagagctgtgatttttttgtcttttgcagtgaggagcttaaatgggacagtggtgtattggggagagttatttggtagcagaagacgcaatagatgctttgaattctgcaaaaccaaactcccctgtgaccagtggggataaagcagagccgaaggggacaatcagaagtgagcactgatacatgtttaacaatcagttctctggcaggagggtaggggtgccctgatttgtttgccaaatactcccaccatagcccatttcaaactgccattgcaatgtcactaggtacggagttaggaagagatgcacagttgcctctcatgagctgatatgagccagttccacataccactgggtttcaggaaaagttgggaaaacttgcctcattggaacatgggctccaattgctgtggctcccatgggaaactacagtacagcctctcgaacgagtttctccaatgtgctaggccctaccatgagacccaagacagactgtgtcctaactctagtggggtccacagtctactggggaaactggcattaatcaaataattcctctaagtgacacattgagctgaacacttggaaagaagagctgccttacatgcagagcactcccgtgttctttgtttcaaagctgaaacaaaaggtacattgtcgttatctgttctgaatcaagaacatagtgtgtcctctaagtttttcagtacacttttgttcacttcatgatatttaaatcagggttgttgtcattacaaccctttcaagacctagggcttggatttcaagtgccttttcaggtgccagtgaaaaatccatcagtttgcaaccagaaaatcgttcagcggagcttatgtatttatttattagtaacaacagtctggatacttctctgtagttctctccaaatgtcaagcccaggctgggctccatcatgctctgcgcacttctgtttaggaaacgttttcagctggcactgtggctcgtgcctgtaatcccaaaactttgggaggccgaggtgggtggatcacctgaggtcaggagttcgagaccagcctagccaacatggtgaaaccctgtctctactaaaaatacaaaacattagccaggcacctgtaatcccagctacttgggaggctaaggcaggagaatcgcttgaacccaggaggtagaggttgcagtgagccgagattgtgccattgcactccagcctgggtgacagaacaagactctgtctcaaaaaaaaaataaaaaaggaaatgttttcactgttgcgttgcctcctaggtggtcttcgaggccctgcacaatctggagccccgtggctacgtcgtggggtggatcatcgccatcagtttgttggtgggaatcctcatcttcctgctgctggccgtgctgctctggaaggtgagtctggtgattgcaggtccccctggggtccccactcatagatgcccagctctcctgcctttccagggaagaaggagtatcctgttagagcttccttcatggcaccggtacagtgaaggacagtgacccttcaggcagggagtggaatcttggctccccttgaggccattcacaactgaggatttggaccacttcagagtgaaggcaaaagtctcagttctctcttctcttaccttcccttagagccctaacataggatggtgagaacctaactccaaaacagaagtctggggagcaactgccagaagggggcgatttcccatttgcttaaaaaagatcagaaggcgaactatagaacaattcttccttcttttcctctaaggaatgtgaggaagatttctgaccagaaaacttgagtaactgagatgggctacagtccagagtagcttcatcataacttctcccaacctcatggtggttcatttggaggtggcccagggtgcagacctgtcctgcctcaagcatcactctctcaaggagaaaggggtgtcctcatccccatgtctaggatgatttgtttgcctcacactctcctttcagagacccggagtccttttccttcagagcctctctattcatcagtaatggtattggaggctttagctgatgaaggtctgtctcttccttgtttccactgtgtccccagctccaaaacagcaccagggaccataactgcaacttcctgacaccaaagtccatacttctctagaattacaaatttcagatgtaggtgaaaacagcctcttagagtattatagatggatattttaaaataagacaactaatttctttgggattacaaaataatatgtatgtattgacctaacataacatatcaattaccaaaaaaagttgtaaaacaccaggagttcacatcccagaaataaccatgatgagcatagtattgcctcattttgacctttttctctgcatatatagatatagaccaggcattctcataacatcaacttatttttgaatagtgtattagttaaattttacagtaatatactcagcatattttcaggtgaagtacctctaaatttaaaagcagtgggttcctttttttttttaagtatggggtcttgttctgtcacccaggctggaaggcagtggcacaatcatagctctaactcctgggctcaagctgttttcctgcctcagcctcccaagtagctgggactacaggcatgcacaatgcctggctcatttttttatttttttgtaaacatagggtctcactatgtttctcatactggtcctgaactcctggcctccagctatcctcccacctcagcctcccaaagtgctgggattataggtgtgaaccaacgcacctggcctggatttgatttattaatctgggaaaaacgtatacctatttttccctgaagacagtactgtgaacatctttccatattgttcaaagcacgtttccagcacatcttaaagctgtagagtgtctgcagtctactcatccagtcccctgatactggaatttaggttgcttctgtttcacacttcttttaacagtgccacattaaatatccctggagccaaatatttgcacaaatctttcattatgtcgttaggttgaaagcctagaaatagaattgccatcaaaagggagtgtatattttaagctttttaaaaattatatttatttttttattttgagatggagttttgctcttgtctcccaggctggagtacagtggagtgatctcagctcactgcaacctccccctcccgggttcaagcaagtctcctgcctcagcctcctgaatagttgggattacaggcgtctgtcaccacaaccagctattttttttttttttttgtatttttagtagagaccaggttttgccatgttggccagggtggtcttgaactcttgacctcaggtgatcctcccgccttagcctcccaaagtgctgggattacaggtgtgagccaccccgcccggcctaagccttttattactattgcagattgccctgtagaaaggtcataccaattcaccctcccacaagcagtgtatcagaaatgtctgtttgccaatagtggatgttaccttttaaaaacaatctgccaatttgttgtttatttaatccacatcgccagatagattcttaattctcctttttctccaactccaactccttcctgctgagacagcctctggtttgtgggtggagaacaaagcctgctcagtgtttggcatctgaaaagacaaggcttcttgctgagttgagggctttggtgcatgagtgtgtgtgggtgtgtgtgtgtgtgcgtgcgcgtgtgtgtgtgtgtatgtgacttccttctgcctttatatgggctcttaaaatgagaggagctgtgtcctttatggctgggtgtgtggaaccagacagggcacagagtggggagtgttgtggccgtgccccacttccccttatagtctgcatgccctccttctggccgccccacctggctctgcctctcaggggtgtcctgtctcctctgcacagcccctgcctcctccagcccaccacctgctttgccttgcttttgctgtgtttgtttaaaaaagcatggttgcaggagatgctgtcatgggtggggagaaccctgaggtcacccagctgtgtgggatccaaagagccaggacctgagaaggcagactctgccctctgccacagactgggagggagagggcagtcacggccgccagggacacaccgtgtgcccagaccagggcttgccgtaactaacgggtggcaggaaagctttgaggaggctgttgaatgaggccacctgggtcacaacagctttgctagtcaacccagagcagtatctcatttcggctcacatttctcgaacgcttactttgccccagtccttgctttgcctggactaggcactgggatgcagcaataactgtgcccttccctgcacttgaccgcctcaccacctagcaatagacctgcaggcataatggagggtggtgagtgctgcgcagtaactgctctggaaactgagaagaaggtgccatgagtccccctcccttgcccccaaggaggagggaggattaaaaggtcacagagaacagtgtggtagatgagagcagctttcaggctgacagctgtgggcagcaatcctgactctcacacttgcctgacatgaggccttaagggggctgcttaccttctgtgaccctcagtttcttcctctgtaaaaaggagaccatcacctccagtttggtatgtagaggttatgcaaggaaaatgtttagcactgcgcttagcacacagaagccaggggatatttcataaatgaggtgtcattcgagtctgacctttagtgtggtttgagttttccaggcagggaagggtagatgaagattccatccagagggaaggaagaggtgggaaaataagcagggtttgtggagagcagcttgtaaagtttgtcagggcagtcactgacctgcagcaagaccgtctgccacagttgtgaaggccactgctaaccaggacaaagggggagcatgggaggtctgtgagcagagcggtggcatgaccagatctgtgtcgagagagagatctggggctgggtgcagtggctcatgcctgtaatcccagtgctttgggaggccaaggccagaggtttacttgagcctaagaatttgaagttgcagtgagctatgatcataccactgcaccaggtggtagagcaagaccctgtctctaaaaggaaagagagatctagggacagtgtgggggcaagagtagggccattgccatgggtcaaggtaggacaggcagggtttgctgaccagttggacttgagaggtcagggagaaaaaaagaatagctgtctctccttaagataagttcagacaaaggatgggtgcccttaatcagggtggggaaggcaagatgcgaattagtttggcaagaggaggagcttggtgttgggctttctgagtgagtggtgcttagaggaggctaggagacaaggctgggcttgcctcactccctgtcgcccccacccagcagaaggaaggtcaacagaaggaagccccttctctctacttggctacacatccgcatcattctcttcccaccgcagaccagctttctctatgtttccctacacatcgtagggagatagttgcctccagcccctccaaacttgcatctcaaggactactagccacagacgcagaatgatcagccacctctgattcctggtcccacatatctgggagagaggatctgcctggcccagctctagtcaaatgtctactcccatcaactgtggaagggaggaagggagttgggagggagagaatccacctggcccaatgtgggtcatatgtctcccacggaggctagtgggggagaaagatgcaggatggtggtttaggggatactggggaggagactctcagaaaagaaaacaattaggcaggcaccccaaaggagttcgctcctgcaggatttcatcgttgttagtgctgctgctgcctgaattgcaggctgttgtatcataccagctagctatgctgcatacaaactgcccccaaattgaatggcttttcacaaccattacatctgacaaatttctgggtcagggatccaggaagggtttggcggggtgattcttccgtcccacatgacattgagtgaggtcacttagtggcatttacctggtggctaagctggtcttcagagttcaagacagcttcattctcatgcctggcaccttggtagggacagctggaaggctggattcagtcaagtccttcttcctctccatgttgactcagggcctctccatgtggttcttccagcagatggtctgactttttatgtggtggcttaggctgaaagagagcgctgccagttgtcttaaatgctagcccacagctggcatagcatcatttattctgttggtaaaagcagtcatatgccagctcaggttcaagagaggggaaatagaccctgcttctcaatgagaggagtggcaaagccttagtggctgtcttttatctgtcacatacatgatgttcgaaatatgggcaaaatcttttctttttttttttttttttgtggcagtcccactctgtcactcaggctggagtgcagtagcatgatcttgactcactgcaacctccacctcttgggttcaagagattctcctacctcagtctcctgagtagctgggattacaggtgcctgccaccaagcctggctaagttttgtattttttgtagagacggggtttcaccatgttggccaggctggtctcgaactccaggcctcaagcgatctgcctgccttggcctcccaaagtgctgggattacaggtgtgagccaccgtgtcttttccctaaaagtcactattacaaacaaaaattcgcctaactagaagttttgttctattttaaagtagatgaaacctcatctctctcccatagtgtcatagataaaatcacagttgaactcctttggggaagaggaggcaaacagaaaatgttggtgcagcatttatgtcagagtgtgcagtctgttgaggcagtgttgtaatgtgataaggggcttggtggaggggatttctttagggaaaaaaatttttttttctcaaaaggctaactatgacttttgagacttataaagtctcaaaagactttataagaggttaaaagggcaattgaaatgtaggattattttaaagacctacgtatttctagaacttcaactacagacctcttgttaactctgattcccatgtctacaacctaagaatgatacattatgtttagtgaatagtgattcggtatcacactgacagtacggtgcagtaacccaaagacctgttaattgatggtctaaactccagcctcatatttgacttatacgggaggtcttaatgtttccggcttattgccatattccatatgtaatttcctccattcctttcaaggggaaagccactgagtgttacccagctgccactgctgaccggttgcccacttcactgagggcctttgaagacagcggttggcggggacagtgttgaagtcctcttccctttacagaaccgtggctcttgaatgtccttctagagtagctcttggcattgctacctatggtcatttgctgctgccttgaggtccggagccaaaagtggttgttcccaaaagtgttgcataaacgtgaatcgtgacatggtactgaaagctgagcagagcagctggccatgccgccgcattcacagcaccacacaagcctgaaggtctgcatgctttatgcttgcaagatggccagcaccttcactaggcaaagagtagtaggtccctactaggtggcaggccctgggcaaagggacaaagataaataaacaacagccctcacctagtctgtttcttttttttttttgacagagtctcactctgtcacccaggctggagtgcagtggtgcagtcttggctcactgcaacctccgcctcccgggttcaagcaattctcctgcctcagcctcctgtgtagctaggattataggtgtgcgccaccatgcctggctaatttttgtatttttagtagagacagggtttcaccatattggccaggctagtcttgagctcctggcctcaagtgatccacccaccttggcctcccaaactactaggattacaggtgtgagccaccatgcctggcctcaacaacagagccctcacctagtcttgaagacctttaggaaaatcagcttcagcaaagccctgaaggtgagcaggacttggcctgtgccaccagcccctggccccacctacgcatgcactgtggtgctactgtttacctaaatcagaaagcccttatcgtgtcagcaagtgtcttttccagagctgagctccaggctccctgctgatgtgctcagccagaccagcccctcatctgcctctgaccctgtgcagctcctggcggccttcaagaaagcccatctgctggcatctcaggcatcttctcatgcttggcggcagcaggccctggctctgacacaaaatccacaatgagggccccaagctaaccagaccgctcttcaaattctgaaatggatcctaatcagctttcccaaagctgagatgttagcagacactgggagccataatttaaactttatgtgcgaggattacagtagccagccaaaccaccatgcaggaagaaaactttgaaatatgaaatgcttttaaaggaagaaaagtccaaatgagtcccctctcctttcctgcagctcctgactgggttggaagatgcctgggcctggcatctcttcaagacaatcataaaggcctgtttaggaggagaaagttaaattgctcagaggtgcaggagggataacaactttgtgtgtgactggcacctttaagaaataccttcagcttatataagccagcctggtttctgtggaaagaatgaagatgatggggtgtttctccttttgaagaaagacaccccccttcccttatttagggctccaagctcttccctccctgtctttctctctgcttccctctcaccctcctcccctccccagctctgtccttgtttgtttgcagtttgccaaaacatacaggccaccactcagtgaaggagagagaccatatcctccctcactgctgtcaaccaaggaccctctctctcccatttgacccttttgcaaaccgagatggtttggagcaaagggaagtgagactgcttggccagccctatggccatgtcttcccaggaggcccaggacctacttgctcaagtggcaaagagacaggctgcagaatgtgtttgccagccctctgaaaagggctgcctcaaaccctctatcagctggggctgttccaagagcctgctgctttaggactggctttgggctcatggtttttatttgagagcattacttctgacctaaggcagaaacacttagaaaacaaatctgtgaaatggctcagagaatgtgtaaggtttggcaacccctccagaggtcactgggttatcaccttcccttcaaactgggctgggagggcatccttgcttctcctccaaagaaaaaaaatgaacagacacatgcccatgtgcttgcacacacacccttcacactgcctcaattagaaccatgtgccaatgacattcagtgggggcttgtttatgcttgggagtaaatattgggctgatgttgcactgtcgacatctcgagacagagacatgctatgtaaatagtcaagtaactgaagagaactataaacatgaagtcttgagttagtccaaaaaaggaatttgtcccaggtcctcagaatcactgtctaggaagcaacccaaaggccgcggagtgggtaggatcccccaagagaccagatgtcatggtgttgtccagctggtccctctcaccctgcagggggctggggaggaagaggctgctgctgcagggtggataccccagaactcagtcaggcctcatgcctcacgcagcacccatctaagtaaggctgtttggggcaatctgttgtttccctaggagttttctggttgcttttggatacatggttatatgagaaaattgtgtatgtctgttacgagggttcagggagctgctctttggagctgcaggaccagcagacacaaaaaccagaaagcacactgttccttcggcttccagccaagcaaagcttggcttgagtcacctcctctagggtttctatgtttcttctgctacagatagaacagttaacagagccgcttgcccctcaaatggtgaagcaagcactggaaggttccagaaaaaatgcagaaaaacattgactccattggcttggaagtgagtgtggggctgctgggcatccagcttagcccatcattaatcatttcccagcaccttcagggtgggctcagctggcaacaaaaacagagatttgcccagtgtttctcaaagctctccccaaggcacccatgcgtgctcacatgagcgggtgtgtatgtctgaaggaggcctacttaaccttgggatgtgctaatttcccaagtgtagggggactttgggtcctggcagtaatggaataggtaggactggctatgaagtactatagcaggctgaaggggctcgtgggtttcctggcatgtgtatgaagagttacagatttagaccatgtatctcttaagcaaaggaactacaggtgctccttgacttatcatattttaagtcagaaatgcatttaataccccaataaacccatcataaagtcaaaaaactgttaagtcgaggtatggtaacttggggattatttgtacttgttagatcatcaaattcagagtcactatctttagtttagtgtttatctttagtctttagtttttatattttatctttagccattatctttagttgaagtcattatctttacttaaggggatgacaaaaaccttgctaaatttagtttttcacttcctcattcctgattgacattctattagaaaatgttagctaggaagacctgttctttatttattgacttgcatttattgagaactgttgggaataatattgtgcctctagggcatttagaagataacatgcttttttctggttcttgcaaattactttcggtgacttgttctcatgggttgcttattttgagtttttatttttagagaactgatattttttctgttcttgatgaggtaatcaggcagtctctatgttacatgagttaagagtcctagacttacttagcaagtcctcaattctgacacttattataagacatctgatccagagctgcatgttcaactccatcaagccttgcctactttcctcatcggtaaaattgaccttaaaatcccacagttcaaaagactataaaagttaaataagtgaacataactgcatgtgttttgtgaattcaaagacctcataatcttttaaaatattattaaattctgttttatttgtttctttcaaaaattaacagatttttaaaaattgaaaattgaattttcaaaaaatttctcaaaaatctttgagaaaaattgagatgggacaaagactctgtgccttgttcccccttagtgtgagtcctgagtacccagctgtgtggcccacagtctagagccttgaattcactttggggaaaacagaaaaagctgtcatgatgtttcagggctggaagaggtctgagaatcccattgatctcttaggcagagacgaagacactatggctcgaagccagaaaataaccttcccaggctgggcgcggtggctcacacctgtaatcccagcactttgggaggccaaggcaggcggatcatctgaggtcaggagttcaagatcagcctggccaacatggtgaaaccccatctctaccaaaatataaaaattagccaggcctggtggtgcagacctgtaattccagctacttgggaggctgaggcaggagaatcgcttgaacccgagaggtggaggttgcagtgagccaagatcgtgccactgcactccagcctggcaacagagcgagactccatcccccacccccccaaaaaagaaacaatattagtttgacagagccaccactagactatagggtacctttgtgcaaactataatagtaaatagcaccgcttcctaaagactctttacttccatctgtcagaaaaaattcagaaaactctgattttatgagaacaagacactctactgccatctgttggaaaacagttataataaacttatacacatacatgatatctgtgatgtgagtggtatcccccagccccttaaatgcagtgtagcacctgcactactgtacctacaactccctagccatgagagtgcattatgttttaagaaatggtcttcagactctaaaaaaaggaagacatacatcagtggtagctctgatctcccatccaagagattacgcataggctgtgttaggaacaggactggagaccctgcagtgttagagtggggcatagagcttgcaaggctgtttcagccaggggtgggtgggggtgattttcaggcctaatgctgacaccactccactgagagaaagaagcttgcttccgggtgcctgcaagagatgacagtgccttcaccttgttgttagcaagaattgcatacataaaaacttgagcacatgaaagccacatgtaagagtgagttcaggtgctctaaatcctttccagattgttaacacactgtctatgtcaaatccttacactagcatagtgatgagaaagtgagccagcttttgctcttagagatgaacaagagaagtctggttcaggccgggcgcggtggctcacgcctgtaatcccagcgctttgggaagccaaggcaggcggatcacttgatgtcaggagtttgagaccagcctggccaacaagatgaaaccccgtctctactaaaaatatgaaaattagctgggcagggtggtacacgcctgcagtcccagctactcgagaggctgaggcaggagaatcacttgaacctgggaggcagaggttgcagtgagccgagatggcgccattgcactccagcctgggtgacagagtgagactctgtctcaaaaaaaaaaaaaaaagtgaaaagtccagttcagcaaggcacactaactgatgctgtttaaatctagagccctatcagctgtctgtctgattcattaagtcagcaaaaaaaatattgagtctgtaccagttaacttatgctacttgacaaaccaccccagtattcagcggcttaaaagcaatatccatctatgcaggtcacagttctgtgggttggctatttggactgagctcagtggggcagtttgagctcagcgagacttacatgtgcctctgcgggcagctgggagttggctagtctgggagggcttcaaaaaaaactggtctcttagcaggttagacataggcatttgtgtggaagcagggcagggttctgagaaagtaattggaagtgtgcacagccccttggggactgtgtaacagacacaacatctcctccctctcatccaattgtcaaagctagtctcagtggagaatcaaggctgggaaaatagactccacctcacgatgggaagagctggagagtcacatggtaaagggtgtggagggtatgtgggcatctttgcaatttatcgctggtaccaaggacaggtgagatgctgagtactggggattgaaagcacaaagcctgccttcaaagagtcctaagacaaatgcaggagataataagggggcagactgttaagtttctgcttgatagtgccatggtagggaaatgtgacttctctggaattacaactgagtgacctgggattattgacacattacaacatcagcagccaaaggtatgtgctagagaatcctatttccctgttacatccttccacagtttcatgattacattctccttcatggcatgtgaccagccacatctggccatgttttcttagccaaccacatctttatcgcaaaagaatgacatttcaagcagtagcttcttagatttccattcagtcttggtccgtttttctggccttctgtgggtgtgctgtggggatgatgtctatgactttttcttaattatccagaaaattctggccaagcaccttttcttgcagaggggagaaggtgaagaggtttcaggagagaaaagtatatgtgtgggggcgtcagaacatggcattctgatgaatgtggtcttatgctgggaagaaacctccagggctgaaatcaccaggaactcaatatctgtttacaaaactggccttgaggattgaagctcagaacacaagactcttgccagttgttctaagaaagcttctgctctttcccagtcattcaaactgcaccaccttatcgacttcccctcacggtgaatgctcaggatctccttggcaacgtgggtgaagatacctgctggctctcttgacagttctcgtctttggcttggccaataaaccccctttagggaagtagaaagatggtggcaacagacagctcctcagctccacctgccttcccttcttcaggggagcttatgaccatcagggtggctgtgatgcttccctggatgtttggctcacagtgaagaagcatgaggacaaatacacagacaacaaaaacatttgatgtgcccatgacagctgggtttgcttcacgatttgtgtaggacacgtcttatatgtgcatgcactgttggcagcagactgcagagagtcttaagggttttccaatatgacttgggaattgcaagctgatgataccatggtaccacaacctgcagtgtggcaagcctaccagcaccaggtcaagtgtgtgtctctgtttgatttcctctattcaaggggattgaaacaatgatttgagggcaagtcatttatttggaaggtgatctcaggaaaaactgttggagagcagggaaggaagccaataaaagatttgtcatcaagctggttacctctgcaggcaagctccatggggaaactggtagaacgtacacctcagggttatcccacccaaggagagagggagctggggtatttgtacacccgatacagtcagccttgtttaaaggaagatgcagagaggaatgtctgacctcataaacagagcccaccaatgttagtgagccaaggacgagagatgccgagtctctcagagcatgggaggaaaggtaagctttgggctacaaacgttgcttcactgtttggtggtgatgactatgtgagaaaaactagacacttgtcttaccatatgtgaaaagttgtaagaccaaatgtaacatcaaagggcagggtcttttcagaactaagctagaggaaattgccatcctgggtcaggatgaaacgcccgttctaagtgagaatgtgctgctgactgtggtgcacagacagcacaaattccatgggtttgagagaaagatgtaaatgacagcaaggtagaatgcagacctgcagacgctttaaacagcctctcacgtgagagcagtatttattaaattattccacagatggctaagatctctcaagatactaggtttatcaaaagccaaataagcttggggaatgtcaggtccctggtttttttccccaccggaattaatggtaatggatcctttactttccactgtacattaagactctctaaaaaaaaaaaaaaaaaaaaaaaaaagccacacttcccaaacttatttgaccatgaaactttttttttttttttttttttttgagatggagtctcactctgtcgcccaggctggagtgcagtggtggcacgatctcggctcactgcaacctccgcctcccaggttcaagcgattctcgtgccccagcctcccaagtagctgggattacaggcacacaccaccatgcccagctaatttttgtatttttagtagagacagggtttcaccatgttggccaggctgctctcaaactcctgacctcaagtgatctgcctgtctcagcctcccaaagtgctgggattacaggcgtgagccactgcgcccagccatgaaacctttttttactcccaaacacctttgaacagctctcagtaactggtattccccagcacacagtctggaaaacactacaccagatgcattttagaaggaacaaacagcttacgtaatatcacccgcaggaagtccatgcattttgaaaaatgtctccacaggatgtttttcttgccagtgttttctctaatccgaggggtcctccaagcctccccagccctgtgagtgcaggtcacacctacccagggacagactgccttggggtcacaatggctgattcttcagcacttctaactcagcttctctttctttctgcctttcagatgggcttctttcgccgaaggtacaaagaaattatcgaagctgagaagaaccggaaagagaatgaagacagttgggactgggtccagaaaaaccagtgagctgccacaccagtcacatgacctgatcactagcctgtcatccttggtctttgtatcttccatatttggaagaaaaaaatcttctccagatttttcggaggccccactgatgctgttctcttcttcattctatcaagcccaggtgccagcctgaggcagccacttcggccaggtcacacgaccggggccagcaccacttcctttaaagatgaactctgaactttggagagtgagctacagagccgagcaatatttatggatgcaacacgcatggtcaaccctcaggggaaaactgttacctaaagtatttttataaatataagccttttatactgattatgtcttttatatttgtatcgatgttttattatttctattaaatagttatataattcactcaagcactgatatctggcctaaaatcttggaagtacatgtccatgaatacaaattttaaaggatgaaaatcttaccgtactttggaacttgctgtttaaaaagacagatgaaataagttgaagaaacctcatgtaatgaatccaccaggctggcagtggtgcatataaactgtgggtgtggcaagaccccgaagacatttcacatctttatcgcctcgatcaagtgtggagtcacatgctaatgtgtgctaaagaactgtaagtgttttttcatatgtacttttcattggaagattcccaacaagaatttggatggaaaacctgatccctagcaagaagtctgctctgtatcacctttatatagcagacatgtcaccctgcttctacacagatgatggatgaaagcttggagcaatgccatgtggtcatctggtaaacctcagaatggcgtctcatcctggacatcctgcatcagagttcacacaccacaaggactaaatccttgtcccctaagcaaagaattgggtctgaatgctgtgagggattgcctttttgtggtaattttcattgagagatcttcatttcccctaccaccctggctgtcccagctagtggtgattgcagattccttcccagagaggacatttaaccgttttaaaaaaaatgtcttagattgggttcccaagaagcagtccctgaaacaaggatttgtgtgcaagtaacttattaaggaagtattcccaggggataccagtaagagagtgggggaagcaggacaaggaaggagacaaagccaggcaaatgtttgtcatttcagggagagctccatgaagtttagcctcagcctgatcaggggaactccggaggaaaagttaggcctcagaggtgtcccaacctgaatcaaggggctggctgcacccagaaggagatgtaaacgttttattctcaattcctgctggcgtaatggctccagtagctcaggacagtcctctaaaggacaaccacagatgcatcctcagccaggggagacacagggaaatgatgcaaaagaaatgatgcaaaggatctgagcagaacactgcccctccccaccccctgaatgtgtgagtgctgagttacggccttcagtatccaagctctctgtttgacagtagatatattgtcagatgcactgtgctgcttagttttgagtgcagtgtgattttctgaaagggcaatgagatgatggatgtagcatgctcagcactgacctggcccatagtgatcactcaataactgttaacagctatggctgctattcctactgatggataaccatctaataagacagaaaacatggggctaagagcagggtctaacggagtcttaatggcttattacagcctgccaaagtgccagctacatacacatggcatccagtgcggatgaaacaatctataaaaccaagggtctttcttatagcaccttttttactggaagctaacacgttgggagtccgtgaacattgtcaaaaagacatcaaactcaacttctgggaagacagatttttaatacacatacttggctaatactcacaaacatatctaaagttttggcaaaatt

SEQ ID NO: 17372 - DNA, 36307 bp, Human
aaccctctcctctcagtctcccgttgtttagcccctatttataagtgagtgcatgtggttgttcactttctgtttctgagttatttcagttaggataatggtctccagtttcatccatgttgctccaaaagacagacttcattgttttttacggctttgtcgtattcctcggtgtatatgtgcattttctttatccagtcctccattgatggacacttaggttaattctgtgcctttgctattgtgaattgtgctgttgtgaattgtgtgtgataaacgtgtgagtgcaggtgtctttttgatgtaatgatttctttttctttgaatagatactcagtagtgggattgccgggtcaaatggatgttctatttttagtttgggaaatctccatattgttttccatagaggttcaggatccaggatttaagtgcaaccattcagtggaaaaccatcctctcaagagttcaaatgagagtcctcatgaccagcactccctgctgaacggcaatgccccaccccccaaaaaagcctccatcctcaccatcttagaccacattgcaggaaagcagccccatgcccaccagacaggcccacagctgctgctgctcatgggaggtctacctcccgtgctcagcaggcaacccaccccagtgccccttttctacaatgaccatcagcagggctgcagcttcataaaaatgtgaaaaacagtttgaaagcaatgtgaaaagcagttaggtgcctttcaacttcaaactcagcactcatggtttgacaaatatgagtatatttaggatcagaatgtatgaaatctggcctctcctgaatagtcggtcatcccacaatttcctctgccaaacttctcttccctccctgcgttctttctttcacctctctctcatttttacaaggtctggtctcagccagacatgaaccaatgatgatagatgctcctgctgagccctgtgatgtgccagggccctgacatgcgtggcttctctctgatcctcacgtgacctgcagatgcaaaagccagagctcagcatagttgaaaatcttgattgaggtcatatcccagttactggcacagccggatttaaacctaagactttcccctacacgacagggcttttatttctcagtcatctgaaaaggtgtcagcaagggaaatggcttgtctatttccaggggcattttacaagcaaatactgaaaggcttcggtgggcttaagggctgatggctttgatcgaatttcaggcatgttggccccaaggccctgtgtatattccctgggcccactcaaggggatgctggagccggaaagtccccggaggccacctactgcagccctgcactttacaaagaagagaaagattctccctaaaattacagaacagggccaaagatgcctaccggagcaaacccccatgggggcacctcctaccgcaggtgagcccaaggctggtcctgccttctcagtggctacccccctgagctcccgccaccacacaaagtgttccaatccttgtgcatcctccagtccttttaacctctcatgtcctgagaggccagagctacagccacagattccagaagacaccccactcccagccccaacctgctgcctttagaattataaacacttcttgtcatcacagggtcctgaaagtcccttttaagcctgggacactaggactctaaaggaagatgattcttaaggtcccatcccacttccaaattcctgcgattcaatgacatcacggctgtgaataatcagcctggcccgaagccaggatgggctgtgctgcttccaccgtgaacttcctccccctgctttataaaaacaggcctgcctcagctccctcatggccctgtccactgagcatcctcccgccacacagaaacccgcccagccggggccaccgaccccaccccctgcctggaaacttaaaggaggccggagctgtggggagctcagagctgagatcctacaggagtccagggctggagagaaaacctctgcgaggaaagggaaggagcaagccgtggtaggtcgggtttctgtaccttggggtctgtctcctcttctttctcttaaaagtctttccagcaagctgagccagtgaaggaatgctttaaccaagggaccaactttgtaattcaggcaactagaggatccgctagaatccactccagaggggagatgtctgtttgcatttgcatgtgattgggataggctggagtgttttggaggggagaggcagtcggggaaagggagactagggaggttgcattcattggagaagcctctgctgacagagtaaaggggaaagtgaaaagaacgatacagaaaagccccaaatagcctatgggagtacctcaagacgagcaagcaataaaagcaaaatcggctgccttgggacacgtgcctgtgacagctgggagggcccgctgggtcccctagtttcctccctcccccgatgaacccccagaaaggaactgaggctgtggatggggcagagggggacttacttccagagcactatttgctaggtgctgggagagagaagcaggtggctttcacaccccacattaccccgtgggatagagaaatgcctctgatctccctaggtgccacccctacaagtctccacaggtcagtttggccctctggctttttgcccagggtgcatcagtcaagtgtgcagtcctccttaaaggacattttaattacaggggaaaaaactgacattaatgtcttttattcctaaagcactctgcaggaagcatgtggggttctccagattttcactgttattatctttattttcttaacctcacagggagggagagaggaagggagggagggaagacgaaaacacgccgaggtcccaggtaactaatgacaactcaagctcaaagaagtgtggtaacaaggatgtgtttggtggccaattgggaataatatggtggtctcctgtagctgcttgatgacagaaaaaatgtcgtgtgtgtgtgtatgcgtgtgcattgcagtcccgggaaggggtcttgcaaataccattgtcaggtggagtcccctcaaaggtgacttcctagcagtacttgctgtggcaagaacgctcattctgggatctagactcaatccatgacggtcagcatgagctgctgggtgcgtgcttcctgtgcaggcagagtcggactccagcactggcagggacactgtgagtattgagatatgaatagctccatcctgcccacccatttattccacctaaaatgttctcaaagatgcaagcctccaagctctggatcaaatgataaagccccagatcaaaatctcaggagcaaatgaaagctgcccttgtctccaaaatgctccttctctgcccgactccccaagaccagcttggtttatttcacaatgactcgcgtcggattctcccagtgtctgcggctccccctgcttcatcacaggcctgggacagtccaggcagccagggaatagctgggaatagcagttcccctttgttggtttttgagttcactgaggctttgatttcccccagggcctgacgttgctgagcagagccagcggccagtagatttcaaaggattccaaaaaacagtcaggcactcctttgtgaacccaaaagtatctgagacaggtctgtcaatttagaaagtttattttgccaatgttaagaacacacatgtgacacggcctctggagatcctgaggacatatgtccaaggtggccaaggtatggcttggtttcatacatttcagggagacatgagacattaatcaatgtatgtaagatgtgcaccggttcggtctggaaaggcaggacaactcgaagtaggggcttccaggtcataggtagataagagaaggcttcattcttctgagtctttgtcagcctttcactgaatacacaatttacatatgagaggggggcagaggaagagtcacttatgccttagttggctcagtgaatctacttttttttttgagacggagtttcactctttttgcccaggctagagtgcaatggcatgatcccggctactgcaacctccacctcccaggttcaagtgattctcctgcctcagccttctgagtaactgggattacaggcgcctgccaccacacctggttaatttttgtatttttagtagagacagggtttcaccatgttggccagactggtcttgaactcgtgacctcaggtgatccacccacctcggccccccgaagtgctgggattacaggcatgagccaacatgcctggcctgaatcttcatttttacaaaaacaatagggcagaggaagcaatcagatatgcgtttgtctcaggtgagcagagggatgactttgagttctgtcctttgtcctgtacccatttgcattgccaaggtgaagttcagcagaactgttttagggtaaagatcttgaagtccacaaggagtttccttgtgggtaaattgtgagagaggtatgtagccttttatctttgtagccgtcttatgtaggaataaaatgggaggcaggtttgcctcatgcagttcccagcttggcttttccctttggcttagtgatttgggggtcttgagatttattttcctttcataccttggtagtgtcacttgaagccaccacgcccggctaatttttatatttttagtagagacagggtttcaccatgttgatcaggctggtctcgaactcctgacctcgtgatctgccctcctcctccaaagtgctgggattacaggcatgagccaccatgcccggccaatttttcttttctttttttttttttttaagatggagtctcgctttttcaccaggctggggtgcagtggcacaatcttggctcactgcaacctccacctcccaggttcaagcgattttcctgcctcagcctcccaaatagcttggattacaggcgcccgccaccacacccagctaagttttcaccatgttggccaggctggtcttgaacacctgacctcaagtgatctgcccgccttggcctcgcaaagtattgggattacaggcgtgagccaccatgcccagacaggtttttctttgattatttggcattatgcacctgcagtctcagaataaattttttactttctctgagtgattttcgcttctgctttgatgagattgttgggacggacaataagggaccagtgcattctgctcattccttcttggggccatttcttttgtatatacgggagaaaatgtctgtctatagtgtcaggctataaacctcgtcctagtcaagcagctcacaaaaccatatggtgggtctcacatcaaaccaggtaaaagagtgaggatgatttagactcaaagaaaattagagctagaaataaatttaaagctcatccaccctgctccaaccctaagtcaagccacatggtcttccgatagtggctcagttttctacttacataaaaagacagcacattctcttagcaatatgtgtttgtatgtgtgtgtgtgtgtgtgtgtgtgtgtgtgtgtgtatatatatatatatatatatataatttagagacaaggtctgactccatcacccaggctggagtgcagcagtgtgatcgtaggtcactgaaccttcaaactcctgggctcaagtgatcctccatctcagcctcccaagtagctaggactacaggggcatgctgccatatccagctaattataaaatttttttgtagaagcagagttttgctttgttgcccaggctagtctcaaactcctggcctcaagcaaccctcttgccatggcctcacaaaatgctgggattacaggcaagagccactgtgcccagtccctcttagtgatattttgcatattatatattcaaaaaatattttctatgtatgccacttgggaaacttctgtagaatgggatagagggacagataaacccaattcttgatccactcaaaaataacacctgtgacagagtgaagatgaaacaggtgctgggcacacagcaagtgttttagaaacatttttgaactcaactttgcctgagttgtggtgctgatcatggctgccaggaaatgctagccagctgttcttcctatacaagtatatgactgggtgtctgcagcagctgcccggctgtgaattgcacacaccaatggccaagacccagcagcgacttggctaacaggcccagccgatgtgcatgggtgaccacgcgatgctcctgacacacgcactggtggcttagggaagtttttttgaggattgatcagaagatctgattccacctggagcctctgaagtgatcacttccaggttaggctgaacccagataccaggagacctgtgtattgagagccttttgttttttttatgtagtcacaactattccattaacatacagctaggcattagagaatccatgctggactcctacaaaggcccctagatccttagaacactcagagattccaaagcacacgtcctcccaggacaccctggcagaagagcccgggggcgactgtcacctttgcctgctgtcgggagctgtgctgatgggtagggggctctgtgcttgctgtggcccagagccaagccgtggggatgtgctctgtctggagcagaccccttcactgtctgcctaactccttcgtgtgttcccggaacagcttctgtgttatgcattccagaaagcctgcctgaccaccccaacctcaacaagcctgggatggacaacctcctccacattccactccaagcccacccccgtccccaccctgctgcgtggtatggcgctgctctgctgtaccctgagtgtctagttattcatcaggccccttcctaactatgagctctttcaggataagagctgtgtctttgcatcaccagagcctgtgccagggcacggctggtgctccatacacgttgatggtgaatatatagcatgggtagatcattgtctgtgaatgcttaacagagaagcagctcatgtgggtgcttgagggctgggggggcagggtgggggtctggtaggcgctgggaggaggacatccctgcagcttctccagccccatagatgggactcttgatgtgggcagtttttatttcagctgagtctccagaaggcaggggacagggactgggaggggatgctaaacccgataacccagtatggatgagctaacagaggccgggcacacagctcctgcctgtaatcccagcactttgggagcccgaggtgggcgggttgcttgagccaaggagtttgaaaccagcccgggtcttgaacatagcgaagactctgtctctacaaaaaaatgaaaaaaaaaaaaaaattagccagacatggtggcacgcacctgtagtcccagctacttgagaagctgaggtgagaggatcacttgagccagggaggttgaaactgcagtgagctgtgatcacgccactgcactccagtctgggtgactgggcgagaccctgtctcaaaacaaataaataagaaagagagactactggtcaacttgatttctgctggttattctctttctgtcatgttcaccaaaaagagaaacccgttgtattttatcttgttgtagcaagagccggtgtctaacacctgggctactgagagaaagcgaagggtttttttctgggaagctccaatttccttatttctctcacatgatgcctctgactttcatagtgtggcttggtcagatgggccttatcaatagagatggcctgatgtctcagctgtgtcatctcagctgctagttctggcttctgctgggagtccacagtggcctctgcatgcatggtgtgggaaaggcaaataaaaaagcagattaaaaaccagattaaagacatcaccctgtattcaggaaataatggctcctgttgatactgttctacgaacacagatgaaggcacaaaattctacatcaattgcagagaattggttataggctaacacaggtggtcggatgatctaggaagcaggattcagtattaacggggatccatgaggaccccatgaagcgtggcatctcttctgcatcagcagcttcaagttgttccagggagaagcgggaagcctcagtgcttttgttgaggaaggatgttcatgacagtaggtgcaggtcgctcctgccgtgcacccaggtgtgggggaaggactttcctgcttcttttccagttaccttacaattcagcaagacggaaatgattagcccatgacaaaaaccaggaaacaggctcagagagagtgagttgcccacacagaatgtgtgctgtaaatgcagttagatttccaggttgagaatccagtgaccacgccccttctttgtggcattctgctgtcgtataccatgtggaacacattaagaacgttatggccaggcgtgttggctcacgcctgtaatcctagcactttgggaggccaaggtggacagatcacctgaggttgggagttcgagaccagcctggccagcatgccgaaaccctgtctctactaaaaatacaaaaattagccaggcatggtggcacacacttgtaatccgagctactcgggaggctgaagaaggagaatcgcttaaacccaggaggcggaggttgcagtgagctgagattgcaccgttgcaatccagcctgggcaacagagtgaaactccatctcagaaaaaaaaaaaaagttacaattgggtgtcacatagacagtgaggagtagtggaaagagtgttagatttggggtaagagaactgtgtctcctgggcttgagtcctgatgccaactctcacaagatgtgtcaccgtacagcacgacgcttatactttttttttttttttttttgagacaggatcttgctctgtctcaagctggagtgcagtggtatgatcacagctcactgcagcctcaaactcccaggctcaggccatcctcccacctcagcctcccaagtagctgggactacaggcatgtaccaccatgcccaaataattttttgtatttttttgttgagatggggttttgccatgttacccagggaggtctcaaactccaaggatcaagccacccaccctccttggcctcccaaagtgttgggattacagatgtgagccaccacaccttgcaaatttttgtattttttgtacagccgagggtctccctatgttgccgagggtgatcttgaactcctgggctcaaatgatccaccctcctcagcctcccaaagtgttgggattacagacgtgagccactgctctcagccccttacacttttttgaagttcagttctcccatctgtaaaaacgaggtaataatattgcctcaaatgacttaatggatgtgaaagggtttagtaaactctgtgcctggaaaggtagaagctactcaaatatctgttgagtgagtggcattcatccatgtgtacatttctcaggcaacaataatgtcactttcacctaaggccagtaaaatgtgggtaaagtcatataatgatacaatgaaagtttctgatcagtatttcctaattcaagtgtgttgaaatgtggagttgggctggagaattgtcaaatcattgcgtatttaattaccttgtggtgatgtttgctttagggagtggaaggaacatgaggaacgaacgaccttcatcacggaagatgacattcatttcgattcactttagatttcagggcttgtttagatgcagactttgcagttaacattttattgcactgactgatttagttttcaccaggtggtccttgtgtttgcttcagaaggatctaagtgtattaggacagggtttcttctgttttgattgtgggaggaggcgggatagacttctgttttcctagacccacaaccaaaattccccactcctccaaataaccgggattaccaggcagagggtggagcattgaggagatgacagctggacatgcctgctgtagctttttctgagtttaattccatatagcttagacacaggccatatgcctacatttggaagatgttttggagaaaattctgctctgatgggtggggggcagggtctgccaggaaaatattctattcttttgaagacatggggtcttgctatgttgcctaggctggtcttgaactcctcgcctcaagtgatgctcctgcctcagcctcctgagtagctaggactacaggtgcaaaccaccacacccagctctgagaggatgctatactcttcacttcattggaattggtgaaattagataagaaacagactcttcctctcttctcccctagttataaacagttctgttaagagagggaaaataaccatttagcctatagaaaatcaccttttcgaaaagttaagaattacttatgtgatggtagtttttgaaagtggtttttattctgagatcatggcctctgtactatgcagggcctggagaagtgggatgagagctaccaggctcaaagctcctgtcccgaacaaagggttgctttcgtgggagcacgccaccctttccaaggctagttcctctcccagcatctcacttcagctctcgtcctgctctagaaacgtgcctttgctggtccaaggaatcctggccgtttcttttcttaattgttggcattcatctgggctatggtggttgtggcgggggtggcagtggagagtgtgttgttttaaatccatgagtcattttagggtattggtactcttgaagactgactttctcttgctcaggttttcagagagaccttttgctaagcaacaataacctaagaatctccttgaccaaagataaatgtagcaaactttgcacatggtgcaacatttgataatagtatcaatttacgtttgtctttcccttgcaatttccctcctcctctagcttgctcacgtttctgccttcttcttgctggcaagagtacagactataattctccagttcactaacatctggagcgactgcactgtttgcaatttcattgattgactacatgtgtacagttcctttattgcaagtcacttttctgtataatcttttttgagacgaagtcctgctctgtcgcccaggctgcagtagcgcaatcttggctcactgcaacttccgcctcccgggttcaagcgattctcctgcctcagcctcctgagtagctgggattataggcgcccgccaccatgcccagctaatttttttgtatttttagtagagatggggtttcactatgttggccaggcttgttttgaactcctgacctcaagagatctgccagccttggcctcccaaagtgctgggattacaggtgtgagccactgtgcctggccatataatctatttttaaaatgtttttatatgaaaataaacagagacagagtctcactgtgttgcccaggctgatctcgaactcctgggttcaagtgatcctcccaccctggcctcccaaagtgctggggttacaggcgtgaaccacctcatgtggcctcgctttcctatataatttaaacaatagaactatagtgccatttgtaagagtttcccagtttatactgcatgtgacactccccatgtcgtatgttctcacaacagaacagaaaccgcaggatgtcagcaccggaggcaaccttggagcatccagcccacttggttttgcattgctggcaggagattttatgcctcaaaatatagatgctttttggaaggacagcacattaattatttttcagtcatttttaccttatgcgaacaagctgattagttcctttcctaggagctggtttttatggagggaagatggggccggtagaggcagatagagggggatgtaatacacaggcactgagacagcaccccactgactttcccctgtccctcctccagctggcctcctcctttccaggggctgtgcccaatccagaatcagttactcactggtgcccatcgaccatcatttccccatgtggccaccaaagaaatgaacaccacctttctggttggcatgatcatcaatttctcagccaaaacggcatgcatccttggctctgggaaacagtacatctcccaggaaagtgagcttacagcacggtaccccacttcctggttaccagactattgttcccgttttccccaagaacagtcatcattcacaggttgtttggcagggcccaggaacagagtcactctggttgctacagccaacagaccaaacacggcttccaggcaggaaggtcagagctgctctgcaggatgcacatgcaggttggaagcagacagggctggccgagcacagatatgctggctgtgtcctacacacaggtgcctacacacacatccttcagatccgggctgcactctatcagccaacccacggactctgttttttctaatttgcacagattctttgtcaacctgccatgccctgagactgctgaacttcatccaacagagagggtaccttttgcaaatctgcaaaaatcaactttgtgtgctagggtggcctgacagggctaggccttggggtcttggggaccagcattccacctctcctctcatacagtgattctggattccagcccagcaaaagtcagccaaccttggggccttcctttctttcatcctttcttttttttccttttctatccttctgtgcctcccttcctacccccttccttccttcttctcatttgcctttttttttttcagttctttgatgatcctgagaagctactaaatatagcaaaagggagataacacagaacaaaattagaagtctatttataaaaatgagcctcttccatcccttccgccaatgtcatctctcacccgggtctcgccagagcactcatggacctccctttggtgaggcccaaagtccatcccagccacgccctgcggtcccgagtctgagtccattgttctggctttcactctgctctgcatcccgtcactggccccagacctcgacgcccacctcttcagcgaaggcgaaacaaggactcatttttcctccctctcttcgctctttcttgttttcagactgcactgtttttctgctggccggatgactcatttctttgtcatctcttaccccacttggccttttcagctgctcgaatcgcctctgtgtgatgcggacagagctatcgccctgctggggtgagattcacttgcattgaatcagctcaaggcgcaggaaggtccagggaagccaaggaagagaagagacaagtctccaactctctcaggagcaaagacaaaaatatgctcctgctctcttatctcttattcagaccgttcagttgcaaaagggttgaacatgatgcagcgggtggtatgtgtggaccagccctaggtcgtgcttctcctccatctggtccccccacccctagttatccagaaagggggatgttcccaggcaatgccaacatgtccatactgcactcttcacattgcagtttcccggcatctgggattgcattccttttggaaggactttgagttcttgaaataaagaagtaacttggtgggcatctggaaaaaacacccaaactgtatcccaggctggggtgcaggagcctatcgagagggctgggtggtgtggacagcgtgatgaagaaggtcaagttccttgtactcactcgtttgctgtttcattcacaattcctgtgaggtgggagctctcaccatccttgggtcttgcttaagagtaaggagtggggcaacctagagatacatgaacatcaaggagaaatggggagggagtttcacatgagctatttttacaagattaagtaatgggataaaatttaaaaggggaatttaagaggaattttgggcagttttgagaaacaggaaatttgaggaaagctgagaaagagaagatctggagtaagtctctgtgatgagaagattccaccccgcactcctgttctgggtggccttggctcctgactccctttcttctgaaactgcctggagccagggagtagcacagctgcttcctcccggggagaaagggacacccaaagagcgcactccagggagaccttgggcactgcgggctcaaaggctggagatggcacttctgttccctcctgatgggacaggtgcagggaggctgagaggatgccacgctggcgagcctccctctgagctgtgttttctcattggaattgctgtacccggagcctcctgcaggtttccctcgccctctccctaagctcctctgcctgacacaggagcccggggagaatctgtcaggcatgaaatgtagcgaggcaaggagggtgatcagcacctcccacgggggagttcgtttcgaagtaacaatcaaagatccagagccggacccaggcagggaggcaaggtctggaagcccctgtgcctccaggcccctaggacgctcgggggagggggagggggagggtgggacctgaagttgttgtgaccgaagggaaatgagtcagggaaagaaatgccatgctttaatttttgtggatgaaggagggaacaggccgccagaccacaaaataacacccggccgactaacctacttttagctgccgagggcaggatcacagaggagaggcagatggaaactggggctctggggtccaggaagatctgagtcttccgaccaaacatcatttgcctcccctccttcctgcaaatatgcacattgccggatctgctgcagtctatgaaaaaggagacagatgttctggcagagcggtgggggggtgggcgtggaggttgggttggggggcctctgctttgtggggagaacctcaggcaggggagtaggctccatcctgcgtggaggaacctgagcagtctaaggcaggctggctctatgatgtgctggcaataaaatcccaatggcttccgctgcagaagtccaagaggacatgactgcggctccatctagtcaagcccagggcaggaattcccttccaggaaaccaagccagagcgctgtggtctctgggctgccaagatgtctcagaaatggtctagcccttcagcccacagaaatctctgggcaaaattatctcccagcattgacagacgaatggataaacaaaatgtgttctatcccacagtggagtattattcagctttaaaaaggaaggaaaaatgctgggcgcggtggctcacgcctgatcccagcactttgggaggctgaggaaggaggatcatttgtgcccaggagttcgagactagcctggacaacatagagaaaccttgtctctacacacacacacacacacacacacacacacacacacactctctctctctctctctctctctctctcagccaggcacagtggcacatgcctgaagtcccagctctgggaagctgaggcaggaggatctcttgagcctggtgggtcaaggctgcagtgaaccatgttcatgccactgcactccagtctggatgacagagcgagacctagtctcaaaaaaaaaaaaaaaaaaaaaaaagaaagaagaaagaagaaaggaaaaagaaaaaaaggcagcggggcgcggtggctcacgcctgtaatcccaccactttgggaggccaaggcgagcggatcacgaggtcaggagatcgagaccatcctggctaacacggtgaaaccccgtctctactaaaaatacaaaaattagccgggcgtggtggcaggcgcctgtagtcccagctactcaggaggctgagacatgagaatggcatgaacccgggaggcggagcttgtagtgagccgagatcacaccactgcactccagcctgggcgacagagcgagactccatcttaaaagaaaaaaaaaaaaaggacatgctacagcatggatgcaccttgaagacatttgcaaagtgaaacaaaccagtcgcaaaagaagaaacactgtctcattccacttctaggatgtatgtagagcagtcaggttcatacagacagaaagtagcagcgtggctgctggggaaaaggggaatggggagttattctttaatggctacagagtttcagttaggggtgatggagaagttctggagatgggcggtggtgacggccggccgcacagcaatatgacgtgcttaatgccactgaactgtgcactgaacatcgttaaggtggtaaattttgtgttatgtatattttgcaacaataaaaaatatgtagtttctagaatcctcttctagatgcatgtctggcgtttctgccgcggggctggcactggaggaagccagacaggacaacattgcggcttatcctcctctgttgccatcatggacctctcgcaccccgtgatcaagctgttttttctctccttccagaatttaagggacgctgtgaagcaatcatggatgcaatgaagagagggctctgctgtgtgctgctgctgtgtggagcagtcttcgtttcgcccagccaggttggtgtgcaggatccctgtgtcccgcccctcaaggctgtgatgcttccggaggctccaggggtctgtgtccatctgggccacggaggttggaatgctgtcagggagcagagaggcacagggacgaggggctggcattgctgtggagcacacagcacacactcccttctgtacagcaaactctgtatttgggggcccagtgtgtagctgggccctaggcacttattttgacctgagtaagcggaattaacatgccactccctgcctgtgactgcctttttttgcagctgtttttaaagaatgtattcaaattaatccataaagtacagttgtccctcatatctatggggtatttgttccaggacccccaaggataccaaaatccagggatactcaagttcctcatatagaatggtgtagagtttgcatatcctatgcacaccctcctgtatactttaaatcatctctaaattacttataatacctagtacaatgttaatgctatgtaaatggttgttataaggtattttttaatttgtgttatttttattgttgtattatttatttatatattttttggaaacagggtctcactctgtcacccaggctggagtgcaatggcacaatcatagctcactgcagcaccaaactcctaggcttaagccttggcctcccaaaactctggggttacaggtgtgagccacaagcccagcttatattattattttttatttttctgttttggttgaatccacagatatggaacctgcagatatacaaagtggactgtatttataaaagacaatgcaggacagggcacagtgactcacacctgtaatctcagcactttgggaggccgaggtgggaggatcgcttgagcccaggagttggagaccagtctgggcaatatagtgagatgctgtctctacaaaaaatttaaaaattagccgggtgtactagtatgcacctgtggtcccagctactcaggaggctgaggcgggaggatcgcttaagttcaggaggttgggacttcagtgagatatgattacgccaatgcactccagcctgggtgacaaactgagatcctgtctcaaaaaaaaaaaaaaaaaaagaaaaaggcaatgcaagtgccatgagccacagcagaggcaaactgccctcatggtgcctactctctagctgagatggaagcgctacacacactctctgaaaatgcctagcaataaagggcctcacggaagtccaaactaaccacacctctccaacaggaccctacagcggggagagccaggtgactgcgtggagtagacagccagctgcaactccattgcccaatatggtggccacttaccttgtgcaactgtttaaatttaaaataattaaagttaaaaattgtttctcagtcccactggccacattcaaagcactcggtggccctgtgtggcttctgtcgtggacagcacagacagaaaacatttccaccaagcagaaagctcttctggacagagccagtcaggaaggagaggaagaattggactagaaggcaggagatggactttcacttgggccagttacccgagggggtctctgagcagaggtatctggccggcaggttcacatgggcttctgggttggccgcctttactcttagtacacctggcatgtgctgatccttcctccacctctggtttcttcgcaggaaatccatgcccgattcagaagaggagccagatcttaccaaggtcgggtgaagctgaggggtgcatggggtcatcagggagggaggcagggcggggtgcagggtgcatcacccacccaccacctgccttcttccacccaccacctgcctacggtgtgacagtgccattgcagcatgattctacagagatgcctgtgtcggcaccattctcccatcagctgcggccactgggcgggttctgattctgaggggagcagaaacaggtgttcccccccaaggagccaggctgtcagggatcacaacctagcgggggctggggggggcggccactggcccaaggtcctggttatacagatcaaaaggcagagcccaggagagagcaagtggcttgcccagggtcacacagccgccagcagcacggccagggcagtcacagccgaggccaggcccatgctctgggtctcatcctaggctgtgatcccaccacagtgcaccggcagctttggtaacaacatccctgtgtatccatttccctctgttgatccaaccgggatgtcccaactgggatgtcccacccaggcaacccctcgacatggtggggtctctaagtccacatctagagttgactctagaaggctgaggaatgcgaggcccagcttcaggtccaaaactaccaacttaggccctcgatttccctccttcacgacccagttccttcgagtctggaagactctgcaataccctttgtgaaggtgttaaaaagggtgactcactccccagagcgagtcacacctggactcttaatgccttcgttgttggatggcatcctgcttcctaccaggttatcctggcctcagtgacctcagaagcagcaagggtctgacttacagtgggcacgtgctacttctttaattaattgaaagtaaagttgttgttttttaagttggcattctggcttgaaaacagaaagatggcatgaaaatattaatgggagtacttcaactattttcattatgccaaaaatacttggagaagtagcacattttctgcaaagtctaaaatgtcaattttctttggggccaaaaatgcatcatttctgtgtggtaatacttatgtggataaaaaactctggtagacagttatgcatatatatattttttggtgaattacaatgagaaaaagtccaggtgcaatggctcacatctgtaactccagcactttaggaggcggatccaggaggatggctttagcccaggagttcaagaccagcatgggcaacatagtgagacacctctgcctcccccaccccaccccgcctctacaaaaaaatttaaaaattagctgggtgtggtggtgtgcacctgtagtcccagctacttgggaggttgacgcaggaggactgcttgagcctgggaggcagaggttgcagtgagccaagacagcaccattggactccagcctgggtaacagagaccctcgaaaaaaaaaaagaaaaagaaaagaaaagaaaaaattaggctgggcacggtggctcatgcctgtaaccccagcactttgggagaccgaggtgggtggatcacttgagatcaggagttcgagaccagcctgtccaatatggtgaaaccccgtctctaccaaaaatacaaaaattagccgggcatggtatcgggcacctgtaatcccagctactcgggaggctgaggcaggagaatcacttgaacccaggaggtggaggttgcagtgagccgagattgtgccacttcactccagcctgggcgacagagtgagactttgtttcaaaaataataataataaataaataataaataaataaatcatatgagaagatactcaatggcactcagaaaagaaatgcaaatttattttattttattttgagatggagtcttgctctgtcgcccaggctggagtgcagtggtacaatctcggctcactgcaacccccacttcctgggttcaagcaatactcctgcctcagcctcctgagtagctgggattacaggcacctgccaccatgcctggctcatttttgtatttttagtagagatagggtttcaccatgttggccaggctggtctcgaactcctgagctcaagtgattcacccacctcggccacccaaagtgctgggattaccagcatcagtcaccgtgtttggccagtattcattatcttgttgtcttccagttgtgtctcttcaataagggagtatgcaatggagtctatagaaagcaagtgagggagttttctcagtaggtgcaagggtagtgaggcatttcattttgagtcatactctgatgaggctggcctgtcttttctcatagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagtatgtactgaggctgggaggtggtgcatgcctgtgatcccagcactttaggaggccaaggtgggagggtcgctggagcccgggagttcaagaccaatctgggcaaacatagcaagtcccctgtctctacaaaaaataaaaaaattagccagacctggtatgtagtcccaactacttgggaggttgaggcagaaggatcacttgagcccaggagttggaggctgcagtaatctacgattatgccactgcatttcaacctcagtgacagggcaagccctcacctctaaaacaaaacaaaacaacacaaacaaaaacaaaaacacagaaaagcccagtacaaatcgacttcaaactgagacttcgagttcaggggtccagtcatgaaccctgtctttcatggtccccggaaagttcaaatcttcaaaaggagcctccaggcctgttcggccttaggcggaggtgaaggtacaagcagaaaagggagcaagaccaagtgaccttgggcaaatgcccgcttgcctcagtttcctcatctgtaaagaggtgggaataacagtacacacttcatggtttgctgtgaggattaaattagctaatttttgtagactgtacaacagcgcctggcacatagagcacattcttaatattttaactcacatcatccttggagctgctttgaaaatacaggggacccttgaacaacacttgtctgacctgcagggtccacttatgtatggatttttttcaaccaaaggcaggatgaaaacagtatttgtaggatgcagaactggtatacgcgtgttccacgctgcaggacttgagtgtgtgtggattgtggtagacagggctcctggaaccatggcctgagcacacagaaggaggctgtcattaggggcttccttttttatacttgacaggttgcagcgagccaaggtgtttcaacgggggcacctgccagcaggccctgtacttctcagatttcgtgtgccagtgccccgaaggatttgctgggaagtgctgtgaaataggtgagtaggtgagagcacgtgaaacgagctgaaatcccacctctccagtctcccccgcccccggaaggaaaggcagggtgcgatggcagggccaggggtgggggccagggacagggaaggcgcttctgccatgggtcaggaagcacagtgccacacagcaagcagagcctaggtgtgaccctgaatccaggctggcacccttgccacccagcctgtggcttccgagccagcctgcatcaggcctgggggaggacggggcagagaggggagcctcctgagggctgaatgaaaggggactcccatgtgaggcatccatgccctgctctctgtcagataccagggccacgtgctacgaggaccagggcatcagctacaggggcacgtggagcacagcggagagtggcgccgagtgcaccaactggaacagcagcgcgttggcccagaagccctacagcgggcggaggccagatgccatcaggctgggcctggggaaccacaactactgcaggtgagggcacatccccaaggagggattccccctgtgagaagctgctacagctggggaaagattctgtcagatccgtcagggttctcccaagaaacataaccaatacaggatggatagatggatagatgatagacagataatagatgataggtgatagatgatagattgatagatgatagatgataggtgatagattagataaatagatgatacatacatgatagatagatgataaatagacggtagatggatgacagatagacagatgataggtgatagatagatgatagattgatagatgattgatagataaatagatgatagatacatagatgatagatggtagatagatgatagatggatagatgatagatagagataggtggtagatgatagacagatgattagaaagatagatgatagatacatagatgatagacacatagatgatagacagattgacagatgatagatgattgatagatgattaaatagatgatacatagatgataatgataaatagatgatagatgatagatgataggtgatagatagattgatagatgatagaagattgatagatgatagatacataggtgatagtagatgtaagatgatagatgatagatagatagatgatagacagattgatagatgatagagagatagagatagagaaagaggagagagaaatagagagagagagagaatgtgtgtgaacccaaagtatctgagacaggtctcaatcgatttagaaagttgattttgccaaggttaaggacacccccgtgacacagcctcaggaggtcctgaggacatgtgcccaaggttgtcagggcacagcttgcctttagacgttttagggagtcatgagacatcaatcaacatgtgtgagatgtacatcggtttggtcgggaaagttgggataactcgaagcaagggcttccaggccataggtagataagagacaaaaggctgtattctgagtccttgatcagcttttcactgaacacacaattgagtctggctcagttcatctgcatttttacataaaaaatagggcagaggaagcaatcagatacgcatttgtctcagatgagcagagggatgattttctgtcctgcacctgggaagataagctatccatttacaatgccaaggtgaaagtcaacagaactgttttagggtaaagatctttaggcctgcaaggaatgtccttgtagagaattaaaaaaaaaaaaaaaaaactttgcagctatcttattgaggaataaatgagaggcaggtttgcctgacgtagttcccggcttgacatttcccttggctcatgacgttggggtcctgagatttattttcctttcacactagatagatagacatttatgttaaggaactggctgacaggatcgtgggggctggcaagtccgaaacatcttggtaagccaggctggaagtgcaggcagaagctgaggctgctctcttaaggcagaatttcttattcaggaaacctcatatttgctcttaaggcctttaagtgattggacgaggcccaactacattatctaggacaatttccttttctaaagtcaactggctgtagatattaaccacatctataaaacactttcacaactcctagatgaatgtttggttaactgactgggtgccacagcctggccaagttgacatataagactattccagtccacaccttgtcaatttggcacccatgtgcatctccttaaaccatccttcacctccaagtaaacacaggaacaaaatcatactcctgcctaacatgatagaactaccagtgtacaaccaaaaacgcactcccggctgggcgtggtggctcacgcctgtaatcccagcactttgggaagccaaggcaggtggatcacctgaggtcaggagttcaagaccagcctggccaacatggtgaaaccctgtctctactaaaaatacaaaaattagccaggcatggtggcaggcacctgtaatcccagctactcgggaagctgaggctgaagaattgcccaaatccaggaaacggaggttgcagtgagaggagatgcgccgctgcactccagcctgggataaacagcgagactctgtcaaaaaaaaaagcaccccccattcctccagaaaaggataccaaagtccttgggtcctaaaggagaggcttcacctttgacctaccctggcccttcccttggctgatttttcagaaacccagatcgagactcaaagccctggtgctacgtctttaaggcggggaagtacagctcagagttctgcagcacccctgcctgctctgagggtaagtggcagccaccccgcctttccctgaatgtccctgggggaggaaagtccaggaggacaggccgatagccctcctgcacctgaggggagaaagggggaggccaggagtgagtcattttggttgcagagggaagaaagacaggacttaggtctgtgcctgggcttggcctctgactggctatttgtctgacctggagctgatctcctcacactctgaccctcaatttcctcctctatggaggagaggatggggctgaatcagtggttttcagtccttttgagaatgaatggagattctcccttttttgattaatgggtgaatggggctttgtctctctttcgctccctctcaaactttttaatgcaaaaaaaaaaaaaaaaaaacttccaagattgaaaaaatatatattaagttacaagaccaggcacagtggcttatgcctataaacccagcactctgggaggctgaggcgggcggctcacctgaggtcaggagtttgagaccagcctggccaacatggtgaaaccctgtctctactaaaaatacaaaaattagccggatacggtggcaggcacctgtaatcccagctactcaggaggctgaggcaggagaattgcttgaacctgggagatggaggttgcagtgagccgagatcatgccactgcactccagcctgggtgatagaacaaaaaactgtttcaaaaaaaagaaaaaaatgaaatgctaagttacagaaaggtactatgaattcagtggtgcttatacaaatcattacgttacttatcacatttatcacagcactatgaaagattttttttaagttctaaatatatatagggccaggtgcagtggctcgtgtctataatcccagcactttgggaggctgaggcgggagaactgcttgagcccaggagtttgagaccagcctgggcaacaaagtgagactccatctctacaaaaaatacaaaaattagtcaggtgtggtggcttgtgcctatggtcccagctgcttgggaggctcaggtgggaggatcgcttgagcccaggaggttgaggccacagtgagcaatgattgtgccactgcactccagcctgggtgacagtgagatcctgcctcaaaataaatacataaatatgtgtgtgggtgtgtgtatatatatatgtaatacacatatattaaatttatatatgatatatataaacacgcaccagctatatgcattcagcacccaggtccacgggtgatgcctgtgactctgaagactttacagtcactctacaatatcctccccatcccccatggtctggtctaaatgaggactcgcagatctagataatcttgaaaatcccttccatttatggtatttatgtatagaggtatgctttgtcagtttcaggtcgggagaaaaaaatggaaaaatgggggaaataaatgaaaacaggcagcactccacggctcataccctcctccttcccaagcccatcatcagatcctcaggacactggcagacacagtccgagaaataacccccaccccagccccactgaagcacgttggttcactgcagcctgttaagtaacacaaggaaacccctactggctttcaaagcagcttcagaaacagcccccactcatggaagtggttcttcctgctgaacctgaagatgtccccagactctctctcaacatagcaatctagggagccacttccggtggagatgaaacccccttgccatctctaagtaaaaggactcaaagagggggaaaaaggctcaggccgggcgtgttggctcacacctgtactcccagcactttgggaggctgaggcgggcagatcacctgatgttaggagttcaagaccagcctggccaacatggtgaaaccctgtctcaactaaaaatacaaaattagcgtagcatggtggcgcatgcctgtaaccccacctactcgggaggctgaggtagaagaatcgcttgaacccaggaggtggagattgcagtgagccaagatcgcgcattgcactccagcctgggcaacaaaaggggaagtgtgaggtgttacactcttctcagtgccgggctagcggcctccagcttcctcgaccggcagctccgcttcaagccccagccctgacttgcgtgcttcagaatttgtttttgtttcagtttgagaattcttttcttctaggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggtaggtagcacaggggtggggggttcaggtcttggcagaacgtgggattagggtgtgagacgggggaagatccaatgtctcaagttgcatgacagacccagtgcgtgggaagcacccatggatattatctaatccaacctcttcacttgctagaataacacatattgtgaaaagcaaggtctaccagttttccaacctaaatcccaagttaagggtcctggcctgtaaccatttagtcctcagctgttctcctgacatctttattgcaatgatttgtaagagttccgtaacaggacagctcacagttctgtctgacaaccctatgagattagaacactacattactgactgggtaacaaagttaaagagaagttctcctagggtgggggtgtgctgcaaggtcaagatgaactcggtgtcctccctcccagctcagtggttttcattggttgactgagtctccttctactcttacatggcctgtgatgtggctgaaaatgggattgaaaatcttaaactcctggcctggtgtggtggtgcatgcctgtaatcccagcactttgggaggctgaggcaggaggattgcttgagcccaggagttcaagaccagcctgggcaacatggcaagaccccatctctacaaaaattaaaaaataagaagataaaaaggaaaccttaaactctcttatcatttaggaatcctgatggggatgccaagccctggtgccacgtgctgaagaaccgcaggctgacgtgggagtactgtgatgtgccctcctgctgtaagggctgggccccggctgcctccctgcacctggtctcccttcttcaccatctcctcgccactttctaggccttcatggctgtctggtgcagactgtgtgcctaccagacttccaggctgggtggggagggggcttccatgactgaagccacggtgggtgggcgggtgtccatgacccatgcatgggggtggtggggaggggcaagaagaaagaaaagaacacagcaacctctctgagaagtcagtaggctctacccggctctctctagacgcctctattggtgttgctgagagtaatggggaatgaggaggaggcctcgcatgcatggctccttagataataaagtgccttcaccacatttgtccaacagcgtggtggaggtggtcttcctacctccagtttactgagtaggaagcagtctcccagacgccaggtggcctgcccaagctcgctgggcaccgggaggtaaagctagggcctgccctcatgccctctgaccccaatggcatgtacttccactgtgagatcttccacgtttcctgttgacctatttcacacaggggagctggctcatgatgtgggtgagagataggagattcaagttggtgcatattgctaaaaaatgaaactttagtttggaaatggccagagagtaggttattaatcacctcctgtgaacacagatcagccagaatgttccccaaggaacacaagtccaactgggacgatgagacacagaccaccagctaactcacacccaagggcattagtgtgagtcctcagtggtccgtgtccctaagctcctcagagctgagcaggtggggacgtcaggaaagctttgcgaggaggcaggattgcacctgggccttgaagcatgggtaaggttggacagatggaaaagaaatgagcagacattccacagaaggaagctgcaattcttcatttcttaggccaggaaatggctgtaggaaaacattagaaggaatgaaggatggcagatccccagttttggagtcaaacatacttgggaactaatccaggtgccattgcaaccttgggcaaaaacgtctccgcctcctgaaacttatcgctgtgggaactaaagagaatgtatggacaacattcggcatgctgatcccaccaagtgaaagttgtggttttacagccatgctgatggcctcctcactctacctacacacgtgcaggaggcctgtgggactgactgcctcctcgtcctttcctccccagccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtaggggctcggaaacccagttggtttttccaccctctaacgcctagaaaccaagccctttaggggaaatcccacagcaaaaaaagcattctaaggctgtttctccaccaggtttccgccccaccacctgacggtgatcttgggcagaacataccgggtggtccctggcgaggaggagcagaaatttgaagtcgaaaaatacattgtccataaggaattcgatgatgacacttacgacaatgacattggtaagagctcgtcattcccggctccagttcatacagatcacacaacacacccacatgcactcacctatgtttacacacacgggcctcctcctccagcccctgcccctcctgcgtgttcctcccctcccggggacgcggccctcacgccagctcactcctcctttctccctcccagcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggcctgtaagtggaaggaagtctcggccccatcctgtctgcgggacagcaggggaggctgcggtccaccagaggaaaatggggtcaggagaccgaagttccagccccgggtcaggcactgacgccagtcccgtctccctgtgtcgtgggggcccgtctctgctgtctctgcctcacagggacactgcaggccaggaaaggacacaacagtatgagggcctcgaagtgctgcaggtgttgggaaggttctgagtaggaagtggagtacagtcgctaagcgtgtgggttctgggaagctggagttacaaagacccgatttcaaatcccacttgctgagctgtgtgaccgtggacatggatttttattttgaactgctcccagcctcagtttcctcgttggtaaagtggagatagaactatctccctaattagattaggagggttaaatgagataatattgaacgaatggatgtcagctggggtgattttgtcccccaggaaacgtttggcgaggtctggagacgtttttggttgttacagtttagggtgagggttaacgccggccttcagtgagtgcagccagggatgctgcacactgcagggctcgggactgtccccatcccccacaacagggacctccctggtccgaagcatcagcagtgccactacggagaggctgtgggttcaatcccggaatcctgctgtttttgtgggtcaaaacgataaaataccagcagtgtcataggattcgacctaatacatgttgaatcttgatcaatgttagctattattggaaaatttggctttctctttcaaaaacgtttataaataactttccctaaaaccatatgatggttctcccctttcagtgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccaggtaaccaggagtggcgcgcccatgctgggcacaacccaggggagaatgcccctgggacaacaggttcttcaccaaagaaaaaagttatcaccagagtggagtgatttcctcttagtgatacccctggggattctagatgagggcctcacagaataaagcaactggaggaagatcaaagtcacctaaacctaagaattctaaactgcaggaaatttccccaggatctgcacaggcaactccacctgtacaggatttcctttcagcccaggcaattgattgactattgaagtgatggagagagccacacaattaagaaacgtttgcctcagcctggtgtggtggttcacgcctgtaatcccagcactttgggaggctgaggtgggaggctcacctgaggtcaggagttcgagaccagcctgaccaacatggagaaaccccatctctactaaaaatacaaaattagcctggcatggtggcacatgcctgtaatcccagctactcaggaggctgaggcaggagaatcgcttgaacccgggaggcagaggttgcagtgagccgagatcgcgccattgcgcttcagcctgggcaacaagagcgaaactcgatctcaaaaaaaaaaaaaaaaaaaaaagaaagaaatgtttgcctctgttggcactagagaattggagtctgctttgtagaaggagaaggaagaaaggcaacttactgggaagcaggatctagatgatgtgagaaagaagttttcaaaactcacattcagccctaataccctgggaaagcacactatttgaggtcctttgtgtgggcatccttatcagaattagtacttatatttcatgattagccagatactggggtatgggaggacaggccagcctgctggtattaagacctgcacagagccaaggaattgatcttcctcagacatttcagtgcctgcagcgtgcgaagctctcctttaggggctgggggtagaagagatacaaagagaagtgaggccaggctctggtgctgaaggatgtgtgggctttgttttcgcaaggcagtcatatcggcggtttcccctctgattccctgacaggatttagtttctttttgaatggtttcttcagcaacctcagctgtaccagcttacagtccagaaacaaaaaggttgtaccaaagtgaaaccattatctatctgcaagcttagttaaaagcaaaaccaaatcattttaattcaatataagaacagctaacaattaccaagagttttactagatgtcttccagtgcttttcatgcattcttctactgaatgccataaccactctatgggtagtatgaatattatctctatggtacagataagaaaaccaaagcatggttagtctaaggccatcagctagtaagtgatggagccaagccagggtttttgaggcctgaaacgtttgagtaattaactctactttaccagaatagatacagcctaatcctccatgggaccaagataactgagatacaatctacccactcttcagtaagtctccacttaacagcatgcctggaaaaaataggttcttagaaactgcaactgtaagtgaaatgacgtataacaaaaccaattttaccaccagctaattgatataaacaagagttggtcaggtgcggggctcatgcctgtaatcccagcactttgagaggctgaggaaggcagatcacctgaggtcaggagttcgagaccagcctggccaccatggtgaaaccctgcctctactaaaaacacaaaaattagccaggtgtggtggtgcgtgcccataagcacgagaattgcttgaaccccggaggtggagggtgcagtgagctgagattgcgccactgcactccagcctgggtgggtgacagagtgagactctgtctcaaaacaaaaaaacaaaaaaaaacaaaaaaagaagagtgaagttcttgtggcaatatttctagtcataaaaacatcagcaaacttctaaataaagacccaaaacacttctaacattcaatattgaaataaatgtgagctatacaacatttaagaaaggttaataaaaacaaacatggtatttatttacccaatttttggagaataagtgaatgatggcggccataatagtggtgggttaattcagggaataaatgtttgcaaagcaaaaatggtaaggaacacctcttactaccatgaagttcaaaaacaatcacaaatagggcaggctccctgactgcctccacacctcacagtttatcatgcattcgtgtatttagcacagactagacagatttttactttataacactttgtattcattcattttccaacgtgcttattccggttcagggtcttgggtgggggtggccagagccacctggcagctcagggcgccaggcgggaccagccctggacagacgccaccatcctattgcagagccactaacacccacactcactcagactgggcccacgtagatacatcctcagttggcttaatgtgcaagctttgggatgtggaaggaaaccggggtacctggacaaaacccaggcagacagtgtccccagacaggaattgatttttgttttcctcatcaaagttataatgaaatgacactgaatggaatattattgaagggcctgctgtattttgaagattacgatgttcatgctacacatactgactttctccagatagtctgctttttttgcaaacgccaaacctgctatctcctttgcagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttccaaaatcagagtggaatggttttgttatagatgctgtatcccactctttattcatgttcacattttaaaatcatttggaattctgcttcactcgcttaacatatacacaacacctgtaacatacaaggcaatgggctaggtgctccagaccgggaaaaggagggacaggaatgcttggtctgatgggctaatatggcatttagagaagtaccaaggtacagtggagccggtcacaaaagggcagacttgtagtagaattcagttgcaagagggattggggaatcttaaggaaaaaatagaatcttaaggaaaaaataactgggtgagacgtggactgtggacaggtgtggaaaaggcactctccatggaggtatgaatatgtagagggccaagagaggggagtacagggagaaatgagttgagcttgtctgaagtgaacttcaggaagaggaacataggctggaatttagattatgggggctctgaacaccaaactgagtttggacttaattgacttctgtaggcaacgaggagccatggagattctgctcagggaagtgaggaactgggcatgccttaggaaaattaaccagggggtggctggcaagcaagcagacagcaggagaggaacgctgtggggatagggaggaagaacctcgcatgaccttgctaacacagcaacatcccaaccgttggttcggcctagaagctggtatttgggccatctgtttcccattgtcttaattttctgctcattagaaattgaacccctaaaccagtccacacaagtacgttatctaagtaatgttgcattctgcttctcttagactactttttttttttttttttgagacagagtctcgctcttttgcccaggctgaagtgcagtggcgctatctgcaagctctgcctcctgggttcacgccattctcctgcctcagtctcccgagtagctgggactataggtgcccgccaccatgcccggctaatttttcatatttgtagtagagacggggtttcaccgtgttagccaggatggtctcgatctcctgacctcgtgatccgcctgcctcggcctcccaaggtgctgggattacaggcgtgagccactgcacccagccctcttagactactttctactcgcgagatgcaacccctattcctggctgctgtctggcagcttttgttctcactgacatcctagttccaagaataaatcggatgctgcaatgctgctgttggggatatgctgacacagctcctcagagaggagaaaggtggtcgtctctctggtggagttgtcagaactgctcagtttagaggttcttggaacaaaagtcgtttaaactcacaaaagaaagagattctttaactcccaagagcttgactggggtgagggaggcagcgggggacatccctgaagtgttgaagtacctaggccagtaaataaatgcaggtcacagagacttaagtcacagatttcttgacttcagactgctcacttgcatgttctacagtttttagacagatgtgtgtctcagccatttaagaaaaacattgtttgaggccaggaacggtggctcatgcctataatcccagcactttaggaggctgacgtgggtggatcacttgaggctaggagtttgagaccagcctggccaacgtggcaaaaccccatctctactaaaatacaaaagttagctgggtgtggtggtgcacgcctgtggctccagctacttggaacactgaggcaggagaatcgcttgagcctgggaggcagaggttgcagtgagctgaaattgtgtcactgtactccaccctgggcaacagagcaagactctgtcaagaaaaaaaaagaaagaaagaaagaaaaaaaaaaaaacactgaggaccagtgcgaaggaacccccagccactgaatctccggcagaaattcagctggtttcatcccctccccctttgcaggacaagctcttcttcaggattaatgaaatgaactga

SEQ ID NO: 17373 - DNA, 48997 bp, Human
aaaaagtagcatacttaggcgactcagaaaatcctgccccatcttctatctccttactccctcctcaccaaaaaagatcttttttaatactgaagaccccctttaaaaagaaaaagaaaaagaaaaagaaaacaatagttgctctaatttgagtgtcgtttccctttattggagcatttgaaaacagacatttaagggcaaaagagatggaacacatctgaggtaaatcgtgtatctatcttcaggctgtgcccaacctttagaaccacctagaaaggtacaaagctgagagcctctctcagatttttcatatagtatttcaagactcacctcttaattgcacccttcccccctcccattataaagagcatggaacctaggacccaccgccttgtgtggaagtccacacaccactggtcacaggccactcacaggtttgggggacttcatgatgattcctagactttctgagtttcccttgcctcatctgaaaaaagggccaggacctaactgcaggttgtgagagttgaatgaaatcaaataacaacttttcagtcagtgacagactgcatatacaaaggtggtctcatacgattataatagagctgaaaaaattcctattgtctctaaagaccttccaggaggacaggatgtgaggtggcatcagtggcactgacaatcctgaccctgtgcaggcctaggctaatgtgtgtggttgtgccttagtttataacaaaaaagtttaaaaagtaaagaaaaaataaagaaaaagaaaaatttaaaaatagaaaaagcttatagaaagaatacaaagaaaaaatattttcatactgctgcacaatgtgtttgtgttttaagtcaaacgttattacaagtcaaaaagtttaggtcgggtgtcgtggttcacgcctgtaatcccagcactttgggaggccaaggaaggtagatcaccggaggtcaggagctcgagaccggcctggccaacatggcgaaacccagtctgtactaaaaatacaaacaaattagccgggcgtgggggcacacacatgtaatcccagctactctggagggtgagacaggacaatcatcaaaaccggaaggcagaggttgcagtgagccgagatcgcaccactgcactccagcctgggctacagagcaaggctccgtctcaaaaataaataaataaataaagtttaaaagatttaaaagtagaaagtaaaaaatcatagtaagataaggttaatttattattattgaagaaataattttttaataaatttagcatagcctaagtgtaatacagtgtttatacagcctatagtagtacacagtgatgtcctaggccttcacattgactcaccactcacagactcagccagagcgacttccagtcctgcaagctccattcatggaaagtgccctatacaggtgtaccatttttaaaatctttcatactgtacttttgctgtaccttttctacgttcagacatgtttagatacacaaatatttaccattgtgttacaattgcttgcagtattcagtatggtcacttgccgtacaggtttgtagcctaggagcaaacaacagcctgtaccatatagcgtaggcgtgtaagaggctataccatataggtgtgagtacactctaagatgttcacacaagaaactcgcctaagacatttctcaggaggtaatcctgtcatcttaaatgatgcatgactgtaagatctacggctgagtgcctaactgtatatcgagaaataacgctctatttcatccgtcttccgatattgaactttaactgaccatcagaccggcctgaataccagaatctctttgcaatgcactcgcctcgctcattaccagaaggaggttttacctgcctagtgacctggttggtctgggcatgaaccccgagaggtggaaactctcagactctcaggactgacagccgagtggctggggactataaatccgcgagaactgccctcgcgctgccatccagctgggtagccgggggagcgcgcgtgggggctccgcgagtcgctcgcccttggtttctggggaagcctgggggacgcggctgtggcggaggcgccctgggactcaggtcgcctggagcgtggcacgcagagccccaggcgcggagctgaggccgcgcggccgcgcttggccccagcgggcgtgggactgagcagtctgctgccccccgacatgtgacccagccccgccgcccatgcgggctcccggccgcccggccctgcggccgctgccgctgccgccgctgctgctgttgctcctggcggcgccttggggacgggcaggtaggtgggtcgcgccgccaggtgcgggtcggggatgcctccaggccggggccccgccaggcagagctcgaggccgagctctcccctcctgcccgccggccaggtttcgctttcgggcgggcagaggacgaggtgcgcggaggccggagcttccagccccggggctgcagggagcccgggggacactcgccgtcgcctcgcgcaccttggctcggggtcaagtttgcaggactccgcgctccgcactttcggtctcgagaattgaggtggggtggggggagttcggtggggggtgcgctctgcgcggtgcccacagcctatgacttgcggtcggggacggttaccatgcggggcccctcgccggccagtcccaggttcccgccaccaccgccgcggccgcgcggaggggcccctgtggatgccgcgtctcggccgccgggccccgcagtcctgcaagccgcgcgtcgcgagatccgcgctttaaaagccaaactccccgaaagggtcagccccgaaggaacatgatccagaaagacgcagcttcttaaagtaagctccccctgtcctgggtacgccgttgtttcctttgcagttatgaccatgtacagatagtgctctttgatttttcagaaataacaaaacttttaactcgtttacgacataaggtaactgaagagctctttcgttttgtttggtttttaagtttaaattctctaccaattggaatccagtaaaccagaatgattcattaacctgattgctttttttccctgtatttctcgtacatgagaaaaagattttttaaaaaaacaaaaaagatatccgggatccctttttaaaaaaattattttaaaaaacaacaacaaagcttctccaaatactgtgctttgtagacacttcgttcaggccccgctgtcttttaacccagaactgaacagtaagagtgaatgcaggaagaaagttgacggtgaatctggagtccttggtagttaaagaaaaagttaaattcaatatagttacaacaataagaaaagtatgcacacagatcttggagagattttgaacgatagctattatacataaaatattttatcttttaaatttatcagaaattatagttatttttccttttaatattcccgggtagactgaatgggaagaaacgactgacgtgcaaatattgagccttcaactaacagacagaaatttgtttttatttttaatcgaagagagaagctgggcgctgtggctcacacctgtaatcctaacactttgagagacagagacataggcaggaggatggcttgaggtcaggagtttcagaccagcctgggcaacatacggagacccctgtctatactaaacattaaaaaaataaaaataaaaaactagccagacgtggtggcaaaaacctgtagtcctagctactccgtgtgcccaggagttccagactgcagtgagttatgatcacgccactgcactccagtctggccaagggtgagaccctgtctttggggaaaaaaccaaaaacaaagaaagtgagagagagaaataaaattgttgggtgctgacattaccaggtagtaatgttcttgacttcaaaataaaatttacaaaacaaaacagtaagaaatcttttctgacccaagagaccttgatactactttcttagctcttcttagggtattcccgtcctctcctgggtctttgggctaaggtctaaggactgctgggaagaccaccttagaagatgtatgtagttacctggatactacctgctcgtaattgaaggattatctacaatgtcttctgtacaacgtgggcttactaaggttctatgactttgccactctcaggtagattaatgctttaatgctctcattttttaaacttctaaaaattttcgtctcacagctcagtgccatatcaggctgtaaaataccaaaacatccaaagaggaaaaaaaaaactcagcatgtcatgaaccttgtagggaaatcttggtatttcatttcagataaagttgtaatggaattcaaaatgtctatgcggctccctcaaggcaggtgcaacacgctgtcattcactcttggacccctccagggacagaatttcacagtgaagtttatccttatggcttatcaaactccgccctattggccattcccatatcctgttctcaggaacgataaagaaccatgattagcataatataaacaggcatttaaagtcactaagatagaatgggagatggtgacttctcaggtcatctgcctcctctgctcaaagcccttcagaggcttctactgttcctggaatcattctcagttctacaagatcctgtgtggccaactcctgcctgtctctccagccttatctcacaccacctaattcctgctatcctggcctttttctacttcccagagcaagccaaagtgtttcccatctcactcatactggcagttcctctggaagttcctactggagattcatactggcagcccctctgctagaatgctgctgtgccactctattcccagctaactcctgctcagactttggcctctcctgccaatgtgcttccctcaagaaggtcttccctagggagttcaacaatgaaaacacatggacacagggaggggaacatcacacaccagagcctgtcggggggtgggggctaggggagggatagcgttaggagaaatacctaatgtagatgacagattgatgagtgcaacaaaccaccatggcacatgtatacctatgtaagaaacctgcatgttctgcacatgtattccagaacttacagtatatatatatatatatatttaaaaaaaaataacagggtcttccctaaatccccaaagaggaaaaaagtatagcttatgatgtctattaacaaataaacttgagttttggagctttagattgcagtctaaataccaaacaacaactatgcttattagaatgacttaatggagtgagagtattagtcaaaatgtctcttctttgatacaaacatggcagcattccgtattttatttcactgagaagttattccaggacatacttcactcacacacacacatacacagggacataaatgattctagtgaactaattaaacttgcagaattattttctttttttaacttttaattttgaactaatttgggacttgcagagaagtttcagaaatagcacaaagaattcccatatccctctcacctggtttctcccaattaaaacatcttatgtaaccattgtacaatgttcagaccaggaaattaacactggtatagtgctactcactaaactatagaccttgctggagtatcacccatttttccaataatgccctttttctgtttcgggatccagtccaggatctcccattacatttagtggtcatgtccccttagtcttctccaactggtgacagatcctcagcctttctttgctttcatgaccttgatacttttgaagagtcccagttacctcttccttagaatatccctcagtttgggttcatgtaaagtttcctcaagcttagaatgaggttattcaattttggcagaaatgccacataaattgtcacttcaaaggatttgtaatatcaacatgtcttcttattggtgatgttaaccttgatcgcttggttaaggtggtctcttcagagtttcttactataaagttacgatttttcactgtgtgactaataaatattttgcagagagatactttgagattatgcaaaaatcctgcttatccccaaactcacacccaactatttttagtatctatcggtggattttgactgcaaaaactactatacctagtagtgattttttatttcactctttttttccacatttattcattggaattctattacaaggaagggtcatcatttttgcctttttaggtatttattcaattggttaagtatatcagtatggactcatggatgtgtcttcttctttcatttataatccaatactatcattatcagttttattgctcatgctgttccagctttggccactaagagttccttcagtttggctcctgtgtccctctaaggaaccccatcttttttgagcacttcattaactttctagtgccaacaacattccagactcatctagtgttttccctgccccaggcctggaattaatgacttcctcaggaagctctggttccttctattggagaaaggtgtttagaaaccaaaatctgggtgtgaggcatgcttattgctactggaatgttgtttctaggtgctctcggtggacggagctgggaaatatgtgtgtatagactaacgtagttatacacacacatctatatttctgtatgtatctgtgggtgtgtatatatatttaagaccgtgagtttgtaatggtgccactaatttcaacctaacaatcaagtttcattctagccttcctctttcatttacagcctctttgtctaacagtgagaaacccagatgtcattatctacaatagacttatttgcctgattctaatataaatattttcaggattgctaactcatgctcttatgagaaaaacgtgtacttactaaattatagcctttatgtacagttttctggtcttaagctttataatatcccatgaagatactattgaccaaagttacctggcttagtccttttttttctttactccttttggtgtggttattctatccatttgggataagttcagttcatttgttaaactgcttgtattacaatttgggttccccctcatgctagttgttttgtttgtgacatttggggcatttggcagctaggtgaaatattactgtgcttataaaagtcagagctatacaaaacggttttctcagacaagtgtggctcccttctgagccctactacctcctttctattcctcaccataccaccacctctttcccattacactataaatgtgattacgatgttgtacttacactgtcattgtgatattctgacatcatttctactttgttcttggtccacattccatgccatctccttcatttcttgtttatttttcctgaatttcttttgcaccgatgagcaaatatgtgtatgttttaagatccaggtctaaatctgatttctgtactgcagctaatggaggatttgctcgctcaagtgttctttttatcaaaaaagcatgtcttcttttccagcctctctcctattgcccttcaagcagacttggggtgatttcttatctatagatttgcaggcctcctgatctatcagcttgaggcccagccccagcctccccagagagtatcatgtacccaacatccaagcttatggctacaggtatctccagcctcactcctcacaatgtgcactcctcctgcctagaactactcagcttcctatagaatgaattcaggaaaggcagtatttgcgacctggagagcagccaaggagattggttacccatggaaagcggcatggaataggaacgacatagtagggctgaggaggaagcaccacctccctgattataccttttcgtttagctctgactcttagaaccataaggtaggacatatatatttcacttactcataaactgtgggtaaagacaataggcaagtgggattattgctttaaaattaagattttagtataaacatttcaacataaaacttttgctgtttttataattttttaatgaaactgtatatctctatgttgccttttttagtgcttggcatagtatttttcacaaaatgattgttctgtaaagttgtatggctttcttaaaagcaactttcattatatgcgttacattttaaaaatgactttctatttgcaccattttcttcaaagtacaattttaccaggtgtcattgacatgctgacttccatattgatttaaaaaaaatgatcatctgaggcttcaggcagcatatattttatggagtaaaatcgcattatccatcttaattataacattatacttttgctatcatcgtgatgttctgacagcatttttacattttcttagtctacagtttatgacataacacaaaatttgatatgagaaacatgaattaaatcactttaatcaattccaaggtctatcaattacatataaaattggagaacaaggccaagggcaatgggtcatgcctgtaatcccagagctttgggaggttgaggcagaagggtcacttgaggccaggaatttgagagcagccaggagagaccccatctctacaaaaaaatttcaaaaaatagccaggcttggtaatgcctagctgcttgggaagctgaggcaggaggatcacttgagcccaggagtttggggctgcagtgagctatgatcgcaccactgcaactccagcccaggcaacagagcaagactctgtctcaaaaaaaaaaaaaaaaaaaaaaaaaaaaaaaaaaaggagaacaaaagaactatagaaagaaagtatgctagtcagagacattaaaattaaatactgctttatctttcagaattccttttgatgtagaaactcagagttgacaggaccttaaaagtcaccccacccagctgccactctcttgattgtcctctgcagcatcacttccaagtaatgacctgtctgctgtgtgagcacctctcatcacaggatactcactaccctgcacccaggcaggcaggatgtcctgtcactgcagatttcaactattaaaaagttctttgataaaatgagctgagccttgatccttcaattttcactcactgttagtcctcattctaagccaatgaagtcatgctggacaagctgttcagatcattgaattcaaccatcacatttcctctgtgtcttctttcctctccagaaaaccacctccccagaaaactgctaggtgccttctctctcccagtatttccagtatatgttccagtttgtttgcaatatctcgggctgacttcctatagatcatgatgagactgctggtctacaacattctaaacactgaaccttggaaggttcatttaccctccaatgattcagcatcaggttcctgatgaacacaggcctctgatgtctaaaaggagccctcctttcttatctttgttgtcatctatgagacacagaccctcattcaaactcagaatttcatattagtacaatttcattttgctctggaggtgattttgtttctgtttgcctcttacagcatagggaatgaaagtatggcatagtgttttatctagaacttgtgatgatggtcttaaatgcaactaaggctactctttgctgaaaggacaatttttattgactataaatattatctatacgaaattgggtctgttttttgagggtagcaatcgctgcattacactttgcaccaccaaaatggatacttcaatcactatccactgttcaagcaaatgccagctctacccacaacacagagaaaaggcatacttagtcctgtacagacttgtggggaagctttgtttatacttcttgatttcaacatgtataccatgtatacttttcaccccgcttcttctcggctgcatagtccaaagttccattccatacagctacatttgcattttgatgacgtgggatattttggcagctatgtgctcctagttaaagcatttgtttacattatcaaccgtatttaaatttcctccttaccaactttgcagggttttcttttgttttggtttttttgctcaacatcagtcccctcatcttcactttcaggagactccagcagctcttagagcattcatttttcttttcaataaacattgtgctcattgttgaggaaagatacaagcaagcaacagacacctactctattagcttctcaaggctgccatggcaaagtgccacaaactgggtggcttaaaataatgcaactttattgcctcacagtcctggagcctggaagtctgaaatcaaggtgtcagcagggtgggttctttctgaaggctgtgagggagaatccattctgtgcctcttcgtgcttctggtggtgctggcaatcttaggcaccccttggcttgtagacacaacaccctgatctctccctgatcttcacatggcattcttcctgtttgccttcacatagtcttccagaagactctgcatgtctgtctgtgttcagatttccctttttatgaggacaccagtcatactgcatttcggcccaccctgatgacctcattgtaacttgctcatctctttaaagaccttatttctgaatgagatcccattctgaggtactagaagttaggatgtcaacatatttcttttgggcaacacaattcaactcatcacatctaccataccctcaaagacttatagaataccaagcaggatccatgggcttggcatctatggtggaaaagaatgttttctcagccacatgcagtggttcctcctctccaacatgtttaggagtctgtgtccaatgaaggaaaacttttgcagaagggtgagagctgaaagcctctactgagaatgttgagagcccggacgaggtcttctcttgtgctttccgtaacttgaccataaggcagagctgtcaatgggtacttaataaagactaaagacatttaaatttatccagcagaggagctcactcttctgagacctctgcctcccatcttggctgctctagggagcacttgccctgagaaatcctctcccttgttccaacaaagaccattttcatatgtaaggcgtaactacccatagtcttccagcccagcatccctctccctttccaacgaacccatctatgttgcagaatgtctataaattatctactaaatgctcaacttattatttttaaaattagcttatcaattttaagtgcaaagtagaatatcacatgcagcccataatgtagggaatgaggtatttgaagtgatcagatttaacaaaataggattacctcaataccccatgcatccattttgagttttcaaaacatttaactatatcccgactcagtgtaatttctaaataatccttcgagtgatttttgctcactcattcattcagtgtcatccttttatacatatggggagctgttctaggcttcagggtgaacaagaaaacaagggccctttcttcatttagtcttcagagaaatatagacaagtaagtgattgcattaaaatgtaaatgccagaattgaggaaaacagtttctttagaagcataggataagacacctgatctaataatggtgtcaggcagggcttcctataggaaggtcctttaaactgagacttataagagttgttggttaattaatatacatgtatgcatatgtatatatcacatcacattctccttactcaaggataaaaggtgaatcagaaaagaaatttgatatccaagtaaatgcctttctatgaataaataccttaaatacttttagtaaaaaccatattaattcaatcagtagtcataagtaggttgccatctatgttatataaaatatttataattcaatataaatttagatctttttaaaaatgtggtaatatacaccatggagtactatgcagccataaaaaggaatgggatcatgtccttttgcagggacatggatgaagctggaggccattatcctcagcaaactaacacaagaacagaaaaccaaataccacatgttcccactctttttttttttttttttctgagatggagtctcgctctttcacccaggctggagtgcagtggcacaatctcggctcactgcaacctccgccttccgggttctcaccattctcctgcctcagcctcccaagtagctaggactacaggcgcccgccaccacgcccggctcatttttttttttatatttttagtagagacagggtttcaccgtgttagccagggtggtctccatctcctgaccttgtgatctgcccgccttggcctcccaaagtgctgggattacaggcgtgagccaccgcacctggcccacatgttctcactcttaagtgggagctgaacaatgagaacacatggacacagggaggggaacaacacacaccggggcctgtgaggagtgctgggggagggagagcatcaggataaatagctaatgcatgcagggcttatcacctaggtgatgggttgataggtgcagcaaaccaccgtggcatacggtttacctatgtaacaaacctgcacattctgcacgtgtatcctgaaacttaaaataaaataaaataaaatataaaaaataaaataaattcaggtcttttaaatttaaatattagcaaacaaataaagctaagtcctgctatcagcatattccatatataaattaccaagtagttaatattccttttcacatacatttctttcttaaaacactaaaaatgaacaaacaaacaaaaatccaataatagcaaaatcccatggaaaggatgatttttctgagtggtagtcatctagtgggtaggagtcaggggttttgtgactgtaggacactgacctcaagatcatcggcagcctcaacaagccactgtggtctgcggctctttgcaacactcactcaaaccacagtaatcaaaaggcacacattatgctgtggcttctgacataggtactatttaccacttcctgagtcaacccagtcctttaaggactctgttaactttcatgaacaacatcaaaggaactgtcttgcctggtccagtatccaagttgtttctggaggtgttgcaatgaaacagtgaattgaatagtgtcctcccaaaagtaatttccacctacaacctcagaatatgaccttatttggaagtagagtttttgcagacgtaattagttcagaattttgtattggtccattctcgccttgctacaaagaaatacctgtgaccgggaaatttataaagaaaataagtttaattggcacttggttctacaggctacactggaagaatggtgctggcacctgcttggcttttggggaggcctcaggaaacttacaatcatggcagaaggcggaaggggagcaagcatgtcacatggcctgggcagaaacaagagagagcaatggtggggaggtgctacacactttaaacaaccagatcttgtgagaactcactcactatcaggagaacagcaccaagcgggtggtgctaaaccactaatgcccactttgtgggcattccattcatgagaaatccacccccatggtccaatcacctcccaccaggtcctacctcttacattgggaatttttagtacttcaacatgagatttgggcaaggacacatatccaaactatataagatttcatgatgaaatcatcccagaattagggtggactggtgtccttgtaagaagaggatgggactcagaaaaaccacatgaaggccaaggtgagcagagactggagtgatgttgccatgagccaaggaacacctggggccaccaggagctgaaagaggcaatgaaacatagttttctagaaccatctgagggagtgtggccctgctgactccttgatatcagacatccagccttagagctgtgagataatgaatgtccattgttttaagccacctagtttgtggtactttgttttggcagccctaggaaactaatacaagggacttggactcttctttgtgggcgtctcttcattattgccctgcttttatcctgattactcttgttttatatcttgtggcaaaataatgtaagtacctcaaagagccagtcttctgcaagtcctgttcagcatatggaatctctgttcattttactgcatttagttacacaactttatcaaggcgtaattcagccttgaagaggtccgatcctagtcctggtcaccctcaaaacaattcatcattctgatagtgttcttgatggctaccgaacacttctatcttcctggtgtgtgattggaaagtctgagattccagttgagatcatgccgtcaatctcatttgcctccaaattccaagcaacaatcagcagaagtaaatactattcattattttcttgaaagttaaaagaaatgcaacattgaaattactgtacacaaatgcttccaccgaaacagaaagtgagaacttggagccaggatctcagggccacgtggaaagaatagcaatcgggaaatcagaggatggaagttcagcccctcctcgtccactgccctctgtgggcaagtcacttaccttgaatgggctttggttttctcatctatgaaggagtagggttccatgatttctgaggcccagagatgaccactgcctgggcagtaccaggccatcacttcacctgccttgtgccctccacccgcctgagggaacctgccctgtcactctgtccttggggctggcctttgtaccctggttcccaccagctgtctcctgccactgaaactagcccctgcctaaccctccacatttcttacatttcccccaggagtctccccacattaccacctatgcaacaacacaacaatctttttcctctccacagagcttattctaattcataccaagtagataccatactggatttattttcttttttttcttttctttttttttttttttttttgagacagaatcttgctctgtcgcccaggctggagtgcagtggcacgatcttggctcactacaacctctgcctcccaggttcaagtgattctcatgactcagcctcccaagtagctgggattacaggcacgtgcgctgccacgaccgactaatttttgtttagtagagatggggttttgccatgttggccaggctggtctagaactcctggccttaagtgatctgccaacctcggcctcccaaaatgctgtaactacaggcatgagccaacacacccagcctcatactggataaccatcctctttcattttcttgatcacaacctgatacaggattatacgaaggacatagttctgtaacagtgaagcatcacttgatgatggggataccttctcagaagtgtgtccttaggtgatttcatccttgtgcaaacatcatagaatgtacttccccaaacctaaatgaaatagcctaccactacacacctaggatatatggcatagccaatttacccctaggctaccaacctgtactgcatgctactgtactgaatactgtaggcatttgtaacacaatagtatttgtgtatctaaaaatagatacacatcttatatatacatcatcttatgggaccagcatcattgactgaacgttgttttgcagcacgtgacgttatttctgaagtgtgcaccagtggtttaagttgatctttgagctagcagtgcagttacccagctacacccagctgtacattgtatcatccagggccccagcaacagcactgcttgttaatttattgtggctgttataggctgaaaggtaacttatgcaggaagggtatccagcataggtgagcgaattggatgtgcttggaggaaatgggctgttttaagtcttttgatgtccactgccattggcctgccatttgcctgcttcccacagataagtaattcgtggcaatgtttattactgataataatggcagttattcatataataacaatagttattgttaacggtaaggaacagtaaatatttacaatgaatagtaactgttgagatgggtggctgggaggaaataagtataaaaggtgagaatgggtacataatagtggaggaggtgaaggggaggtgatgctgaaagcatactccagagatgtccaaggagtgtttgaattatccctgtactgatccactgggcaaattgaaaagttactacgtctgagtattgggaaacttttttttttcattttttccctttgaaaaagaaaaagaaccaactcttggggttaatcaataaaccaaaattattttcactgcctttctcaaatgattggttaagattaaatcatttgagaaaggcaacaaaaataatgtttgttattgccttgtcccactgttcctttttctttattccttctaaccttcctaaggacaatgtcacatgtgcaagtgtaaattaaatacataaatataaaactttgggaaagctgatgatggggacatgtggtctttatgagtaaaggaggcacccagaagtgtgtgtcatgaggggaaagagttacactgttttacatcccattaatcttatttattctttgccaaatagccttgctgttgcttttcagcttactgaagtacttactgatatatgcattgaaaactggtggccgagcatggtggctcatgcctgtcatcccaacactttgggtggttgaggtaggaggatcacttgagcccaaaagtttgagaccagcttgggcaacattaatgagaccccgtctctacaaaacaatgttttaaaacttagccagtcatggtggcatgcatctgtgttcccagctactcaggagactgaggagggaggaccacttgagcccaggattttgaggctgcagtgagctatgatcatgccactgcactccagcctgggtgatagagtcagaccctgtctcaaaaaaaaaaaaaaaaaaaaaaaaaaaaaaaacccgcaaaccgctgacattttccaccataattctttaatgaaaatgaaagaatctctattttcctccctttctctaatgctcttttgtccattatttaccatttaatcatttctgcctcattttttttttaccttttctattatttttttcttgcacttttatcttgttgactttccttctgaaaatttcaagtcatgaagatattagtggaagaattgcattgcctctaggaggataaaaagaagtactagtgttgaaaatgatttgaggaataaagtgttgatatttaagaaatagttactggttgaacttggagtttccaacagctattcttttcagtactttagtggtcccaaacagtttgtctttgaccatgttctttcttttatattttcccttcctatgcatattatcaagtagtaaagatttcaacccatatttgaatctacttttccagttactatgatgatcattactaccaattgagatgttttggagattataacatgtgaagaacattaggtactcactctcaaaaagtttattttattttattttattttagagacacagtctcactctgttgcccaggcagaagtgcagtggagcgatctcagctctctacaacctccgcctcccaggttcaggcaattcttctgtctcagcctctcgagtagctgagactacagtcacataccaccatgcctggctaatttcatattattaatagagatggagtttcaccatattggtcaggctgatctcaaactcctggcctcaggtgatccacccaccttggcctcccaaagcgctgggattacaggtgcaagccaccatgcctggcccaaaaagtttattttctaaaaggtaagggaagagctttatataatctaagagatgacataaagtagtgggactggttttctaacaatggggctggcttatacaaattaataatagtcattatgggaggctacacacaaaaatctcacaacaatgaatttcataagctcccttttctcagttgcaggtacagcttggcacacactgatcagaatatcccattgagtggcaaactttcaacttgggggaatgaattttattgttgaaagcattcaaagccactttccacaagtttgggtgatcaggctgggaaatgctatattgagcaaaaacaagatgtaactatttaaaaaatgagattgaattttttttttcatgtttctaagctacttctgaagataattgtagctgaaaggaaacatccctcaaatgccatgagctaagaagtatcatgagaataatcataaaccctcccaagtaaaggactttaaagatacacactctctttagtgggtaaaattcaatagatttattttattttaaatagtctgtatgttaaagtcttacttgctatgaagcaccaacagcaaaatactaaaaaaacatgtttaagcacatagatttacttactgaggtgtggccataaagaaataacaccaatttttctgtatgacttatgtattgctcatccatataaatgtgcaggtacctggcagagaaagtatatattgatgggttgtgccccagactcagaaaatatctcctccacgagagcagggctttctgtcaatttctttttttttttttttttttagatggagtctcactctgtcacccaggctggagtgcagtggcacgatctcagctcactgcaacctgtctcccaagttcaagctattctcctgcctcagcctcccaagtagctgggactacaggggcacgccaccatgcccagctaatttttgtaattttaatagagatggggtttcaccatgttggccaggctggtcttgaactcctgacctcaggtgatccaaccacctcggcctcccagagtgctaggattataggcgtgagccactgtgcccagcccttctgtctatttctgtcctcaactgtacccccgtgcctatcatatattctacttctagcccatagtaggtaccagtaactatttgtcacacgaatataactatgaacagttccaccaggaaaagcttaaaagaataatacttgagtttacctcattgacttttttatatctttccttagaagccacaatctttaatatgcaaaattgatcttggtcatataatcttttcttcccacaacactgtacttgggagcatttcccacttacctaaatgtaagtatcccaggcgagagccctgtcttggccagcacacttgggcctgagcatccaccaaatggctgaaaaaccatgggcaagtcattcaacctccctgggcctctatccactaagctgtaaaatgaggatggtaactttggaggacaatactgagcgaataattcctgagctctttctttgtgccgggcactgttccaggagctctatgtgaagaatcttaatcattgcaacaagcctaagaggcagatagtactgttccattttccaaatggggaaattgaggcacagaggttaagtaactggcttgagggcgcatagctggtaagacgtagagcatggagtaggctccagtgtgaccctagaactttggttctggaatctctccctgagctactcacataaacaattactagcaaccattgggttagggcagttggcagtaccttgtaagaatggacagtattattacagagaaaactgaggcagcgcaccagtccagcaattagtcagagaaataatagtgaggtggtggttaggggaagaaaatcaagtgcaacggaactaatgctagcaccgaatcgtgctctgtcctttatagacgacagttgtgcagcttttttctcaggtaggtcctcactgaatcatattgtaagtgctgtttagaagacttacttttcagccaggcgtggtggctcatgcctgtaatcccagcactttgggaggccaaggcgggtggaccacctgagaacaggagtttgaggccagcctggccaacatggtgaaaccccatctcactaaaaatacaaaaattagctgggcgtggtggcgggcgcatgtaatccccagctactcaggaggctgaggcaggagaatggcttcagcctgggaggcggaggttgcagtgagccaagattgcgccactacactccagcctgggcaacaagagtgacactccatctcaaaaaaaaaaagaagacttactttttgtgggaacttgatatataattaggaagaagaagggagatcaattaatatttttcaagagaaaggattcgtaacttgggacagaagaaaacatgccgttcctttcaacatgatgaaattaaaacaatgcttaagataatctatgtgaagccagtcatacctgttttgctcttcggcggttagaatgtcattgtttacaacatccgcttcctgaaattagtcaatcatcccctggtgtttctgtactgccttttaaccttgttcccacagtagaaaactcacttgggatggaaattttctttccctacaagcctatgaaggtattttcctatttaaaaatacacataaaatatgtagcaaccacttgccatgccatgggttactgtgccttcattaaaacgcagctgttgagtatcttctgactgtgcagatcctgtgtgtaatgtaagcttaccaaggtgaattcaagctacacagatttggtagttcaagctgttccacttcaattcaatgctcatgtgaatctaggatctgccatgatttatgtcagcccgaagagttcctggtcagttcatttccaaagcatttatttgccagacactgagaatacaaagaccttataagacctggtgtccaacagatcagagcctctgattccttcacagcttcagctttagaaggctaaagggggtaggacatctggggaccttttctgagcaaggtggagcagggcttctgaaatgctaaggctgccccagttggtcataagcttcagaaacttgaatggtcccaaaggggagtctccagaagtgatcacatttggctgtccagtctcttgcgatttgtttgctttctgtactggttaatgaatgtgctggccataacgggaaagtctaaatgcctcagccacaaaagacaggttgggttaaccacagaggctgattaccctggctgtttatgagttcaccctgagaaccttacccttttaactggtgttcatcaggcactcacgtatgcgtaggcttttccttgagtacaactaaaaagaaacaacttttactgtcagacatataattaaaactgtaacatacttagatggcaaccctagtaatcactttgaggccattaggaaaaggtcacaaaccattttgctatacttacagacctgtattcaaggtaactcttagaacaaatgtagcagctgcattttataaaactccactaatgataaatttacccatttagatctatcttattaatccattatcttcctactggaaggacctgcgagcaaacagagaactttttcctttggtgctagagcataaatgaagctgggctagaagaatttcccaaagaccaaatgcattagttcattccagctgctaaaacagaatgtgatagattgagtgaattataaaaaacagaagtttatttctgacacttctaaggctgggaagtccaagatcaaggcagatttggtgaatggagagggcccacttcctggttcatagatggtcatcttctcactatgtcctcacatgttggaaggggcaagggacctctctggggcctcttttataagggcactaatcccactcatgagggctctgcccttatgacctaatcacctcccaaaggccccacctccaaacaccatacattgggtgttaggatttaacctgtgaatgttttgatggggaggaggaacacacacattccatttatggtgccaaggtataatataataaaagggaaataaacactgagaggggacacaaatctctatgtggcttacaagctacaggaaatcaatcattacctcgaagttcattaaatggatagttccttgccgactcctcacaactttgtgaaggcagaggccatctttaacccacaactcaaaggggcatcctcacatatccttccatcgttcaaagctcaaagggagtccagagttgatgacccttccctcagtcttctgagttctgcttcctctggaaagatcagtctcctgcccaggtgtctgtggtcaggattgctcactttagtggagaccacacacaccctacacatcacagcacaatcatgtcattaaaatagcacaagccagtatttattcaatgatgcacacatggaaaaccaaggggtctcttagttccaaaagaatgctagaggcagaagggacctaaacgcaaaggtgtgaaaaaacagggtaggttcaagtattgaaggtattttggtgtggctggtgaacacggtgcatttggcagaattgcaaaaggagacattggacctgcccatctgaagaatttgtgtaccaaaccaaagtcatgatggtctggcactccccaaacataaaactatgtgcaccaatgcaatggctttttaatttgggatgtgaaatctcaaatatctcagagaatcagagccgtgcttccagaccataaatctatttgttaaaatgcatttgttacccataaattggcacacatttcctgatagcaatgtgggtgtgacatgttttcactttggtgttgattcaatgaccttatcagtactagcaggttagaaaattgatttctctccattgaaatgtttattcaggaatctttcatcatgcttttcaaacttgaaacaaacacagtgcctaaaaacttcgcaattttttttaaactaaagagaatactagttatcaaatcgtatttcttttttaaatgtactatttcttttcctttaaataaaagtgctaactcttgttttgttttgttttgttttgtttttagatagagtctcactctgccacccaggctggaatgcagtggtgcgatcttggctcactgcaacctccacctcctgggttcaagcaattcttctgcctcagcctcccaagtagctgggattacaggtgcctgccaccgtatctggctaatttttgtatttttagtagagacagtgtttcaccctgttggccaggctggtctcaaactcctgacctcaagtgatctgcctgccttggctttcttaagtgctgggattacaggtgtgagcccacacacctgggctaattctattttttatcactcctttgcatcatcaaaatagataaaagcatgagtattccttgctagatcttcatctgttaattttactttcacagcacagccactctcttcctgatgggacctgtgcagttctgcttcatcggcaggtcccacttctagtttgaaacttgagttccaagcttcccatgcatctccctctccacagcctgcatcttggtgcacaatggagctactgcagttatggtctcactggcttctcccttctcctcttggtctatacagtcttttctcccttcagcagtgaagtgatccatttgaaatataaataggttcatattttcccctgcagcaaaggattcaatactttcccatgaatttcaaatataatccaggcattttcccagagtttagagagatgggggatctagctcctttgtactccttagatttcatcttggccactgtcctctttgtcagctttccaaactgatattttgacagttccaaagacactgtccttttggataggccctttcccatctcagtgcctagaacactgccctctcctaaggccctgtgtatttatgggttctgtgacccaccactccagccttactccgttgcttagtctgatcaccaaatttttatgtatatatttgtttttgttgtttactttttaatgatgtctctcttcctactaccctggaagctctgcaagggcaggaacttacctgtctattcaccataagatatccacatggtaggcactgtgttagtattcaagggctgccatggcaaagtaccaccggtttgctttaaaaaacacaatttattctctcacagttttggaagctagaagtcaaaatcaaggtgttggcagcaccacactccttctgaagactagagaagcctccttccttgcttcttccaactcctggtggtcccagtcatttcttggcttgtaggtgcatcactccagtccttcgtcttcacatggcattctccttgtgtttctgtgtcttcccatggctgtcttcttataaggatatctgttatactgaatcaggagcccacctgacttcagtatgatctcatgttaactgtatctgcaacaactctatttccaaataggtcacattctgaagtactcagaggttaagactttaatatatattttatttttatttatttgtttttgcaagagaggaacacaattcaacccataagcgtacccaataaatatgagttgaatgactgaatcagatgagtgtcgaactgatgtttctcatcaatacagataggattgactatagtatgatttatatgggagacaaagagctaaagtccaaggccaaggtgaaatatatgtgtccatatctataaatttaactgtggtttcaaattaatagaaatcctgttctcggcaactaaacataaaccagagtagagtccaacacaatcttctaggaatccctaccttcgtggtcaccatatcatctggagaacgtgtcaaaagaggaggagtttctgcttgcattccctaggaccagataagggaggacatattctggcaggaaaaggaacggacctcctatgacaaaatgtggtgggatcccaaaaaatttgctgaacagattagtatctaacatttttaaattcccaaattatttgatgtattaatatcatagattaatacatgttttctcatcagccttttcttatctttaaattctgcttaaattctacttggtttacaatgctggcatgtgagtgaggaggttaagagtatgggttctgaactcagctcctccacttactagctgtgtgaatttgtggcaacttactaaactcctctgtgcctcagtttcctcatctgtataatagagatgataacaatagtacctaccatagggctgttatggaaactgaatgagttggtttgtgtaaagcacatagaccatcctggctgtgtggtaaggattaagtattagcgactatttttatgatatgccaaccaacttgctcatatcgactaaatacattttaacatataaaggctttcacaatatttattattattattaaaacagagcctcttagcctgtcataagtggatcccactttcaacattttattttttgagacagagtctcgctctgttgcccaggctggagtgcagtggctctctgcaacctctgccttcctggttcaagtgattctcctgccccaacctcccaaatagctgggactacaggtgcccaccaccatgccggctaattttgtttcttgtgtttttttttttttttgctagaaacagggtttcaccatgttgcccaggctggtctcgaactcctcacctcaagtgatctacctgccttggcctcccaaagtgctggggttacaggtgtgagataccacgcctggccacaacattatttttaatcatacccaaatatatgataccatttccaggtgaaaccagaactaatccaaaggaacaagcagtccatgtgagagaattcttttaactcctctttgcagaaaagtcaaacctctctgtagtaagaaccatctgtttccattgatcaaagacacattattaaaagtccataattaacaaaatactactaatccacagcaatttataagcatccatttctgaaaataaaatgtcgacaagcagagagacaagatgtgctttgcctgatctaaggaaagatgactaacgtggcttaatttgttctgatttaaaaaaaaaaaaaggtttcaaaaccagcagaccatgtcataacaggaatattttgtgtcctggagagatttagagatgggctgatatcaagacgtgacctacttttctcatgacaggtctgcccctgaataatagtttgatttattgacaacaggatgatccaaaactgaaacattttctgcctctgccatcagaaagataacgtcaatccaaaggaagaacctgcaggtctaaaagctgtagtattttttccccagatgcagtgtacaaaatataacattcatttttaagtggatttctgttaaagatgtttattactctgaaatcttgtcagcgtatttgcaatgagcttaactaagcatttgttttttaaaaaaaaattcaaaaagtttttactgtgatctttacttgctattaaaaagatagtaagtttctggtcttctcctcgggtagtttttaatttttttcataaacataaaatcaaactattagaaagaacatttctcaaaattattaaggcaagagccatttattaaattattgggaatggagggttttttttttttttttagtgattggtctgtcttagatgctttcagttttagaatcattgttgtattcattctctactattaggtaacaaattaccttacacttaatagctttaaacaacaaatattatctcacatattttttgagggtcaggattccagtaagggcttagccaagtggttttggctgaaggtctttcacagtagtgtagtcaagaggcaagctggggctgcagtcatccgaaggctggactggggtcagaggatccacttctaagatcactaacgttcctcttggcaggaggcttcactcagttcttcagcagctttgggaagcctcagttactttgccacatgggcctccacagggccactcacaacaaagcagctggtgttgcccatgcaaatgatccaagacaaagaaaacaagacagaagccacagtgccttttatcacctaatctcagaagtgtcttttgtcatggcttttgtcatattttattggacacacagaccaacccaggcacaatgtgggagagaatgatacaacctgtgaatgccaagaggaagggattattggaggccagctaccacagtcatggtgatagataagatttacccataatgtagacgtgcaggggaggcatacatagttcacagcatttataatgaaatatattctcttctcaaagaatagaatggcataagaacattattttttaatgttattattgtcacattattcattctgttggtttaatatcattaccagagtttgctaacatttcaacaattggcatagcatttgtgaaggaccatttagacaattacaaagcattaatcaaactgtctactgaatcaatgaacattaattattgacagaacattccagagtatagtttatttcagaagagaaaaattgctttgtttccttatgacagcaaccaaaaaaactaaattaaaataaaattgcctgtctatttcttttactccaagttatttctcaaaacttttttgggtatgttttaggcatcttgagagctctgtcatttctttactcacattaaaaaaacaaatagggctgggcgcggtggctcatacctgtaatcccagcactttgggaggccaagatggcaggatcacctgaggtcaggagttggagaccagcctggccaacatggcaaaaccccatctctactataaatacaaaaaaattagccaggcatggtggtgagtgcctgtaatcccaactatttgggaggctgaggcaagagaatcatttgaacctgggaagtggaggttgcagtgagctgaggtcatgccactgcactccagcatgggcaacagagtgagactctgtctcaaaaaaaaaaaaagataaatagaatacagtgttgtagaagataaagatttgtacagattgaaccttgagacgatatgcctggactatactatctaagataacttctgttttctatctccaaactcatgttgccacaaaccaaaatgttcaatttccttttcatttctataaagccatgttttgacaatgtcttccaccagtgatattataatgcacagtctattttattttgtataagatgctaaccactcttcatatgttaaggccatctaaaaatgtaggccacagcattttagctctggaaagatccttggcaatttttatgttaaatgggttccacattttagaagagctgagaagtgttatactcaatgtgctgcctcctcatgttctgttttgtcttcaaaaatctgattaaaattgagaacctagtagtaccacaaagcagtattaaatcattgataaatattcactctatgtaatctccagaaaataccaacaccacttgctacccaatggttccaaagaattacaagaagaaatcaaagactgatgttgggcaggctatgtccttttgagattcccctacccctaacacacacacacacacacacacacacacacacacacgcacacggcagtggtcaattgattgtgcttctctgtaacattttttaaaaaaataaaacaaaattttttaaatgagcaaggttaaaagtaggagtcatgacaattataacacaagcatacctacactcagccatctttacactaaagagctaattttgcttagaatcagggtgatattacaaagtttaattctaaagtaaataatttttcttttcacttggcttgcaaaataacaatacattgtatagaactaatcttaaccaaggattacctcacacataattcctttctctgacattagtcccagctactttactcaagaattatgatacttagccaagattggacctgccatcagtgactgaactaaattttatttcctaagtttgattggcagtattaatattttatatttttcaagttcattgattgactagaatgtgcatatttgtgacaggataagttgttcataaaacctgattggttatcactccgtgctttgtgatctttccaatattttaaattaatattttgattcctacatattaccactgaattttttcatttactttaatccaaggattatctttgctttattttataagaaagtagcctctcctttccttttccaagtttttagtagtttctcaattctttaccatttctctacaaggatttctgtaaattaatcctctaggatacagtttttcttagagtgcacctatgtgaacatatcagtgtttatttaaataaattgtcttatttcattggttccttttctaattattgctttactatattcattagtaaaggcagtcccaattctaacctttgaaactctggcctctcggggtcacctactctaaattttgtttttatatttaataaagagattgttttagttctctgctgtgcataacaaactacccccaaaacttagtggtttaaaacaatcattttattatttcttaaatttctggggattaactggggctctgccagatgattcttctgctgatctcacacgaggtctctcatgcagcttcagcctgtgacagaaggggctagaatggccacagtaacttcattgtggccccttaattggaaggctgggctcagctgggacaccaggacaactgagcctctcttcgtgcaatctctcagcatggtctctccagcaagttagctgttattttacatagctactcgggaatttttttgaaaagcaaaagtcctggcttagtcccagagccacctctgccacattctcttttccatttcagagatgttacacagggaatgcatactggaaggccgtattgggggccatctctggagactagctgctacaggaatcatgttttccttttctgccactaagacctcaattcctttctgctcctttttcagttccctgtgtctctggtggtttgcctaaacctgcaaacatcaccttcttatccatcaacatgaagaatgtcctacaatggactccaccagagggtcttcaaggagttaaagttacttacactgtgcagtatttcatgtaagtttcttcttttccttttggctagcttacaaacacaagactcagactcttgtgaattgtgtaaagataaactctccgtggtattaaatgtgtttgaaaaagagaaaagttttagatatttcaggttaagttttcttgatgttttgtaagattaaattagaaaacagtttcttcatggagacagaggcattggggggctcaggcgaggcaaggttatttagacagagaaaagaagtttctaataataaaacattattaggtggctgagcaaacaaggcaatccatcatcttgaaatttctaagctgtttggaattataggcatccttagactccttgaaaccgcgtgcacatttggtgtgatcagctgttgcacttaaagatagcagtgaatagacatttcatctggccctcaaaactcattgcaagcaggaaagaatgcaagacagatagtcagtgtccatcttcagagaaacaaaggaaatggccacaaccctgaccacaaactaggaaccatccaagccaaatcttgtggaatctgaagaaaaacagctgcagaaactgaaggcaaacctacctacaccttcccagctccaaccacaggaaatgatttcacaaaataagtatcacagtgcaaagaggcccacctaacaatctgagagcatggaaatctaaggattgccaccaccagaaattaaggaaatgtccccatggagccccagctgggtgccacagaatatcagaggtggcgaaactgaaatagaaatcaggcacacaggacatgtccattgtggaggccctgtcacagcccagggagaagctgggaatgagccggggtcaggaggaaacggaggtggcactggctgggaggcagcccaggaaggctacaacatcagcctcctgcagcccaaaacctgagggcagacaggcttcacagggagcaaagggaataatggatttggtgagagggtgtttgatggaaacagaagtttaaaattatggagagcgttggccggacacggtggctctcacctgtaatctcagcactttaggaggccaagacttctggatcgcatgagctcacaagttcaaaaccaacctgtgcaacatgacaaaaccctgtctctacaaaaaatacaaaaattagccggtcatgatagtgcatgcctgtagtcccatctacttgggatgctgaggtgggaggatggcttgagctggaaggtggaggttccagtgagctgagatcatgccactgctctccagcctggacaataaagccaagtcttttcacaaacaaacaaacaaacaaacaaacaaaaattatggagagcaaaagctcattatctgagccctattcttatatccatttgcctgttcaacaaacagctggccccactcaaaaagtaatagtcccaagggaactagcatagcgcctattcataattactggaagggggaaagaagaaaacagaatacaagtttccagaaagctttgctatggaagtaaggaagaattaaaataaataacagtccataattttgttagagtgcataaacaacaggatctgtaaaggtaaaactcaaagaagagaaaacagtgaaagaagagtttctaagacaacagggagaacatgcttttttttaaggaagtgtgcagagcttaggaaaatgctggaatataaaaatactgtatcaagatgaaaaacctgttagagctaagtgatagtaatggttgaacaggtaataaaaactgtttggaactgtgtatcataaatgtgtggtgtgtctagaaaaaaattggtaaaaacaatagcaagacatatcctggtgaagttattggactttaagataattaaatgattcatggccattttagcaaaagcagaactcaagttgagagaaagggagaatttcaatctggcaacactcaacagaatatatcttgtgaggaaaagacaagtataacctaagactcttacgaagttcagtagactggtgtttggaagcaggtgggaactcaggagatcacttttctgagatcttcctggaggatgaggtggagcactaactaaagacgacctccagctaacagagagataaagacaaacccaaaagaagaacttagtgatgaccaaaagactggtagcatgcatggaattcatctcagtgtagaactaagactaaatagtgatggaaatgtaattatagaagtttcttagaaataatttgaatttaaacaataatataaggtggaaaagggggggggaactataagtgtactgattttcatagccagaagccattaaatgtcatctaaaatgacaatattttattattttaataattaacctctcaatatttttcacaaaccattttcttaatttaaaagctcttttaggaacaaatatgtcttgtggtgacaaacatttgcacttctgtagtttctttaatctcacttcaatttcttttttctatcaaagttcaaggcacattgaactgactacttttattaaaaccatatgtatggtataatctaatttttgtccatctattctgctatcatatcgtccttctgtttatacagaagcacaatgagatatccagaatcatacacaccaaatgttccagggtaatgggttttaggatgatttgtttctcttttgattatactttctgaattgtttgattgtttgaattaaaaaaatttaccatattttcaaaaaagaataaagtcagttttgtctttgaaaaaaaaattcagataactaaaaccagtgaaagacttcagcagcgactcacagtgacctcatttatctagaacctcattctcatttccaaggagtttctcaggagccagtgttagaggaaagaaatcactttgcagagaaaaggctcgtgagcatgtccttgcctccttatccattaggtggagcaaagagcttgctctgtcctttatgttttatgtgatccagaaagggatttttaaaaaatagacaagagtcatcactgcttcgtgtgagcagatcactcagattgtgcaacttttaaaaatatgtttttaaaaagaagcttgcgatgttggagttcttacatgcctgtgcatgtgaaagagggacaggaatataagacaatgtatttcactgccagagggctccaatctcagctctggagtcagacagtccccagttcatagccaggctatgaacctagctgggaaggttacagattatacttttatacttttgagtgaagtttgtttccaaggtgaaaattttccaaaagtttaaattctatccaccaaaacaattaatgcaaaataatagaatgtagcactaaaaacagaagttttggcgtcagggaagagtggttcaaatcccaggaatgctgtttactagtcatgtgaatttgagtggatcccttaatctccctgagcctcagctgtctcatctgtaaaatgggatgaaaataagagtacctaccccctagggttgttatgataattagtgagataaagcttgtaaatcagagaccactgagggccccatatggctgtttgccatgcgtgagtgtcattactggaatatttgctgagtgattctggtcatcattcatttattttgttgaaaatcttgtaaagagccttttctcctgcatcagcatctgtcatgggaagctgccttgcctttggcagagtgaggaagtttgaggagggaggggccacataggcaatggcaatagtcttcaagccacaattcaggactctttgatgactcatgaaatgaatgttgagggatattatttttaatggaaaggaatggaatggtgtggaatggactggaatgaaaaataactgaatgcaaggcatgtggtaaagtttaaatattttcttgtacaatttttgttttaatatgttagatagttttatattttgtgagctgaatcacaatataaaatgtatttttcttttccctgtggatcatggtcaaaaaaaaaaattgaaagcccttaagtaacagtgatcacttggatggagaagttgatcagtaagatctgactatatttctgatgtcttttggtaggtatggtacttaggaaatgggaaacatttactttcagaaatctgttgccatattctgaaaagagaaaatatccttaagctttggcaatacatggacatatcctctttctcaagacgcactcttcccttgacctttatgatatttttttctcatccctctttagttgctatttccaggtcttctttctatccaacctttaaatcttgacgctcctgaaattttatcctagactttattttgtttccatggatcattcattcatgcttgtgccatcaatgagcagtttgatgacattgactccaaaatccctacctcccacacacatgtctctcctgagacccattgcccactgggcatctgcagtgggatatctctaacatactcaggctcaaggcatcaaaagtgaacatcttatcttcccctcctgctctgcctccccatccatttcccaaatctgttctgtctcagtgctctttttcgtagtaaatatcaccaccattccacccatctgccccagacagaaagagacagcatccttaacaccttcatttccctaatctgttacatgttttctatcaccaagtcctatctcctaatatttcttgcttttgtcctgtccttatttatcctactgcccctgtccttgtccaagcgacctacatcttcccctggaccactgtagtgtcctctcagctgttccctaggctgccacttgtaacccatcacctttcccaaactgcctcccctgtccctttcactggcttatcacatgttacctgaactctacacttcagtctctcccacctgaaaagggctgaaaatattgccacctccctatttgctatgggggttgtgtttttaataaagaaaaggaaaatcagtatgaccaatctagtcaatattatcatcatcactataattatcaaaaatgcagatttctgtatgcactccagcctcatgtattttccctagaatcattgatacttagatttttatatgctatgagaacgtcaaagtaatttttcttccaagaaaaaaatgacaaactgttcttcaaacaatccgtcaaactgacctcgtgtacatagtagactaaaaacctacacagataattactagaagaattgatcacacaatatgtaaaaatttcactgtagccaaagaataacagtaaaatatatgcttccaaaatatactgtccacattataattcacagaaagaaaggtgattacagaaactctgactcatgttcctgacagctgatgaaaaaaattgcccgccgcaaaagtggattcttttttatctcaatgacaggcacttttgtttttctgaagagaaggtcgtcagttccattcagttttataaaatgactgagtttttttattgtaaagtatagagggcacctcattattaattcagcttctttcttagcagatatgggcaaaagaaatggctgaataaatcagaatgcagaaatatcaatagaacctactgtgatctttctgctgaaacttctgactacgaacaccagtattatgccaaagttaaggccatttggggaacaaagtgttccaaatgggctgaaagtggacggttctatccttttttagaaagtaagtaatgccattattgcaatggtcagttaaacatgtattcatatcaggtttaacagtctcagcctcacagacagccttgcccagaggaaggtactctgcttggctgtattctggaccagtgggttgagtgagcaggacaaagtccttaaccttgctggctctgagtctcaccttgattgactgattgattgattgactgtagagacagggcctcattatgttgccaggctggtctcaaactcctgggctcatgctatcttcccacctcagcttctcaaagtgttagggttacaggcataagccaccgcacccagcctgagtctcatctttagagtgaaaggtttaaccaagtggtctctaagatctctcccagatccaaaattgatactagatgacaatgatatcaaattttgactttgtcttactactttgtggaagctatgtaatttgaggaacaaaatgactttatttaatgtgggtttatggactattaatgtctccacaagattgattaaacattgtcctgattatccactatgcttcttcttgtatgaacttggtagtgtgatgatgtaatttccaagtgtaacccagaattaaggcaacttcttcctggtatttacttttaaaatgttgccatcccctgagctatggctgactcagtcatgaaggacccactcagggctgccataatgagctctgcaagtgctccataagtccaggagcccttccggatcagaggtcagaaaactacccttgggacaatccaacaacaccctttctgtttttctacaagccaagagttaagaatggtatttatatttttaaatagtttctaaaaatccaaggaatattttgtgacattggaaaagtaaaggaaattgaaatgttgatgtctattcataaataaagttttattgggacacaagccacactcatttgtttacacagttaccttagattgctttcgcaatacagcaagagtggagtagtgcaacaaagatcatatggcctgcgatgcctgaaatatttactgtccagacctttaggataaaagtcgcctggtctctgttctagatcattctaatcacatctctgattttccacttatcaagtcatgttgttgtcatttatcaccaacttttcaagtcacagaaatcttacaaacagttttgattgtattaaccatctactgtttatgcatgtgactaaggaaacagaatacttgagtttgctgttctaacatgggatcaggctgtgtgaaggttggtttcaaggttggtttcaggatggtttcaagatctggcatatctcaggcccaccttagtacattttggggcatctcctgtaagaaggtgtcttttaaggctgggcgcggtggctcatgcctgtaatcccaacactttgggaggccgaggtggacggatcacaggatcaggagttcgagaccagcctggccaacatgatgaaaccccgtctctactaaaaatacaaaaattagctgggtgtgttggcgggcacctgtaatcctagctacttgggaggctgaggcaggagaatcgcttgaacccaggaggtggaggttgcagtgagccgagatcatgccattgcactccagcctaggcgagggggcaagactccatctcaaaaaaaaaaaaaaaaaaaaaaggatgtcttttagggccttgatccaagtaggattatatggtagctttacctaaggtaatttttcatctgaacatgataataccctctttctccccctttaagcacaaattggcccaccagaggtggcactgactacagatgagaagtccatttctgttgtcctgacagctccagagaagtggaagagaaatccagaagaccttcctgtttccatgcaacaaatatactccaatctgaagtataacgtgtctgtgttgaatactaaatcaaacagaacggtaagcctgaaatggaatggggcatacattcatgtaccactctgtagctaatgtgggaacaaacaaccctgatgcattgattctctgcatgtgaatctgggaagtcatgatgttcaaaagatacgccgcacaaaataaagttctatatacagaaattttacagaactaacttcagatcttctttacagaaactctgttgacaggatatggtgttgttattggagtgtagagagattgtacacttcactttgatgaagagctttcacttgcacagtctttctctgagaagaagaaaaaaatgtgagcaaggacccaggacaatgaataagaactctatccatgtgttgtttagaattgttctcagcattggtccagttcctgaccatgctctgctgagctaaaggaaaagagtatattgaaactgttgctgaaaaaaaaaaaaaaaaaaaaaaagcttatactgatagtaaagaattaaatggtgccttggtcttctatttccttctacagttatttgtctggggtggtcccagaaatgtctggctctaaccaatgtttgcaattccctatcctagtggtcccagtgtgtgaccaaccacacgctggtgctcacctggctggagccgaacactctttactgcgtacacgtggagtccttcgtcccagggccccctcgccgtgctcagccttctgagaagcagtgtgccaggactttgaaaggtaagctttaaaaaatctttgctggtctaggaaggagatctgctaaaactagaagtcggtatgatggtttagacaaggttttgacaaatccgtgtctaacagaaacaggttgaggcaaaggcagaaacaactaccaccagaaatgcgtggagcagcctgggactctgccattgagcttggccgacgttcagaagtgttctcacaccctcggagaactcatacaggtcccgtgtccactgccagcttctttccatggtccttcggccacctgccttgtgaattaacaatgaagaacttttacacatgccttttttcttctttaaaatcataatcacgctgggcatagtggcccacacctgaaatttcagcactttgggaggccaaggagggaggatggcttgagcccaggagtttaagaccagcctgggcaacatagtgagacctcatctctataaaaaataaaatcaaccaggcttggtagtgcatgcctgtagtcctagctactcgggaggctgaggtgggaggatcacctgagcccaggagaggctgcagtgagccataggtgcaccactgcactccagcttgggcaacagagtgagaccttgtctcaaaaaataaaaaataaaatcataaccactctgattgatagaaattctgtggtcttcaagaacatcagacaattttattgctagaaacaaagcgttattctaaaaccactgtaaagcagaattcattttttactttccctggggaatactaattataggtgcttccagttgtgttcaagtgccactaattggctgcatgagggtctgggatccacaaatcagtgatcacttccttatccttacagttgcttctctctatttccttttatttatctcctcttcacattttctacactgggctgccaaggaaccgtgattggagatacccattcctatgagaagacatagagttgtgagcttggcatttgtttaatttttctgccttcacagtgagaggagctttaactaaaaacttgaaaattgaaaaaaaatacatcctaaagtttgcctgcatcgaagggctcttcatccattattcctccgcttcttttccaaacagctggtctagagacagaggcccacgacctccaccccatgccttggctctatcaccagccatggataggaatccataacccctgctttcctcctccctcacccctcccacctttcacgatgaaactgtccgaaagtaaagaaagggaactttgtgagtacatgtgaaaagcgcaaggctttgcctttgactctctgtctttatcatagcttttcttttacaatgaaggagtctctaccatatatcaaatgaaactaaaatgccaagcaaaacaaagcatattgaagaaatcgtatttgtatttgggagaagtgctctctttactaacaccttgatcagtgccagctggtgggaatgaatttccagtggaaatcattaacacaattggagcaaaagcaacaaaatgcagattaaattcaaaacttctcagtaagcagatgaagcccactttctcactaatatgaaaaaagtggccaagtgcaatggatcacgcctataataacagcactttgggaggccaaggcaggagaatcacttgagcccaggagttcaagaccagcctgggcatcatggtgaaaccccatctctactaaaaatacgaaacttagccaggcatggtggcacacacctttagtccaagctacttgggaagctgagatgggaggatcacctgagcctggggaagtcaaggctacagtgagccgtgattgtgccactgcactccagcctgggcaacagagtgaaaccctgtctcaaaaaaaaaaaaagaaagaaaaattaacggaataataaggctctatttctggttctgaacccgtgctatcccagctgttagaccaccagagatatctttccaacacactggtgtgaggacctgctttctgaataatcagtattacctctattggaactattctttaaaacatatttctgctctctcgtcccccatccctaaaatacaattatagtttattaggtttgttgtaataaacatgggttagtgtatactaaatgctatcagtcattgttatgacttttttcaattaggacaggctcaatccagggaccagggattgtattaagagggttggactgagttataggctacaagcagggcaggtggtgttctgacacccgcagcatccgcatcacagcattggcacgtctctgtgtggaacctggtgatgaatgtgctccttgggaattgtgcagggtaacaggcccgcatgcggaacttttcccaccggctcttgttgaccaccctcatcagccatgacacatctgtttcgctttcaactggatagttaaccagatagtgactttgctgctttctcttgggcccaagcatcaagagcatccaacattctcctggattagaatgctccggtcacactcctgctggttttgttagtgtgtaaggagcacactcggacttttgtcatttgtgctgaagctgctctttttcctacagctgtatcagtcaggattctccagagaaacaggaccaatagaatacatatagatgcacatatcgatacatttatttgtttagaaatattgatttattttaaggcgttggctcacaggatcgtagaggctggcaagtccgaatttataggataggcaggctggagacccacggaagagttgatgtttgcagttcgcacccaaaggtagactcctggcagaattccctgttccttagggtcatcaagacattttttatgaaagtcttcaattgattggatgagactcacccacattataggtagtaatctgctttactcaaaaacctgctgattgaaatgttagactcccattaaaaacaacaacaacaacaacaacaaaaaccttcacagaaggctctagaataatgtttagccaaatatctgcatactgtggcctagccaactggacatgtaaaatgtaccatcacaacttccaagtataccacagtggcttaacaagtatgagctagtcacaatgagctctagtcatcagctatatggcctgattaatggtgtgggccagggctgcttttattaaaacgatttcccaggtcttttcatttcctctgcggacttttactcatcatgagcctacagcacagcaggcccgggaagggagttaactgccattcgcactgcaccctgtccagccacctccctacacacatccccaggctccagccctacccagaaagtccagccaaacagtgcaagaacagttctgctactcatataaaagtggcgtcatgcattcatgtctttcagtgaacatgcagaaagattgagtcaaacaggtggcgtggaaaagtggagcaattcaatgggatcttcactggagggttttgttgtttgtttgaaattctgtgacttacttgaatatcaaatacatttactttgaaatataagaacctgcatgaatctcatagccagacatacgatggtggaatatgtgctgacttggatgattgatgtattcttagtgtaaacatttgaggtacactcagatgattccttcagactgtctcttgtcagggagagtaagaattctgagaccgcttataacatttagcttaagcttctcaacgtagaggtgagaaaactgagttcccaaatgtaagtgatctgcacagaagcagcttaacgatacgaggtttttcccatcacatcaaatcacaactatctaatcccttcccccgaattcccaccttttttttttttttacagatcaatcatcagagttcaaggctaaaatcatcttctggtatgttttgcccatatctattaccgtgtttcttttttctgtgatgggctattccatctaccgatatatccacgttggcaaagagaaacacccagcaaatttggtgagtacttggtgtggcagggttctttattataatagtacacctccaggaggacagaagaggaggttctagaacagattcagttccctttaagggcagagtgaatttaaagttaaatagctggtgaattaaaaaacagtttctgggctgggcatggtggctcacgcctgtaatcccagcactttgggtggccgaggcagttggatcacttgaggtcagaagttcaagaccagcctggccaacagtgtgaaaccccatctctactaaaaatgcaaaaattagctggatgtggtaatgcatgcctataatcccagctactcgggaggctgagacaggagagtcacttgaacccgggagaccaagattgcggcaagctgagactgtgccactacactccagcctgggtgacagagtgaggctctgaggctctgtctcaaaaaaaaaaaaaaaaaaaaaaacgctttctggattagctgactaacagaacattttccttagctttgaaaagatgttctatttaaccaccagattatacaaggtcccacagataaattcaatcatgatccctgccctgcccttctagaagttcaagcctagtcgaggactagaatttcaaaataacacatgaaggctaagatgagagcaggcgctgggaattctgggggtacaaggagggccccaaaaccctacacaggggctcagctctcatgccagggcttggctatgagaggtgagtaggagttaggatccgtagtgcaggcagaagaaacagcaaggtggatgtgtggaaactgcatgacacccctaaacaaggaggctccagatgaggagctagagaagaagatgagactggagagtaggcagtgggtccaagtaaggggagagctggggtgctgttctaaggagctaggcctcattctactggcaaagagaaatctccatagggttttaggttaggagcatcatagtcagtatcaaggtttagatccaaccagatattagttccaggaaaacttagagcggagtaagactagaaacaagaaaagcacctagggaactgtagctttgtccaggggagagaagattcaagtctaacaggcaagagtgggatatcagtctagagagaaagacatggaatggaaacacacttaggaggaacatggccatgacttaatccttcacagtaagaagaagcaagaaagaagaaagaattaaacccacagaggtgggacaatgtgctgaagggttctgaagggctgagcatatttttaacaatcaaaaccattttcttgagaactattaaaagatgtgttcacgtgtacatgataacataccttgtttcctgttagttcagtttataagtttttctatgattctgcctgcattcaggtttcagagttggcttcttaatggcattgggagaccttttctggaaggaacattcacaggagaattgaccacctgtgatttttttgaaacttaaaatgttgtaaaagattgaggctgaaggttctgttttgtaaagttaaatgaaatcacatggtagagtgacaatgaggattgtaactcatgctctcttagataacaggtatctttcatggtacccacagcaatattttaatctcatctgagcttccttgacatgatttagagtttctctgtctaccgtaaactggcagatgaatttccttttttggctctattatagcatgataagaatggtgtaaggggtaaaaaccatccctgctcatatatttccctccttttctacatccagttctcatgcctgtctgcatttcaagtatatccaaaaacagggcaggtagcccaggtaaccacagcttattaacaagtgcatagcaaactataaataaaacagtgtcacaaactctgccacacccagtctttgctactcttcatgtggctgagattctgactttacagaatgtaaaaaaggtcaagaaatgaagcaactcctctgccagttagaagagggggcaccaacgccccagccccagccctggactggagaaatacccacccagcgaatcacttctcgcttccaactatcttttgtgtgtcttgggtctcttgcctcccagtgagtgaggttttctgtatattgcaagcataactttcatttacatgagttggtaagagtaggtctttaaaactgtctggtgacaagatattctacctaacagctgtttttaatgtctctctaaagtgaaaaggtgaaaatcattctcttttctctttatagattttgatttatggaaatgaatttgacaaaagattctttgtgcctgctgaaaaaatcgtgattaactttatcaccctcaatatctcggatgattctaaaatttctcatcaggatatgagtttactgggaaaaagcagtgatgtatccagccttaatgatcctcagcccagcgggaacctgaggccccctcaggaggaagaggaggtgaaacatttagggtatgcttcgcatttgatggaaattttttgtgactctgaagaaaacacggaaggtacttctctcacccagcaagagtccctcagcagaacaatacccccggataaaacagtcattgaatatgaatatgatgtcagaaccactgacatttgtgcggggcctgaagagcaggagctcagtttgcaggaggaggtgtccacacaaggaacattattggagtcgcaggcagcgttggcagtcttgggcccgcaaacgttacagtactcatacacccctcagctccaagacttagaccccctggcgcaggagcacacagactcggaggaggggccggaggaagagccatcgacgaccctggtcgactgggatccccaaactggcaggctgtgtattccttcgctgtccagcttcgaccaggattcagagggctgcgagccttctgagggggatgggctcggagaggagggtcttctatctagactctatgaggagccggctccagacaggccaccaggagaaaatgaaacctatctcatgcaattcatggaggaatgggggttatatgtgcagatggaaaactgatgccaacacttccttttgccttttgtttcctgtgcaaacaagtgagtcacccctttgatcccagccataaagtacctgggatgaaagaagttttttccagtttgtcagtgtctgtgagaattacttatttcttttctctattctcatagcacgtgtgtgattggttcatgcatgtaggtctcttaacaatgatggtgggcctctggagtccaggggctggccggttgttctatgcagagaaagcagtcaataaatgtttgccagactgggtgcagaatttattcaggtgggtgtactctggcctcttggttcattattttcaaacaagcacacttgtacaattattttctgggtacttcccatatgcacatagcactgtaaaaaatatttcccaaagatcactcattttataaataccactttttcagaattgggtttattgcgagcaggaggagatacttaaaacatgcacatataccaggttggtggtaagttggtcacatgtgaaaacctcaactatttaatcatcatgattcatattttgagtgaatacatcaggcacagaccttcatgatatcacacactcttggctactttaagaggccatctttaatactttatgagtagttctggagtgtaaacataaacgagtattcttttgtagtcagaaaagtgtcctctcaataatttagtaggggcttattgtctctcaaaactaacctaaaagaaaatgacacattttataatagaatattacatttatttctggaagtgtgttttcaaaaagatatttacatagtctgtaaactagaaagtgttaggtaaagctctaggttactgtgttactattataatattaaacattcgaataggcagtcgttcaaagactctttggaatatctatgaatgaatatcctctattcttataatattaaaacccataagtaaatataggacatacaagagaaatgagttaaatgactatgtaagggagagtttattaaaatttgatgaaatttactgtaggaactaaactatgccataaaacaatagctttctagttcatttccagtaactgttcccatctcctttaccacttgttaagaaaattaaattcttcagtcacgctgctttaaaatgggacaaaatctattaagttgaaccatatataattgtggatatttggctgtttttaatctgacaagcagtaacttcatatggtttgccttaatatatatttgttttagtcatgaactcataatccattgatgctctttcatgagaagagatatcacccatatttccttattgatattattggtacaggcagacaaccctggtaggagagatggattctggggtcatgacctttcgtgattatccgcaaatgcaaacagtttcagatctaatggtttaatttagggagtaattatattaatcagagtgttctgttattctcaatctttatagaaacgattctgctggttttgaagaacagatgtattacactaactgtaaaagtagttcaagagtgagaaagaataaattgttattaagagcaaaagaaaaataaagtgattgatgatagttctgcttattaattccattcacaaaatattctctaagtacctaatatgtccttcagtgtcctcatctgtgcaatagaaataagagctgccttagggctgttttgaggataaaaagagttggactatagaaggtacttagacctgtgctgggcacatagtgagtgctccctaagtgtttgtcatcatcatcattaactgccaggtcccattactaactgccagaaagaaacgccatttaaacatacaactattgtgattcaaaggcagaccttgtctaactctgtttttcttaccagagagtaaatagtaatttgcttcctactttgtgccctcagattgaaatccttcagtgattcagccacattatctggcttcgtaaaaggggaatctaattctgagttgcttttacatctcttgttattccaagcatgtcagaaatattgagcattctctaattttgctgcttcagttctttgcaacttatgtatatattgaacctatatatatacacacacattcaaacatgagcatacagtagatatttctcatgggggtggcgacatcttcttagatgcggtatatctgtgtgggaggcagctgtcatgcatcctgttcctcctgtggccacgcctcaccatctccaagaagccaccctttggtccgcttcagattccatctctgtgcctgaggttcaagtggagctgagaagttgaagtttcagagtccgacaagtatagttggtcctctgtatctgtgggttcagcatccatggattcaaccaatagcaaatcaaacattcattaaaaaaaaaaaaatccacaaagttccaaaaagtgaaccttgaatttgcattgcactgagtactacactgaatgcacttaaatgaagtgatgtctaggcctattgggcattacaagcaatctagagatgatggaaagtatacaggagaatgtgtgtaggttatctacaccattttataccatggacttgagcatgcgtggattttggtatcctcaggggtcctggaaccaatccccagtgaataccaagggacaactatgctgttcatcttatccctgatcattcccaggattttatataccacttgaacattagttaagttttccttatctaatagaaataaaaaacatctattagcagctccatttccacaccccataaatcctaaacaactggtgaacgaaaataccacctctacaaagtaagtgaaacatagtgccatgtcttcctctcaagaaggaagtgagggaagtgaacttgtcactggagcccataacatgggaaagatttggtgcctgcccatgccgagcccaactggaaggaaatcagtgcagagaaaaactatttgtacagcccagagcacaagaccgccagcttggtaaatctaatgagaacattaaacagaggattggttgtcatggatgggtacccctgggtcattaatcaagttatttctggcccacacattaccacccccacatcttgcagattaatttttgctaaattatcttagaagaacttttcctttttaattccccacattgtgtcttccataaacctatctacagatatttttcaaagattttgctcaaaagcatgtacctataatttttaaaataaatagtgctatggttatgggtattttaacaatagcttttatttttattatagaagatatatattaagatatatgtatacatattcattgtagagtaactagaaataaataggggaagaaagaaaaattacctataatactgtcacccagatttaaccaccataaacatatttgaatagagaaatgattctcaactgggagaatttttgtcccccaggggatatgtggcaatgtctagaaaatttttgatcgtcaccactcaggaggagggtgctgctggcatgtagggggccaaagccaggaataaatactgctaaacatcctaccataacaaagagttatccagcccaaaatgccaat

SEQ ID NO: 17374 - DNA, 84227 bp, Human
aagtagagagaggccaagtagaaaggcgtattttaagctttctcagactcgtgactttaaccattaccggttgacagcaatacttgccgacatcatctcaccttgcttgcggcatatcagattgctggagggggaagtgcttcactttctctttcagatgcacagctaaattgaacttggatgaattaaccatcggtgaaactttgtgcgtgccctacggctactttctgggacttcagatttttagagatataggagtgaaaaggagaattttacaccttctctgagtctggaaggacagacattcccctaaagtggctaaggtggtgaagggcagaaagattggaagtcaggcccacagcagctcgaattattccgtatttatctagctaagctttgctgagcaggtgtgagccaattacatactctttcttcccccaccccccagcccatgattacgtagggattctatgtatccttcgacctcaagcagagaagcccgagcgctacgagggctggtccagatgttttagttattgtacctgccagggcaacctcccacgggggttggcctcggtagattcctgaggatcaactggatcagcgtttttctttcccacggaccctgaagttagagcatcccagcatggcttggacaggcaaagctaaggggtcccaggcctgctcaattgctaggaccacgaaggggccttgagtgccgtttgaagtgacaaggctctgcctgggcagtcaggacactcttgattttaactccgattcagtaggttttccccaagactcagtttccctttcctgtgggatataaactcttcctttcttgctcctccacagctcatctcctcctctccgccccacggtgcggtgtgggtcccatccactggcactgtaaaccctcaggaccccggggcgctgggatcgcagcagctgcccccgacagcgctgcaggcaccagcgaaatgcgctgcgcccccacgcacccctcagggagccgaggtgggcgtgactgtaaagcgggcgcacagagcgcagatcgcgccacatcggcctcggcgggctgcggctgctccccattcctccgccctactaagttcctcgcggccggaaggcacaaaaggatgtttcagggcggggtttcccataccccgcagccttccccggatgcctccttcccggctcggagttggaagggtttcctcagggctctcatttcctgcagcccggcgcctccacgcgggccagatcccgtctctgcagcctccccccggcccgcgcccattccccgcccccaggagccgggcccggacgctcccgggaagcagccgccgtctccggggccgggcgtggccgggccctccccgccgggttcccgcccgccgccgttccagtcctcagccgcgccagggcgggggccaggcgagttcagcgccagcaacggcgggggaggagggcccgggagccctcccgggctgcgcggcgccggccggcggtgcagtcgcgcgctcgccgccagcgaagccattggctcggcgcagtcaccccacgcggggctgccgcggcggcctccgcggattggcgcgcaggcgggcagggaccggggcgcgcgcaggcgagtgcgtgcggccccgaagccccgccgtctcggggtgccgcccttccccccggccgcgacgaccacccctccattgtccccgcgtggcccaggccgcgcctggggccgccgccaaacccggtccccaccgccccggcccgaagaaagcgcgcgaaaggcgcgctcccagcgcgggcgctcgcgccgcctgccgcccccggccgttcactgccgcatttcgcgctctcgcgccgcgccccgccccaccggcctaaatttgcatatcccaggatcgcggccaatcgctgctcgtctctctcgaagcggatggcttttgcctgagaggaaagggagtggctggcggcgcatgcgccacggtggccgacttgaaccgaggcttttattgctgtagtttatttccacccccttccctcctgtttctctctctccttctctctctctctctctctctctcttttttttccgccctagctggggctgtgttggaggagaggaagaaagagagacagaggattgcattcatccgttacgttcttgaaatttcctaatagcaagaccagcgaagcggttgcacccttttcaatcttgcaaaggaaaaaaacaaaacaaaacaaaaaaaacccaagtccccttcccggcagtttttgccttaaagctgccctcttgaaattaattttttcccaggagagagatgtcttatcaggggaagaaaaatattccacgcatcacggtgagtttggtacttgggaaatctgcggtcggccagccaccttttgtagcacagaaggtctaaggaatttttaaaaaggaggggaaaggagagggaccgaactttttttttcctttctgttgctaacggaggcgatggtgatggtggtggtggttgtgggagatgcagtgatccaggattagaagtcgcatcgtttgcaaggcattaaacaggagcgcgagtgcacgaaggtagccttaggtaacgcgccagacccggtctatcttttattgtcagtgagagatgctgcagcgtcggcccgcggggtgcaagcaaatggatgccagattgaatatgcatgcctggagctcggatattgttctctgggctgcgtgctgcgaggctggactcctccagcagcgatggggagatggggacttggatcctccccgggtcttccgcccccacccaaaaagggctttctggagccttctccgggtccttggaaaaaggagcgggtttgagccctaaggcgtaatgacagcagagggatgctgaaaagggcagggtgtaccggaatggtgtggaaacgggaaggaaaaacagggacgaggtgatgagcagaggaggaaggcggggggcaaggcgggggcttcttgttggccaggaaccggttttgggtgcccccccccggttttctcgccctgtagttcggggctggggccctggcggggattcgggctctttttcacgtctcttttccgccccttctgccgctcaggaggcgtccgtgttggtgcatacaaagcggactgcagggtgggcgcggggaccgcggcgagcggccgggcgctaatggcgctgcgcgacgcgggagcagatggcccggccccggccagacaatgatcgcggcggccggagggctcggcgcagtgctggggcctggacttgttggtttgcaaaccacggggaaaacgtctgtgccgtgaattagcgatgcctcagagatcagcaccagtcttgctcccacctctcccctgctccctccctctccccatcttttcctggaaaaattcgttcgtcctattctttccatccccagtgaaatcccagggaggggggaacaccagggaaattcattgttatataaggatgtgcaattgcaaccggccagctgattcccgggtagaacctaggactgaggcagagatcgaaagagccttttaaagcagtcaggatgtgtttttagggctggatataaggacgctctttggttctggttttccctttagccatgggcaccccggcttcctctccgtgcacaagggcacacccatccgcaggagagagaaggggagcaaatgcataggggagggggcgtgtgctcggaggattttctaggatgatctgaagaagggcgctagcttcttcttgaaggcaaaagacccaagatcccaaagggccgggcacggggcacccacccttgtgtgttcactgtgctggaggaaggagtggtgactctggggagggaggatggaaagcagatttgcagcaagcctcaaataatttgctgtcttcgtgaatgaacaaggcagcttcattttgacagtgtggggagaaaaaaaaaattaaaagcaaacgatcaacaagacttttttttttttttttttttaaagagcgcccccccccccacaccctttaaaaaatctggttgcattatcataggacctatagcatggtattcctccctccctcaccactggcagcctcttatgtaagagccttctggaaggcactagagtgaacgggggtgtggtgtttcactttttttcatggcatcatgttggctcgggatattcgcggtgatggctggggcaggtaccacagtgactgtggaggcaggaggtgaagggggaggcctctccttgccttccaggtgatatttattccatggaagcttagagatctgggagagaagtggaggtcattgtagacagaggacaagtgcactgatttgagtgacctgggcaagtggcctaacctctctgagcctcagtttccttatgtgtcatgggaatagaacctggcctcatctacctcacagatttctttcgaggctctgatgtcatgatgtgcacggctttgtaaaggtctttacacttaccttatacaggtgcaggaattattgttggctattctcctttgactttccaaagtctacgtgaggatcagggaccctgcagtgtacaaaattaaaatgatcttattggttttcagtatgttagagagacaataaatactttctgaaccaaggtgtgtgtatttatgtgtaaaattatcttttttccttgctctctagtagcttatctcttttttaaagattttctatgatttccttttcttggtagctgctaaagagaggtagcacttgctgagaatattgttttgtaactgaattttgagttaactattgccaaaagaatgtcattctttgaaatgtgttgcatattaaaagggcaatgtatggttcagcttgccaggtttaagcccattctgtataatacaggtgcatatttactgaacactcgatgccagcattccttccatcagcagcatttgcaataacgatgagtcataatgtagcatttctgtcacattctcagactttatctgctgcttgtcctttattttttagcataaatatcaccggttaaaatataagtgcatcagcaatctgtagtgcattgcatcttagaatttgctatctcagatacttattcgtgggagtttacctttttcttaacagcctagttaaaatggcatcaatggcgtattttttgtagtctttttgctatacttgctgtgatttacctcaaagataaatgcaaatataaaggacatattgaatggaaaccttgctatggttgaacccagtgtatttgtgtggtatatcccgtgacagcagactttttggtcaattgtgcttgcttgacacagtctttccaagacatggctttcctatatgtaggtggttttttttgttgttgtttgtttgtttttaaattgaggtttagccaaaagccattttaaaaagtactatcttctttttttttttttgagttggagtcttgctgtgtaacccaggctggggtgcagtgacgtgatctcggttcactacaacctccgcctgctgcttcaagcaattctcctgcctcagcctcccgagtagctgggattacaggcgcccaccaccatgcccagcccattttttgtattttttatagagatggggtttcaccatgttggccaggctggtctcaaactcctgacctcaggtgatccgcccatcttggcctcccaaagtgctgggattacaggcatgagccaccgtgcccggccctatcttctttatatgaaataattttcactgctttttttttttctttggagtccaaggtctaattgaaagagatggttcgtttatctaggataagctgtccctgtgtgttctgactcatcaggtgatgaataggttgccacatacaggcttacctttgtcactgaacctttccaaaatgggcttattttgaacatcacttttgaacagtgaaaatgtatccttagctcacatatcttagcacctgtttctcataggtcagttacgcgttgtgaccttactgcctctttgtttcagagcgatcgtcttctgatcaaaggaggtaaaattgttaatgatgaccagtcgttctatgcagacatatacatggaagatgggttgatcaagtaagtgtaactcatgatatacagatgtatttgaacactttccagacttcccaagtattagataccattcgcatccaaagtatcaaacttcaggaacatcagagagtgaccaacttagtatctgttttaaactggttttgattggtggtaattagtgaatttgaaaactcaaatttagggaattcaaagcaacaattaatgtacacccgttgcattaggtattatgtaatttactatttttaactgaggtgatatgatatctttctgttgccagctcaaatacttggtttgtgatatgttgaatatattaaagttttgcctagaatgtcattgtttgggttggattgcccaaaggacgcaaacgtgaaagacagtctcctctattgagacagcacatctgctttcttcatcaagaatccaagttggaggggccaaagaaagataccaagttaattactaagtaatacagacaaattactgcctaaatcctgagggaattttaggttttattctaagtggcaactagtgcaaataagactgcccttgtgtttattgtgttaatgttacaaaggagaagcaacagggcagttcctgagtttgggtatttttggacgccagagggttaaggaagctgagttcatcccagtatctgcctgccctttctactggggtagctcccggggctctggagaaatagcacatctgtttgaagacaaacactgcagccagtgacagcttttaaataagcagcattcatcaagggatagctgtaaaccggtccagaggagtggaaaactggagtggctgtgactgttgcctgggagctcacacccagatttatgaacctaaaatagattttaacatttccacgtttaatgttttctccatgtgtgtttgctgtgacagtctcagctccaggctctcaaatgccatgactttgatgttccattttcccccaattataagatggcacgatctggtctggtagaatgacactggcccagaagtgtgcaggcctgtgtgctgtttttactcatcactgatttgttctagaactttatcaacttctcctagattaatattccttttaaaaaattggtagaaagatataaaaatattttttaaaagttggaaatgaatcatgtctcccaacataatgaatattcatttttctgccttttaaaattatatttcagctgttagctttttcattatctgaataactaaacacacgcttccaaaattttaaatcattgcaatcatagtgttcactttttttttttttttgctttgatttgttctacctcacccttccacccctattttccttctggtgaaaaggatatgataaaaataaatgtttggaaagtacggccaggtctggagaaaattgctataggataattagctcaattgcaagtgctgtaaagaaagtttaatgacagttcttagaaatatcttggggccttgttatcatttgatcttagggggtttcttgggaacaaaacgtctttgagtggggcctctggtgccttatttaacttttgctttctagtatactctgcattgcctcttgctggggggtaggagtatatagtgttttattatgaatcgtaacaatgatctgaaaagcccacggcacagagcggaggatagtttataggttagtgaaagtagctgtcagatcccatttgagtccacgtttcatttacaacccttatcaccaaccctgtttatttaggcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcagtaagaagcttaaaaatcatcattgtagtgcttaggaagtgtgagagtttgcaaataagtctattgtttgattctctccttctaaaacttgctgtcctgagccacagttcaatctaccaaataagggggtgaggatgtgttaaccatttgtcttatttatttatgctcattttctgtcaaattttaagttctcccattgaactagagaatatggttctaaggagtttggtaagatgaatgacttcttgctttctctccatgtggacttttgtcttccttgaccctagaatgtgatttggttttgaaaacacggcatttgaagtcatcttcaatgccaccaactttaagccattgagcataagtatttgattgagattttcagaaaaattcctaagagtgcttctttttagaatgaggatgggctgcaacaaatgaaatgctgaagcaggaactcctgttcctctgatatgaaaatcaaatggaggcgatactctctaggctgagtttaacataaaaggaattgggcagccctgtctggagggggacccacaggtaattgtcttttagatatgaaaattgctgacacccacagctgggtgccccttacgtattgctccaagggctttgtgctttttttttttttttttttttttgagacagagtttctctcttgttgcccaggctggagtgcaatggtgcaatctgggctcactgcaacctctgcctccccggttcaagtgattctcctggctcagccacccgagtagccgggactacaggcatgcacccccacgcttggctaattttgtatttttagtagagacgggggtcttccatgttagtcaggctggtctcgaactccccacctcaggtgatctgcctgcctcggcctcccaaagtgctgggattacaggcatgagccaccgtgcctggccgctttgtgctttttgtttaactaaatctgaactgtattcacagcactgtgacacagcacacataatattaagagtttgcttgtgaactgctagattccagcatgcccactgattgtccttttgaaaaatgtcattttgtttttgaggaggtgggcaagctgcatagtggcccgtcagatacatattttaaaaaacagattgcatccaagagtgacagtcaacgtggagtctgtcatatatgaaaagatagcagttcagttcagaagagggtctaagtagaaagaacttagctgtttctgctatagaaaaacctttcttactggttatttttccgagtggtggtctttttgcttgtggctttggggtctatctggaagcttcttttctatcttgcctgagctagaggaatgttgccctgccatcccctcctagtctgagttcccccgcattttaaatcacaactcatcctctggcgttctctctgtcctggtcctcagggtctgaagcatcaggaacagctctctcctgtttcagctttcttggcaccactgagaaaagcctccaagtgtaagccttgcgacttgtgtcttgctgtacatgttgccctttaacctagtgggtgccattttccagggatgtcggggggagatttcatgcacacctagggagagcagagcctgcaccttgtcatttgctggggaatcactggcacctgtgggcgtttctgcctctcctccagggcggactgtggagaaacacttgaacttggagaagcttagactattcgggtgtcagccgggaaggccaagtcagggtgatcatctgcctcagtttggagttcacagggagaccctgcaggcccctggattggtcacagacagtcaataagccattaaaaacaatatttctctggctgggcaccatggttcatgcctgtaattccagcactttgggagcctgaggtgggtggatcacttgaggtcaggaatttgagactagcctggccaatatggcgaatctactacaaatacaaaaattagctaggcatggtggcatgctcctggagtcccagctacttgggaggctgaggcaggagaatctttgaacctgggaggcggaggttgcagggagctgagattgcaccactgcactctatcctgagcaatagagtgagactccgtctcaaaaaaaaacaaacaaaaaaattctcgagtgaatggtcagtgtcatctatcattggagagggaaatgcccccagccaggagttaggagtctggagtgctggcccccttctgacactgacttgccgtgtgaccttgagtcactaccctactctgtgttctagctgtgtgtctccagtgagggatttgtgctacatgaccctggaagtcctttccagccccctacatttggccattcactgaaactcattcactgaaactcagagagattttgcctctcatcaagtacatgttgctcagcagatacagaaagtccctgttttctctcacacttgctggaaagaatccctcagcccaccatctcctgtcctgcattcctgggtctgcctcttccctccacacgctcgccccgtgcttaggcccccactcttgttcttgtttttgactctttcctgccttcccttccccaccacaggagcatcaccttcttgccaccaccccgaatttctctttcgtcttccccctcagaggctgtggccttttttccattcatccagatgggttccttctgtttagggacgagggacatccccctctgagtgcagcacctggcccagggagctcagaagagtcagcagatggccttatgggcaggtggtccggaaaggggagtgaggagtctgaccgcctgctctgcttccttggccagaatgctatggcatttgcacggaggctgtgtgatgcgatctggctatagagtggggcatccaatgagcgaacctcaaggaataaaagtcatcagagggggcagtgtatggttagcattgtgacccccaaatgccattgcttttatagcctgagaaaagtactaactacttttgcaaataaccacctatgtttactgacctctgtagaatttctactagcctgcctttccccgggggagggaatggtaataatacaggtgaggaactgaggaatttttatcctttttctgtttgctgaccagacgttctgcattgctttaagtgagtgagtggctgggatttgctttacagagaaggaggccttgcaaagagaaatagcttaatgccacttcattggcacctaagacctgctactttctttgacttaatatattgagtccagaaagaaatgcctggggcactttgaaaacttcacaggcccactgctgcttgctgaaataaaaaattgaagtgaattggtacaaaaatctccctcttcctcccaactccccgccaccccgcccctgggcactccaccctcctggctttctggccttctccagaccatgtcaccatgtcacctgccctcacgggtaaatcctcgcctgcctccctgctggctctgcgtttcccaggtcacaggccctggagactcctttctgtctgaaatggcgccgcatgtagaggaaaacacagccaaatattctcggtttaaaaaaggagatggcatgtcagcagcagaagataatattattgccattaaacagagcctgctattgagaatcacacaatgagatctttatgaggcggactcagtgtggagcagggggaacgccctttgccctttccacccagtggtgggtgggcagagactgcagacataccctgcaggcggcatccagaccggctgaggggttgcgggggcggccgcattgctgcttggggaaaaccctacggacttcccagggccttcatggtcatttgagttcaggatctcagagtttctaggaagcagctgggaacagttacctctattttatagaggggaagactgaggccggaaggacagacacgacttgccaacacttaccctgtgcgtcggtgcaggtggccaggtgtggaacatacacctgtagctctggcctcaccgcttgccctggggccacctttgctctcagcctcagtggcctcatctgcaaaatggggcaagttttgacaaaggtggactgtggtggcatcacaacagcatctgcccagtagtgagcactcccatgtggtagctattgtcattccatccttgctgggtactgacaccctcccatctcttgtacactgagctctactctcccccgcatggccggagaaacaggctgagctgccgtagggcttgacctgagtattcactgagagcaggcgctgtctaggcgtggctggcggactgtgtgctttgtgtgttgcttctgggggcggcatcttgaaacattacacttcctgggtcccaccttacctggttaaagtagcaaatctgctggtggggtctgtgactctgtattcgaatctggtgcttggggagctttttgaaagcatgactttcaggggtgcatgccggatctgcacactctggatctccagggcttgggaaccactgctctgaatgtcatttctgctcacctgaactccaggctctctctagaggaggtgcaccctcaggcacaacatacccagcaggcttcctggtccctgggtagcaccgcacagcagagatggggactggactctagcagggaggaggaggggaggtgctgctgccgcagggctggaaggggccctccctcctgagtaccagccttgtcacttctcccctggctgtggctccctggatgtgcatcaggcacctccatccaactgtccccagttggactccctgtctgctccttgctgcttttccggtgcccagtcctggagagggctcgctggaggttgtgctggcggtatctgcagagtcatcctagcatcttcatgtcctcgtgctgccttgagttgctttcatctctgtgttacctcttgcactcattcccttacccacacagatttgacttttgtcacctcttcctggattttggccctgtcctctgaggagtcttactgtctgtcccccacctcctgcctctcgccaggctgtttttctggtgcagctttcattgtgccgccttcttcctctgaagccttcagtgactccctcttgctcagagaatcagcccaagtgtcagaaccctccacgacgcggcctattcctgctgccccagcccagacttgcattgtcatctcagccagggatgccctccctttctttccctgcttctagaagcttcatcacccttggtggcccagcctgggtgcttcccattcactgatctcctgtgatctgtggctgctgtgtggcctcttcgcaaacgttgggcttttatcccacagcccaggtggcattcagccttgcgtgtggttcaatcaaggcccctctgtctcttacattttcctatttcctgccgcctgggcagcctcactcctcagaggcactctgttaatgcccatgggtgaatgaatgagtgagtgaatgaatgaatgactgaatacactgacgatacttgatatcctgcttcctctgagtgatgccaagagacttagtgtcacaaggagggaggagggtttaggtatccgacgtggactgtgttcaccctgatggaagctgtcgcttgctcagcagtggctccctctgcagccccagctccctgagtccctgtggtcagatctggtcatggtgggggagggtggcagaaagaggaagccgagagcccaggcatggcctgtggttgtggatgggacagctccctctgtctgggctgttcttcagaagagggtgggaacagcagctctctcattggtcctcttgcgagaaagcctgctctccaagtacagagggtcacaacatggagaaatcacatggtcccagcaccacagtggacccagcagtcattcccccagtgccttgggcttgtcccggctcttcctactgagcctccccatggaggcaggagggctgggaggaaggtgaggtggcttcctgaagggacgtggctcctgaatgtcactgcggtacatccacggcttgtcatttgttcatccatgtggcatgtgggttgctccctccttatggcgagtacacacgtgtgaacgcatgcacacactgtaatatggatgtgtctgtaattgatactttgattattccctttgcagcactcatttgactcgggttagaaagtgtttacaaaaacgcccgaccacatcagacccaagtttcaaagtccaggaccaaagttgttgccacaaaatctgcctgtggcctggcgattagaaagccacgttatccaatgggccattggtgtgggctggttctctgtgctcctccccttgtcccctcagtctccacatggttgaggtcacacatttctcctaaggacacgggtgccctctgcaagcagatgccgggagcctgggtccactcaggtgtcactgcgtgaatctcggccttgaacggctggactggaagaatccatccaccctcaggtgtcactgcgtgaatctcggccttgaacggctggactggaagaatccatccaccctcaggtgtcactgcgtgaatctcggccttgaacggctggactggaagaatccatccaccctcaggtgtcactgcgtgaatctcggccttgaacggctggactggaagaatccatccaccctcaggtgtcactgcgtgaatctcggccttgaacggctggactggaagaatccatccacccccttggcatagtttgggccgatctaatgcctggcactgagcagagcggagggatctcctaatgcctggtgcggtacaggggaaggatggcggagcatcctcagagacagcacagctcttcccaaaggtccagcacgcacactttaccgaatgcttttcttgtgaagggagtcattgggttgggctagccaggtaggctgggtaggcctgtgggggttaggaacttctaggcccttccagaagcaagggcatccccaagtgggtgtctagactctgtttcgtggacattgtggcagttatcatactgtcccagggtttcttgcccccacctggccctgggagctggcagttacagtgctggaaatgagcctgactcactggggtggtgatcttccaccccttcaggtgccctcatcccagttcctactctgcctatgggtgttttacatggagagtcacagcactgggggtttcccagagcctagactctgacttgccctaaagctgggtcacacagactattgggaacttcctgtcgatcctgctggcctgattgacagctggaaccgggagtggaggtggggcccatgggaatgctaggctccagcaagttctgcctgacctttggatgtgagggtcaggcattcagtggtcgggtctcagggttccttattgctagatgaaagcttccacgacacacatgtgtctaagtgtgcccttgtcctatgtcctggctgagtgagttgggcagagacttctgaggacagcgatcgtggcctctccattttcctaaggcccctgcatgcctggagctggctgtgggggcagccagagaagctgcccaatgagtctgatgggagccagacccgttactccttctactcatgatagctttagcattgttgtcccggggcaaccctttctcatgtgaaaccttgcgtggaaccccctccacctgagatatgagactgatgaatgcagaactgctctggttggaatggtgggtggcaggtgggctgtgggggagtccagatcctctccgctttctctttgtcatccccccatggcagcccctctgcctctggagaatcccagagcttggggaagcacaggatggaaaccaacccatcctggcactgcctccccctctgcccacctcccctgcaaagcttgcaatgcgattggtcctggtgtagcctccgtgttgagttgtaggggaaagggtgtttagtaagcaggcatatacccacggagtcgcttaagaaaacacctaaccacactgtaagtttttagtagtttcgtttaatatccctctctctgttcaagacaggaaccagggtagagcacctgtttcattttccctgcctaggtttgggttggttttcttagctttttatgacagcccataataggtgagcattctgccctttttaaaaaaattaatggtgcagagagttttatttatttattttttagaaacggtgtctcactctatcacccaggctgtagtgcagtgttgcgatcatagctcactgcggctttgaacttctaggttgaaacaatcctcttgtcccagtagttgggactgtaggtgtgcaccactacacccggctaattttttacttgttagtagagatggggtcttgctatgttgcccaggctggtcatgaactcttggcctccgttgatcctcctgccttggcctcccaaagtgctgggattacaggcgtgagccactgtgcctgtttggtacattagtttttttttttttgttttttttttttattaagacggagttttgctcttgttgcccaggctagagtgcaatggcgcagtcttggctcactgcaacctccacctcccaggtacaagccattctcctgtctcagcctctcaagtagcttggattacaggcatgcaccaacatgcccagctaattttttttgtatttagtagagatggggtttcaccatgttagtcaggctggtcacgaactcctgacctcaggtgatccacccgcctcggcctcccaaagtgctgggattacaggcatgtcccactgtgcccggccggtacattagttttaaagggaagattgactgtgggtggccaagggatttgtgttttctgacttaaccatccatggctctgaccccaagtcacccattaagggctgtttctccctttttttttcctcttcctccccaagctgacctttctctcttcttaagaagtgattactgatttctttaggttttgagggttctgtctttgactctccgtgattgttgggtgaagccatttgcttaaattccttgcttttagagcgtcttaactgccatggtaatgataaaggggagtgacagtgagtagaaattagagttctttctggttaacccatttgggaggtagctttctttgaatatgactaagtgttccccctaatgacagagaggatgttgctgggggttgggtcgcggtggctgaggctgctgtccagttaagagaattttgcaatgaactagggcagtggtttaaaaaccttgactgcacattagaatcccctggggagttgtaacaaaatgcagagaccagaccttctgacttaattgttctaggtgggcctggcattggtcgttttgaaagcctcaaggtgatagctgggattaagaatcatggatcccagtgcttgttctgatagttggacttctgttgaaaccgaatgaatgtctgccaagattttccgaaacccagagctgccctctgctccctgctttgtcctgtcctcttcacgaagggagtgggatcacactgttgctatctggccagggtggagtctacagccagatgctccccagaagcttaaccatggaggggctgagctaattgtcaccagaaagagcctcctccttcagttgctgtccttggtgttcgggaaggttttacttggctaattccctaaaagggcactggttaggacttggagtaagtggtgatgagcaagagcagggctggctggtgggacagggtgggtgccgggggcagaggggaactggaatgtggactgctgtccccagcctgtggccacctgctgtgctggtttccctgagaaaaccctactgtctttaggttgaatctgtagtgtttatgacctaatcactctctaatgataggtcaggactggaatctttccttgtggggagcctgtgagacaaaaatcaaaagggcctgataataacatagaatcatggactcttaaggcagccattcacctccttcccagccccgctcccacagctgggcacggtttattggaccaggcttcagaggatgggattgtaagtaactcaacaggacaggatgggagcgctccaagaatcagatctaagtttaacttccctttctagtgctttctgtctgagcgtgatcatcctaatgtgtttctagatggctatttccacatgtgtaaagtggagacaatcaattcttatgtcttacgactatggaaaaagtgagtttttttgtgccatactatttgaaagtaatcattgtgacacctttggaacaagtgtgaaaagatctccctctctctctctctcacacctgtctgtatccatctttatctttttatcatctatctctatctatctattaatatatatttatctatctagcatgacctgggataggtgaattctatagccaggtggcctccagaagcttacgaaatgatcgtctaccaaatctaccatctatctatttccctacctacctatcatttatctaatctatctatatattgatatatatctatctggtctatatctatcttgatatgacatctgtctgtacctatggtctatcatctctatttaatccatcgtctctatatctattgattatcacttatctgttttacttatcctaatctatcattaatctatcatctttctaatctatctgtatatatctattgtttatctaatctatcaattgaccattcatctgttcatctttcatataccaaagatgcagttgcatgccacctgattccagatgggttatctcacttcactgtcacttagtgagatcaggaagaagtctcaaggattgtttcaacttcaagcctatgtacatgagtttgcgttttgaacatagcaggaaaaacaacgatgtataagaagctttcttattggctgggcatggtgacttatgcctgtaatcccagcactttgggagattgaggtgggaggatcacttgaaggcgccaggagttcaagaccagcctgggcagcaaagtgaagccttgtctctaccaaaatcaatcaatcaatcaatcaatcaataactaaaaataaaaataaaaaattagctgggcgtggtgacacatacctgtagtcctagctgcttgggaggctgaggtaggaggattgcttgagccccagagtttgagggtgcagtgagctatgattgtgccactgcacttcagtctgggagacagtgagaccccatcttaaaaaaaaaggtataatgtagcttatagggcttataatcctgtaagaagacttcttatgcaagaaaataaaaattttacttttcgctattttttttttcctcctccaaataatctctggagaatttggagcctgattttcttgacaacacatctggccctgcagatgtaaagcagtgttcccagaaaacagcccgtcaaatcaataactcttgctatctttgaattttcagccttttttggcattcaaatgaggccaactttataagtggccattgctgtgctgttgaattcaagcccctccgtttttcatggtggattccttgcattgtctgctaggggggttgcattcctcgctgaaccagacctctgccctcttccccgctgccttgcagtttgctgagcttccaggcagggctgcagggtcgtgctgctggaagtattggtgacaaattcttccccagtgggtgtttcggctaaggaagcatttagtcatgtagggcctaccatgcccagcagtgcagcgtgggagaggcctggcagagggcagagctctcttctctccagccgggtgtggctggtggctccttcctcttttgtagtgtcaaaccaagggatagtatggacccagcagaactgaaagcaaagggaggacccattattagccagttctggcagaggcgagcagcttctttgtgtggacaggcatatctcatgcctttttgcttcagctgggagtttgttttttttttaattactgttatttatttatttagtaccttagctcattagctgcagaaatcacaggggatgaaaaagcaggtaggatgggtccatccttaaagcaaggagagagttgaatgaggaaactgtccctgaggccttgacagatattttggagctaactctgagcccagtgagggaggacctaatcttttggaggaagtgcaactttagcttcagagttttaaatggaaactgggcagaaagccacagcttgggcacagcattggtggcgtgttgttgtgtcactttgcacagttagatggggcttcagccctctttgtaggatgaacgtttaggttcttgtccaaacgaatacacttctatatcctactaaaaatgattgcaggacagcagtgcaaaccagggctgtcctaggcaaacccaggcatctgtcactctaaaggacacaaggacacgtgttgagtcctcttgtcctccagtgagctcgggaaggggatgaccctagcagttgctctctggacctctccacagacctgccgggagtcatgggtaggagttgtgtgattctgtccttttcacaagagatggttagaagaaagtgaggagtttggagggagcagataattgatatcatttatcgggaatctgtgggacgcaagccctgcatacaccatttctaatccttccatcaaccccgaagatagataggcttatcctcctgttataaatgaagtaatgagcagtccagagaagtgaaatgacttgcctgaagccacagagcctgcaagtgcgagggctgggattccaatccaagctctgggccaatggcccttgcatatcctagaatgcgagaggaacgtttgttttgtagcagttagacagcctgctcatgaaagctgctttgtgcccagccttgtgacaggtgctttacaacaatcccagacacagcacccaccttgagtttgccctcaggtacagggctcctatccatcctggaagaacagaaagattttggtgttcaagttttatcctgcccttccatccacctgttatttaaaagtactttttctgtaatatataggcagaaaatgatcagatatcatacgtctcctactaagtgggaggctgcacccagcatggaagatgctcaccaagacggtggtatattgggtgtctcttctctcctacagaagccctgggttgatgccctagatctccccttgcatcccagagggggatttggagagcaatcaagaggagtaactgatgccatgcattcatcaactgaacttaatccttcttctgggaggcccgggagccttcttccatgcggggccagattgagctgatttctgtcacgtaggctgctccgaggttgccttgcccttgcctggcactcatcttttgcatttctctgaatcgctttggcgtgggcttttatgaggttcattaggctcagcacctcccatgtctgcttgggaaacaccacgggcagatggcatttttcttttcttttctttttttttggatacagagtctccctccgttgcctaggctggaatgcagtggcttgatctcagctcactgcaagctccgcctcccaggttcacgccattctcctgcctcagcctcccaagtagctgggactacaggcgcccgccaccacgcccaactaatattttgtatttttagtagagatggggtttcactgttttagccaggatggtctcgatctcctgaccttgtgatccacccgcctcggcctcccaaagtgctgggattacaggcaagagccaccgcacctggcctcttttttttttttttttttttgaggggcagagacaaggaggaagatcagacaatttctcagagttggaattgtgttctgggtattgtttttctcctttatggagataatccagggagaaacatgaagtgtaatggaaagaatttgaggcccaaccttcttgatgatgcatcttcatggagctgggagaccttcgtgccagggtcgactctgctgcttattagctcaggctcggtgccccacggcttggtcctggttttctgaatcgtcagatgcacctggatcagcatgtcttgcataatagggttgctttgaggatccagggaggtggtggctatggcagggcttggacaaattacatgtatgggggagtagccccttcaccccagttttgctcctgaccgttgaagctttttatattgacccgtggctactgtggtattcgaagggctaaatttgttttgtgacttttgccttcagcagccatcgcattacatcatctaccttttcttgtgttcttctgtcgtcgagaatcaattaaaatggtcagcattgctatgaaatggtttatttttttgtggatgttttagagctcctcctctccatctcctgaatttcttttcttgctaagcctattcagctctgttttttagagagttcttttccctcctgctctatgaaaacgtattttccatgttaaaaaaggaagatccatgttgctgtacttaatgcttcatgttttagaatgttagtgccagcagaaagcaccaggagacacccgatgtgcccccaccttggtgagcacctttccccccaggcacagtccctgcttacgggagatttgaggcatttgatcattttttcccgttagcttacagcacaaagtactttgaaataaagattggctcgcagggcaggttgaagcttcaacaccaaaatctctctgttccttgtgggtggatgggagcctgacacctgattacaagctccaggtgaagagcaggtttgagacttacaccttgtttattgcaatctttctttcattttgcaggcggtgggggtgggggaatgaaagcccagaaagggatgtggcactcgggcaggacgggggctgcttctgtgccttttccccactgtgcgtattcttagctgcgcaagtgtcgtgcatgtgcgtttggctcacacccagcgggagtgcccttcttgtgaaggaagctcgttctctaccgaaaagctcacttttcagagaagagctggagaaggcctgttgtccatcttagtcctgaaatatgagttttcattccatggcaagtccttttaatgaaagatggactggagaagctgatgcatagaaaagaaataggttcttttatgtagagggggaaagtgtccactctgcggtatttcctgggtcctgtggcttgtaggcatttgaactgttttgtcttggttctgagagagtcagatgattcagaagctgtgttctgctgaacattcctgccttcttgacagaaatcccctatttttgtggtccccctggcaggtaaaggtggcccctactgacttgtaggatttctgtccatgattgtgtctgaaatgtcattttttctggttgttttccctcttcatgtattagcttggctctttcttctcctctttgtctttaaggtaatttgcaaaggtcacactattcttgcttcttcttagaaatgtcataagggattttcaaagaaagaaaatttctgagtaagagtatctccctcccctcccctcccctccctccactcctctcccctcttttccccttcccacttcctcctttcctttctttctctcgctctctctctttctcatttatgttagcttacatgagtatactgactctaaaaatttttgattctactactgcactccagcatgggtaatagagcaagaccctgtctcaaaaaaataaataaataaaaataaaaaatcttaaaaaaatttagatatgatttgtataccctcagattcactctctgaaagtgtataactcagtgctttttagtatattcacagaattgtggaagcatcactaccatctaatatcagaacattcttaccaccccaaaaagaaaccctaccaattatcagctgctccccattccccacctctccccttgcacccctagcccatggcaaccactacatttctatagcgttgcctgttctggacatttcatataaatggaataatacaatatgtggccttttatagctggcttctttcccttagcataatgttttcaaggtttatccaagttgtaatatgtatcaatacttcatgactttttatggtcgaataatattacatttatgagtagaccacattttgtttgcccattcatcgatggatggcatttgggttgtgtccactgttttggctattgtgcatgaataatgtacatttgtgggcaagcatttgcgtgggcgtgtgttttctgttctcttgggtatataccgaggagtggaattgtggggtcatgtggtcattctatgtttaattttttttttggccatgttactggcaaatatatttaactttctgagcaacagtcagactgtttcccaaagtggttgtgctattttacactcccaccagcagtgtgggagggccccggtttcttcgcatccttgccaacacttgctattgtctgtcgttttgattatagccatgcgagtgggtgttaggtgctgtgtcattgtggctttaattttaggctttattttgaggcccgtgtactcattcactgacccctagtcacatttatcttgacctgtgatgtgagaacttggtttgggtgtgttttccctactctgcactggctcatctggtgtggcaagtgcaaagatgtttgcagagatgagaatgagtacctgcaaccaggggtccccagaaaggcagccctcttagctctccccactgaggacccttgagccctccctctagggctcaccatttgtggctggctggaatggctacctccattcccttgagcctggcaccgctcctcgagatttgctctgatctcaccgcatggctgagagtaaatcctgttttgctcccttttgtgagccttcttctttctgcttcctgatggggtgggcagataggtggttccatgctggggagggaacttggcagaggccctgttagcctcttcctccagtgtcacccttctgacagcacacagcctgcggggtccaggcactctcagccatgatatggaccatctccagggccagtccattcctgccgctgatggagattccctcctgatctccagagggcagaggaatcagaatagtttccttctacatttgtagtttgcaggaaccattgctcacagctgctccctccttggatgctataccctcactctgtaagatagggtgggaaatgtcgcctactttacccatgagagcatcgcagaagggagaggctgagggacttacccaactagtatgaggctgaatgaggactcagatgatggtcatctggctccggggccagcacttaatcctgctgggtatgttcctgggccctctctttttttgtttttgtttttgtttttttttgttttgagacagagtctcgctctgtcccccaggctggagtgcggtggcgccatctcagctcactgcaagctccgcctcctgggttcacgccattctcctgcctcagcctcccaagtagctgggactacaggtgcccgccaacatgcccggctaattttttgtatttttagtagagatggggtttcaccgttttagccaggatggtctccatctcctgaccttgtgatccgcccgtcttggcctcccaaagtgctgggattataggcgtgagccacagcgcctgggccctctcttataggaacttcaggtgctaatgttgcaggatttaggaggacgagagagaccttgggttgaaacaggagaatttttactgagtgtactcaggcccagctgacttacgtttaaaagactgggcctggaacaaagacagtacttgacatttatatatattttataaaagggggtgggctagcttgaaataagctcatagtggtgcgaaagcagggatattgaggcaggacaaagacaggattgtatatgactgttgccaagcaacctagatgtttgttatttaggtttgcctgggcaaaggcttattttataacctttattatggtgcccaggcagctgtagtttaggcttatttaggctttttatgacttttgttgtattttttagataaaacagaatacttgaagttactagttatagagaacaggaatttataaattttataaaacaaaggaaatttttttttttttttttttttatgttgagggagtgctgcgagagtttttaggagcgtattagataatattattaagacttttttgggtctgggccatgcctttgctgcctttgggacaagttagcttaatacaggaaaacttatttttttttaattttatataaaaattctcctgtttcaacccgagatctctctcgtcctcctaaatcccgcaacactaagtgtggttcccttaagtgcactggattcaaggtgactttgtccttgcttttggatgttttggatgtaacagcgatgagatggcccctcccagagctgagaatggagagtattatgctagacacctgaggctgcagtgatgtgggctgatggaggggtgtcaaggagaaagcatgtggtcaccttcatggcaccatcacagcctttggtttgtttaaacaaagtgaattagtgttgtggtttctgctgctaagaaaaccctgttcgtttattcattcacctattcattccttcatccgttcatttattcatttattcatccattcatccattcagctgacatttattggccatctggcaggtgctgatctgggcattagaagtacagataaggtcctctttgcaaaaaacttcttgtctattgggaagacctacaaagaaaagatgaaaatgaaatgtgaagattgctgtactaaggttccagtggaacagagaagagaaatctttaaaatctgcctgggagagccaagagaggcttcagccaataggtcctatgtgagctgacccttgaaagccggctcaaattttaccctggggtggatttcacccatggggtgggcaggagaagggagtgtccacccaagagagagatgtgtgcagaagaatttggtagatgagtctggtgtattttagaatttagactccggatttgaccataggatgtttgagttctatcttcatggcttgctagctgggcaagtgacttttcatttctcggagccacagttttctttcttctttatttatttgtttttatttttattattttttttgagacagggtctcgctctatctcccaggctggagtgcagtggcccgatcttggctcactacaacctccacctcccgggttcaagcgattctcctgcctcagccttctgagtagctgagactacaggtgtccaccaccacacccggctaatttttgtatttttagtagagacggggtttcaccatattggccaggctggtctcgaactcctgaccttgtgatctgcctgccttggcctcccagagtgctgggattacaggcgtgagccaccgcgcccggctctttcttctttattttatagtggtagcatacataacacaaattttaccactcgaactattattaagtgggcagttcagtggcattgtgtattcgcattgttgtacagtcatcaccgtggtccacttccagaactttatcatcatccctaactgatcatcatccctaaactgttgccattaaacactaactccccattcccacctttctctagcccctggtggcccgtattctattatagttgtttctatggatttgactgttctaggaacctcatgtaaatatatatgcttatgacattgcagaatggccccaagttcacctatgtgatagcctgtgtcagaatttccttttttttatggataatatttcatcgtatatatagaccatattctgtttatccattcatccattgattgatagatacatgggctgcttccaccttttggctattgtaaataatgctgctatgaacatgagtgtgcaaatatctattcaagtccctgccttcaactcttgggtgtgtgcccgtaaatggaattgccgcatcatacggtaattctgcaccacagttttctgatttgtcatataatttcagggttactgtgcagcttaaatttgattgaaggtacaaagtactgagcattgcctggcacataatcagtattaagtcccatcctgaagggccccttctagcctctcctgaaaagtgaaccctttaaagcaaaaggacttttaactatttggatgaaaaaatacctcttcaaatgtagtttatggttcttaaatggaggtcctttttggcacttttgtggagtttgggtgaggagtcagatggccacatttgcatagtgaggtgtgattgggtcctggaatgtcatgccagggagcaggtgaaagccaatgagtattctgccaggtccaaaggcccagtggccagtttccatctggatgggcctggaaggcttcctggaggagggggtagtggccccagctggggaaagaggaggtaaaggaatgggtgagaacctgcctgcctcatcttgagagaggctgaggaagcacagagctgggaaggtagccactggtctccatggccactatgctttgaacatacctttgctgcagggccgatgaaaagttggacgttagctatcttcatctcaacctactccccgtcaagtcttgctttttttttttttgagacaagagtcttgctctgtcacgtaggctggagtgcattggtgctatctcggctcactgcaacctccacctctcctcctccggggttcaagtgattctcctgcctcagcctcccaagtagctgggattgcaggcacatgccaccacacctggctaatttttgcatttttttttagtagagacggggtttcaccatgttggccaggctggtctcctgacctcaagttattcacccacctcggcctcccaaagtgctgggattacaggcttgagccactgtgcctggccacgtcttgcatttaccatgggaaattgttagcgtggtcatcatttggtctgctttagtagagagtatcttttatgtttctcaaaggcgttatgttctgcattgtaaatgtgcggaaatcagtcacccagtcacctgaacttccatttaacatcaggtccctggccatgggacttgggcaggagcaccagggctggcccatcaagtacctcaatatattgctccctgatgagggaggggccagaatacatgttatcactactgtttaacatggttccggatatgttagccagtgtaataagatacgaaaaataagaagtaataataatggggagaaaatataagattattactatttttttttattgcccaggctggagtgcagtggtgtgaactcggctcactgcaacctccagctcccgggttcaagtgattctcttgcctcagcctctcaagtagagtagccaggattacatgcacccactaccacacccagctaatttttatatttttagtagagatgggatttcaccatgttggccaggctggtcttgaaatcctgacctcaagtgcctgcctcagcctccctaagtgattattactatttttagatggtttactttagccattcaaaggaattaaatgaagaaatatttgatctaagaagaaagtttatgaagatgactgacttaaaaataatgtattaaaaattaatagcttccctgtatgtcataaataaccaatcagaaaacataatttaaaaaatccatacacaatagcaacataaaatataaaattactaggaattataagaatacattcttatatatggaatccaagaagagtcttaaataaattaaaagaaatgctatgttagtgaacagaaaaacccaatactgtaaagaagtgtatactttagattaattttaaaattgaaaacctcaaaaggtggttgagtttttgttttgttttccatttgaccaaatgattcttaagtacaggtgaaagattaaacaggtgataagaaccaaaaaatattcaaaaaggtcataatgaataaggctgggagaccactactggctagatattaaaacaaactgtaaaaatataataattaaagctgtgtggtactagctccagaagagacagctatataagcaggttaaagtagaaaatctgcaaatgtgactaactgtatctaggtatttagtatataaaaaaggctacatttcacactcatggtaaaattgtaaaatattcatagtattatattagaagttaactattttgaaaaccaaagtaaacatcttaccttagttcgtataccaaaatatatcccagatggattaaagaattacatttaaacagtaaagtcagaagagaccagaagaaaatacagatgaaaagccatataatttagatatttcagcaaaggcagaaatcagaaaagatggagatgcttgactacatagtaattaaaaacattactaacagtttaataataaaaggataacgaagtaggacattcgacttgcaatatatgataaagggttgatgcatttaaaatatgaaattttaacattttaataaaaaaagcatgctttaatagaaaaggtaaatggtatgagcaaggtattcacaaaaaggaaataattccaccattgaactataaaaaatattcaactgaatgagtaataaaagaaatacaaattgaagtttcactgagctaagtttttatctactaaactttcaaatattaaaaggggttaagtaagctgaaaaaaatgaaactatgttggaggattcacttttatctgttttatttaatttcttttatataaataatacttcaggcaaatatgataaacttaataaatgtcaattctgaggggggaagaataaaggagttaaataagtagaagttgtaatacccagtgttggctaggttgtggttaaatgaacactcaaactgcggataggtatttacattggcatggccctttctggagggtaataagacagacagtatctaacaagagctgtaaaaatgtgtaaacaaaaaaattcatacgccttgacctagagtaatctatatgtaaacatttagctctaaggatgttcattgtagcattatttataatgaggaaaacaggaaatgagctgaatgatgaaaattggtgactggtatagtaaattaaggccatccctagaaaatagtagtatatagtcattaaaatttattttgggggccgggtggtgcctcacgcctgttatcccagcactttgggaggctgaggtgggtgaattgcctgacatcaggagttcgagaccagcctggccaatatggtgaaaccccatctctactaaaaatacaaaaattaaccgggcatggttgcacgcctgtagttccagctacttgggaggctgaggcaggagaatcacttgaacctgagaggtggaggttacagtgagctgagattgcgccactgcactgtagcctgggcaacagagtgagactctgtctcaaaaaaaaaaaaaaaatcattgtggggctgggcgtgatggctcacacctgttatcccagcactttgggaggctgagatggaaggattgcttgagcccagaaattcaagaccagcctgggaagcgtagggagaccctgtctctacaaaaaatttgaaaattacctggacatggttttgtgtgcctgtagtcccagctacttaggaggctgaggtgggaggattgcttgagcctggcaggttgaggctgcagtgagctatgatcctgccacgaacttcacaaagcaagaccctgtgtcaaaaagaaaaaaaaaaatcggctgggtgtggtggctaatgcctgtaatccccacactttgggaggctgaggtgggcggatcacaaggtcaggagatcgagaccatcctggctaacacggtgaaaccctgtccctactaaaaacaaaaaattagccgggcatagtggcacgcacctgtagtcctagctactcaagaggctgaggcaggagaatcgcttgaacctgggaggcggaggttgcagtgagcctagatcacgccactgcactccaacctgggtgacagagcaagactccatctcaaaaaaaaaaaaaaaaaaattgtggaaaatatttattaatatgaccatgttcacagtatattgatggaaataagcagaccatgatttcattatgtctgatttgatacttttttaaaaaacagctttttgaaacataaaaacattatgatgctacttttgtaaaaagtgtatatgtgtataataagtagataggaaaaagattgtctagacatacatcaacatagtaatagtgactttttttggatgattggatgagtcatggaagattttattttttttctccattctttctggtgttccagggttttggcattgaagtacttttgtacttagaggagttttataaaaaacaaaagttccctttgagggatactttgcatctggactgttatctcttacccacatcattcttgaggacgaagagaaaatacctgtgaggaagtatttacatttgttacggtggtgctgggctgagtttgtgtggaccctggactcccagctgtccacacagttataaagagtaattaaaagctccctgaacaacaggtcccttatcagccttaaaccttattgttcagatacattggcttttattcatagtcttactaatcaactggggacaaaaaagacccattgaaccattagccctcagcccgagatgagaagcgcatgatggtacaatggccgtggttcagactcagatgttatgctatgttttgaattcagtccaggttcctaggaggaaaacacccatcaaattatgttggctttagagcgatctcagtcaacagatgacatcaccgacttttccttccctgctggtctttatttggaggggatgcaagaattgtgcaaccttggaataaacagaatagagacccgactcctcactcattgtgtttctgagtttagtttcaatccaacagcggatctgtttttttactccatgtaatgggactgttgctgcagcttttgtacaagggtggagtgggtgtccatttgctgacgagcaccctgtgtacacgctagtttttatttgaacgaggtgctcttgtctttattatgtattgtctgcccataaatgatgtcttgaaatagaggggtgagcatcacctcatttatttcaacccatatttgtacagaaggatttttgtaatcaaatcatggggtttgtgtgtagaactcagtaagaagtaatcatgaccctgtccgttcatttgctctttgttctttcctgttattaacaatggctttggggcttttggggagcatttagttctgcacgttgtgtatgtaagtagatgttcttctgtgggggctgcaagtccttaagttatagttggattcccttcccagcaaggaaccaacaggaaggaaaacgaagtcaaacccagtctttgcacgtggaagcttgtggcgtgactgttatttttttgtgatgttctgtacagccctgtaatctcttatttttggcaagccaactctgaatctgtggtcccgtagccccaggcaaccaaaagctgagacaaacagaggaagtgtcgttattcacatgtttctctggccacctcatcgggctggacgctgccggctgccacccgtcgctgagctggagctccccagagtgcagcctggccaggcagggactgttgaccctggcccctgtaggaagcacctctggcttgtcccccagcccccagggtccctgccactcattacttctctgcactctttctgtaatttgttcatcgcctggaatttatttctggcagactttgtggtcaaaactgggaagtgtctgtttccttaaaacagcctttcctcaaacccaggaagtgaagtagggagctatccttcctcacctcctccctgtcacatgcacatgggcatacacacacgtacacactcacccatgtgcacacacacaggcacacacatgagaaagggacggggaaagctagggtgtccaccccagcctgggctcctggtatccctaagggttttggaagaagagtttcagtttttcaaagcctgctggagatgtaactgtcgtgatgtttcgtgggatctgcaagagcctgtagcgtcaggtttctttccttttgattgggatgacatgaagtctgttaatgcgggatcgtttgtgttatctgctctgataggtggttttacttgcatttgatttttgatagaatgagagatgaattgatttgttcctgatacattctgttgggatacagtccatttgataggaaggttgtttacatcacagtgtcctgtatttgggggctgccctgggatgtgaaaagtctgtttatgtctgttgacagagggtctctatgcttcttccttttctagcatttactcttatgttacaattagtgcctgcttgctgtgtgaacaggacagatttgtcttgtttgtttgggtcgtatgcagtttcatgcagaagacttagctagatgagtgactcaaagttccatgcctggggccctccaccctccttccctcaatcacgcctttatccagtcccttcccacgccctgttcctcattggaatcctctgtcctagcctatcccccctgctctcccctggcatagaagggtgcatctcgtctccccacaacagcactggaaggtgctagaacacttggagaaaactagttctgtaccagggattatgttcagcaggtttatctcctcaaggcacccctaaagtatgtttttactatttaacacacgattttgtaggccctactgttgttagctgttcgtagatactatttcagaacaatgctgtgagtagatactattattaggtccatttcacagataagaaacctgaggccctgacagggtaaggagtcctaaggttctgtagctagccatggtagagctggggtgtaaactcaggctttctgactccaaagttcatatttttaatccctatacagtgaagtaggcactgttgccatttctattttgcagatggggaaactgaggcactgaggagttaagtactttgcccagggtcctagaactagtcagtggtagagccaggattctacccagacaggtgagctctggagccaaagccctgagcatctgtagtagattccttgtggctttctgtcctgtccttgttccgagaaagttcccaggggacagttacggaatcactgggtgcttgctgttctcacacgcacagtttctactggctctctagcatttctttcattagtgagagaatgtttcagcccagcttttcagatggtggagttgaggcccccttgtctgagctgggtatttgagagccagcaggcttgagggcctgtgaggtctctggaggacacggtggtggtggggccaggagaagtcacttcttgggactttggaaagcctagaggaattccagaaatgaaacaccacacacttactggaagccaagttcgtgtttctcccactggtggaagggatatgaggtgctgtaaacgtggccttttttcagatgcagaatgcctgtctaattacaggaaacagagatgtcgccccacactgagccaaggatttcaacatctcttggagaaattctgcatggacctgaagtttgaagctttgcattgtaaccaagttggctctccttgccttccccccaggccacgatttcgtcatcctgctttacggatggcatttcctattaagtgtctgtctgtgaacataaacatggagctgagacaaagcacagcttctccctggacccggaaagagggactcaggcgcctggggctggggcctggctccagacctgctgctgctgcctggcctggttcggggatgcctagcctaacaaggcagcctgggctgggaatcgcttaggcctcaggttgatgaagctgggagaagggttgagagggcaccagacctaagatggtggccagagccatttaatcatgtggttgtaaaattgtcagtaacttctttgtatggctagttgatctgatctctcatgtaggactcagtcccccagttggatcttggaaggtagacatttatttgaaacagacagcctggtagagtgaaaagagctttgtgttttaccccctcagatagtaagcaaagaaaatggaaaaagcagcgctgtctggggtgacatcctgatgcattgctggtgacagagtgaagaggtgacacatttggaacataatgtggccatctgtatgaagaaccatagttcatccagtcatcccaaccctaggactctccagagaaaaccgtttaaaatagggggaaagttatttgcatgaatatgttcataagaacattatgtataatagaggaaatttggaagaaacctataggttcttccacagggaaattgttaaggaaatgatggtagattctccgcaagaatggctcccattaaaaattgaattaggaagactctaagataatgtggtattaagaaaaaaactccatgattaaaaatgagcatgggccaggtgtggtggctcacgcctgtaatcccagcactttgggaggccgaggcgggtggatcacttgagctcattatctgatgccctgaattggctttttctcatgcacattaggttaaggtcagtagttactcacttaagttacccattgcatgtgtttccagtgacagaaaaggatttagggatggatcgttgaggtgactgctatgcatagaaatgcctagaaggaggcggtggtttaagctgtagaaggaggcaggtgccaagtgctcccagtttggggtttgagctcccacattctgtctgcacagcagcaggcaagtcccgtggcctccaggctctgcatctgtgatgtaagatcgtaaacctgtcctgcctaccttgtttgagcatcagatgagataaggtacgtgataacactttgtgaatcacttaaaaacactatgtctatgtgaggttgatattattgctattcaataaatgcaaacgtgtaggaaattataaaatgattcaactgttccattcctgtttttgaaactttctgaagagaggtggatatgtttccctgaggtggggagctagggttgtgcctgtgttcatccaggaaaatgggatgaaaagcccaagatacatctgcgacatcatcttcagaatgtgaaattacagtgggtttggaatctgggccttctctctgcctgctccctgcctctccttccctacccacagtctccagctctgactcctggcctcccagggtcctctcccagcagcctggaaggaagggacatcctcattccagggcccaggccatgaggaaggaagcagtgggcagggatgcaggctgcaggtgtgggcagctccaggtgcccactctaggcttcaggatgagtggctcccttcctgcagtgggtgcccatcctggcaggtacagtcaccagagaggcccgcctgcttcagctgcataccatggggtttttcctgagactaaagagggtcctgctccttatatccattgaccagtgagtgatgaggaagactgaatgctgacggacgggaggaaggaagtcaggagaaagggagaagggctggccaggaaggaggagagaggaaatgacagaggagagggagagatcaggagccccatgcctgccagccagggaaggccctgctgttgcactcttcagaaccccaacttgggacattttgaatagatgttaggagtgtgagtggaatctaatgagtgggacagacctcccaagtgagcattgaatatgagggcgggtggggcatggtagctcatgcctataaccccagcactttgggaggccaaggtaggaggatcatttgagcccaggagtttgagacctgcctgggcaacatgggagacactttctctacaaaaaattaaaaattaactgggcatggtggcacgtgcctgtggtcccagctactcgggaggttgaggtgggaggatcgcttgagtcctggaaatcaaggctgcggtcagccagattgcaccacagcattccggcttgggtgacagaaccagaccctgtctcaaaaaaataaataaaagataaaaaataaagaaaatgagggtggaggaagaagagccagcggaagattcttctgagacatgggaagtaaatttgcaagattgctgtctgggagctggacagacaggaagggaacagaactgggatgtggcagggacaggttccaggcactggcaggatgggggccagtgtgcagtgggccaagagggaatgggagcgagaaggtggggcgtcagcaacattcagctccctccatagctcgatgagaagagaggggtggggacaggcggtagctggagggtccttcaggatcattttatccgtatccctttcgtatcttttagtgagtttttgttttccctaactggattgttggcattttaagggcacagtttgtatcttctacctctttgtttcctccaaagttggccgatcaccagatcacttaaaggaggttgtttgttttataagcgttttaccagatcttggcttaacacttcccccagagttagtcataatcattctagcagggcttctagatgctgaacaatgaccgatggtgccacttgatttatatgaagatactggtttagttttaaaagcaaacttacattgaacaaagtgtaggaaagagaaaggagagggctactcaagtgcctgaaggtccgagcagtgaagaacatgtttccatatgcctgccacccttaggctaaggacacggttttcctatctgtttattgaattgggtcacttgctttagttataatatatgaagggataagactgaatttcacttctcaattaactagccctcttgctctcttttgatcacacgttctggggtcagattccagctctgccagtcagtggctgcactggccaaggccacgtggttgaccaccatccagagttctgccaagagccttacctgccagaggcacgggaggtgtggctgttgcgcagcttctgtggcccaggccctctgcctggcacattttaagtaatgtgagcgggttacttaatcttactgtctgttcagctgaaaactagggccaaccctggctcagagctcagggggccgttgcgaggattaaatgagagaatccatggaagatgtttagagtcgtaccagacacataggaagtgctgaataaatcagaatggtttttactatgactctcacctttcaatgtttgtgacttaaacttatgttacagttagtcatttcactggcgtgtgctaaccaaaggtggcctggcccctccgcatccattaggagggcttgagtttaaaatccaggccctgtgagtctgcagggaggaccgacgggagagctgggtactcctgggacttcagtgtccagtggatgctggggttctcaggttggtatattgagtcacatagttccatgactcccttggaggaagaggctaaagttgtctagaggcaggtgtgatgtttggtctgtcctgtgtgcactgagcaccttctgtataccagtccccctgcttgcttcttccagacagaagaaaacacagatggcaattggtcatatttgaacagtgcctcttatagcttacaaataccatcttattgaacactcatgaaaaatgctgggatgtatgttatttttactgtttcaaagatgaaaaaactcaggcacagacattctaaatagttccagctcttaggaaaatgcttctttagcattgcgggagaaacagtatatttgtacaaggcaagtagttcaccctgtaaggcggcacgtgctttggaggcacctaaatactacacagtgttttatgcatgggcgtttttcttacaaaggaacatagctttatcttcctgggggtgtttatcaaaccacatctatgtagcagatgctcttcaagcatttcccatattccctcgtttacaacaccctggaaccctgagttaattattagtcccatttcatggctgaggaatctgaagctctgagaatttgaacttcttgtctaaagtcacatggtgaggaagtggtagaactgacctggaccccaggtatctggctctggtctttccaatagtgcctcttcagtgggtatcccttaaattctcaggggcaggtgctttctcctccttttatgccctttttttcagagcaaaaccacgttatcctaactgccaagcacaacccacaaaggctcttatctctccttcaaaaaaagccattccctgcctggttgatgaggtcacctggcattttgcagggcattttgcagggtagatgccagctcgggaaagccacatagataagccagtggatggcttgtgttactgcctccctgatggtttgcttttaattcaagtcgattcatttatctgagatgaaaaagggagaggctgattcacacacattgaaaagcagggaatggtgctggagaatgaggccgtgactatttggaataagatcctggagatgggcagtgctgatagagtaaatatccagggagcaggggaaggtgtgtgcactgacaacaggagttttagcatctgcccctccttgcttcaaggggctggcgggtacccgaggcggggtcggagggctgagtgatggctcccatcctccctcttccctcctgctccacgggtgtaaccttgaggtgggattggagggcttggtgacctctctcctccctcatgctccatgggtataaccccaaggtgggatcacaggctgagtgaaggctcctcatcctccctcctccctcctattccacgtgtgtaatcccaagatgggatcagagggcagggtggagggttacacatcctctcccctccctcctgctccacgtgcgtaacccccagctgacttacagactgtggtacctgctcaactgcttcaattccagaactggaactgcagggaagctgtttctgacatccctggttttaattacaaagggccccttgagaccttgtcagaaatactgccagcctagccctttaaaaactcatgatattgggttctctatcagtgtcgctccctggctgtaatattgtactataattaggcaagatgtttcctttgggggaaacggggtgaagggtatgaaggttctctctgtgtcatttcttaaaactccatgtgagtctatagtgagttttaaaaagaaaaagttccagcctgggcagcatagcgagacctattgtctctacacataataataataataaaattagacagtgtggtggcgcacgcctgtggtcctagctatttgggaggatgaggtgggaggattgcttgagcccaggagatcaggactgcagtgagctgtgattgcactactgcactccagcctgggtgccagagcgagacgccttctcaacaaaagaaaaaggataaaagaaaaaaaaattaaaagtagggtcatttaaatatggcaaactccaaacgggtcttctctttgaagttttagggagcagcttatttactttgtgtctcacactttgctaatatccaaaatgcagaacattagggaaccgcttgaggcaggaggggaaggaagcactgattctcgctgcagcatggatgaaccttgacgacatgatgccaagtgaaagcagacagacgcacaagactacatcttttatgattccattgataggaaatgtcctgaataaacaaatctatggagacgggaagtagattgatggtggccagggtttgggagtagcaggggtaggagggaatggggagtgactgtaagtgggtaccaggtttcttttttgagtcatgttctaaaattagattattgcaatggttgtaaagctctgtgagtgaactaaaagccaccgggttataccctttaaatgagtgattgcatagcatgtgaattatacctcaataaaactgttaaaaaaaacagtagggtcctttgatagttttaatagaagtcataataagaggaatagtcctttttcagagactgcttgtaacttgcaaattcaggccactgtcctggggcatgttcctggctctcataaaccagattcacaggcccaccacgcagaccatgagggtgtttccagtcactcatcttgagggaaggaacacccagtgtgtgccaggcattttgccaggtgcttttacctacgctttattatgtaaactttttgcagccctgcatggtatgtggttttacgccttttttttttttcttaatagacagtctttatctgttgcccaagctgaagtgcagtggtgcagtcatagctcactgcatccccaaactcctgggctcaagtgatcttccccacttagcctcccgagtagctgcgactacaggcacataacaccatgcccgggtaatgtttttttttttttttttgtagagttggggtctcactatgttacccaggctggtcttgaactcctggcctgaagcaatctgcccacctcagcctcccaaagtgctgagattacaggtgtgagtcactgaacccagctcatgcctatctttttatagatgagtaaatggaggttcctggctgggtgcggtggctcatgcctgtaatcccagcactttgggaggccgaggttgggaggaacatctgaggtcaggaattcgagatcagcctggccaacatggtgaaaccccatctctaccaaaaaaaaaaaaaaaaaaaaaatacaaaaattagccgggcatgatggcgcgcgcctgtgatcccagctactcaggacgctgaggcaggagaattgctcgaacccaggaggcggaggttgcagtgagctgagatcgcgccactgcactccagcctgggcaacaagagtgaaacgccatctcaaaagaaaaaaaagaaaagaaaaaagaaatggaggttccaaaaggctaaaccacagtaagggagtactgcagcaaaaactagaatttgggggctccttgacccccaagcctattctcttttcactgctggtatagtcgggttgccaaggctgccctcttggaggggccgatagctcagggaggtcaccagaggaaaggcctgtgagctctgtgcaagtcattttcaggcttgtgtcctcagtggggactctactccctccggaagtgagtatgacattctgccctattcccttggagcagctcttcccaggagagcttcagtggaaagaaaactgtgggaaaacatttggaggcatttcatggacacgtttctgagtgttatgagctcttgaaggaagcatgtttatttccccaaagtgctcagctgtgtccgggtcctgagtttttcaagggtttataacccccggagctgaatttggatatgcaaggaagccatgggattgcagccagggaacatgctattttttgtaagtgatgatgctgttgtgtagtaaacaggcccctcgtggtaaatggagagcagtgaatggaggtggagggagaagttttgggaaaagatttgcactcagttaatgatgctcaaggtagttcaaggcagactcagtagctcccgggttgcttagtagaaatgcagattactgggtcccagtctggacctgcagcgtcagaaactctggggtaaggtctgggaacctgtgttttatttttatgttatttttttgagacagggtcttgctgtgttgcccaggctggtcttgaactcctgggctctagtgttcctcttgcttcagccttccaaagtgctgggattataggcatgcgccactgcacctggccagaacctgtgttttaaggaacactggagatcattactgtgcaccctgaagtctgaggagtctagcaccagatgatctgacgacacatcattgggatgtggagtcatggttccagtcaccagcctgaagttgtccttgtctgtcaccctccccactttgtctaagggtgagtggaacagacagaaagtagactagtggttgccaggggctgggagtagcaggctaggagggaatggggagtgactgcaggtgggtacagcctttcttttttggtgatgttctaaatctagattgtggtgatggttgtaaggctttagatggcttgcttgagccttgcaatgggaatgagtgccttggcctaaggagaagggaagaaaatcttgtggaggaaatgagcttttatttttttcctttttttttgaggcagtctcttgctctgtcacccaagctggagtgcagtggtgcaatctcagctcactgcaacctccgcctcctgggttcaagtgattctcctgcctcagcctcctgagtagctgggattacaggcacctgccaccacacccagttaattttgtatttttagtagagacgaggtttcatcatgttgcccaggctggtctcgaactcctggcctcaagtgatcttttgccaccagatattaaaatgtatcaaaaagctgctctatttagtactgattgagatgaatggagcaaaatagcccaggaacagaacctggtattgtctctctgtaaagtatgagtgaatttaaaacattattagatatgttatctagtaataataatgataaagtattttttaaagtcatcatgaatcaatagaaggaaaggattattcagtaactatgagcatgtgggtcttagtgtcaccagtacttatccttcttcttaggagggatttgtttttttaatcttaaaggaaatagatatgttaaacctatcaggcttccttatttacattggctagagagcctaactctaaatttagccaatgtataagactaaatgtcaagtatttatctatacaaacacacacatatgtacacacttgcatccacatctacatacacatattttacatacacatatacacatataaatacacacgtacatacatacacatacatacatgcctctttcctgattttattttaccattatttttcttccgctttatcttgcattactctttctggtttatcacattttcttgtattttatgtatctctataaaccactttaaaactttttgggggaagaaagtggactatagataaagaaatagaataaggtataatatatagaaaaaaggcagtaaaaatacacccaaatttgaataggttgattttggggtggtggtggtaatgggattattaactttccctaaaattttctgtatttttgaaattttctactcaaagaatcatatcatcagaaaaaaattattatttctgctcattccctttgctggccagtgaaaggaatgcatttccataagtgagggtctggcagagcagtgttgaggggaggggtctttgccgcagcaaaagctggtccggttcccaggagagcccctcctttgctgcttgacctgattgcaagtggaatgtgagagccagaaggaaatattccatcacttatttagagcattcatttggctcttccctgatctaggcgttcagtacctgctcagagggagtttacattctagtcaggggtcagagagtaaatgagtgaaatggattcagaaacgatgccaccctgggatggtgacatatagccccagtgagaaggatgaggagatgcccaagtcaagagcgaggggaatgggtttccagagagagagagggctgcttgtgcacaggcttggagttgcccaggggttgggcaggtcaaagtgaagaatggccggggtggccattgtgggtgagcaggtcagggataaagagtaccttggagagatcaactaggaccggatctgactggccaagagaaagagtttgaattggactctaaggatggtagacagctactaaaggatttaataaggggaatggcagtgtttgatgaaaggtttaagatccttctagctgcttctgaagggtgatttgtagaaggacaagagatgaagccaggggagtgggtagggagattctgcccaaactgattgctacacagtgatatttttatgcttttcttttttttctttctttctttctttcctttccttccttccttccttccttccttccttccttccttccttccttccttccttccttccttccctccctctctctctctttctttctttctttctttcttttatttttgttttgggtgttgatgaggggacatacaacttaagaagaaaaattggaattattttgtcaacttttctacatcagcattttactgatggaataagcttgcatttgaactggacatcatttttgtttttattagataacattatctgtattacagataccagatatgtgtgtacccatttatttactaatcactaatacttacaaaaaagtaaattttgtcaaaagaaaattcagcttagatggccatattgtatgtgtgtgtgtgtgtgtgtgtgtatatgtgtgtgtgtgtgtgtgtgtgtgtatatatatattttttttttcttgagacaaggccttgctctgttgccctggctggagtgcagcggcacaatcttggctcactgcaacttctgcctcccgggctcaagcaattctcctgcctcagcctcccaagtagctgggactacaggcatgtgtcaccatggccagctaatttttgtatttttagtagatacagggtttcaccatgttggccaggctggtctcaaactcttgattcatgtgatctgtctgccttggcctcccaaagtgcaacggctatatttctgacatatacaaatccaagcccagttgatcagaatttagcagtatctgcaagatttgaaccatttcagaaatctgagctctctagcattacatggactgatgttttcttagctcagaactgcttacctgtgtgtagaaaatctaatatttaggaagaataattcattgctttaagtgttcagtcctggtttttatttctattgttgcacaagtttgatttgaccttggacaaatcatttcagtttgtattttagtgcttgtgtgcagaagatgggtagtaatagtcctggtaatcctcctgccatcatgttaactgggtgagagctcttcaagacctaggagagataatagcaggtgcaaagtccctgtggtgggaggcagcaggtagatattttaggagctgaaaaacggtctgtgtagctggagagcagggtacaagggagaggtggtccagggtcatgttatagaggtaggccagggccacactggttggggttttgcaaaccttactggggacttgaatctttatctgaagagcagggggaagtcattggaggatttaaatcagggaatgacataagattgatggatatgctatctcctttaatcctcataacaaatgtatgtgctaggtaatatccccgttttaaagcagcacagaaattagggcagtggagattaaggagtttaccccaggacaccatgcaggtgaatgatggagccaggaaaccaactcgggtcagcttgcatccaaagtcctcagtcttccagatcagcgtacctccatagtaatataacaatgactgcagttttaaaacactttgaactcttaagatgaaagatttcccttaaattacaaagtggtattatgctgcagaaatgtgagcggtaatgagagagcaggtaatgcccgggaacttttgaaaggcccggtccgtgtggctctgctccagcaccttcaagttccctgccgtctggcggggggcgtctcataagctgctttcaacacaaagaagggtttggctgctccccggccatttgacactgccattgtccataaggactcgttgtccgtgaaatgcacccaaagcttgagctttcaggggttttgggaaatcagatctgggcagtgcatgtgtggtttcgctggagacatcatccaatgccaagtttctgctttctgctttctccctcttggataatcagctgggttacatggattcttagaagctggttgtagagatcaccatctcgattttgaacccaagaagccttattcagggttcaagtgggaaaatacctgctggcccacggcccttgaggctcttggtgatgatgacatatgtctgtttctttctagttgaccacgttgttcctgagcctgggacaagcctgctcgctgcctttgaccagtggagggaatgggccgacagcaagtcctgctgtgactactctctgcatgtggacatcagcgagtggcataagggcatccaggaggagatggaagcgcttgtgaaggatcacggtaggttgcactgagtcaatgccctctgcagatgtttccgcttcagtccatcaactggcacagccctgggaagaaagtgataatgcttccagatcccatttgtgcctcatgcccatgcctgcccctgggaaggagagagggctttgggccgcagcttatgctgtttggaggtggccttacccagtgcagtaacatgagccttcattgatgataagagaagatgaggcttactgctgggacctgttcttaggtgacagctgctcacagcttattggtttgtgagcaccgtgctctctagccagggtggggagttgaggctgctgagagagagatttaccctcaaaagataacaaatacatatctcagtgaggatttgacagtctcaggagagtgttgggcagccccttcctacaaacctggatggatctaggatagatttgagggctatgagacacttcaaaactgagtgacaacctgagagggcttttcctttccctagaattattttggagaacaaatttccagggattgggaagattcacagagaggcaggaggaatctttaccacctcaaggtgcctctgggactcttgtcaacaagaacctcgggggtttgcggggaagagccaggccacatcatcttcctgggtctcgctgggcttggctagagaccagattaacttcactggatcttagtgttcagggaaacacctattgctttagggttctggggacttccaggcttagaaacaccatgtgctgtgagtgacatggcaagagggaaatctctaggtactagaatgatagaaaatgccccggaatgaaaagcaagagtcttgggtttatttctctgatcttccacagactaactgtgtgaccctgggtaatttgctgaaattttatgggtctcagttttttaaacatttctcatatatgagggtcttggactagatgtcctctaagattctttccagcacaaagcttccacataaaagaaaataggtaaactttgacttttctcacttttgatcatgcggagactccaagtggtttaactgtggatacttagactgaatctgctccaaaccaggcaggagggttaccatggtaactgttgcctggcaacgggagaagggccaggatgtccagaggcatttaactcaggcagctcccagcaccccccaggtggcttgaattaagctccaaggctgcgaggttgtcaggacaattgtttaaaattgtgatgaatgttgggcagggatgtttggtctggtgcctagggaggcaagaactccaagacgccaggatgagaattgcgacatctgcttgttgaactaatggaccttttcttacttaaaaaatcattttcttaaaaatcagcatggaaggcagtctgtctgccaaagaaaagacatttatcacagttcttcataggcagaaacttctaattcattttcttgttacagtcgcaacagacttgtttggtagaggcagcttaaaaaattaactgtggtaaaataaatataacattcaagttaccatcttaaccatttttaagtgtgtgtgcagttcattgttttaaaatacactcataatgttgttgcaaccatcaccaccctccatccacaggtctctttatcttgcaaaactaaaacactacactcactcattaaacactaactctccactgtccttcaccccagtccctggcaactgctgttgtactttctgtctgtgaaattgacttctagggacctcatacaagtggaatcatatagtatttgtccttttgcaactggcttatttcatttaccatgatgtccttaaggtttctccatgttgtagcatgtgtcagggtgtctttcctttttaaaggctgaataatattccattgtatggatagaccacatttggtttattcatttatcagttaatggaggcttgatttttgcttccaccttttggctattgtgaataattctgctatgaacatggatgtgcaaacactggcaacttttaattttgatatacttgtaaacttacaggaagattataagaatactaaaaagcatccttgtgcctcttcctcccacattcacaggttatttatatggtactctgcttcctttaccattctgtgtctccatttctctcctctctctttctctgtactgaaacacacacacacacacacacacacacacacacacgtacacacacagacagtattatcactttcttatcccttatttggttatttggtttatctattaaaagtccacttctctattttgtccgcactaggggtaaattccttcctcgtgtacatggctttcaaagatcgcttccagctaacggattgccaggtaagaaagtcggcttttcggaagaggcaccctgacatttggtaccttcaggctgtggccgtttgggaaagcagtctccgatgtatgcatgtttcctagcttcctgggaagtggctggtggatgcagttactgatgtaactgagccttggaagagagtatgaacgcagtgccctggcccccagcactgccactccgccgccctggatctgaggctctgccccgcacggcgtgtgtgggagcggcactcagaacctccttagcaaacctggtgcagagccaggtgtcacccaagagcttctcactcccggtccacgtcctgctaagttgtactgcctctgttaatttctgaggggtctttctccatcaaatgtggccagtaacattgccctcatcatatcaaaaaaagtcaggctaatagaatcgcctaggtgtcctgtttctcatcccagaaatgcctctggtggggagatgattgtctttgtgaacaggaagatggaagtccctgtctctgatcccacccttgtctctctctcagatttatgaagtactgagtgtgatccgggatattggcgccatagcccaagtccacgcagaaaatggcgacatcattgcagaggtacagggctttctttttcgtcatttcttcatcacctggagggtgagaggcaggctcaagaaagggaagctgcatctgtagcttaacaccaaggtggaaaagcagagggacctggtgttcccttgctggagctctgctcagtctcacccatggcatgaatgccagtgacacacgtgcctctccgtgtgtgccacagaacatctaagtcagttactattgcagagagaggccatttctctcggtgctgtaacgcagctgccttgggtggggtacgggaaccctcacgtcacacacaggcattttacaccgtggctgagggttgcaaatgcaccagtcgtcagcatcccagggaacagctgaatgggttttgggaggctgtaattgatccatcctgctcaggcgggactgggaacagggcagtgaacccttctcttcatgaggtcttgggatgagggcagaacgatcggcagtggtaattttccatcttgcccggataactgcatgcccgggcctctgccatcagagctgtgcaaaatccactctccctcacagcctgactttctctaaacattgcaggagcagcagaggatcctggatctgggcatcacgggccccgagggacatgtgctgagccgacctgaggaggtgaatgttcaccaagcggaatgcgtgaatcagtgtcccttgggcactgtgcagagcctcagggaacctgcttcctgcctgttgagaagggggcttctctgatgctgactgtggtctttctgagaagctgtgggtcacgtgtgtgtctgtctgtctacgcaggcaaagtgaagtgttagattgctcctgagggtaaggtggtgtggactgtttcgccagaagattcttctttctgtctgtaattcttcaagcccttgcttgtatagacacaaacagttcttcattggcatcctgcaatgtagattttagtggttcacaacttatggtctccaatatcttaccaaaattcaccaaaacgtagttggaaggatggaaaagctcttctaaatgcctagaaggcgtgtggggaattgtttttccaaggtaaccctgcacaggatatcacatgatatgcagagtttggtagacagaatcttttaaaattatggagggaagattcagagcaggggcctgtgctggctcaaaggtggagactcaccgtcttggtgaggtgtgtgagttcgaagggagggtgcacacgtcttaggtaatggagaacctgtgttcatcagttagaatttgtggctgtgaaatacttttcagaagttggttccttaatgacaggctggatgtcaggctctaggggccctgactagggagcagcctgcagcttcgagtgaagcgtgcaatcagggaatctccagggaaccaccaggatttccccttcatgggaggaagtggcagaaaagggactggcgccgagcagtgggggaagatcaccaagggcctgagtggaggctgacagtgaggaggctccagaagcccgggagggaggagcttggcaagagctccctgcagggctgtggccactgagtcactgagtgtcagcaccgtgccaccaccctgagtttgggatgtggtcatgttcataccagtgtgggaggggagccggtccctgtgataaggaagtggattcaggagggcttggaagcaaaggcaccatctgtgtactgcctcgggtgcaggagggggtggttgggatcctttcagacttgaggggaagggatgaggctggaagaggagaaaggagtcaagacaggcagaaagacgagagtgggagccactcggaatgctttgcacacagtcagggtccacgctttgttctatccttcttgctgcatgcatatgcacacatagacacacatgtacacacagacataggcacacgcagacaggtaggcacacaacagacatagacacacatgcatacacatagtaacacacacagacacatagacacacagacaactagacacagccatagacacctacacacacacacatacacatagacacacagacacatacagacacagacacagacatacacagacacatacacatgcagaggcagatacacagaactgcatgctccaagacactttcagtagcatttgaggccctgaggacattttcctctccccagatgacagaatggaagccgtgacattttcaggattgcacgttcctgcttcaggccagggatgcaggcccttttgtagctatcaaccttctcatgcgtgctaaaggctgaaagggtggcctggcacaggcccgaggatgagggaggcaggcaagcccctgtgtcagctgagggaagccccatgctgagaccgtggctggtggacagtgattgcaggggacagcttgcaggcgagagcaggctaagatcagccgaccataaacatgcctgaggctgattttattttattttattttattttttttcctttttctggagaacggggtctcactatattgcccaggcaggtctcgaactcctgggctcaagctatcctcccacctcttagcctccctgagagctgggattacaggcgtgagccaccgtgcccggccgaggctgattttatgcacatttgtgtgcacacagatccacgtgcacaagcacacacacgtgcacacactcacgttcacacacatatacatacacacatccataggcacagacatgcacgtgtacacacacagacacattttagcatacgcacatgtgcacaggcacagacacgcacatatgtgttgtacccacatattttcacatacacatatacacatgtacaagcacagacacgcataggtgtacacacacattttcacacacacatgcacatatgcgcttgcacacacctatgcaggcaccatccccctttgcagacaccgcaagggttcgtttctgtggtttcacttctccctctgggccggcttctgtgactgccctcgccagattccccaggatccacctgtcgggtggtttaaaccatggcagcataagccatggttgctctcagccctgacctccctggaattgggctttgttcccagggctttgttccgccctgaaacagtcttgggattgggccttggaaatgcacagagtccgggagaggtggagggctgacacagttctcacgtgagccctgttcaaagctgccttcatttagtgctcacgtgtgctggacactgtgttcctggcccacatttcagttttgtaactgtcctgtgcaggaggtacaacatctccttcccacaactccaggggatgccattcatgcaggctgcatggctgtattcagggagcaccatttacattctactgcccatgagtggtggtaccagagctgtgctgcagtgggctccttggttatctctctttagatgaggacactccagaagcatgaagttaagtgactgcccagttatcaaagcagagagctagaaagtgcagggtcctgcctgctaccccaacccctcccgcagtgtacacatactcagcttaaagccacacctggacctgggctttattagaaagtttcctcctgctttcctcccgtttggtgactgggagccagtccctctgcctgccatgtaccagctgtacaaggaggtgagaagatgtcctctgagaaaagcaaatgccacttctgcaaatgctacatgaggctcctgctgagaccctcactcttcaagttttagagccttctgaggggcttgcattccttctttctcctgctttctgcagagaagtacacaaacacagaaagaaagggccctggctttgctgaagaggaaaatgctctcagagagttgttattctggttgcttgtattcatccattttcatactactgtaaagaaatacgtgagactgggtaatttataaagaaaagagatttaattgacttacagttctgcatggctggggaggcctcaggaaacttataatcatggtggaaggtgaaggggaagcaggttccgtcttatgtggcggcaagagagcgagtgagcagaaggcaaactgccacttttaaaccatcagatctcgtgagaactcactcattatcacaagatctgcatgggggaaaccttccccataatccagtcacctcctacaggtccctccttcaacatgtgtggattacaatttgagatgagatttgggtggggacacagagccaaaccatgtcattgctatttcaaccagagaaattgaaaccatttttacgtgattaggcccagcagctgttgccctgagaacttcagaatccccagcaactgattatggagtctccttgagggctggcagatccagggatgcaccagtatgggatgcagtttttcagctgatttagaggcctctcttgtatgccaggccctgagtccttttagccatatgacagcccagtgaggcgaggaggggggatgcagggggtttgaaaggcttggatagtggcagagcgtgattagaactcaagcccacaggcacctgccggctgacgtctcctctcatggtgagtttgtcaagagggatctgttgtgtgttaaaccctgtgtgggtgataaagagaacaagtatggaacaattttgtgtgaattttagcttcccagtctacttggggaggtgctgctgatggaatgaaacacatcccagtgtaacttctctgtagtttggtgacctatccatcactagcatgatggttctcttggatttgaactttccaaaacatgttcctaacccactaggcctttcttcccaacccaccatgtgagaccacccagtaggattttccctcgttttccacccagaggattggaaaggacactagggagtgcagacatctggaactgaaccatctgtggctgagaggagtggcgactgagcctgcgtgccaatccgggcagtgcctggcattgtggggatgcaaaacagataagaaagtgatcctttctgaagggactgtggacaaggcgaggagaaagaggtagacagaaagtgagtgtagagatagaatttgacagtggctctgagctgtaagactgatgtctgggaagagagtggggacttggagatgaggataatgaagaacccttcacagggacgggcactttccagcaggccttgtagaatgacagatgtcctgacactgctctgtgtccctggacaggtcatttccctttctgagttacctcatcattaaaatcagaagataggcgtagtggcttgtacctgtcatcccagcactttgggaggccgaggtgggaagattgcttgagcccaggagttcaagaccaacctgggcaacatggcgaaaccccgtgttgggacaataaatggagtagtcacctgtatctctgggaggtgctgagggttctagtggagtccatctcacacttcacacccatgcaagacgtccctgtccccgcctggtgctgccgggccacaggcatctctgctgtaagtggagagagagggcttctccttcagctgtcttaggaatgaaaaacatttgggtgtttaatatgctttttcaagagccctttgcttggattgtggatttctagacatcccttttcacatagttgatgcctgaaaggccaaatgtgaatgaagttgtctcagctctgctaaattagattaccagttaatgcaattacagaatttaatcttttggccaagctctggtggagacaaggtaaccaattcagttataggggctcagttatttcttgtgaaaaataacagtgttctgtggagcagcctagactgaaataccatgaacataaaatgaaatcatttatatgcttagcaaacatttttgagcacctgctgtgtatcagacaggacattgggagctattgggggcagggcatggaagatactaagcagtgagtaagccccagtccctcccctccaagagttcaagccagagcccttttgctgggatggagagggagccagtgatgttctgagatctgccttccacaatttcacctgctccttcccttgctgattggtgattcctctgtaggatagaacttgatccagggagtcttgcctgatcagatattccacagtcatcatgtgggatttgaaatatcattcatctgaacatccgatgtatttatttatttatgagatgaagtctttccctgtcacccaggctggagtgcagtggcgccatctcagctcactgcaacctccgcctcctgggttccagcgattctcctgcctcagcctcctgagtagttggaattacaggcatgcgccaccatgcctggctaattttttttttttttaatttttaatagagacagagtttcaccatgttggtcaggctggtctcgaactcctgacctcaggtgatccacactcctcagcctcccaaagtgctgggattacaggtgtgagccaccacactgactggaacatccgatttaaagcgccagattatttactcaagcagttcttcaatcttgtgctgaaggtcgtaccaggctgtggctggccatgtctgtgcttcacacacagggggccattggtgtagacaaacggggcccactccgttcctagagccctgtgaggctgcattgtttcgtgggtgatgctgacttcattcatgagcatttaatgggagcccagcacaaactccacatcactgaatatcttgactcaagaccctgggagcagaatgaatatatggaattgagagcaatcagtgtctgtgtgtggcggttctcaaacgttagtaagtgtgaaaatcacccacattgctgggtcccgccctcagagtttctagcctgtgagtttctagtccagggcagagccagaaaatctgcatttcttacagactctgggccagtgctgatgtcacaggcttgctgcctgcacctggagaagggtcagaagggagttttcttttctttttcttttgagacttagtctcactttgttgcccaggttggagtatggtggtgcaatctcagcttactgccacctctgcctgctgggttcaagtgattctcctgccttatactcccaagtagctgggattacagtcacctgctgccatgcccagcttttttttttttttttttttttaattgtatttgtagtagatacggagtttcaccatgttggccaggctggtcttgaactcctgatctcaggtaatccacctgcctcagcctcccaaagtgctgggattacaggcatgagccactgtgtccagccacaggagggaattagttcaaccaaaccaatgttgagagacacaaggcaagtcatactcctttgaattgtcccctggggtaggaccttggagaccagcagcctcgccttcatcttagcctctctctggggtggaggataaaggtagcggctcgtggggtgggctgagccacattctcatgctctgctgctgttttgcaggtcgaggccgaagccgtgaatcgtgccatcaccatcgccaaccagaccaactgcccgctgtatatcaccaaggtgatgagcaaaagctctgctgaggtcatcgcccaggcacggaagaagggtgagtgctgtggccggactggctgatggcaggtggggaggtttggaggggaggggggctcctcactagggagggctccttttccagaccctcatgccaagtgggccacttgcaccatgttctggcattaacctaattacagcagggcaaggcaggagctccagtttcctcctctgctccactgctgcggccttgttagtatctatttaaagccatgtgcacgccaaggcggggtgggcaggcacatgtcccccagcccccgtgcaagagctggacttactttgatgtggttgaaataaactaggcacatacacagattacgtcagtttccatccgccccagaatccttggtcacatcatgcacctcccctccaaggctgggagtgatttctgccggggtatgtaaggcagctttgtggggtgtggggatgcattttgccccagacactatcacatccagatgttttggtgtttgataaactctcttgatgcattctgaactggggctgggtctctggtattactagggtgtccactgtaactaattgatgaagtgcagcttccagtgcttcctctagaggacgccccatgaggcacctcatgcattttgaatgcagctgagccctgttgtcacccaccgctgacaacatgaatttcgataatcacactgcatcttttatgcttgggagttctctcctcgtacagaaagcctgagggcatgtcgttcattttgatggtggatcttaggctgatctgaaatgaacattataaaagggtccccttcttccttcctttctcccttttatgttccctcctcccctttgcttgttgggatctctccatctctgtgtctccacttctcttcccttctttcctgatttctgtttcattttatctttcatttgactctttctcagtccctctgtcattctctctctgtgtctttctttccctgttaggaagggagccatttgacctctatggcttggtttctacttccctgcatcatgcaatccacatggatcaaggtgggctgtgggatttttttcactggcgggtgacttgctgcaagccctggaacaaattgctcaatgatgactgagtcatcttgtcccagagatgatgacttccagacggacccagcgactcctggccctggttctttggagtgctcctggggcctctgtccttaggctacacatcaaatggttgccgcctttctgtcttctcctggcaccttgaaggaattgccttttagaaataagaaagcattcacctaaaataatgtaacctactcagaatgagctttgagttgttttctaggagatattgtggatgacgatggaatcggtggccttgggccacccagacacgcatttgcaagaaggcagcgcatttgtgggaatcagcctctgtacagaaggccggccacagcactgctgcccccacgtagtgtggggatggttggcatagtgtctgaaagggggaaagaatgagacggcttattttctgtattttactactgcgctgtacctagatgatgatgatacgtgagttaggctaacatttcaacgtaattttggatagagaacttgtctaaagtttacttcatattcaaacctgtccaaatgagaagacggaggggtcctacatgtcccagactttagttgggggaggtggagtcgtgggccagccctgccgcaggcctcctcctctctgtccctcagggttcttctcaggtggagttgcggagctggagtgtgttgttgcggtgcccagtatggacctattaccccaactcagtgcctggtagcccccgttgttgttttttttaatttattttattttatttttgagatggagtctcactctgtcgcccaggcaggcgtgcagtggtgccatctcagctcactgcagtctccgcctcctggactcaagcgattctcccgcctcagcctccttagttgctgggattacaggcgcccccccatcacacccatctaatttttatatttttagtagagacggggtttcaccatgttgaccaggctggtctggaactcctgacctcaggtgatctgcccgcctcggtctcccaaaatactgggattacaggcatgagccactgcacctggccacccctattgtctttataaccttgacacactgtgtgtcttatggggtgagcagtaggaggggactttagtctgttcccttccagagccttctgagtgtgagtccaaatgtgcccacaccatggttcccaggatggcatttgcattcaaactgttacccattaatctgtgaaagcctgagctttagacaaacctgagctgccagaaaggaatttccagtgcattcaggtgctaatgagcaggaatgagaagtcctagctaacttcctaggctcttaggctctttcccatcttgctggaacttcctagcaactttgggaggcagccctggcaggaatttttatattttgttttactttgcagctgagtaaactgaagctcagagctcatgtatagtggaattggggcttgactgtcaggcatctaacttgaggccacaaatatccgtgtaaatgtttgactgacttaccttcatgctttgagattattttaatacggtgatgcttgtgacctgtgtctgttggggcttagttccttaagaatcctgattgaaacagtggcctgacacccagcagagatatgggtaatgtacacacaaggattcccaaatgaccaagaaggaaagctctgtaagggagtattaattgtttgcctccaggatcagtattcattcttggatcaaaccccagctccactgtacaccagccacgtgatgctgggtgcttcctcatcatctccacatgtccttttgccatctgcaaggggaggatagtaaccatgactcatctcacagggtgatgatgatgtgtacatgagatattgcaggtaaagatggagatgagaagcgtgaccagttattgtgactacaggatgaaggggctggtctaaccttgagcttgcgaggaaagcagagtaaagatgcctgctgaccctggacaagggttttctgctcagaattgtttgtccacttcaggtgggttcttctggccccctgaggcaagtgtgtgcactgccacagccccctttctgatgctgcatttcttcctctgtgaatggagagattctgaattcattgaatgcattttcatgatgtgatactttaggcctgcgtaccaggaaaataaatggtcccaaccacagttagctcctcgacttgcaggggaaggatgctgagtggaaagtcacgttgggaggtagtcggggctacaaaaggggtacaagtcaggagaggttgagcccagaagggagtctcagagaggtcaggctgcgtaagcagactcgaaattttgctataaatgtgagctttgaaaaatgataatcctgccctgggaggagtagtaatgtctccttctcttagtgatccacatgaacctccccagccaagacctgctggtccagaatctaagacaagagaagttcggggaagtgaggatatgaggagaaacgaatgagaactgttttcacgtgcctgcttgagccagcacgactgcatcctgccttccctgagagacatgctgagagacacgctgcttccatcagccgctctgtggctgttcagcaggatggcgtgttcagccggggagtggtgtgtcatcaacccaatttggcagctgaggcaatgaacacagagccaggaccagaagacctgggggcatttttactcttgaaaagaacttagacattgatcaacttaataggctcatttcatggaagaagtagaaatgcagaaattgaaaatcttgccctggttcatgtagcctgtgggaattagaaaccatgattccaggctcctggccacctctctttccatggagggccccttgtggggatttcttctctagaatgggctccctctgaccacattttgtccatgtgtgaaatccagcatgactgctgatgccttccatgtgtgagtggtggccgtgggcagtgcctgatgacctcatctgatggacattcttttccgtcctcctcctcacccctctcccataacccgggtgcagaaacattcaggacattaaaccctgggaacctcaatttgagataagacctcttatgtcctgtgggtcaataggagtgactcaaacgttatgagaagcacatggtcgcagggcctgtgaggaccacctcagcttggggatgagtccttagttaagcttatgcttgatgttgcaatcttgaacagaaaagggggatgagagaggagagaggacagtagagaaagggggaagatttattttaaagaattatatttaaggaatcaactcacacgattgtggggatggcaagtctgaaatctgcagatcaggccacagactggagaaccaaggaagagctgatgttggcatcggagtccaaaggcagaattccttcccaatctatgccctcacttttaacggcagatggtctgcaaggttgggaattcaatttgcattgtaattcagccactgccaggatgagatcctacttctggttttcagccatctcagctctgcatctatgggacataagggcagacatagaaacttttgattcattcatgtggtgcttgagctgggaatttgaatccctgaattcattcttcttttttcccccactttgtctagtacaattaggagcaaccaaccactctcgttatacttgttaattttacaaaaatgtttaaggtatctgctacacacccacctagaaccttgcctcttagaagcctttgggagtatttaataatattttctgtgtctctattgtcccatcatgccctgtactctcctctttttactactggacgtagaatcattagtgcctttcaacccaatcagatctgagaacgaatttcagaaacctcagaacccattcagaaaactcatttttaagatgatgttcttctagaaccactcttgctacgaaaacctgacagcacagtccccaggctgtttgttagggtctggcataaattcttggaaaggcaaaggagaatggtgagagcgtgtgtaactgtctgtctgtctgtccatcccagttggttttcactgtgctttggtggctgcatatggagctacagatactgatttcccacagttcccactttggatttgttctcctgcttctcgtccatgggaaatgactgccagagctgggagctatcaagcatatttaaaccgcagccttccatttattcttcatgaatgcacacgggccccagactggttgtaaataagcaccagctcccatcccctgcagttcttggccttatagagagcctgccagaggctggcttggtcacatccttcagtttagactttacctggagaagaaaatcacaaaggtctaacgggcacccagatagcatcagcagtgtatttagagaagtgcagaagggccaattaagcccatttcgtggtttattattattagtggtaattatttctggcatgcagttcaagggtgtctgtggcctggctgagctccggaagtgcatccacagcaccctcctgtgaatgtttatagacccaggaggggagccctgggttgggagctccagaccactggggatgggaggcagagactctatgtatagatcatactcttgtggaggtagaggcctggaacatgatggctaaactcctgtcgctgattctgggctaagaaagaaagaaaatccaaaagacagcaaggacctctgaatccctgagggaagttgaacagagcaaagtagaaatgaaccacaggatggctccatccctcccctggcatccactgcccctgcccctgaatgtccctatctttgcttagctgtggcccagaagtccactcagcctttgtctaaagaggcaggttctgctcagcagtggcgttgagagctcagaccccattttgggttttctagaggcagaaggccaagttcattctcttgaagtgaggtagatattcctgtgcacagagagaaggggaatccagctcctcatagagcagctccccaccccaagctgagttgtgtttcgcagggagagataagcctgtggtcagcagcattcatccccatggtattcaggccactttccaagaaccagcccctccttgtacttaagtttctagaggcagggccgaggagcaggcacagggagaggatgagcgtcggcaagttacaggaaactcaggaaaatgtttatgtgtgtccagggattttcagagactatccagccattctttatctccaagtgcctctgctctcatgaacttcttcatgtggacaaaagcaggaagcctttagggccacgcatctcttgttttcctgtgacttacacagccctcacctttgtgcttagatggactgtggccagcgggacctccaggcctggctgggtcaggagagttttgcttaaccagatctgtttgatccttgaaccaaaagcggggagccagagagatcctttgagaactgatgactgctgctgggtcctgcccagccatttgcattttataaaggtctttggcagcggccaaggccttctcattatgtggtgtttttccacttcgggatgaaccggagtggtttgtgcagccacctgatagctctttgcaccagcttctgcatgggagactttgagcaggccaggagccaaggggaccctcctaggccttccgagcacctagcactggcccttttcttcctcggggcttccttctggaggaggtttccctgggtttggagtcctccctcctgctgggggtgggggcgtggttgctggtggcctggagtgagctgcctgctgtggcctccagcactccccagctgaacagcgagtcctttgtgaaattcctgaggcaggagggggcagctgtgcagagccagctctcagagtggccgacagggagggtgttgtggtgtatcatcaagtgataaggccttcggaaaggctgtggagaggaaggaaaacacattcctgactgtggtgtgtttgcccttgagggccctgtgtttggggaagtagagaagcttggctgcattgttgtggggtgggagttagccctgtgctggggggagctagtgagagatgaattcagctgacctgggatcaaattccagcttggatgcctttaattaataacatattagaccatttaatcaatttaacacacgtttttggagtgcctactatgtgcaggcaggtaaatgatcttcaaggtgtctccatcaggtggaaagtcaaaaattcagaactgggcaatgactggaggggaggatgggattctcaggtgaagggtgtgagacccgagttgtgttttggacgatgttaaaggaggagatcagcttccagtagtgaagagcatctgatgctttggtgaggaggattttcttttaagtccttgaatgcagaagggctcctttggaagattttatgcaagagaatgccatggaaagattatattatagtggatcactctggaagtgtcatgcggaatgaatggagaggtaggaagcggggttgggagagcaaacgtaaatctaaggtccaattgggaggctctgttggaatgagctggcgagagatgatgagggcctgatttaaggaacgattgtattgaaggcactaaggtattggcattcagcgaatgtacatgagtctcaactttctggtttacatctgaatggacagagaagaggacatgatctgagcatcagggagttgatgtttgtcttggacattgcattaatatagttaggctaggcttccagaaactctgaaatcccagtggcataatgtccagtttgtttctctctcacagagtcagctgtgaagatggtggctgtaacggacagcttcttccaggcagtgactcagggatccaggctgtctcttgaggatatctggggggttatgtatttgccctgaaatacttcgccctggtgatgtcatgtgtgatttcctcccgcagacctttagtcagagctagacactgtgaagggctaggaattgtgaaaagattgtgtgaatgaacaggaaggttaaatttgaggtgccataggccatgcataaagaacagtccagatggcacctgggaccggatgcctggacaccatccgagcaggagattaatggaattgaaaatcagcaacgtaggagacagaagccttcaggatgtctgggatcctatagggagggtgtgttgtttgaagagcaggggctgaaggtggaatcttggggagctcatgacaggctggcagaggtactgaatttctccaagtctcagtttcctcatctgcgagatgagcctgatatttcctataaagggatagtgagtgcactgggtgctgctgggcaggcagtggctcctcataggggtggttcccttccccctgcattgtgttggactgaaccttgtgtgttctgtttgtcaggaactgtggtgtatggcgagcccatcactgccagcttgggaacggacggctcccattactggagcaagaactgggccaaggctgctgcctttgtcacctccccacccttgagccctgatccaaccactccagactttctcaactccttgctgtcctggtgagtcctggcgacttgttcacacttcacattctgtctttcttcagaccagactgacctgttaggcgaaaacaacatggtggccaagagcagccataaaactgggagacccttgttcaccaaactaggttggctacatgagtacagggaattgtcattctagcaccattttgggaggggattctggataaaaacctgggccatgttgaaagtcaagccaagaagggagaggaggcgtcaaaaggactccacttgggttggtgtgatgccattcatgagacagcccaccaaataggtgtaggcgcacagcatcttgacgaagctgcagcaccacgttatgcattttctttgcagtggagacctccaggtcacgggcagtgcccattgcacgtttaacactgcccagaaggctgtaggaaaggacaacttcaccctgattccggagggcaccaatggcactgaggagcggatgtccgtcatctgggacaaggctgtggtaaggagcgatggcctcactccttggtggctctcagccttccttgtcctcctcatctgggggccatggggctcatggaggccttgaaatgacagacagtggaggacatcctagaagccagtacttatatgacaatatttctgagggttggaaatctaagacctcttctaataggtcatttcttcctaaatattacatatatatttctttttaaaacaatttttaaatttttttcagacaaggtcttgctctgtcaccaggctggagtgcagtggtacaatcatagctcactgtagcctcaaactcctgggctcaggtgatcctcccatctcagtctcctgagtagctaggaccacaggctcagaccaccatgcctggctaattttttttttattttttgtggagatgggggtctcactatgttgcccaggctggtctcgagttcccgggtttaagcaatgcctcggcctcccaaagtgctgggattacaggtgtgagccaccacgcctggcttacctgtatatttcttatcattatcatcaatggaacagtaaagactgaaaacctacacagctttagatgtgactctgggtcagtcaggaacaaacttccttagcaaccaggtgacttactcagttaatcctcgtctactcttggaaatgggctcaatttccttaaaagtgtcttttagggctctctggacttagcatgtcttctactgccagcttctagtaggcctgctatgaacatacactgacctttagaggatctttgggctttttcattttaatgttttaaaatatattaacagaataggttttctgttttttagtgaattgtttagattatatgaagaatatatccttatttccagaagaataaggaagtaaataaaagtcactgtgtttcagatataaccacaattaacattttggcaaatgtctttccattttttgctactacacaggcacacacatgtatatgtgacatgcgtgagtgtgtaaataatattggcatcatacagctgggcccactcccaggttcatgcctataatcccagcattttgggaggccgaggtgggtgaattatttgagcccaggagttcaagaccagtctggcaacatggcaaaaccctgtctctactaaaaatacaaaaattagtgaggcatggtggcaggtgcctgtagtcccagctactcggtgtgggggaggcaggaggatcacctgagccttgggaggttgaggctgcagtgagccatgactgggccactgaactccagactgggggacacagtgagaccctgtctcaaaaaataataataataataatattggcatcatacatactattttgtagtcttttttaaaaaaaattttatcatggaaatatctccacctgcttaaatatacttgaaaaagttgatttataataacagactcttccatgtgagtgctaaactgggactcatttatttatttatttatttgagatggagtctcactctggagtgcagtggtgcgatctcagctcactgcaacctccgtctcccgggttcaagcgattctcctgcctcagccccctgagtagctgagattacaggcgtgtgccaccacacccagctgatttttgtatttttagtagagacagggtttcaccatattggccaggctggtctcaaactcctgacctcaggtgatccacctgccttgacctcccaaagtgctggcattacagatgtgagccaccatgcctggccaggactcacttataattctttttttttggctgggggagacagtttcactctttccccccaggctggagtgcaatggcgtgatcttggctcactgcaacgtccgcctcccgggttcacgcaattctcttgcttcagcctcctgagtagctgggattacaggtgcctgccaccatgcccggctaattttggtatttttagtagagacggggttttgccatgttggccaagctggtctcaaactcctgacctcaggtgatccacccacctcagcctcccaaagtgctgggattacaggtgtgagccaccacgcccagccacatttatgtctttggttgaacatttatgttgtttctggttttttttttttttaacttgaatgacatttttataatagacacattcttgattatgtttgtaggagaaatttctacaagtggcattgctgggtcaaaggatgcatatatttttaacatttttggtacatattgtcaaagttccttccagaaagtttgtactgctttatacgccaccaccaatatatgtcattccccagtgtcttctaccacctgggtgtcatcagcaaagatccattgtttgctgatttgataggtgaattttgtgtctcattgttttacatttaatttattcaattactgattagagtgaaaattttttcctatgcttagtggccatttgtacttttttctccctcttaataccagcttatttcctttgaccagttttttactggatttagagtgggtttgggaggggaagcacttgaggaaatgtgattggcacctaaaaccagatgtggggcggagacttctaggttggctagactagaagatgacatctggccaggcatggtggctcatgcctgaaatcccagcactttgggagagcgaggtgggagggttgcttgagcccaggacttcgagcccagctgggcaacatagtgagatctgtctcttaaaaaaaaattagcctggtatggtggtgcatgcctgtcttcccagctactcaagaggctgaaagaggaggattgcttgagcctgagaggccgaggctgcagtgagctgtgatcactctactgcactctagcctcaatgacagcaagaccctgtctcaaaaaaaagattaaaaaaaaaaaggaagcctagatctgtggctgtattttgttgaaaaggacagccaattgggccaaatgatatttcctaaagagggattgccacccctgcaaattaaacgaatttttttttgttttgaaataattatagattaagaagcagttgcaaagatagtacagagagaggtcccgggtacccttcacccagtttccctcatggttacatcttatataaatgtagaacaatatcaaaaccaggacactgacagtgtcacaatgtgtgggtatagctctaggctgtgtggccacctgtggagtcatgtgaccatcaccacaatcaagatgcaggtctagtccagcatttcagagaccaacctcttgctgctcctcccctccaccctccctaaccctggaagaacccatctagcccctcatctgttctccatctctaccattttgttatttggagaatgttatagaaatggagtcatacagtgtgtgacctttgagacggtttgtgtttcacttggcacaacgctcttgacatccatctaagctgtcgtgtgtatcaatagtttgttattgaaaagtaactttttaactcgtttctgctgtgtgcctcctgtgcacacctatgctgtctccctcaggtcactgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctctgccaagacacacaacagcgtaagacctgttaactgtgcagaccccatccaaacgaattacagtcacagagacacagacggagggagagccccagggtttctaaaaagaacttgctgtgatgggaatgcgctcgactgaggatgttatgatttgcaatttgctgggaaaagaatagttatttcattttctttagtgaggtcaataagattgttactctcataatcattttggaataccacagcctctctatctatagacctttagagcctctaaagtgatgtcaggatgtgcaaagcttccagaagtcaggcaccgctccattttcataggttggcacagcacttctcatggcagtacttggtgcaagggacctcaatgaagcagtgagatgtcctctcctgagatgcccactggggactttgatcctcttaagccattgttttctcaggccagtatccatgcagaaaactggatgacagccattcttattatcttaaaggaattgattgactgacttctccctaacagaagtaccccccagccatttgattgttgttttaggatctgccgctttgggtatctcttccctctgggtctgggctttagagcttagagatgtcctctcttgttaacaggacccagggcaagtctgttaatgtcttacgctcctcagctgagagtgaggggttcagacgaggtctccaagtgtcctgtgattctgtgaggtcagcagacattaagcagagttgttagacactgccgattcctcacaagcaacatggtataggcagaaaaactgaaggaatatgcccagagggagagctttggaaaagaaatgggcctcgggcagaagagtttcgtgtcaggaactcatttgaatcttgaagacagctcaggccagcaagcactgacacctcccccacacaccacgacagcttagggcaggtttctggcatttctccgggacaaccctgggactttgccctgtcccagtcctctctcatttgcacacacagaggtgtttgggctgcaatgggctcaggctcagctctggcttctgccacctgtgaggaccagggtggtgggtgtttctcagaagactgttcaagtctgtgtttaaagctgtctttctccctctcccaccaccactcactggctcagcctggcagcgcagccttatgatcgcgccccttacagcccagatcatgacttcttgggtgtcctgactggctattttatggtcagggatcctagggccctgccccatgaacctccctattcatgtgcctgtaacttcacattctcattgactctttcatttgaccttctcaataaagggactggtattattatcccaatttgggaaaataaataaacggaggcttagagagcttaagtgaccagtctaatgttacatagcgattttgcggttgagccagaattagaacccaaaattgttcaggactcttccctgccagactgcatatgcagcctcttggtcaggcttagacggggaaaatgcttcccctctcttgcaaggttgcttcccccagaggtgctataaatggctggctgggctcgttatttaagacacaaatgacctagctggggaacttgcatttggagttcttaacctagaagacgagacagtgggaaggagagaagatttgggaagacagattctgccctccagacattttcaccccaacctaccctgcttttacctccaggtgacctatggaagaaatgttgactttcaaagcggtgcttttccatccccacctgttttaaagagccagcactaagcatgtgcctgttcgttcatcttctgggaaaatgcaaccaggagactttccctgcatagtacagtgtttcctaccatgaggctaattagctttagttcagagcatctagctaactattatcgacagccctgttgctaagcctttgcttggattttccaggcatctggcccgatgagtaattttagggagcctgtgtggatgtaggttaaaaatgtctatgcatggtgagtgaggaagcctccctgcatcatggtttgatggagagtaggctctgagtatctgggaattgtgatctgacccttggacttgtcaatgttaagtcactgagagtcatggggctggttcttccatcttttaaaaatgatagatggccccagaggtcttctaggtgctcatttataagcaacaagactcaacgcatgcattgtgtgagatcttggatgctgcagggctggcaagtgttagcaaagtgcaataaagagccagacagtgaatgagtgaagattttctaaatgcctactgtgagccaaatagtgagctagatgcttttgttcattttatttcatttgattctcacatgagtcctgcaaagggggacctacttacccctcacagatgaggaggtggaggctcaggggtgtgagggatgcatccaaagtcacatagctggtgaatggcatacctggggtgtgaacccagggcagatgtctccatggccgaggctgcgcccatactctacccagtagggcacaagaggaggttgtcagggcataaactgttagctgtggagtgatgtggaagagatggctcttgatccaggccttaaaggatgactcacaccctttcaaaggttgtttctgagatgaccagggatgaggctttttgtattgtcatcttcacatacacctcgggagggtgcagatgaagaaactgaagctgagacaggattaaagcaatctccccagagtcacacaacttctggattttaccgtatctgagatgccatcgattttaagatattccattaggttatgtaccacgatgaaagaaaacatgcccaagacgaggagtctcataggagactgggccaccaagggccagcgtgtgcttattatggcatctctggggagaccatctgctgtgcagacaggggtggcagaaaatctcgcaggcctcgaccttggcattggttgccaagagggaaaaatgtctcccccaagaattggaactggaagtgggtgcttgtccagccttgtggtctgaatgcatgccgcctgtgtggtccagaacaatgtcaagctgagaatttactgtaaaatgccctcagtggggttgtcccccaacccagtggcacaaacaaacccatatccccctagaagaacttggatttagtctaggctggcagtacccgcgtggctccggctgctataagacacattctgacttcagggatgagtgtcttagaattgatgaaagacaattttaagtcttgggtctcagtaatccaagtgcagagtcctcttccctccctgctggcgcctctctgctatggttcctttggtagcttctgcatgactgctttgagactcagagcaatgtactgacagccctcgtggttgttttcacccaacattgtatgcggggcattgtgcatttacatgcccgatgtgagctgctgagctggccgaatccgtgttaccagccgctgcactaagcagaaatgtcatcttgaactgcagggtgctagcacagctctctgttcagaggccagctccctgagtgctgataacctggtctgaactttcccagaagcccagggtgctttttatggttggagcaacctattaatcctctagtccagactcagccacagccattggtccccgtgaaccaaacaggcaggaagaagcgggaggcatttgggatctgggaagtagcactgggttagcagaagctgcaggatggaatgactcctgtgcaatgactcctgtgttctgttgcttcattaccaaccacaaactcacatccatatggagaccccacctattttccaagagggcacacagatatgtctctgttttacccggaaaaacttgaaaccagaaggatagctacatagctacattgttctggaaattaactagccctcaatcattttatcggaggcatgtctcttcagtgaccacaatcctttcatttagggacttcagtttaaccacaccgcaaacagactagaaaaccaggctagccagtgggaaaacctacttgtggatggctcatttcaagattaaatttagaacttggtcagagaaggcctttggaattcaaccggaatggagctggagatggtgggaacacagtctctgttaataggaagaatcattttctttatatttgtgtagcatttacaaacatgcacccttttcacacaattattctgtttaattatttttctttctaatgtggagaggtagaaaaagttatttcatattctagacagggaaatggagacacagcaagtaagtgcctgctggggtgcccagttgggacaggatccctgtctctgagtctctcttttgtctctgtggggttggggcagtgggtgctgccgggtggattgagtccagccagagtggcctgttctagagtttactttgccttcttctcagtctctcgagtacaacatctttgaaggcatggagtgccgcggctccccactggtggtcatcagccaggggaagattgtcctggaggacggcaccctgcatgtcaccgaaggctctggacgctacattccccggaagcccttccctgattttgtttacaagcgtatcaaggcaaggagcagggtgagtagttttgttctgatgaattttttgttaaatcacgaattaagttcaaggccacaaacatttattaagcaccttgagacagaatattaagatgaatttagtggattccagggataagagggagcctgaattttttattcctggcatttaaaatactggagaaggagtcagtcgtgtccacagagagccctagcaaagtgagatcatggtatatgctatgataaggagtgtggagtaaggacccagaggagggagccactgctgtagttggggagagtgtcatggggagaggacattttgagttgggctttgaaggttaagtaggagtttgtcaagtcaaagaagggagatgagggaatttgataagagtatcatgagcatagaaaatgtacagtgtattcagggcatgtgaagcaggaaagagatggagctataagggaattaaaaggagagaatgcaattggaaagaaagtttggggccagatcttgaacatgataccagatccgcctcacagcatgcttaggggattcttacagggtttaaagttgaagtgtcttgggggaaaaattgtaaggtgtgttagtttttgtagagttaaccagttactggaccttgtggggagttttggcctggcatggtgggagctggccccacacaacacctgtccacctgtctgtaaggagagccctccatccctagatctcacaggcccatcctccctccaggagggtttctagagaggtatcctctgtggctgtggcctgagctggggggactcttgtgttttgcagctggctgagctgagaggggttcctcgtggcctgtatgacggacccgtgtgtgaagtgtctgtgacgcccaagacagtcactccagcctcctcggccaagacgtctcctgccaagcagcaggccccacctgtccggaacctgcaccagtctggattcagtttgtctggtagggttggggcttggggagggcacagttctgcagggccagctcgctggtgctggcgaggctacagttgcatttggaaaggacacagaaatagaagtgaatgatattccctttctctccaacgtgagaaatacagtggactcagatctctggagatgtattttctttttcttttttttgaggcagggtctcgctctgttacccagactggagtgcaatggcacgaccttggctcactgcaacctccacctcctggttcaagtgattctcatgtctcagcctcccaagtagctgggattacaggcatgcaccaccatacctggctaatttttgtatttttagtagagacggagtatcaccatgttggccaggctgatagaactcctgacttcaggtgatctgcccgcctcggcctcccaaagtgctgggattacaggtgtgagccaccgggcccagcctagcttggcctggagatgtattttcatagttaatgactggttgggtttcagaatcttgagatcagtttgtgtcacacaatgcccatactgtgttttacctaatatattaagaagacatttgttcaatttattaggtccatcataagaaaggacactgtggtatttcaggacttctcttctctcctacagtatattgtagtttagcttgtggagtttggagtttcaacagcctaacttcagggctcagctctggctgtgcttcagtctcctcacctgtataatggcaataatagtagttgctcccccgtgaggttgttgtgagggttaaatgggttaatatatatgtacagtgcttagaatggggccatttgagaactgttagttgtatttgcttgggtaatttgtgtgatatccccttggtgagaggaaagggttcagatttttaagtttccttgcttgaaacttctttcccatctttcatttgtcccatgactagaacattccactcttccagctccctgggccacagattcctatggcgtattaaagaaattgttaaaccagagagaattttttttcttggtggttgtatgggtttttagaaagtaacctatgtcccatatatggattaccagttttcaaaacatttaaaaataaggaactttactttgttgtaagtaaaacgtgtataatcatgtctgtgttttctgatctctcaaagctgttccaatataaggtgccatcgttcctcctacttgtgattatatgtgtaggattaggggattagaatgccagaagagggctatgtcctcagaaaagccacagccaatttgactaatcagaacaggggacaggacagagtctaagatgtagtgatattttgtatatagttttactttctccagtaatagatccaacaacctttatacagtgtctgattctttggttaccttaggctcatctcctttttaaaaagtttatttttatttttagagatataatagtatctcactgtgtcacccagtacccaggctagagtgcagtggtgcaatcacagctcactgcagcctcgacctcctgggctcaagtgatcctcccagctcagcctccccagtagctggtactacaggcttgcaccatcacgcctggctaattttttaattttttttttttgtagagataggctctcactgtgttgcccagactgttctcaaactcctggactcaagcaatcttctcacctcagcctctccaagtgctgttagtaggattccaggcatgagccaccatgcctgctctccacctcccttctgtagtctaaacttcagtgaggttttaagagaagaacaaagaatgtgaggccgggcagggtggctcacacctcttatcccagcactttgggaggcagaggtaggaggattgcttgagcccaggagtttgagaccagcgtcagcaacatagcgaaacccctctttacaaaaaatttaaaaattagctaggtatgggggcctgtggctgtggtcccagcttcttgagggggccgagtgggaggatggcttaagcccaggagattgaggctgtggtgagctatgatggtgccatagcactttggtctggaaaacagagcaagacgctgtctccaaaaaaaaagaatgcgactagcacttttcctcctgagctgtgagatttcaccttcaagcaggatcttgtgtgactgtcctggcccctcacccgctcctctcttctcctctccctccaggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttcctttttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttaagaagttttctttgtggggctggggaggggccggggtcagggagagtcttttttttttttttttttaaatactaaattggaacatttaattccatattaatacaaggggtttgaactggacatcctaatgatgcaattacgtcatcacccagctgattccgggtggttggcaaactcatcgtgtctgtcctgagaggctccacaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgggccatgccgtctcacccacagtatcacacgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggcgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggacttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttcaggggtgtgtctgtattgagatgttcgggaggcggctgcttgacttgggcctccaaccagacttcccctccacaagcattcacggagccctcggcttcagtttggtgaatataccaattcaagagttttcactccatgtcacaggctgctacgtccaggccacgggattctaattctaagcaaagatgcagcctgcgggtgcatggcaaaccaagtgtcagaaattcacagactctatcctggagagccctccagaatcaagctgcatactgaagcttgaaactgggaatggggtgggaccacatgctttcatgtgggtgacccctctgggctctctgcttccttccagcttgtttaccccggaaaatcctccagcatgaaagataagaggcaggtgtgttggcccttatccacacctcagtccggaaacttgtgggaaaccaggttataaaggcttggtcttccactttcatgcaagtgtcaagaatgcactttggccaggagccccgcccaccccagcagtccagatgcttggtttccgtggttaccctgataactggcactcacattattgattctgagaagactgaatgaagagagtgtgtgccttgggccccccaggcctatcatagggttgatgaagtcattatctttttttcccttcctcctcccctcttttttttttgagacagggttccactctgttgcccaggcttcagtgcagtggcacgatcttggctcactgcagccttgaccccttgggctcaagcgatcctcccacctcagcctcctgagtagctgggactacaagttgcacaccatcatgctcagcaattttttgtttgtttgttttgtagagacacggtttcatcatattgcctgggctggttttgaactcctaggctcaaacagttcacccacctcggcctcccaaagtgctgggatgatagatgtgagccactgcagccagcccatttttattttctgtccagccctgtccaaacaggatatgaggtgacttatacaaacacatacacagtgccacagtttataaataaagagtgtttgggtaaagggaaaataagagcaagaaaaataagataaggccttgcaggggttagcgtgtgacacctgccacgaggctgtaaacttgttagcgagctccgagtgtcctggcaacacgtacacaaaagggaagtatggccacttacaacacttacagtgaccagaaggtaaagaagataaatgagtccttcataaggaatacagcaaatcctgggaaccacagtgttgagcgtctggggctggctcttacctgcctttcactgcatgctgatggcagagcactgtgaaccagtcaaatcgagtctgtccacaagaaagggacaaaaagtctcaccttaacattgatgggacctgggacaagagttaacatgaagcctccaggcccacagcccatcctcctattctcataatggcttcatctcacaccaagatgggcctcatgcccatacctgtggacactgcagcccacgtgtccaagttccatccaagcccagcaaacagctgccccgtgaggtgtccacagcagctgtgaggtcttccctccaaagaatagagccagcacagagtccctcttaggtccctttgagcagggacccaggtaccaaagctggcctggaagggctctggttggcaacatctcactgacccttgggaactcctcactctgtggtgaaaggcatgctggagggggcccagagagagggcttctacaggtagaccagcctcgaactcctgggctcaagtgatcctcctgcctcagcctctcagtctccagaatagctaggactatggatgcgtccaccaccactcctgtcaattttttttctctttgtagagctgggggtctcactatattcaggagttcaagaccagcctgggtcttgaactcctcctggcctcaagctgtcctcctgcctcagcctcccacatgtttttaatg

SEQ ID NO: 17375 - DNA, 84296 bp, Human
  misc_feature (1)...(84296): n = A,T,C or G
attgaagaaaatacagcacgcagtgcactgaagttttgtacctgttgtacaggtagccaaaagatgacacatagagggtggatttttagttttgattaattcattggtaacgtgggaaatattcatgcagaaacagaggaatgatcatgcagtggtgcagttgttcctttgaaggaattttgaacgttgcattacagttcaactgtcctggaaatcaaaaatatggtagaaagtggagatggtggggaggacgtgtaaatatctttaactcccccttcttggtttccaaacgcctttatcactccattcagccttaggccaaattctggatgcttttacaggtgtttttcacgtgtaaaatgtgcatatctatctcctaggagtatcgtggagatggaatgggatatgtaaagtgtgctgtatatagcaactgcatcattagagcatctttcaacagaagtgcacatcccctcatagctgatgactggcatttcctgttcatttttttccttctacctcttaaccttactgacgatgctttcaatacaaatctaataataacggcagctaacatttatcatgtgctcaaattaagtcatttcatctccccaacaatcctatcaggtaggactgtcatcttcatctcctgagccttggaatcatattaggcagcctggcttcagagcccagcactttttgtgtttttgtttttgttttgacaggatcgcattctgtctcccaggctggagtgcagtgatgtgatcacatagctcactgcagccttgacctactgggctcaagcagtcctcctactgcagccttctagtagctgggactataggcacgccatcatacctggctaatttaaaaaaaaaaattttttttggagagatgggtctccctatgttctccaggccgaactcggaactcctggcctcaagcgatcctcccacctcggcttcccaaagtgctgggactacaggcgtgagccaccgcgcccggccctgagcccagctcttaagcacgcagtccaacacgtttagctggagagacgccgggtcacttcttgggccataccctctcatcacaaactcaggtttctcttagaaatcactcttagtgtccgcagtgcctaggactcccgccttggatcctggggcccacgagaaggtaatttaattcacccagatagaaccagcccaatcgtgtccctctgaaccccgtgaactttcaccccggctgagcagtaagtctgcaccgctgtccctttctttgtggtctcagggctaatccaaagtgacaatttcctaagaagcagtacggggttttttgtttgtttgttttttgtttttgagacggagtcttgctctgtcacccaggctggagtgcagtggtgcgatctcggctcactgcaacctctgcctcccgggttcaagcaattctcacacctcagcctcccaagtagctaggattacaggcgcacaccaccacgcctggctaatttttgtatatttttaagtagagacggggtttcaccatgttggccaggctggtctcgaactcctgaccttgtgatccgcccgcctcagcctcccaaagtgctgggattacaggcatgagccaccgtgcccggcccaggtattcctagaagacataggaccccatgaatccttgcaggagagcacgtaaactggactcctaagcccgccccagagccccggcgctagtgctcgaggctgggacactgctaggtgcacacagccgcggcctggcgcaggcggtgcggacagagggtatgccatggcgagacgctggcgcggcgcaggccctgccggccgggacacggagggcggggcacaggcgcagcaggaagggggcgtggccaagagccgcccggccgctcccccgcccctccccctccgctctccgccccagcccggcggctccgccccctaggtgacgtcactggccaggccagccggcgccattttgaaagtggagtcgcctgcccctgccgctgccgccgccgccgtcgctgtcgtagtcgccgccgccgctgccggagaaagagcacgagcggggaagccccagagtgaaatctagcatcctgccggctggtctgcccgcccctccttccttttccccccggcccccgtcccctccccccgcaggtgccatccgccgccatccgccctctctacccccccatccccaggtgaggggggtgagttcaggaagcggagaccccgaggaacccagcagggtcaccatttgcagcgcaacatggcaggtaaaggagaaatccccctcgccccctgacaaggcaccgcttccttattcctccctccatcaccccctagcgaccgcccgcgcctcgcgcagagccacagggcgcccctcgggtttgagggagtagggtccagaggggtggggtgggggcggggagggctcccgggaggcaagtggtcacggtgagagtcactgggcttggagaacggggctggcgccgtggcgggggtgggggtggggtgtgccggcgagcttggggtgaggcgtgggtggggcggggtgggggtgcgtgcagatttgtccctcccgctcgggagcctggtggatcttctcccacctccccaccttgccccccgcctttatttttttttcctgcaggtcttcatttaatttctatttttccccctgctgcaagccttcttgggtgtatatacacatttattttgcctcgagaaggaagagcgccttataagttaaaatacagtgggggcatatgtgtattttttccccactgtagatgccaatatttttgagactggaagcctaaattttttgtttcgaaccatttcgtttccgtttcttcccttttaccgccgaagagtgcaaggcctttcatgtacagcaagttgcatgaaaataatttaaactttgcgtttagcatgttagcttttttgcagatgtccttttcccaaaagggtttggtagagttagttaaaatagttgcggagttcagagatataaatagcaaggaggagagagatttaggtagaagctttgaaggggaggggaaaggatgtagagagaaaaccagtttggaaataaatttagcaaggaataggggtgatgggggagagagaagtaatgtaattgctttgagaattctttttgtacatgttggtattgctaaatcttttccttcatgtagtagaatcagttgcagatttagattcagtttctttctccctagagccccaggacattttcaatcatttcgacctcagtacttgcacgtgaaatagaaacattccgagatgagaccagttttccgtgctgtattcattatttagataattaaaccttttgaaaaagttaacatgtcggattgacttacggtttgctataaacaagttgcttgttggccttgttgaaaaatgaaatgagattaaaattgttttgcacgagatgacattagcaaaatgaattctttgccaggtcctttggagtcaagggatgaggtgaagggaggcagaacaagcttcctttgacagtctctttagcagcattcatttcggtttcttttcctctctgtctggagccagtgatttgctggtaatgaatgcaaagaaatgggtgtagtgtttgctgtgtgtgcactttggtgataaggttcatatgaatcattactccttacccaggcagtaatgttcccgaagttttctcttcgttctatgtttcatggtagtttaaccttattaactcttctgcaggctttttgtacacttaagaaaactctttaactcttggtatttactttttttctggtaggtcttgcctgaatgtaaggcttttactgtatttgacaggaagtttgtgaacagatgtttaatgaccacagaacatgtgcctttaaatatttcgtacctggaatcttttttttctttctaatgcagtaccaagtattggggactaacctctttccaaactggtgctcttggtggtagttgtatgtgtgggcagaactaggctgttagtatcatgccaaccatggataccatctttgtgtttacgagagtcaacataagcagaactcggttttaattggtatgttttctttttccaggagctggaggagggaatgatattcagtggtgtttttctcaggtgaaaggagcagtagatgatgatgtagcagaaggtaagaaagcgtttaatgcaaaatttggatatataatttttgcagaaatgtttcctactggaggatttccttgaagccgagactgctataaattcaagatgattttgttgtccaagaaatgtaagaacagttttaaaagatacctttctgaaaaacagccttaaatttcatttgttatttacgccttgtttttattattttttcctctgaatttacatggaaggagcggtagatgatgagacatataagatcctcacatgaaagctctgagctccatataagggtttctttgttatgtaaattccacatacaaataaatggtgatgcatttttatgtttgtacattggttttagataagtaaattgaaataggtgccatcaacatttggctcagaaacattcttaacggcatctttgatttttatgggaagattttttaactacttttgaatttgtccactttgggagtgtgatgctgcttggcatattctgtgaagagatgatagctcagattattcattttgttgtctttctggtatttaggtggataagacagtaacaatgctatgcatatatcgcttgtcttttaggaatcgtatattcttgtgcaggtagaaactgtgtttgatcagttgaagtacttacgtctaattttctccccaaatttattttctaacgtgtttcagaagtttaagttttgaaacttcaaggttttgcattcatttgagatggtcttaggcagcggaggcattttccacaaagttgttgcattgtttcattcctgagaaatgttaaagtttgagttttaatggtattgtgtgtcttgaattacagtaggaattttccaaacaaaactcagataaatttaaacatgtacttgtgagttttaaaaatttggtgaaaattcataaaccttttttccctagattgtgttgtcctcatatttctgacctgtctgtagggtactgtttgttctggagattttttttcaggtggtgggtggtagccgaactctcttatttgcttgtgtcagtgtcatccttaattgtctgttttagagtgtggtgaatcctatggcaagccaactggtgtagattatacttgtcatattttgcagagctctctcacgttccttttctattggatcctcatctgtttcttagatgagaaaccagaaacaaaagagactgactgatggtcatgcacatagtgtaaatcaaggttttctgatgaagtcagtggtgtttgacttgttcagagaagtaagtcctgacttcaagggaggagttgtgtattactcatgttgtaactacattacctgttgaatagtaaacactccagtattggatcattagttctgtgcagttgtgtaatactcaccaagttatgaaagtgctgtatacttggaaaatgttctttggttgaattccatttattcccttaggaaagttcccctaaatgctgagcactgagggtacttggtgtctggaacataaactctgcccacaaggagctcatagtttgcttgttaaacattacgcagaaagatcacatggcttttatttaatcagaagaaattgatagttcaaagtgaacatcatttacctacctgaaccaaataacttgtgatatacattaagtcctcccttaatgtataggttctgtcaataatgtaatgtcaataggttctgtgactttaagcaaagaaagcaacttataacaaaaccattttttatccataccataacaaaagatgctgagcagaaaacaaagtcaaagttttcaagaacctattgacgtgaagttaggagataaatcagttatagttcccctttgctgatacttagtagctgcatttttctactgattggttaaataattttctttagaggttgttaaatattttaacgtaagcatattcttagcatcgtaaaatgctgatacttggtatatacattttagtaagataacatatcttagtaaaaatatgactagttctaataggtattgctgtacaaatgtattaagtataaaaataatccagttttcaaatgacactgctttaatttggatatttctgcatactagagtttgcatattatagtcttgcttatttgactaaggggagatttgcttttctgaagtaaaataaggttattaacacattccccacccccctacctttagactgatctcttcaacaggttacatgtagctcaacttttacttgcctgttttctgttaatgatacattttgattgtctccatattgcctgcctttctcccgtctacatgcagtcagctgccagggcataccatttttactctgtaatgccttaatcttctttgcatacctgctttcacctctattcaggtttgcactctccctcatccagattgcagtaagttcctaaattattccctgcttcttcgtcctgttttgcttcaaagttaatcttaaatgcagtcccagttttgtcattttcctcataagtctacaagtggatcactgtatccactggattaggaattaagttcaaacatctcagtctagaatgtatgacctttgcccaatatggcctctgctctcagtttatttgctgctatggctaatgacccagctaaacagatactgttcttaaaaggcgttctatgctctctcactttagggtctttgtttttgctgcttccaccttggaatgcctgacaatcatcccacagttctcttaccaggatcctgctcatctctcaagtcacgcctttaacctttttgctaatttcctcttttggaaataacctatttttaaagtcttcctttatagcactttgttacgtagatatcatatggtaccccacatctctactgttacatactacagagtttagtgtaggactgatttatcttcgtaccttatgcaggcatgaagctgctctgtctagaacagtgcctggcacacagtagttgaatatttgtttgaatgaaggaacgtaaatgttattgttcttaggttttgaaaggggaagagaaatggtaaaaggcaggatgattgagatgtagttctagcagtcatggatttatttacttggtaggctttttaaaataaaaatttaaaacgctttctgcagaatcatcggtaggctttttataaccagattgatgttatacaaccgtataatgcaaagaaatcaggagaccttgggtttttaccctagctccagcacaaactagtgtatgtcactggggataagtactctcctgggttcctgtgtgtttagcaatggaataacaagagtggattaggtgatttctgctcttccttgtactttaatcttgttaatttccaaaggcatgtaaaaacagcccaaattcttttggtgtgtgtgtgtgtgtgagacagagtctcactctgttaggctggagtgcagtggcacgatctcgactcactgcatcctcagcctcccgggttcaagtgattctcctgcctcagcctcttgagaagctgggactacaggtgcaccccgccatgtccggctcatttttgtatttttattagagatggttttgccatgttggccaggcttgttttgaactcctgacctcaagtgatccacctgcctcggcctcccaaagtgctgagattacaggtgtgagccaccggccacaaaattattactactggtaattaatactactggtaagctagattgtttgagataccgtactctctagaggccttaaataaaaaataaattattgctagtaatatattttacatttttaatttttcttttattgaaaactgtctgtcatgagacagtaggttaagagcacagactcaggtgctaggctacatggtttgaatcttgctcagtcatttatcatttctgtggtcatctctttgtgcctagctcccctctataaaatgaggataacaataaaacctgtcttacagtgttgttttgatgattaaatgagtttatacacataaaacagaacagtacccagcagaaaagagccttatgaggatttagatattattacttgaaccttcatattattgttactttgaaggaagagtctttggagtatgagtatattgaggatttgtctttaaagcctactaaaaatttctcaaagtgaaggaaatagcatatatgtgtgttatacatactctttgattccactagtaaattacaaaatacattcaaaattaagctataggtttagaggcacatatgcagctggtaaaactatgaagaaaagctatgaagtaaaaggaaaaaaacatactgtaaaaagtactataaaagtcagtatagtggctacccttaagctgttggaaaggagttgtgatcgggaagggctggggaggcccttgtgggctatcttgactgggatggtggttgtacagatgtttgtaaagagtaacctggacatttttgtttcaatttttggttttctttatctgttacattttacagtaagaagtttttggaaatctaataatgtattaaagggtttaggatgaaaaatggcagtcccctacctccccactccttaatccctagtccatctcctaagagcagttgttcaactcttccgctgggttccttggtgcttcatttcctttttgggaataaaatggtatttctatatcttgtcaattttagtatttccagctgacttgctcctctagtagatgataactaagctattcacattatcacccccatttctgtccccattgtgccccgatgttacatcacacactatgattaaattggacgtcagtgcttaaattgttatgaccacgcacacattctctgctgaaccagtagtgctctgcagtgtttatttcatcctcaaggtaatacagtaattgcttgtttgttaatttgactatttggttttttaaaaaacgtaatcaatctggaacattacagaaagtatgtggaatagtataatgaacccctgtcacccggcgttgtcaatggccagtgttgccccatgtatggttccatcactggaccctttcccatccttttgttatttaataatgtaatacttgtttttaaaatctgaatttaacaaaatagaaagccaagttcatttcttaaagtcgaacagtaagaaattttttctaatgattttgataatgtgtttaaattttacttgtggaaataaattattaaaaattcaaatacatgtggataatctgaagtgtgtaataattggtcaaaataatagaacaggccaggtgcagtggctcacgcctgtaatcccagcactttgggaggccaggcgagaggatctcttgaatccaggagtctgagaccagcctggacaacatagtgagaccttttctctacaaaaattaaaaatattagcagggcatggcagtgtgcaactgtagtcccagctactaaggaggctgagacttgagcctgagaggtctgctacagttaggctgtgattgtgccactggtctccagcctggacaatagagtaagactctgtttcaaaaaaaaaaaaggaacaacttaaccattcaagatagttattttaattattttaatgtagatttttcattgtttagtaatcttaaaatatcagatgttattaaatatttaataatgaacctcatctgcatatttgatagtcttaaactttcacaggaaattattttaggatattatcttataaagtcttattttatgaaacttggatccaagtacattgtgtgttttcaactctttgctttctgtttacttttggtaggatttagccttgtggactgggtcttgaaaaaatattttttaaatggtagaggctaaaatatgccccaaataaggacataagtaaaaatttgaaaaacagtccatattatgatatctcacacaatttaatggttttagtccattccatatgtttaatgctataatgtaaacaatttaaaatcatttctcttctgcatctcttttttttttttttgttagagacaaggtcttgctgtgttgcccaggccgtcttctgtgtttcttagagtagtatgcatgttagatttaggcagtaaggtaagttagtagaaaaagtagaaccctgttgttttgtggatttaaaaatagtggcacattagctgtattccgaaacctaatgacctatggtaaaggtcttatttaatatccttaccttgtatgacatgtgacacttctttttcttaacactagcattactactgaagtctagtagacctcactcagtacagtcacttaaagtagtagtgtaagtttacccattaaataccatgaatgatagtatctgtttagcatcaaatagttttcttgctttgttttaaaatactaagttttttcacattcatttgacaaaaaattatgagagagaatggccattgaaaacatattgctgacattttgtcatgttattaaaataaaacaaaaattagccttaggtgtttcttagtactctgtaatagtgaacaaaatattaaaatcaagttcttgaaaattgtggaataagcagaatgatgagaggttgaagcaaaaatgtattaaatcagtgaagaggttacagtatgttacgtatttgcatataagtgtttgcctagtttatcttaaagttgattgtaggaagaaaggtacgtttcttaatgctgttaaataggaaaactgaaggattggaaatagctaaaaaattttagttaatatcctcaactgtaatctcgttgccctttaaggtgatgatggaatttgtaattaagtaatcaagtatccataaggtgcttcctcagcagacagaaagaaaagtaaaagctggcggggcgcggtggctcacgcctgtaatcccagcactttgggagacggaggcaggcagatcacgaggtcaggagtttgagaccagcctggccaatatggtgaaacactgtctctactaaaaatacaaaaattagccgggtgtggtggtgcgcgcctgttgtcccagctactcaggctgaggcagaagaattgcttgaacctgggaggtggaggttgcagtgagccgagatcgtgccactgcactccagcctgggcaacagagcaagactccatctcaaaaaagaaaagaaaagaaaaagcctaggtgcaaattagattttctataaataaactgctatatagtcattgtaaggaaggcatggcatggccatcttgagtacctacattttttgagtgcttaactatgtatcaggcattgttttaggtcctttacatctatttatttactgttcttcacaaataccctgtgaaataagtagatactggtgggaaagttaattaactgtataatcttgagcaggtggtgaagctgggattcttaccttagacctttcacttttcctaatataattttatttcaaaacttaatctccttttagttcaggtgaaggcgtttgatgttgaactgcaactcctgtttataacaaggtttatttgtaatgcctagtagatactttttattttgaagtaattaaatataatttggagatttgttgaattttcagctaatgccattcttttttttttcctttttcttttttttgttttttttttttgagacggggtcttgctctgtcatcctggctggagtgcaatggcgtgatcatggctcactgcagcctcaacctcccaggctcaagcgatcctcctgccccagcctcctgagtagctgggactacaggcacaggccaccacgcccggctagtttttaaaaatttttttttgtagagacagatctcaccatgttgcccaggctggtctgctgatggcgttcgttagctgagatgtgctatatatagatgggttataagggctttgtgaaccctctgatgatgtgtgtgaaattgtgtgtgattgtacatatgtgcatttctctggtcggagtccgtagctgccatcaaaattgatatcatttagtccagtggttctctaaatgtcgtctggcaacccctgaactcattccaaatgtctgtgaagtaaaaactattttcacagtagtactcaggtgatacttgcctttttcaatacattgactttgcagcagtgctgcagaagccatcttagcatgagatcaagacagtagcacaaaagagtacctgtagaggtaatcttcattaccatgtactagcagtttaaaaaaccatcagttttaagaatgtccttgaagcagtgaaaacttaatttgattaaatttctacttgaacacatgtctattaaacgttctgcatgacagaatggaaggtatacctagagaaagaacttctgcaagggggtaaagtggttgtctggaggaacagcattggtgcagctgttttgagtttcaactgcagttttcatggaacatcacttttatttgaagtaactgatgaactatagttattcagacttggatatttggtggacattttctcaaaagaacagtgaaactgatacttcagtgtacagtgtttgttgcccatgatgaaatttgagctttcaagcaaaaattagaattttggaaaacacgtctctgccattgtgagcttgacagcctcccaatacttaaaatattttttcaaataaaatcagtagtcatattaacgaatgtgattttttgatactatgtaatgtgttaacatttggaagatctgtataactcagtaaatcagtcttttacgggtgaccgatgcatgtgatgttaaacagtcatacatcagtaaaagtgcgtgctagagcattgaattttaatgtgacagactaccgatatgttttgagattccacaaaccttcaagaatccaccactgtggaattttggtgtagtatcaaaggtatatccataactacctgaaacacctattaaaatattcctccctttctaactacatatctgagtgaggctggattttcttcatatatttaactgacagaatatattgtggtgcagtacattgaatacagaagcaattaagagaatcttcattctgttaggccagattaaattaaagagatttgcagcagtgtaaagcaatgtcattaattttgttggtggggagggggatgtagtcatttttcataacatttttgttaatgtgtgaggtttattactattttacaatgaagaaatattttaaagtttaaaaggtctttgatggtctaagattttaagagttaaggggatcctgtcattcagaaaatttgagttgttggtttagtctgttcatagatttcattttagtaataatgctttacaagtctcatgaaccacaaggtaagtgatcagaatagtgtactgcttttgtggatgaatgtcttaaaaaattgcctacgaaagtagtttctgtgacttgaaattgtttcagtctcctccctccctgttcttttagataccaaattagatctgccttaagctccttcagctggtgatcttggtgaaggaagaataccttcaggacgttaaagtatctatttttaaacttacctctcccttacagagattaaataccagtaacatatttgccagaataaaataattttttacggttttccccacaatgtctgctcaggtccaactatcaggaacactgaaattctcacagcctaatttagtgccactcctaggttgcctgcctcgtcattagaagtgagttggtgaccttgacattgtgttttattttgagcccaacttgtagcagtttggtgatgtgttgtctgttctaggaaagaaggcataaaattggcttgctaactttcccaacttaactactgaagggaagagagagagggaacaatgtttttctgaaaatcctgaagtgaacaacataattatattttaaatagttaaatttcccattctaaggatgtagtatcaactattgcttaatattttcagtatttttgtggctgttttctactcttgaatgccaaagtttgtagacttcagcagttttctgtccaggtttaaacactgaatgtaatttaaaaaaaaactccgctaatttttaaaaatgaatatgaatgtttttagttaattttggcagtagttgattacaatatcatctagatctttgctcttggcatatgtggaatccttggcaagtcgttgaatacttctatataccacattgccgggagttacgctcttgtagcttttagtttctattggttaaatcctctctgtatgttcaaataccagatggagttttctcttctagaatcttcgaatgatctctctttttccagttcacagggtctgtggaccggtgatctggtttaagaacttctgctctaatcttgagttatgcctgtgtttacacacttactgaaacttctgtgctggattctaaatttggaagaatcaaggatatttgtgtggtaataatggtgtttagactatttaggagggtattttttcttaccggtcctcttattactttttcctgagataatatgggagggattaatcatctgtaaaataccagacttgacagatttagtgtgttcccatcttttttttttttcctttattaaaaactgtctctcatgggtaaaaacattagaaggatatattggattttgaaccagttgcttattttatactttaatcagaaggaaatttaagtttttcagtagcttgtattaagagagaaatcagagtaggtaaaagggattgggggcaaaattttaaaaattttctaaagatccagaagaacatggttagatctggagcagtgttacttttcaaacctgccattgcaggctcattgtaggtctgtctgctctgtatgaaagtagaaatagtacctttttggtgttaccctgcgtgtctgttttttcctgcttaccacaaggtaagattcttaagggtggatgactttctaagggaacaaaagaggaatctttccttttggctaatagagtgggaaggctctaattcaagagaaacaggctattgtaggcaataaatagttctgaccaaatttcttatcaaggcatgcaacatgcaaaaatgtttgttaaaggaattggtagtagcaaaggcattgcttgttctgtctttcttctccttgacataaaatgagcattatttttttttctagcaacagaaccaatttttaatgaaaatttttagctacctaatgtttttatgcatattatagaaaacatataacattaaatttaccatcttaaccattttcaaatacactgttcagtagtgttaactctattcatattgtgaaacagatcctcagaactttttcgtcttgcaaaactgaaactctatacccgttaaataactcccttcttcccctcccctcagctcttggcagctaccattctactttctgtttctgtaaatttgactgctttagattcctcctccaagtggaatcatacagtctttttgtgactggcttatttcataatgtcttcagggttcatccctgttgtagtatgtgacaggatttccttcctttttaaggctgaataatagaccattgtgtgtatatatcccttttgtttattcattcattctttgatgggcattttggttgctttcatgttttaactctcgagctcctagtctttttatatatatggggttcggtgggaaggaaccaggtaggtactttctgtaattaatttgagtagtctaggtagaacatgaaagtgtcagtttaaaggatttagagattggtgtagttttatttttaaaactcctgtttgattgagtctacatctctgatttttatggggagggggcagagctaaggtgagacacagccacaagtcaacaggtatctgttgagttcccagcactgtggagaatgtgaaggagatagaagacattattccttcattttaggtacatggaggtccattttattgaaataaacatttcccatagcacttggcatttggtattacaccctacgtatggtactgtgaaaaccttctctaatgccatgtaaaaattttacagatgatactagagtctgagtagtaaattactttcccttttctaagttgattttatgctgcttgatattgagatggggatgtagtacaaatatttacttgtttcttggagttaaattttaaaaaatcccatattgcaggtctaagaccataaatttgtcttttactgctttcaaatggtcgtgagttggaattttccaattagtatttttagagacttctctaggtgaatgtttatggtagcctacaagctaccatacaaaattacaaaaattagctgggcatggtggcacgtgcctgtaatcccagccactcaggaggctgagacaggagaatcgcttgaacccaggagttagaggttgcagtgagccgagatcgtgtcactgccttccagcctgggtgacagagcaagactccatctcaaaaaaaaaaatgagtttctagactggacgtggtgactcacatctgtaatcccagcactttgggaggccaaggtgggtggattgcttgaggtcaggtgttcgagaccagcctggccaacatggtgaaacaccgtctctactaaaagtacaaaaattagctgggcttggtggcgcttgcctgtaatcccagctgctcagaaggctgaggcacgagaaatacttgaacccaggaggcaaatgttgcagtgagcaaagatcgcgccactgtactgcagcctgggtgacagagcgagactctgtctgaaaaaaaaaaaaaaaaaaagttttctagagccaataaactgcatttacaaaagaaaaacattttacagcactgtacttctgagtcatacacagactacatttacatctaacttttcccactgtattaatcaaatctagtttgtacgtctgttttacaaaccaaatataggtaaagatttttatgttttagtaactaggttaaaaaaatctaataaaggttgggctttattagatgatgcatgcctgtagtcccagctactcaagaggccaaggcaggaggattgcttgagcccaggagttcgaggttgcagtaagccatgatcgtgccactacacaccagcttgggtgacagaaaaaattaatacatatatagaatggtaaatcaagaggaatacagcaaatgtatgcttctctcttctttctcccagtttcttcgtcctctcaccagagatgccatcacaggtttcttatatatcattccagaagtattttattttgtatttgcaatgtttttaacagcgcatctttatcattttggacttgaaagtaggaaaatgtattctaggaatccatgaattattaagcaaggtctataggccctgccttaaagaggatctgatgagttgcctgagaaattagcattttcttttaaccagtagattaaaaccatacagatttctatatggagagttgctgagaaggttgtacacatttggaatttacatctagatgtgtaattagtggactctaaacaaagctaagtaaaatctataatatctaagatatacaagtctttaaaaataacagtttgggttcacagatactggagtcttcggattgtagaccttaagtcttctttctccacttgaatctgattgttcctggcagtgtgtaaagtgatcggttcattttggtgatttatttaattaagactgtactacacattatagaataggctagatcctaaagacataatgtgtgttcttaagtgttcagtaaacacgtaggcctttttggtcacttgtccaccatgtctaattctcgacctaatttcttgggagttttgttaatattccttaaaatgccaaaatgtcataatttgtatactgctcaggttgattggaataaagctttgttaaattcttgctatgcagaattcttttaatctttaagaatttttgtttgttaaaggaaaaacaactttgattataaatgtctgagaaatttaaaaaataagtgctcaagagactgagctgtctataagtgctttatatgcattatctcgtttaatcctctcactctgaggataaattattactttcattttatagatgaggaaatcaaggcttagataaagtaacttgctcaaagtcacgtagttggaaaatgggggagtgaggggttgaaccttgttggttcttctgacttcacagcccatgtactatatgtaaatgaaaaaataaaatcaaatataggcatacgtcagaaatattgctgctttggttccagatcactgtaataaagcaaatattgcaataaggtgagtcacaaatttttggtttcccagagcatataaaagttatgtttacattatgcagtagtctgttaagtgtataatagcgttaatgtctgaaacaacagtgtacatgacaattaaaaagtacattattgctaaaaaatgttaatagtctgagccttcggcaagtttacattttttgccagtagaggatcttatcttgatgttgatggctgttgactgatcagtgtggtgtttgccgaaggttggagtgactgtggcacttcttaaaaagtgccaaatgaaatttgctgcatcagttgactctttcatgaaagatttctctgtagcatgcaatgctctttaatagcattttatccacagtagaacttctttcaaaattggagacaattctttaaccctactgctgctttatcaactaagtttatataatattctaaattttgtttgtttcatttcaacaatgttcacagtgtcatcaccagcagtagattccatctcaagaaaccattttctttaaaaagaaactgctcatctattgatggtatcatgaaattggaccaatacatctttaggctccacttctaattctagttctctcgctatttccactacttctgcagttacttcctacatggaagtcttgagcccctcggagttatccgtgagtactggaatcagctcctttcagactcttgtcaatgttgatattttgacatcctcccatgaatcatggatgttcttaatggcatctagaatgttgaattctttccaggaggttttcagttgactttgcccagatctttaagcggaatcactgtctatgtcagttacagccttacaaaatatatatatatatatactttttttgagatagggtctctgttgcccaggctgcagtgcagtggtgtgatcatggctcactgcagccttgacttcctgggctcaggtgattctcctgcctcagccttccaagtggttggggcttcaggtgtgcgccactacacctggctcatatttctactttttgtagagttggggtttcaatgtgttgtccaggctgggcttgagctcatgggctcaaatgatccactcaccttggcctcccaaagtgctgggattacaggagtgagccaccatgcgcagcctatatttctttaataatgctaacaattgtcttgtaagtcagaatcacgccttgatccatgggctacagaatgaatattgtgttagcaggcatgtaaacaacatctccttgtccctctctatcagagttcttggatgagcagcaatatttggaaatgagtcttttttctaagcagtaggtctcaacagtgggcttaaaatgtttagtaaacagtgctataaacagatgtgctctcagctaggcttttttctagagtacaggcagagtagatttgggccctagaattcagaatggtcaatgagcattggcctcaacttaaagtcacccagctgcattagcccctaacaaaagagcctgttctttgaagctttgaagccaggcatcagcttctcctttccagctatgagagtcctaggtggtatcttctttgaatacagggctgttaatacagagctgtttagttgactttgaaaatctgttgtttagtgtagtcacctttatcaattaaattatcttcctttcacttgaacacttaagaggcccatagggtaattgtcctaatttcagtattgtgtctccaggaggcccaaggagggagagagagaggggaactgccagtaggtggagcagtcagaacacgcagcatttttaagaattacatttgctgtcttatggaggtgcttcatggcattccaaaacaattacaatagtaatatcaaagatcattggtcacagatgaccataacaggtataatgatggaaaaattgaagttttgcaagaattaccaaagtgtgacacagagacacaaagctagcacatgttggaaaaatggtgccattcggccaggcgtggtggctcacccctgtaatcctagcactttgggaggctgaggcgggcggatcacgaggtcaagatatctagaccatcttggccaacatgatgaaatcccgcctctactaaaaatacaaaaattagctgggtgtggtggcgtacgcctgtagtcccagctactcgggaggctgaggcaggagaatcatttgaacccgggaggcggaggttgcagtgagccgagatcgcgccactgcactacagcctgggcaacagggcaagactccctctcaaaaaaaaaaaaaaaaaaacacagtgtctatgaaacacaataaaagtatgcctgtataatctcgcaatttttatattatatctgttaatatttgggcatagatctttccagcatatagttctttttccacagcaaatatgtattttcaaaactgttatcagacgtacagttttgtattatgtttttttccagttaacatatatgagaagataaatggctgtatgatatttaattggatctctaatgtatttcatttagacatttagattgtttataatgtttgctattgtaaagatcatgatgaacatccttgtgagaatcttattgctttaggatatattatctggaaatgggattgctgggtcgaaaggtgtgattttttttttcctttttttttttttaatggcttatggtatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggcgtggtggcaggtgcctgtagtcccagctacttgggaggctgaggcaggagaatggcatgaacccgggaggtggagcttgcagtgagccgggatcacaccactgcaactacagcctgggcgactgagcaagactccctctcaaaaaaaaaaaaaaaaaaacacagtgtctatgaagcacaataaaagtatgcctgtataatctcgcaatttttatattatatctgttaatatttgggcatagatctttccagcatatagttctttttccacagcaaatatgtattttcaaaactgttatcagacgtacagttttgtattatgtttttttccagttaacatatatgagaagataaatggctgtatgatatttaattggatctctaatgtatttcatttagacatttagattgtttataatgtttgctattgtaaagatcatgatgaacatccttgtgagaatcttattgctttaggatatattatctggaaatgggattgctgggtcgaaaggtgtgattttttttttcctttttttttttttaatggcttatggtatttattgccaaatcaccatagaaagttggtgttgatttttcacttcctccaatagtgaatgggagtggccatttcctgacctcttgacaatacctggcacaatattcaccattcagaaaaatcttttccagttatttgtttgagcacgttcaaatgttggagcctttttgtgttctttgtctagttttctttggtgatgcttttttaaatttatttgtagtatcacagcccttttccccttctgaatcatacattgtagtggaggaatgttggagggaagctcaaagaaataatttgggtctgtattacatgggaaagacttcctaaatgaagtggatttttttcctttttcttttttcttttttgttcaagcaaaggaaaccagagagtaaggaaacaaacatttgagaattgctgtgttttagttttcttatctgtaaatgggaataatagtacttgtctttttatttagaggattaaatatacatgaatgcttagttttggcacatagtaagcctcagaacatttaattgatgtagttatttttctatctgatacccaattaacagaattaacagttgatagcagaagaataaaagcctattccggtccacaaattgagatcaactagtttttgaggttttgggcacattttaggcacttccaataaatatacgttacattaatgactaacatttcagcttggttgagttaggcatttggtaaaactagggagagattagtttcccagcttcatcagaattgggattagtttagggtctggcactttgactattaatttgactaatttaaaattattgtgctgagccgggcacggtggtgcaagcatgtaatcccagttaattgggaggctgaggtgagaggagcacttgaagccacgagttcaaagctgttgtgcacagtgatcatgcctgtgaacaaccactgcactccagtctgggcaacgtagcatgaccctgtctctgaaacaatgaacgaaaaataatgtgtgacaacagaaattcaagcttctttttttctctcttgttttcccttttttctccagttcctccagtgttttattcttccctataattatatattctgcatcttccctcaagagtaatataattgggtggggtggggtgcacctagaacatgcaggagggtccaaagcacccttcactattggtgtcagtttctcatagcagggagggatggagtttgggaacatctgaagggatggtgtcaggcacacggaggctctaaaacaccctgctattggctccccttgctacctagggcaacgttgtaaatagcatattttttacattataaatattttctctttctcctcgttcttctactcacttgtttgtatgatgatctgaatcttttatcagagtttcaagtaggctgacaaatatatttagagcccttggaaaattctccagaagtctgaagagaatagaaatggaaagcaaatgttattataccagtgaacatgcttaattcccctcaattccttattcagaagtgtgctgttttgttaaaagagttgtattggcctgataatcaacacttctctagctttatgtgcatgtgaatgtcctgggaatctggttaaaatacagatgatgatggtgcatttaggtcttgtgggggatcctgtgatttttgcatttctgatcagctcccagtgatgctggtgttgctgctggtggtccccagactatactttgagtggcaaggcagcttatagcctctctttaagggtaagggagacctagtagcttaatttttttactcagcatttttgacagaataaatagatctattgtgctgttctcacatcagttaacatttcttctgtaaatgaataaaatacctctttgggagttttgcactagctcttaaaagagcagattgcatcatactgcaacacgttagccatctctagttgttactttaaatttgtatttcaatttcaagtttggctcggtctaagaccttactatacttagcaaaggtgtgttttttgctggtaatttgcccttaaatttttatctttgccatttttctgtttgcttccttacccttgaggcacctgttcatctcagatcagggcctcccttaccagctatctaagtttaatgttgttttagattgatttttattttatccatgtagctcatgtatatagtttttaaataaaagtccatatttcaaaatacttacaaggcaaatgaacagttttctgtttctctcacctgtcctcatcttgatccactttcccaaactcttttagctatttcttctggtgtttattttcatatttcttttttttctttttttttttttgagatgaaatcttgttctgtcgcccaggctggagtggcaccatcttggctcactgcagcctccacctcttggattcaagtgattctcctgcctcagcctcccaagtagctaggactacagatgcgcgccaccatgcctggctaattttttgtatttttagtagagacatggtttcactatgttggccaggctgatctcaaacccctgacctcaggtggtttgcctgccttggcctcccaaagtgctgggattacagggatgagccaccgtgcctggcctattttcatatttctaaactacatgctcatacagctgtttttaaaagcaatccacagatggaaatggtagctaagaactgaggtccgctaggctcttcctactgctcctcccagctttcttggtgttgttacactgtgttgattgtttaagccagtgttcacagttgtagtagactggataatggtccccgaaagaaatctgcgtcctaatctctggaacctgtgactgttaccttatatggcaaaaggacttgcagatgtgagtaaatcaaggatttttgagatagggagatcatcctaggttatcctggtaggctgtaaatatgtaagcacaaggatgctataaaagggaggcaagaaaatcaaaggaggaagcaagagataggagtgattgcaaggaaagggtcacaagccaagaaatgcaggtggcctccagaagcgaggaaaggcaagaaaatggattctccccttaaagcttctagaaggaaccagcccagctgacaacttcaccttagcccagtgaaactgttttttgactttaactgtaagagaaaaaaattaatggtgttttaagccaccgaatttgcagtaatttgttacagcagccataggaaactcacgcaggagtggacattgtacatacgggctgtataataaattctgatttttttctattattgttttctttagagttaaaaattaccttattcatttggcttttaatctcccatcactgttttctttctgcaccttcaaaagccttctaatgtaattttccacatgatcaagaagaatcagtttatgttcttcctggagttctccatcatgtttcagtctggagtacttcgtttcgttttctgtgaatctgtcactaaatcatcttcaaatcctctgcagagactgaatcccctcctagtatattgaagcacatcagatgttgtatcagttttacttttgccttaagctctatccctccaacccgcgtgcttcaatctgggcagtttctaagcctggtgcacagctgttgtcctgggattttccttcatcattatcattgtgatcatcatcatcgtgggaattcttttgcctctgctgtgttggagctccttgttcttggatctcacatctttttctttcttgttttatgctattattttgggatggtgcacagtatccagtgctttatgggaaaggtttcataggaggtaaaatttttgagatcttgcctgcctggaagagatgtctttattctacttccacactttcaagtttggctggttaacattttccgttagaatttgggaggtgtttcttttgtctgttagcttccggtgttacatttgagaacactaatgccattctgtttactgatttttcctttctggatgatgtgctttggtgtgggtctttttcattaattggactcgtactcattggacccttgcagcttgtagattcatttccttctgttttttccttctctgtttcatttgttctttctggaacttatctggatcttggactttttgtactggtcctctttttttttcccttcccccccccccccccaactattttccatttcctttttgctttacattctgggggagttcctcagttttgttctcaactctttcatttatttttaccattgcatttttaagagctcttttgctctttggaaataatgttggtggtggtagttttaagcagccccggttttataaatggagtatcttgtctttgagaagattaatagttttttgggtttcttttcattttctaatctgagcatctatttcctttgagtttcttttttcttattcatattggtagactggtatctgggaatccttggttgtctgttagttcttaagaatgaggtagtaagagtaaattaggagctttgtgtccactggcagagatattcggctggtgggcttcactgtagggtgatgagccagggacccgcagtcagtatctctagatgagaaggaacttctagtgtcttatctcagtgggaggtgggtaagtgggatgggtcacatcttaagcctggctgctgacattctgggagccaggaagatcaccgagcaactcatggattactatgcagcctttcatttaatcttgtttttaatttgacgcctcaccaccagcttcctctcaaattgataccttctcaaggtcaggttcagtttctccagaaggtaaatgtgttctctattttagagtctagcttctctgtgtcttgcatagatgtttcaaccaatagctgttttgagtctcatgcttcactgcagccctgcaaggtacctggtgcttctgtgtcctgacttgacaaccccttttgcatgctcagaggtttcactttattttgctgagttttctatttttcagcacattggttgttaccttccttctgctgttgccttgcgttttctttgttcttattttagactgtttttattagtttaccgtcattttagtgggtttagaagataaatgcgtgttttacatctacatgtttaacaagtgtatcaaaatgtttatagtttcttttcattcatgtctagaacacttggtaatcactttctatgcaatagaaaaggggaattcacagaatttatataaaagtagatttgttttcttaaatctaaattctgatattgtgtacttctttttttgaggtggagtctcactgttgttgcccaggctggagtacaacggtgcgacctcggctcactgcagcctccgcctcctgggttaaagcagttctcctgcctcagcctcccgagtagctgggactacagacacctgccaccacgcccggctaatttcttttgtatttctagtagagatggggtttcaccatgttggccaaggtgttctcgaacttgtgagctcaggtgatccacctgcctcagcctcccaaagcgctggaattataggcctgaaccaccatgcccagcttgtgtactgtttttaatggccttttctttcttcaattaatagcaaaaaaatgatacaaattaaaatagcttttgtctaagatactaacctgcatttttagacctaaatttcaggcatgaagcagtcagccaaaagccgtgaggttttaaagaacttaatatatcagagaaaacttcagctttcttagataaaaatcagtttatatttttttactcctgaaataatttaaattaacacatatatttgtcttagaatgaagacatttgtcaaagaccttttgggctgctgttaacagaatagtacagactgggtggcttacaaacaaacaacagacatttatttctcacagttctgaaggctgggaagtcctagatcaaggcaactgcagatctggtgaggacctactttctggttcagagacaactgtgtcttgacatgatagaagggacaagggctttctcttaggtctcttttatagggacacactaatcgcattcatgagggctccacccttattaccggatcacctgccaaagacctcccttccaaatacatcatattaggtttcaacatgtgaattttgtgggggatgaacatttagtccatagcaacataaagtagaacataagattatagtcagttactgattgcagggcaactaaaataccagttttccattgggaagatgatttgtcttgaaactaagacaaaggattaagagagtaatggctttctttgttttccatcaggaatactcgcctgttactagtagtacaacatttgtatcgtaggtttagtactgtgctccctctgcctaccccagaggtcattcctgtcattctccccttgctcactagtaggtccagccacaggagctttcttgagggctttgaacttgccccttttattctgaaatagaccttccttcataatcttgactaccctgtgtaaattaactcatttccattccaaccccaaaagagatgtacatttaatgttatctgtttttaaaatatctttactattatttgaaatgatgttacttattgtttgcttgcttattgtatgtaggcttctttctctccagtttgtgagtttcacgtatgaggaaatcctgatttttttgttctgtgattttcattcttagcatctgtaacatttttaggcacaggacagtatctggcatttagtgggcatttgttgaatggatagataaattctgcaatatgtcatctcattttaaaatatatgataacttcagttgtttattttactaaatgtacactttgttgtttaaaatagggaaatgaaataagctaaaaattagtagcacttcccagttttttgaaccagtaaaaggagacccagacaaatccccacagtcacacaagctagtatatgtattattgaccaaactactttaaagacccacatacacagtggttcaaaaaattagcttgtttctctctcacgtgaccattggtggcagagagggatctgaagtggataagctggttttgccagagattacccaggattgcaggtttgttctgctcagggtctaggtgtattgctcttgtgtgcacggtcagatctggctcaaatctgtgttctatctagcccatgggggagaaaagagagagaagggcaagtagctaccttttaatgatgtgacagaaattttattcataacctattgtttagaacttggtattagagaaacatgcagcctctaatttcctgttaaaactctgtgtgtatgtggttttttgggttctgagagtgaaggtgccaggatgtgccattactaaaggagaaagggggaaatggccactcttagggacgattagtctctgctacagctactaattcttagaacttttactcaggactttgttcattcctctttccttcctccttccagtgttactgtaaaagccttataggatcctaattcaaatagtttaatattttttatgacatgaaacaattggaaatttgaacagttactggatatttcatactaaggaagtgcttttgattttttcaaggtacggtaatggtgtttgattatattgaaaatggtggtcttttataaatctttcctgaaatatttatgggtgaaataatttgatgtctgggatgtacatgaaataatgtggcatgggtttatagatgaaacaagattgtctatgaatgtataattgtggaagctctgtgataggtacacaggaattcatatgatgctcttctgcctacttttgtatatgattgaaatactctgtagtgaaacttttaaaataccagtttatactgatacctccaatttaaattgataccgcagggttattccttacttccctcattctatatttatgtcttttggctctcacagtgagaaccttagttcccagccctgtaactattttttgtcagaatataaagatagacagaacctggatatttgataacattaagccaatgaattaactagccctgggtttacttgccatgccttgggactttttatgtgggatgacaatctttttattgtggtaaaatacacataaggtttaccattttaaagtgtatagttcagtgtcattaagtgcatacaaatctgttgtgcagccatcgccaccatccatatccaggactcttttcatcttcccaaactaaaactttatacccattaaaacattaactcctcattcctgtctccccagcacctagcaacccccattctactttgtgtctctatgaatttgactcctagatgtttcatattggtggaatcctacagtatttgtcttttgtgactgttatagcgtatgtcagaattttctttcttaaggctgcataatcttatgtatgtaccacattttgtttgttcactcatctcttgatggacatttggattgctttcaccttttggctatttcaatagtgttgctatgaacactgatcttcaagtatctgttcaagtccctgctttgaattatttttggtatatacctaagaagtgcagctagtgtatcatatagtaattctgtgtttaactttttaggaacaatcatactgttttccatagtggcagcaccattttacattttcaccagcaatacgcaagggttttaatttctcattaacactttctactttttttataagaattttatacttctaggtctttagccctttgatccactttgagctaatttttagtatgatgtaaagcaagggtccatttttttttcttttgtgtgtggatatccagttttcctaactctcatgttttgaaaagactgtacttttccccattcgttggtcttggcagccttgtccaaaatcatttgaccatatgtgcaggggtttacttctgagctctctattccattgatagaacccattagggtggatttttttttatttatacaaaaagtgctttagggattttgttaggaattaaatcttccaatccatgaacatggaatgtcttttcatttatttatgtctttaatttattttagcagtgttttgtagttttcagtgtaaaagtcttttgtctccttggatgaatttattccttagtattttattcattttgatgctactgtgaatggaattgttctcttaagttcctttttgggttgttcattggtagtgtgtagaaacaactgatttttgtgtgattttgtgtcctgtatctttgccaaggtaagtgattttattccctaagtgccgtgctaaaatgtttgtaaatcacctttctttcaacacctcacctggaaatctggtgagatcaggtttgacccttaggcactgtgccttacatgtgctgtacaggatagctacctgtgttggttatatcctgtacagccatatgtggtagacgttatgtgggtgtcaactctcttgttctcttgagtattcatcagcagaagacgaaaaagcagaatcctggttatttggcaaactctacatgttgtactccaaggtgtcagatcagcaaatacgttgctgcctgattcagttttggttgattcttcccctccgatatcattaatattctcaggagatagagtgaataagctattgggagagggtaaaagagatacatgatgtagggaacgtttttttaattgttaaaccagaagtgggtattttggtttgtgagttaaaatactgctggtattctaacttacgattagtctttaagtattatgtatattccacagtgccaggtgcccactgctgggcatgcagttgtaggtacttctttataactctggctagtttatcctgtctgtgcaattagttcatactgctgagcagctgtgtctccctgccttttacaattgtaggtatattgttagtgttgctgtgctcactaagttttgtgatgttttaaacggaaccaagtttggtggtattattattatttttttaaaagaaagcagttacttaaattaacatggtagaaaatatcctggggattgatggtgtagattaaaaatctttgttttatccaacaatagaattgaattatatggctaggaacaccagcaagcacttcctgtcacagttatcgaaacagtcttttaaagaatgtctagagggccttacttaaacaaatagcttgtcttgactttgggaggaggatggttacctaagcccatgtgttaaaacagacagatgacacactgaaatgaccaacgagcataataaggagaattcagtatccttggaaaccctggaacggtgccataactaaactaaaaaaattttagcaggaaacagtacaaacaagaaacatcgtgagagaaggccttagtgttcatttctgtggttgtgaagcgctagtaggagtaagtgacaggacctactttgaatagccagagttagaattgaagggggagccactggacaattggttcatgtattctgtactttgaaactgggattgaaaactaaatggctcttaccaagagaaatgtgaccagagaaatgtgacctgagagagaagcacaaagttgaaactctgcccccaggctgccttctttgtcaggcagccgcttaaggtggccccagtgatccctggcttctggtatttatgtctctgtgtaaccttgtccctttgagtgtttctggacctctcgtgacttgcttccacaagtggggcaagatgctgggatgctgcttcagaggttaggttacagaaaggttttggcatccatgttgggctgccctatttcacttgctgagggaagccagctaccatgtttgtgtggttccctgtggagctcacatgtcaaggatctgttgtctctggccaacagctggcgacctgacacctgtcagcagccaggcgcacgagcttggaagtagatctcctcctccagtcaggctttcggatacctgcaactttgtgagagaccttgaacgcaaggccccctggctaagtcacacctagattcctgacctgttatgagataataagtgtttgttgttttaagctgctacctttgggacaatttttaaggcagcaatagagaacttatataggaagtaacaatgtcaacatttcccctcctcggtctaagatttgaacttggttctaatgtgttttctggttgaacccaacacagtacccaatattacataaacacaggcccttttctttaaagatacatacagagaatgatagacacatccagattcagtaggtactgtaaaagaagttgaccagtatgagcagtaacttcctatgaaatagacttagtgcaggaaacaagagaaactgttgaagtttaaagagcagctaattagttgctctgggagactgatgagaatttgaaagaatcagagagcaggaaggagttcttaagtgaaatttgtgactctctggagtcaagtagcagcagggttttagaaatattccctcaatacaatgggaaaaagaagttgaaaattgtaacaaaaatataaggaacatagcatttgttttcgttgattttctcagttgcattgtgcacgtttcaggtgctcagtagctgtgtgtgactagtggctactgtactagacagtgcagaatagaacatttctatcgtaggaagttttgatggacagtgctgtggtagagtgtcttccagagaactctgaggaaaaaactatgataaactaagaatcctaaattgatgaagttatcctttacataggcagtgcaacaagatggctttttataggtgtgcaggaactcaaagtatatcactcgactacttgggaaaaaaaaaaagacttaactacacccagctgagtagttagcatctcagaagcatgataagtcaacttcagcattgtttaactctgtatcctgtttcccagaacaacccaaaacttacatataaaagtaggggaaaatcttcatctttgacagctattaagaggatgcccttcttaagccaaacttcagaccgtcagaacggtggtttcaacttagttcaattccagagcttcccctctccttttgacgataaataaagccacaggaagcagcagtttttaaagacattaatccattgaaaccacttttgctgaaatcactaaaaagtctccaagtcaccaaaaccaagtttcattctcagccctctcttgatctttaagtacctttggatgcaattcatcactgcctccttttaaaaacacggtctttgcctagcttccagaaaacttcttcctactcactagaagttcctgtgcagtctccttttttacctggtctccaggcttaatccttagcccagacctctggctttctttatctatacttattcactaggaaatcacatttaagtgtcatgtgactttaaatgttttctctgagctgatgataccctaattatatctccttttccctaatctgctgtcagatcaatctagctgactatgtagaaaacacacacacagtttcttgcacaacacttctgataacatatattcatctgtaagtttttctctgtacatcaagcaagcaatcagttttgcagcagacaccagctgggtgtccccccattcagttccaacactgtctacctggaaatagcatcatattccccaggttgagggggctcggtcccacaagactgcccccactttttccaatgccagttggaagccccaggttgtttacctgtgcctctgaccaagtggccatacatagaggttaccaagacctccttcttgggttcgattaatttgctagagtggctcacagaactcagggcaaacatttaccactttattatgaagggcattttaaaggatacaaatgaacagctacatgaagagatatgtaggacaaggtctggaagggtcctgaatgcaggagcttctatccccgtggagttggagtgcgccacctacgcagctcctggatgtgttctagtttaccttcctggaagccctccaaactccgtggaggcttcattatgattaagtcattggccgtttgtgatctgctcagtcttcagccccactcccttccacttctctgtggctaccacctgagttctgactcctctactctcttaggctactgcagtaacataggaaccatttcttccttcctccagttttcattgttttcacacaacagatttagaacctctccagtgtcttatcacatgttaggacaagtccactgcccttttaccgtggcctacaaggccattgccaccatttgtcttacagagtctacattaatctcactggctttcttgtttgcatcaagtttgccagcctcttttctcattaggcctggcattctggaatgctttccttcaacaagtttggatggctcattcctatgtcttcattttggtttctgcctaagtcaccacctcagagaggctttctttgaccaccctacctgaaatagtattccccactccatgactttttattgttttagggctttatatttttagagcactgagcactgcctgatacattttatattattaatttgtttatagtatgtgtttatcacaagaatgtaagatccatgagagcagggatttttgtttgtcttactcttgtacctagaaatagtgtctaatacagcttccacgtggtgttgagcctgtgggtgcacagaagtcaagaactgaggtttgggaacctctgcctagttttcagacgtgtggaaatgcctggatgcccagacagaagtctgctgcaggggcagggccctcatggagaacctctgctaggacagtgcggaagggaaatgtggggtcggagcccccacacagagtccctactggggcattgcctcgccaagctgtgagaagagggctaccatcctccagactacagaatggtagatccaccgacagcttgcaccatgccccgggaaaagctgcagacaatccacaccagcctgtgaaagcagccagcagggaggctgtaccctgcaaagccacaggagcagagctgcccaagaccatgggaacctacgtcttgcatcagcatgacctggatgtgagacctggagccaaaggagatcatttcggagctttaaaatttgactggcctgctggatttcggacttgcatggaccctataccctctttgttttggccaatttatcctatttggaatggctatatttactcaatatctgtacccccactgtatctagggtgccttgtctcagatgcaactttgtactgtggacttttgagttaatgctgaaatgagttaagacgttgggggactgttgggaaggcatgattggttttaaaatgtgaggacatgagatttggaggggttggggcagaatgataaatggttttgctgtgtccccattcaaatctcaacttgaattgtatctcccagaattcccacatgttgttgtgggtggacccatgggggggtaattgaatcatgggggctggtctttgctgtgctattctcgtgatagtaagtctcatgagatttgatgggtttgtcaggtgtttccacttttgcttcttcctcatttttctcttgccgccgccatgtaagaggtaactttcacctcccgtcatgattctgaggccttcccagccatgtggaactgtaagttaaattaaacctctttttcttcccaatcttgggtatgtctttatcagcggcgtgaaaacggactaatacagttgtattccctgtttagatgctgttaaataatatttcatgtaagataagtatctgcctattaatgatattaggtgcattcagctgcataagtacctgaacattattcttggctttcatctgtagctgtccacactttatcaattatcaagccttgttttatgtactttggaaatgtatcttaaagtttgttcacttatgacccctctttggccttggtactttaatttcttcatttgttaaatgggtatattgatacagccaacttaatagttttgttgtgatgattaaatacctaacatagagtatgtaaactttacttatttttatttattttttattattttttgagatagggcctcaccctgtcacccaggctggagtgtggtggcgtgagatcttggctcacagcagtctcagcctactgggctcaagccatcctctcatctcagccccacaagtaactgagactacaggtgtgcgctgccatgcctggctaatattttgtattttttgtagagacgggttttcgccatgttgcccaggctggtcttgaacttctgagctcaagtgatcctcccactttggcctcccaaaatgctgggattataggtgtgagccaccatgttggcttgttaggtaaatgttaaatgttgctgtctaatgataaccatattttactattactggctcaggtcactatcattgctaaactgggatttctgtggagtaactccaggttggtctccagttttccctttgcttaggttcctcccagttctcagtctccttcacttcagtttgagcaatctaaggtgcatgtctgactggattgcttttacttaaaattcccaagtggacttctttttgtcattggaataaagtctgtaaaatgttttgtaacataccttaaagactccgccattttctctaaatattttgcctctttgttttcagtttgtgggtgaactagaacaattctggcaggaaacaaactgtattgggtgtgactctaccaagaaagatggatagtgaagtgctttctgattcttatagcatagccatagtaatcctaatttgtaaagattttagggagatattaatagccagatacccattctaattataaaaataccttaattaggcatacatagatgcaagagtttcatactgtactacttgtttgtataatctccttgagaagctatttacattatacttaataaggccactgaatgaggtggtttgcttttgtgaagttaattagccagttaaaagttgaggaacatctaatgaagatgataactaactttaagtctagaatgctcaatttagagctcttctttctaacatatgtaacagttatataccagggcttattgtctgtttaaaaaaccacacctatagactaaatgtattagcagctgtttatctttctgttcttggttgcagtaggatatgattccattccattttatccaaacgggctatcagattatccaggaacaagttacaaagaagggaaactggttccaggacacatctctggaagttaccttgtggaccctgagaatgtgttacaggtgtgccaagatccttcagcccttggaagcgggtgcctgagtggggtcttagctgactagagtgcctgggcagacaagagcagctccatcttctctttagagtatgttacataagcattaaatcgagggtgtgccctgacgtaaggaaagtagaagctcaccagcctgctgcactcacatcagcgagagggaacatttgcccctccatgcctactgcccttcccgcccttcagcctcaggttacaggaataaataagttaattaatcccaagtggggagagcctttgaagagtattaaaaggagaggaaggaatggttggaacctgttcccatcaggaacagatgagtaggtcaagctttattcacttttaaggaggaagggattcctaaaggacaaaccaaacttgcttttcagggcgttacaataaaacgttcttaaatcctgaatatcacacatttctgggaggaatgtcctgccctttgggaaaaatagcaagaacttcgagctccctctagaggccagcagtgataaaagagcgtcgtagtggtctgtagggaaatcattttacaatgattagctaagctacctttcagcaagaaactatcattttatagatgtattatccagtaaaatgttctcttatattgggaagaaattggtgcctttgaaaagaaatttgggttaatcatactctaattagctatgaggggccaattgtaaagttcatttactgtgtagaaatacagctgagaagatcatgaaaatgggtcatgtgacctaacagaatagtatattctaaccattggaacaaaccagatcaagatgagaacctgatttctgtgctgttttgtgccggaatgtttcgacagtagacctttgaattgaacagaggtaaaggtgatctatagtaccagctgtgttctcacccactcctccccctcatctgaacaaaaccagtgagttccagaagattaatattaggaaatgcaagatgcaggcatatgttaaaatttctgagtaagctaacatatacagtttcttaactttttcagagcctcagtttactaaatgatccatctattattccaggatagacattttagtcataaccatatatgtcaaggagttagttatgggtttaaccctttgatgtatttagtccttttgttctcaatatatttatacttctttatagaactcactgagagagttcagttctaaaaacttagtatgaactatagaatgacagaagtgattttatggtaatattaatatgtaaaagttgcattcccaccaggaatatgtgaaagtaattgcccaatacctgcactaagtattgcctctttttaaaaaaatcttaatcattggaatggtgtgtagtggcatatcatttttccaccttgtggaaatccatctattatcaaagtttccatggttttatgcaaatagctatcaaatacctgtcacctggtttctctttccgagctctggtaactattccataattccctgattgttttatttattttatacaaacaggatcaaatgtactttgtaacattttaaaaactcggtgatacatcgtagaccatattcttagagatttgttatttttttgtactgggtatgtgcaagcacatatggccagacagcagaggaatatttactaaaataatagtggtttcctcagaagtggggttaagagtgatgattatcctttttctacaaagtagtttatttgtgagattaaggaatgaagttaattttaattaaaaacctatgttatgataatctcattactacaagtgatctttaaaaatcatattgtatataaacacatctgatacataatttgcagtttgcatgaatctgctaaatgactgttccaggggtgagatttcagggtttcttacactttattttttgtgaattggttagtttatagtgataattgtatcttttttatgaacataatgccatcttaaatatttacatatttagattcctataaaactttttaaagtacctttattgcagtactgattttaaggttcctaagtggttgatttaaccattggctattaatctttagctattttgttgtggtcagacagtatggtctttataatttgatttcttggagtttctctgtgactcttaattgcatacctttttagaagaaatatatacttttaatttggtataatttttctgtgtatttgtcatttatattttttaggtgtctatcccttctccctcccagctcccatcactgttcctgtcttctactacctttttttcaactccttattcctaataaccctgaaattgtaaagttaaaatctgcattgggcattgggcataaaaatttatgactgttacattctcaccataccttttatctacctacctgcatagtacaaaacccccttttcctattgaattctttttaaaaaaattccaccagactttggggacatcatctgtatttattaggcatgggtcaagtatgctagctatttggcagttagcaggacagttttgaacaagaaaaattgttcgatggtctgcatagcttagaatatactgccaaatgttcgtgatgctggaaaaaagcttggttattttctaagcctacaaactgttttacttaccaagggttttttcaggggatagaggccacgacttttagtactaaagtttactgtgtaaatcaagggaatgttatactttgaaatgttgggattttttttacaaagaattcttcacagttttgcaaaatcacatcactactgcaatgctgctaatggattttgagttgtgggtaccatatacccgtgtaagtctacatttaacactgaaccctttgtgttgagtactctgcatacagtgtcatcataccttgagtatttacatttagtcatcatgttttcaaatagtcccgccctgccccttcccaggactgcagtgatacttacgttagagcacttgatgttatcccacaggtcaggtcttggttactttttcttcctgtctttgctttattttgttttgattatagggtagttcttcaacttcttgatattttccactacagtatttaaatctgttagtcttatccaatgtatctttcacttcaaatagtatgtttttttatttttagtcacatttttgtctttcgtcttttatttctcatcatgttgatgatttattcttttttcttttttttttttttttttttgagacacagtctggctctgtcgcccaggctggagtgcaatggcaccatcttggctcactgcaacttcacctcccgggttcaagcgatcctcccatgttcaagcaatcctcccacctcggcctcctgagtagccgggaccgcaggagcacgctacagcacctggcttagtttttttgtttttttagtagagacagggtttcatacgttggccagactggtctcaaactcctgacctcaagtgatccacccgcctcagtgctgggattgcaggcgtgagccactgtgcctgggccatgatttattcttgatcatatggagcatatttacaaaagctgtttttggtccgtgtctgctaggaccttaattctttcatttttgtcacttctggctctgtttacactggtttttcttctgattatgggttgtattttcctgcctgtttatattcctggtaatttcggattggaaaccagacagtgtgaatttacattgtagagtgttggattttgttctagcacatagttgagacacttgggatagatttgatcctttccaaggatcaaatgtttgttgttaaactttgttaggacaagtttagtctttagtgctgatttagcctgattactaaggtgtgacactcttgtgagaactctacctgctggtggggatttctcttctctggctggtggggaccctaatttttcagagcctcatgtcacttcatagatgcccagatcagtattcagccaaagattctaagtgagccgcctatagataccttttttggggtactctgcctttacgttgtagctgctttaacctctggcctctggattcttcataactctcaccatgctgtcttggtgcttccagtcagtaagcaagagctactacaggaatcactttcttttcctttctaagagtatccaacccacattcattgtccgttgtctgaaaaacagttgtttcatatattctattcagttttctaatctttcacagcaggacaataaattcaggttatcttaactcctttgtggccagaaacaagaccagttatcagatttttaattttgatttttatcttttactttaacctcttgaaagtagtagtggtaaaaatcacacatttttattgggtactttttctgaatacctttgtttatgtagtcttagtgttctttgttagtctttgtcttttttactgaaatataacaaaaagtagaggagactgattacctagtagagctttacaggaagtcaaatgttatttgtagaaagatacgagttattatagccagcttgacgagagcattttcttccaggtatgaacatttaatttcgtattagaatactacattggcagccccatttgtttgtagatacgtgctctttacacaaatgcagccctttgtggcagtatttggaatacagaattttaagaaatagtggttactcaatagaattttcacaaacttcatgattatcttaagatttatgctattttgtgttgcatgaaacagatatttctggattttcagtgttgtttatttgctacagcaatgtttagagtgttttatgagttttaaccttttaaattgttactatttcactgtaaagcctaattatattgagggaaataacagaatagggtttgtcagcatcttaaggaatggatcctacatcagctgtttcaaatggcactttcaggaatctataaatcagatggttaaaaatacttaaacaggccagacgcagtggctcacgcctgtaatcccaatactttggaaggctgaggtgggaggatcacttggccaggagttcaagagcaagccggccaacatattgaaagcctgtctctactaaaaatacaaaaaaaaaaattagctgggtgtagtggtgcatacctataatcccaactgctcaagaggctgaggcagggagaattgtttcaacccgggaggcagaggttgcagtgagctgagatcatgccactgcactccagcctgggtgacagagcaagactcttttgtctcaaaaaaaaaaaaaaaaagaagaagatacaaattgatatcaaaataccttttgaaaaaaaaatacttaagcaattcctctcagttgtttcttcccctcctttatttttatttttttaaaacgggcatttacatattaacttggtccttatgtcttgtaattcatgctgtagttgtttattttgccttaggatactcctttgatttttcttaagcatttactgaatcctttattggttaatgcttcatctgtagggattacagtgctttctcttagccacattagggggtagaatttagaatgtgtatcacccagtgccttgaatgtagcagattctgaataaatatttaaaagttgtagggacaggcagtaactgtaatgtggtcattaataagtagtataaagttgatgttgcttggctctaaatattttactaaacacagacattttgacaatgaaaaagaggcaataaactgaatacttacacattatcccttttttcatcatccagagatttatagaattctgtgctgccaccttatccctatagtgctaaatatgagtcctgagtctgacagttgatcactgtgtgatttttcttaggctggttaatcactctaatttgtttttctatacattgaaaatgatatgcatattacagtgatgttataaagattaagagagaataaatgcccacttagcacaatgtttggcacattttggttgtaacatctgtatgtgctttggcattagtttgatatgactttgtgttattttaatgccagtatccagttaatataaagcagagtttggcaaacattttctgtaaagggccagatagtaaatgtttccagtctgtgccgtctattcaactcatgggcatggctaagttccattaaagaattatttacaaaaacaggttgtgggccgtagttttccaacctgtgactagaggttacttttgtatttctttgtcttttttgtttttgttgctgttttcatttgacagctttggtacaatgtatttcttaactattgagtatttcaaataccttcagctgtattaaaaattatataggtaatacagttataaccctctttgcactttgattaatttctttcagatcacttatttgagacatagtcctcaagtggaattatgaaatcaaagagtgactccataaagtgcctcacaacacaagagctgaggtatttagagaatgccaaggctactaataatttagtcttttaatggatagtaattatttgttacacccatttatatatactatttgtgaatttccccttgctgatttttatactgagagttacatttttgaacctttggctgtatgtgttctattgtgtttcttataatacataagaaacagaagataggtggcaataaggaaacggccttatgaagtaaaaaccgaccaatgacactgttgtcattcccactaccaattgctcttccactcacaaaagaaagcaattatttcaccttctaagagtgaaacctgcctgggtgctgacagtttagaaagagggggtggaaaaagtaagaatttcattctgtataataaattaccaatcccttggtttgcattaatagtgtatagataaaatttaagaacattacattactttttttttaacaaaaatactcttatgccttttaaatactacctttatatcgcacaatttggaagtcaatgtgtatctaaaattgctgggttgacttaatgcatagtagggcagtggactaatgttctgaaaggtccttctttattaactgtattagaatgttcttttgtaagattaatacaggcatttttcattgtaaaataacattgtgattggtgataggacagatttttccttttaaagaagttgtttgttctttggcattttggtggtggtggtttgtgagaatataactcaactgatatactatactaaagtatgcacaaattcggtatgatagctctgacagtgatgtcagtttttgcttttaaaaaacatgatacacagtgcattgtttaaaggtgcagaattctcaaattccagcattcttgggtttgcaataaaagtcagtatccggccaggtacggtggctcacgcctgaaattccagcatattgggaggccgaggtaggcggatcacaaggtcaggagattgagaccatcctggctaacacggtgaaaccccgcctctactaaaaatacaaaaaattagccggtggtggtggcaggtgcctgtagtcccagctactcaggaggctgaggcaggagaatggcgtgaacccgggaggcggaggttgcagggagccgagatcgcgccactgcactccagcctgggcggcagagtaagactccatctcaaaaaaaaacaaaaaacaaaaacaaaaaaagtcagtatccactctgtaatgttttagacctgtgctgtccagtctggtagccgctagctacatatgggtatcagaacatgagaagaatattttctaagagtagattattttctaaaaacctggataccagtatttagccagccctgtttgggtgtagcatgaaatggtatccctgtttgcaggactgtgcttcctcactttttgcatgtcatggcattcctaaaaagcagcgatgtttgtatggcacactgggatacacagccgaggatgcttacaactagggcttaccgatctgagtgctctgcagcaccaggcaagaccataccccattcttggcatgccggtatgcagtggcacatacggtacaaagctgcttcagcgtgctccctataactcattcctggatgtttttcttggtctatgagcggaatttgaattcattctcccttcttatttcatcatttttatatgtcatattcccagtgagactgtgagacattggcatttcacaacttagaagagctttcaaagcatcatccataaacttagagatttagtgagtaactgtatatgatctttctcttctcttttgtttaagggagaaaggaggaaggaacaccatgacgtagtgatatatttaaattctgttttagaaaccaggaaaatagttttcctaccagaaatatgattacattaaatatatgcggtataaagatcacagcaaggagaccatgaatctgtccatctacccctccccgaaataaaattactctacactattcagataaaaagtgacttggttggctgtttctgaaactttctgtttattggcttttggcaagataaatagtaacaaacaccagtgtcttaaaatctaaaaattggtaatccatgtacctactgtttatttccctcaaggattttacagtgagttgacttttgtggtgtaaatctttggttcttgtcctttcctgatatccagccacttgctgtttgggccagttgtttctaggattcctcaccctacacaagggtccctcttaaaattctttacctttgctacaaaactagttcactgctaaacacataaccacatcactgtacgctaaaaatgtcatcataaaataattgttcctgccataagaagtgatacgttattggagcaaatgtcttgtttctgttgcatcttgcaatcaagtctttttcttctccccacacacccttcaccttcctcttccattcacatgttcagtgattacattataactggttgtgagagtcccctgtcttcagtttggaatattgtacctacaatcattacttgattcttgttctgtcttctcataataaaataggtaagggctgggtgttgtgttttgtggttcatgcttgtaatcccagcactttgggaggtcaaggcaggaggattgcttgatgccaagagttcgaaaccagcctgggcaacatggcaacaccctgtctataaaaaaataaaaataaaaaaattagactggcatggtggtccgcacctgtagtcccagctacttggggagctgatatgggaagattgcttgaacccgggaggtcaaggctgcagtgaggtatgattgaaccactgcattccagctggggcaacaaagcgaaaccccatctcaaaaaataataaattggcgtggaatgtgccttcccaccccacccctcagtctcaaatctcaattgttttactgtaatgctgtccttactgacttaatcatctctaggttttacgtgttcagttcacttaaggaatattaaggtttcttccttattagaaattgagcccggctgggtatggtagcgcttgcaaacttccagcagtttggaaggctgaggtgggaggatcactgaagaccacaagctcgagactaccttgagcaacatagtgagaccctgtctctacaaaaaaattttttaaaaattagccaggtatggtggtgcatgcctgtagtaccagctattcaagagactgaggtgggaggattgcttgagcccagaagttcgacatgattgcaccactgcactccagcctggtcaaaaggcctttttttttttttaaagactcttttaagaaaaaaaaaagtccatgctgcaccaaacctacctgtctaactttactgcttagcagagagtgtagtcaggctagtcacgccatggtccttgacatctccttactaagtgatagttgtaacagctcatcagcctgacaaggagttgtaattaatttaggtggatgcaacaacttggacctgggaaagagataaaataagtaatgggcaactcggcccattattccactgagttgaacaggagaatgagtctggtattggtttcagatgtgagcatttcaccaagctgagagcatattctagagatcaaagataggtattttggtacagcaagatttcatattcaaattaactagttcatttgatggttaggctaaaaaaaacccagcaaattatcaatgctgtagggaaaattgagctggacttacgagaaagaatttgtgtcttcagggtgtctgtgtgagggatttgaatttaaagataatcttgactctgtatgtttgtattattatttgattttagagcctaaccctcagatttgattcaatattttttgtctgctactctttgctcctacttaactccccagttgtactctaatgtgctttaagtgcagggactttgtatatttttaatcctttattcgctgtagaagtcagtagtatagtacagaactcctaatcaaatgacttctcagtacttactggtgtttggctttatgtactagcccagtatattcagttttacgccttttatgttacttaggtaagcagttactcaggtaaccaccgtggtgtagccaggggttttttaacctggcgttgagttgttgtccaaacagtctgagataatatgcacatttttatgagcacttaaatatgtgcagttttgtgggagagcatttgtaacttttggtagattctgaaagagttcaaaaagattaaatgccttggacctagacaacggaggaagaaaagaaaccttctcaaaatctgggctttaaaaaattgctaaaagaaaattatgaaatgcagtgctggatagattattggtgaaatacatgtcagtaaatttaaaattttaaagtatgtatatcatcagattcttaaattcttaacagtgagcttctgtagaccagaggatgtctgttcttttataaagctgatttattttaaatgcacatgataggggcttttctaattcagcttaatgctttatagtgaagaacttcttaatgacacagtgatgaattttaccatgttactgctctatcttatgcccatttctgtaatttagactttttttcttaggaaaagggctctagtgtgaaaaaccaagaaaaaaaacttgacagttttctttgatcatgactgtgaagtcagcactgagctggtagaatccatgtgacgtgactgattctagtggtcctgcagtgtaggggagctggaggagccgtgcacattgaaggcacatagcacgaagcatttctgctataaaaaagcgggatctatttgcaaacacttgtttgaagccatgattttgaatttatgacttaaaattccatctaaaagtatttttacatttaaaattccctctccttattagtaatatgtgcctttattatagatgattatttgcatttgcataaacaagcttatcaaatgtatataagaaaattagcaagataatgtttaagggtgctatcagaatgattcacaaattgttgatttctttgcattcacaaatttagtgaaatgttaataaattagtatttgttgtattctctgttaaaatagtttcatactggtttattctgaggagaatttttattagtggatcaaaatatttatgaaagaactttagattcatgttatttctgatgggtggttgatgtacttcaaagatatacttcatagacttggaatgtttgggaaaacacgctaagttctgaaactagtgagtcgggaaagaaaaactaatatctttttttgttttgtctcaattatacagcagatataatttctacagtagaatttaatcattctggagaattactagcaacaggagataaaggtggtagagttgtcatctttcaacaggagcaggaggtaagtgtttaaagtttattgtctaaatttcagtttgatcttaggactagagcttgtgttgcactggagaatctcatcagaggatgttggaattttaaaagaagtgtgtgtttattgaatacaatgtccaatatatagacagctctggttctcttagctttgtatgtgtgcatgtgtgtacatgagcgtatgttgttttggtttaaaaacataacactaattgtaaaaatacttgattagagaagggggtggaaagtgatggaataatccaagattttaacggttttgaagccttggcccttcattataatttttcctttgaaactccgtaaagcaaagttgctttgacttcttctcaatgcttggtttactttgtacaattgaggggtgagaggctagtttaaagaaaaagcagctcaattattttgatgtcagttcataataatactgttacaatgatttaaatgtaaaggtttaaatgacagttgcatgtacatgcatgtaaagtaacttaaaagtgcagtgctagctttttgaagaaagaaaattgcagaatcggtaattaaagtgggcttttgttttgtttttcttacaacttaggcacacttctaaatttaattgaccagatttctcactaaaaattttttgctaaacaaaatttgtcacacttggttttttcttattcattctctccttccatttgtagatcagagtttaaccattaaaatcagttgttttggaacattctgcccctatttataatatatttaaaaagtttaaagtaatgtggataaattgcagggttttacaaatacatgtctaaatcataacacagagttaggttttaaaggattgtgaaattccttaaataagcaaagaatctagtaataatactactactttgcacttctatagcgcctttgacctgaggatctcaaagtgctttacaaacactaatgaattaatcctcacaacaccccagtgaggtaggtaatttaattttaaaagaaatgattaatagtgtctgattagaagatgcacaaacactaaatatgtcttttattatttttttcgtttggaagaaaatatgaaaataagactcaagctttgcttgacaaagaatggtctcgtgggaagtggggggctaaatcagttttctgtttttaagtagccaaaaactcgaccataagaatcttgacatacttagagttgacatggaaccttacattataatttcattataatttccctttatttactaacaggaaagtcaagatataaatagattactttattacttagtggcagaactaacaagcagaacctgaacttttgacatgtcgtttttcagtattctttgctgtttttcatgctagataaccaaaatgtgaaagtttttatctagagtttagagcagaccttcccataggtgttctctgcccttgaatgtattttttactgaaagttattgactctctacactttacttttattttaaagaaaagtgtttgagaaaaactcgtaaaaattgattttgccctaggcttaacattctgagggtttcagaaagtcttcatttttaatgaaggcattgtgtcattgtcaattctaaaatacaagtttgtcaattaaaagctaatttggaactattttgcctgagaatgaagtcattttcatctcctgtggtcgtttgttgtccaagtcaaaatcaagtgtggaaaaaatggctgaaaatttttttaattgggggaaatgtttgttttaatatgggtttagtaatgtagtcagaatattagtatttagtattttcctaaaggctgttagtaatacattaatttgtaattaaattccaaatttaatagttactgaaattactcatttacttgtattagaaaataagacaaaattattttaaagataatcatttcccgtgattcttttctgaaaccccactgaagattctaaagtgctaatattttaactacattttcttgtaagaagaattgagcagaataactttttgggaagggccattgataggaaaaataggacctccttttcatgtgtctcattcttcttaactatatttaagaattctagatggagagttttgtagaaactcagtaacatgtcttttgagaattacttagtggtgtaaatatcagcatgtttttaagtgatagattaagtaaagatgatgatggtgattgactcttcacttctgaaacttgatcttgactattaatttggtgtgttttgcctatttaattttctacattttaaagccctgtcttagagtttctaatacagtattgtcttcagaatctatgtcattggtcataaatatgtatacttgacacttagaggcacctttgtttcaatacctaatgtaattggatgagattttatgaattcacatctagaggcacctttgtttcaatacctaatgtaattgaatgagattttatgaattcacatgtatatatctgtaagatagtgttacagtttgaaaagtgaaagaaatagtcctttcctaatttgtagataaaatccaaattatttaacaaggttatattgcttcatttagtagcaaaaatcaggttaggatttgggtctccgattttcaatccaactattatatgttcattccagagtacactggtgcctaatgtttcttagactctgatgagggtgctagccttgtttgcagaatacactggcatttgatctattgtggctttattctcttacctagtggcagggttccttcttaaacttgactttactggagaccaaaatatctccacccactcatttttattgtctttacttggaagaagaagagatcatataacagcaacagagaacttggcacatcagactttgacatctgtaacccctcattgtctgcctcatttattttacccttcagaagtagctagtctccttcctgtgatccaggcgggtatctgtgtcctcttgctgcctgtccgtttattccccaatcgtaatataaagaaactgagtagccaattcagagggtcttcatttggtttgagtatgtttcagactgataattgtttaatatttttagctgtcatttaatagcattgttataactaatatatttgtataggtattctgctacacggaatctctgttgtagaatcagggcacctaaagaaattgaggcacacaagtaaagtgatttccctgatgtaatcacagccatcatgtgatcagtgagagtccaaaattctgataacaaatccagtgttctttatagcatgacccgatataagtgacccatgttatttttatagcttctaatagcttttgacagcaaagtaaatgatagggtatattctttttgttaatgaaaatattaatacagggttttgaggagaagagtccaaacagctattaaagtggataatgatgttctctaggttttagggatttttgttgtttccatgggtgctcaaattaggtaattagcagttgtcaaagtagctggtttcctactgagttgggttgctcagaccttcagtttctctgagactttgtgatgtaccctgtaaggtagtgtgggtgtgtgggtgctgggttaaagggacagctaagacagaaggtgaggagggaggttgtacctctttccacttctttttataatttttctaggttggtatggggcctttgatttttgttttctagggctgctggtaactttcttggatttcataccctctggctttttttattcttaatgtggtattcccaaaattccttaacaggatacagaagaaaccttaaaaagcatgcttttcacaaaaggtggatagtattgttaatatgatagtattacctttctaaattatatatggctcaaaatgtttgcatgtatttaaaatgcagatttctgggttgggggccgtggctgatgcctgcagtcccaacactttgggaggctgaggcaggtggatcacttgagggcaggctggccaacatagtgaaaccctgtatctaataaaaatacaaaaattagctgatcctggtggcacatacctgtaatcccagctatgtgactgaaatatgaggatcacttgaacctaggaggcggaggttgcagtgagctgagatggtgcctttgcactccagcctgggcaacagagtgagactgtctcaaaaactaataataaaaaataaataaataaaatacagatttctatcctgctcctcaagattactaaatcagaatatgtatgtatatggtgcattcatagaatgtaagagctaacatttatagggctttctagggattcttaacttttttgttgtcatcccatggattcctttgatagcctagtaaatcctgtagacttctcagattttttttttttttgagatggagtctcactctgttgcccaggctggagtgcagtggcgtgatctcagctcactgcagcctccaccaccagggttaaagcagttctcctgcctcagcctcctgagtagctgggactacaggtgcacaccaccacacctggctaatttttgcatttttggtagagatgggttttcaccatattggccaggatggtctcgatctcctgacctcatgatccacccgtctcgtgatccacccaccttggcctcccaaagtgttgagcgtgagccaccgtgcctggccagaatgtttaaattgcataaaatatttaagattataaaggttgaaataatttaccaaaatattcataattgagtaatatatgttttaagtggataacagctggattacgatattaaaatgtcatttctgtttgacagagtcacaagaattgctaatactatatgcagtttgttacctatgcccataatcaaaagaaatgctgaaatttagctggaggttagtgaaaataaatgtgtacattttccccccatccaggcttataaaatccctgggttctgtcattggacccttgtgtccatgagccctcaatttttaacccctggtagtgcagtctccttttgccagctgggggcccaggtaccagattacccatccaaagtcatacagttaataaggaagtgattcttcactgcagaagccacacatcctgatttctactgcatggctttgcccactctaacctggatgtagtagcagcagtttatgtgctaggacctctgccaagatccctaaatcttacttaatcatcacagcaaaataacaaagatgtatgtatgtttactatatcttgatgtattacaaatttataaataaaatgagatttagagaggataagtaacatttccaagagcaccctgctaggtaagtgggtaaaagctaattctgtgtaaatttggatgagtattcacaatgctggctattgatattaaaataaaaaaaactttaatcctgtttggtgtgatgagcctaattgttagaaatcacacaggaaaatcagtctcattactttatacctaatgaggaaagtacgtgatccttagactttttaatatgagctattgagtgatctgttttctgtcataggtgttagaggggaaaatggactaagagttgaacagccttggttctagtcctggtattcatttatgcatttgcccagccatctcttcttgttcagccttttagcgtccagatttctgtccagactgccatcagattcttgtcagctacctgttaatcttttggggctccttagggtattacatttcccaaaagcaaaatatcatgtattttaaatatttaaaatatcggctcaatgggtacctaattttacccgttgagcagaaatttgaattaaccatatttcttatacagggtgagtatcccttatctgaaatgcttggaaccagaagtgtttcaaatttcagatgttttcggattttggaatatgcgcatgtgtacataatgagatatattggggatgggacccaagtcctaaacacaaattaaattgtttcatatacaccttatacatatgacctgaagataattatacaacattttaaatcatttgtgcatgaaacacagttttgactgtgacccatcacatgaggccaggtgtgaaattttccacttgtgtcatgttgacagtaaaaagtttcaaattgtggagcattttgggtttcagattttcagattaggtatgctcaacctatccccaagaaattctccaccaaaaacaactccaaatctatgaaattaataatgcccagtaattttggaattaattatttaattaataaacttggaatttatttacctttccttcttcctgtgctctccctagcctcacacatataaaacatttcattgtattcttattattaataatttttccctcttaattataaattcattatgctcgatgtagataattcagtaaatatggataagtggcaaagaatgcatgtataaccccaccaaacaaaaataagaacttttggtatataccaaaggcctgtctttctgaatatctgattataaatttagggttgtatgattttttttctcacatactgtatagtgaataccttttcatgtcattcagttttctgtatcaccatctctgtaatgacatgacatgacataattatgtttatttgatctagtctctattgttagattcctagattgtttatttctgcctcttttttcagggttgggaggtgagcgactgcccctttgcagttactgtgtttttccctctttctaaaaaaagaaaagtagcaacttggtgattgaaaatacattatttcattggattttggttttactttacgccttaatactcccaataattaaagcatcttgttctatgccctctttttctagtggtgtatttattgaatttggatgggccacatattgtgagagacggcatcagctctttttctcacgaggcattatgtttttcagctttgttgattggctgcctttaaattttattttactttttgtttttctgcccacagattatttaaacattcttttgttcccttttaaatttattatttagttagactttattaccctacattatgtgatgaagtgatttttttctcttccaccttccccacccattcacagattaccagtcgggttattattattattattattattattattatttattttagttttacagagtctcactctgtcaccctggctggagtacagtggcatgatctcagctcactgcaacttccaccacccaggttcaagtcatccttatgcctcagcctcccgagtagctgggattacagacgtgcaccaccatgcctggttaatttttgtgtttttagtagaggcagggttttgccatgctgaccgggctggtctcaaacttctggcctcaagttatctgcccacttaggcctcccaaagtgctgggattataggcatgagccaccacacccagctggttattacattatttattgaaattttttcacatggatttaaaatgcacattagatcagtcatctgcagagttgtgtctagacttcactatattttagcttttcaaagtcttattcaaggatgatgaactctactagtctttctactttattcgttccttcttacagttgagttgtgtagataggttttgaaatgtattgaaattgggttctttctcaaatatctctctatagcctttcagagtaaatacttgatcagaatagttgttgttgcatatttcttagtgtctagttattaagaaggatttgacttgtgcctttacaaaggggaattttctagcgaacttcatctgtagtcaatttatcaggggtatggaggactttcttattagaatgttaccagtggaaaggacattgaagactatctgatccgatcttatttgttatttctccaatttgaggcacagagaagagtctgaaatcaggcgcctcaaatgtcggggtgtcatgcatttacctgcatcatgttgtttctaaatgatagaatttgcacttgatccttatctggaagagaaactaatatttgaactttacttgcttttgcattaaattcccaaagttatcctgtcctgagagaataaattgtatttaacacatgaagaaaacgtgatccaggggattgttatattttatgaacttcaaagggaaagagacacaagtagtaaaatgaatctttttttttttttttaatctaacaccaggtagggttcatctgaatcttctctcagagagaaaccaactccttaagggtccaggttagattgaaattccattttgagagaaacaaggttggagagccttgagatctgcctccattccttggttgttgatagaactggggaagagcgctagcatctgagcaaggcacagttttcgtgtggggtgtttgtgtgtgtccacgcgcatgtgcatggagggttttttttttttttccattcctttcagtaatgtgtaaaatgtagaataaataagcattcctcctatgtaactttatcacttaatctgtagcatagtttagaacagatattctagctagtttgataatctgagtgaaagcactttaacaactttaggttttaaagcattatattaattgtattttatgcatttcctttaaattttatttgactatcttatagacaaataataatgctacttgatttgactttctaattgtttcaaccaggtatccttcattcagatatctctcccactatattattgtttttttgataggatattgtgactgatacgcttccaaattgcacttagaatagtacataataggcactcagtgaatgagtattaacttactgaacataatttaataaggccttgcaaaatcttgaagtgctccatgactatcgttatcattagtttagagaaagttttgagatttctcttgtgtttatttcatcgaatgacttgtattttgctttattctagaaagttccccatattttctgaatgtgttgagagtagttatcagatatcatttaattttgttttgtaccatttctgccactgtccctgaatgcccatttcacaagacactgactcttttaaaatacttttatactgctataaaatataaaacaaatgactgcttacactatatagaagatgaacattaataaacagtaagttttagtagggttctatttggaggcttaaaaatattcatttattttctgctatatgagatcaaagtaaaatacatttattattttcttaaatttttaaattttttccacggagcaaagtaaatatttcctacatttttgcagagtttcatttaaggaaggagaaagttagtacaggttgagcattcctaacccaaaatccaaagtattccagaattggagacttattgaatgctgatgtgataccacaagtggaaaattcccctggcctcatgtgatgggtcacagtcaaaactttgtttcatgcacaaaattaattaaaatgctgtataaaattactttcaggctatatgtataaggtatatacaaaaccactgaattttgtatttagacttgggtcccctccctaagataatatcatgaatatgtaaatattccaaaatatggaaaaaaatgtgaaatctgaaacacttctggtcctaagcatcttggataagggatactcagcctgtaaaagcacaatggagttacttatatttagaagtagctgttgaaaaatgttaagtgaaattctttcagaagtttgcctttaagtcttgactattcttagtatgtttattgcagaaaataggaaaaatgtgtatcatttccacaaagaataaaatcaaaaccatcccataacaggaatgaaaaatgaagacctgtgtgtgtgtatgtatgtgtggttttctcagggatttttgttttgttttacagaatgagactcatgttgtacatatcactttgtaatgtttagttttatttactgtcaatgttttctcaggttgaaatattgcctcccagtcagggagatgaagagactgttggaaccattgagtagaaaggggcacttgaatagttgggaagaacatactccatcttataacttaggtgacaaggttcaataaacttgtggcttgtgggaacagcttatacttctaccagtagtatgtgactttgcctttctgtcactaaaacaatggtcattatcacatttttaattttttgttcatttaagggaaaataatattgcttagttttggtgggtgggtagatgtgtgtgtgttttgttggggatttttgttttgttttacagaatgagactcatgttgtacatatcactttgtaatgtttagttttatgtactgtcaatgttttctcaggttgaaatactgccttccagttagggagacgaagagactgttggaaccattgattgggttacttccaccttttggctcttgagaataaagctgtaatgggcatggctgtccaaacacctctctgaggtcccattttcagttctttgggataaaatccagaagtgggattgctggattatatggtagttctatttttagcttttttgaggaatctccacgttgttttccatagtggctgcaacatatgtgtggtatatattttaaaatctttatttaaatatacactgaaaagtacataaaatactagcagattattacatagcaaacatttaggtcaagaaatagaacttcctacgcttccacaaacccttctcttttcccttcctctcctttatgagcctgtcttattaatgattattttggcctgcagttttagaactttgaatagatggaatccacagtttatccattatgagtaatgttgctgtgaacattcttactcatgttttttgctgtacaatcatgagtagaaatattatgcccatagggtaggcattcactgttagcagacatcacagtaaaaagttctgctaattttattcttgtgaacagtatataaattttatggctgttctacatctttgccagtgctatgtgttgtattatcagtcttttaaaatttaacactttgtgggtatgaattaagtttgtatttactgtttgtttgtttttttttgagacgaagtcttcttgctttgtcacccaggctggaatgcagttggtgtgatcttcgctcactgcaacctcctcctcccatcaagtgattctcctgactcagcctcccaagtagctgggattacaggcatgcaccaccatgcccagctaaatttttgtatttttggtagagagagagtttcactgtgttagccaggctggtctcgaactcgacctcaggtgatctgcccgcctcagtctcccaaagtgctgggattacaggcatgagacatcacgtccggccttgtacttactcttgtgattcacattgagattgagtagttgttgtgttgttttgagacagggtgtttctttgttgcccaggttggagtgtgcagtggtgcgcttacagctcactgtagcctcaaacttctggactcaagtgatccttcccacttcagcctccccagtagctgagactacaggcgtgcactgcaacacttgactaattttttttttctctctctctttttttggtagggatggtctcactgtgttgctgatcttgaactcctgacctcaagcaatcctctgtcttggcctcccaaagtgttggattacaggcatgagctgcgactcctagccagagctgctttttatatgtttattggctatttggatgttatcttttggaagtgactatcgaaatctcttataattttctgtgttgtgtgtcatttttcttactgatttgtagactttctttacactttttgtagatgaactctttttcagttacatttgttggaggatccaggggcagtggctcacgcctgtaatcctagcactttgggaggctgaattggttggatcacttgagcccaggaaattgagaccaggctgggcaatatagcaagacctcatcttttttaaaaaacaaaacaaaacaaaacaagaaaacccacacatttgttagaagtatttttcattctgtgacttgccttttcatttttttgaatagtatatttttataaatagagattattaatataatacagttgatcagtatttttcttagggttactggtttttctgtcctgtataagaaatacttttcaaccccaaaatccagggaagacatttccgttatcttttagaactgtatgactggtactgtagctactagatccatgtggctattcagattaatggggagttgagtctgttctctctcccctaatgcaagaccctgttgcagtggtccctgtctccatggccctctttaaagtcagccttactaccttataaataagtaaataaataaatttaaattattaaaaataaattgtagaattaacttccttagttgcagtagccacattttaggtgttcagtgtgtgcctagtgctcaacatgactagtggcaaccatactggacaacacagatacagactatttccatcattgcagaaaagttctcttgggtcctgttatcctaaaacttaattattgtaccttcacatttatatctcttattcatctgtaatcactttacgagtggttttgggaaggggtcgagcttcattttatttcctatgaatagtcaacctaacaccatttagtgaaaagaccatcctttccccattgcccagcaaggcaacctttgtcatcatttaggcctgtttctgggccatctgttctgtttcattggcacattggtgtatcctcatgccagtacacagtctttatgactttgctttaaaacttggttatgatgtcctttagtgaattctgttagcatctgtgttgaaaatgtgtgattttggttttgtgtcctgtgtttgtaatgtatgtaaagtatgtgacatagctcattctaaatcctgctttgaaagtctttattgaatgcctgttatatgtgccaagtactgttataggtgctggggaataaagcacatctaaacttactgtagaaactttcatgcaaatagattgtatggttaggaagatgattctcatagtgatcataaaggcaagcaagaaaagagagggaggtgaaaatgctgtgcaggtaaagccagtatgaattgttgaaggatgtgtcacaattctgtatgactgtaggagaggtttttaaaacaaaaacattgtgtttgattttgatgcattctcatttgagtggctcagtgttgagtatgcggttatgtgtcttcttattcaggcttgctcactgtactttgtttgtgcagggaacaatgctatcatgatcattataatgtaaacatcccctcccaaagtgttaggaaaagtctgctgcagctccctgtggtctactgtcagttaccacttgtacccatctgttttatagcctcttcagttttgttactgctgctgtcatttctgccattactctttgtcctgtggacttgtttttaaaagttctgttatgatcactttaataaagtttcaggagagaggggaggctaatgcatgtgctcagcctggcatcttgagctttttagacagaattttctccttttgtgatacattaatttatttcctgttgcaaagagatggagcttcttgcagtccacgaaactgccatatacctctatgattttgtttttggattctgtaagataccatgtttagtagacctgtgttgttgtccacgagtctacaggaagatgttcatgttttgtttcagaaaatatttctgttgttttgtgcttttcttaactcatcaaatacaatgtgtggctcgcccttggcccttcatattgcttaccttaattgtgtagaccataaccagtttctactttgactaaagtttgacgtacacaagttacttgaatgtggggattctgtctatccctctacgccctagtgtacatagtactatatattatagtctctttaagtgttaaatgaaaaaccagtctaaaatgcaggatttatattaaaaatcgagttgcctgcttaatggtattgtggtttccttgtagactataatgataaattttgtgagactgggtgagtcattttaggtaaaagatttgtggagctttaaagtgatactggagtatttatatatgttaatggaataggctgtctaattttgtgtatgggtatggtgatgagaccaaggctctgagtctgatttttaccccttgtgtatccccgatatgtggatcgttttgtgggacatgtattcttaacattggcagacttgccctctaataactgataactgctgtccaagggttcaaatacaaccatccatgaatgaacaacccagatcatcaggctgctggaaaaaacaacccaaaacatagactttcaagatgattcagtgaagtttccttttgatatggagaatagtaataggctgtttttattatcaagaagttctaaacatttcactgggtaactcacttttacttaaaatagttgactgtcaataatatctcattctattttttacttaaactttttccataggtggttctttgaactagactttcaaatttttttatgaaaatgtttttaatcgtgtgataataggtcaaaagatgaaattctgaacatgattataattctcacttttgctgagatattaatgctaaccagagtagttcaaaagtagtccctttatgagatagcttaaattacattttttcaaagtgatactaaatgaaattagtcatcagtgtgtgccaggttcataagatgagaaagcaaatttaaggcgagtaagcagttgttgatgggggtgcatggggccattgctgggtagtgctgaatatggacttgattggtagcaaagctgtctggaacagtggtcttggggtgggaggtaggggtcaaatggtatcccttcttttataagagctctttttttaagctttcagcagcgaaataaccaaaaggcgggcagcagaaaggaaaaggacaatacatcatattaaataacagatcggggagttgaccctaaagtgggcataggaagaaggtgtgcctcacctagctctttctgggcaagactttatcattatttttagatgaacttccttattatgggtgctcagttttttttcatcagtttttttcatagactataccatcaaatacataagagtaaattagcaatcaaattgatccatatttaacgtcattatttccctaatgaattgagcttatttattcagctttatttagccttttcccccgttaagttttctcatttaatccttgaaggcctttagaaatataaaaaacagaatgtaattgtataaagacacaactaatggggtattgagaatgtgcagggtcctttggaattgattacatatttgattattttgaaatatttttcaacaatggtccatatatttttgttttcattttagaacaaaatccagtctcatagcagaggagaatataatgtttacagcaccttccagagccatgaaccagagtttgactacttgaaaagtttagaaatagaagaaaagatcaacaaaattaggtggttaccccagaaaaatgctgctcagtttttattgtctaccaatggtaagtatacatattttctttccatgtgcccactgtgtgtacctgttgcacatatcctgtagcctaggagaggaatcatttaacagagatacttgtaaaaaggacttttgtttttctatacagaatgtaaactctacttttttactgtcacttgcagtttttagattctctgaaagattctctgatagcaattttttgtttactacacctccaatttgtagtgaaaagaatgggctgctataccattggatttaggtcaggtaatatttctgtcatttctcagtctcgtaatcttgggcaggttactaacactgaattgaattttcctcagcagcaaactagagatagcaattttttattatagtattattatgaatattaaataacttcacatacatcatgagtgcaagtgctcaataaatgttaatttattcctcctttttaagtgtttgtaaactacacagagtatctcaaactgcagatacaaaatactcaaaggatggtctccattccaggatacgctataggagagcactttcttacttgatcaccattagcatattgccttcttcccagcaatccacatggctggaaggagattcctctcctactgtttacttgccaagggaacattttttgttgttttttgagacaatgtctgtcgcccaggctgaagtgcattggtgtaatcacagctcactgcagcctcgacctccctacctcagtctcctgagtagctgggaccacaggtgagtgccaccacacccggctaattttttaaaaacatttttgtagagactgggtctccctatgttgctcaggctggtcttgaattcctgggctcaagcagtctgccccgctcagtctcccaaagtgctgggattacacgtgtgagccactatgcctggcccaggaaaagttgagtgaggattaaaagttagtaatgacaggccgggcgtggtggctcacgcctgtaatcccagcactttaggaggctgaggcgggtggatcacgaggtcaggagattgagaccatcctggctaacatggtgaaaccgtgtctctactaaaaatacaaaaaaattatccgggtgtggtggcgggtgcctgtagttccagctactggggcgggggtgctgaggcaggagaatggggtgaacctgggaggcagagcttgcagtgagccgagatcgcgccattgcactccagcctgggcaacagagcgagactcgtctcaaaaaaaaaaaaaaaaagttagtaatgactctaccagaatttgaaatcctttatgatgagttgggtgctttctctttgttcttatgaaaaactttttcctgtgaattgtttggactttgttggggtcttgagtctaaagggaatcattagagtgactgaggagatactttagtttctgggtagccgtagtctataaaaatttgtgattaaaacttttttgaggttggtgctagggtgaggggaacctcttattttctcatcccctcactattaatttaaaaagcaaattctaacacctagaccataaacatttgcagaatatatacttaaatgacttcaggatgaaatgggggaagaaattcagcacttcctccatctaattgatgcccctcgtccacagtattagttcttagaaatgctgttcacaaatgcctgatggccatcagcgttggccgcctcctgggtgcccgtttttctgatcatgaaagctttccccagccagtccattgagatgcgtaccctctgccttctctgttttcacaatagactgcattcccctctcttgtccttattagaagaaaaataaagagaagtaactatttaaagcctgtaaatcacagcactatgggtggagggaacagtttattcctgtcatatgctagcttctagtcttgggtcagttttaatttatatggtaaactaagttatttcaaatagcttcaaatattttagacactgttctttggcatcagatgatacataattaaaccatttatataatttctacttttagaagtaaatgttcctagggaaatgtgttgttaacattttatatattggaatatttttatgtcagtttatttcttatagggctacatcagctttcttataaagagaactttttaaatgtaggctgagttcaagagaatagtatagtgaagccctgcatgctcatcatccacttctgacactcctcagttcatggctaatttgtgtctcggatccttccccttcccctcctcctcagtgttatttcgaagcaaatccgattacaacgtctatggattaaatcttgtttaaagacattagagaatgcattgtagatttttgtcttttgtttcttaatactaagtaaaatacagctaactgggggctgcattttttaatgctaaaataagtgcttaataatagagtccaatgtggaaggataaagcagattatgagaatcatatgaactgttgtgtctgggtagatgggaaaaggatgggaggagtaggacttgaactatatctgaaaaactatttggaaagaaggagacttagagaaaaatgtcaacatctgttgattctgagtgatatcttttatattattttgtgtatttttctctgtgagttttttctgtgagcatagtaacaccccccccccccaatataatgggtctatataaaaactatatctgtgggagaatgatggaaaatagtaccaaactttccaggtttgattaaccaaaattaatcttataaaaatatttgcattggctttccatgatcattatatgaactgggtttcccagatcatttttacttaaaggacgtcatagtcaccttataacttgagttaatttaatgttccttcaagcattttaattctctttctctttaatcttcttttgctcctctgaattctcattaattcctctacattgcagaaaacatgaaactgacctgtcaaccatgagtgttacatatatgaataatgtaaagttcactcataaatagggtgtgtcttaacaacttcttgataagttttttagggtcttacataaagctgcattcccacaaaggaaacggcagcgtggttttccctgctcatacctctcataccttctgcttgtggtgagaggaactctgttcttctgcagtttctccaatgctttagttattagtgttgataattcaggggaacaccacagtgtggtcgttttggaaggaacagatcttgagaatctaataacgtctccactgaaaactgtgtttttacataatctcacatacagttttatggagtttgattattctcacatactttgtcttatgggccaaaaactccaggtaataaaatatcactgctgtagaacataaggattctgattttttaaaaatttatgtcatatttattaacatactgatttatttcctgcctgccttgtccccaccttactgaaaaatgtatcctaattcatatgtgtcctgtgtttgtgttaaggaaaaaacattttttaaagagctttcttcctgtaaacactattaggcaccacaaactaattttatctcatctgaaagtttcataaatacattgtggtttctttatttggatctttaataaggaggatggatttaaacaggccacaagacaactggaccagggggcgggggtgttgtcatcctcatcacaaatactttgcaagtatttagaacaaatacttctcagaatacagatttaggctaggctcatatctatctataaatcatatacatatataaactaaataacacatagaaaatctgtatgactgaactacaagaaaattataagcaaggtcacatagggcttagaagaaataatagattacagatgattaaagttagcagtttttctctgtttacacttcatcattgggaagggcatccttaggggcaactatcattcttctgtacgatacagagactgccaggctagagtcactggcatctctctgagttgtttctgtttttataaaatggctttatatactgttataaacaattttgttacaccattttgcttatgaaagatcgttaggaatgtatgcttttctataagaaaaactgttatacaattgtaacagttttaaatcaacatgcatgagcctatagtgatacaaataaacaattgaatggatacatggagagcagggatgcttcctgcaggagaattctaaataagacgtggatacatactcttccctacagggagtataacttatttctccctttaagtacaggctggatttagtgactcacttccaaagaacagaatatggcaagggtgaaagagtcattgtatagtggagaagcctggcaaacattgtcttaaccaaatgacccaagttaacgccaccagctgtaagtcatgttgataccatgtatccctttgaacaatgctgtgagaagtcacttcatctctctgttctgttcctaaaaacccatggtcccagtctgatcatgaggaaagagcaagcaaatccagttgagggatattctacaaagtacctcaccaccactactcaaaactgtcaagatcaagaaaaataaggagagcctgagaaacttaaaggcagagagactaaggaaacttgatgactaaatgcagtgttgtttgaattctggagcagaaaaggaatgttagtggaaaacctggttaaatctccaaatgcagtctgtagttaatagtaatatacaaagtcgacgtcttagttttgacacacgtaccatggttgcgtaagatgttgacagaagaaactgggtaaaggatatatggaacactgcaattcttgtaactttctgtaaatctaaacttaattgtaaaacaaaagtttgtttttaaacagatgccattttatatatccttgatacctaggaatttggtttcttcttgaaggacttggggatgtatgcttttaatcagttttcttcaggccctgtttcctacttgtgaaccctgatacaagaaggggaaaggttttaaaaaggaggcatccagtcctatggaggcctctgtggaatctttgataggctctgctaagaagtgggagcaagggagagcagctttactattttgattctacataataggcagtcttaatcaacttcattgttccctttaaattttttaaaattcagtactgaacatgtatatgtttacatgtaggtacagacatatatgtgtttgcatacaccacacatgcatatcaagtttttccctctagctttaattacttttaagggacagggatagagacctgtctgtgacttgatttgactatcacatggaatttatgagtgccaccaatctttgcactttatttccatgtgtgtatgttattcagctgataataggaaattttttagtaagttcagattagggtttttttttttttcgtggaatccttttacgtgaaatgtgaaatagcatattttaaatgccttaaaatgtttttcttcttcagtattttaaggacttttctttattttcttcccagataaaacaataaaattatggaaaatcagtgaaagggacaaaagaccagaagggtataacttgaaagaggaggatggaaggtatagagatcctactacagttactacactacgagtaagtacataagaaaaaaatgtcacagatagtgcttgtattcatattatatagcccaaatcctgagcagagcttgaataggaataattacagtctatctcccctttcccagtaattctgtaatcaggtaggacattgagtaactcatttaaacatagaaactgacctacatagaggtctcactttggccagggacagaagcaggactcaagcacaagacagtatttcacgccatcagacttcatctctggtttgtcatgttagctatcacaaggtcaagtttcaagataaattttctttggaaatcaaaaaagtagatacagatcaaatcttctagttgtagctaaaaaataccaagaattagatgttatgggttaattttctttttagcctctttaatctgaaccataaacatttattagcttggcatgtctttcaagcaaaatattgaaactaagaactgcaaattctaatagtattgcaaccagtaaaagaagatatattatccacattgttcattttttcttcagcactcgaaaggatcaacatcagttgctttttaaaactaaatctatgtaatattgttctattttatgttctcaaaaactgaaataatgaagttttctgaatcttaattgctatttgaaactgagccttttgtaatttctgtttttcatgtgtcttattgacaggtgccagtctttaggcctatggatctaatggttgaggccagtccacgaagaatatttgccaatgctcatacatatcacatcaactcaatttctattaatagtgattatgaaacatatttatctgcagatgatttgcggattaatctttggcatctggaaattacagacaggagttttagtatccatttggttttctttggtgtttggtgaagaaggcatgttgtgcccatattagatttatttcatctctcctaatgaatttggttgctttttatagtctgtgtacatatatgtatggcaccttatttttttctttgtagatgagtaatgaaatactggaaaaagttatttgctaaacataaagggcataatgtattgatttaaaattggattcatggaattttaaggaatttgtctattgtatctatgtaaataggattattttttataatttaggtttttgttttaaaaatcacatttgtgaggtctgtgtatggtagcttatgcctgtaatcccagcggtttgggaggctgaggtgggaagatcacttgaggccaggagttcaaggtttacagtgagcttgattgtgcctctgcactccagcttggatgacagagcaacaccctgtctctaaaaaaattttttttcttctaatcaaatgtatgaactactgtatttgaattttttattgtaaaaatagtctcacctggctgcggtgactcagcctgtaatcccagcactttgggaggtcaaggtgggtggatcacctaaggtcagtagttcaaaaccagcctggccaacatagtgaaaccccgtctctcctaaaaatacaaaacattagccgggcatggtggcgcatgcctgtaatctaagctacatgggaggctgagttaggagaattgcttgaacctgggagatagaggttgcagtgagctgagattgtgccattgcactccagcctgggcaacaagagtgaaactctgtctcaaaaaatatatatatatagatttatatatattatattaattgatattaagattagattaagattagattaagattaatcttaagattagattaagattaattttaagattagaaaaagattaataattagattagattagaaaaagattagaaaaagaaagattaaagattacgattagattaagattagaaaaagaaattcacgcaagtcatgatgcatgattgggtaaataaaaatattctattgaggccgggcacagtgactcatgcctgtaatcccagcactttgggaggctgaggcgaggcggatggatcatgaggtcaggaggtcgagaccagcctggccaacatagtgaaaccccgtctctactaaaaatacaaaaaaaaaaaaaaattagtcagttgtagtggtgtgcgcctgtaatcccagcttttctggagactgatgcagtagaatcgcttgaacctgggagtcggaggctgcagtgagccgagattgcgccactgcactccagcctgggtgacagagtgaaactccgtctaaataaaaattaaaaaaaaaagttttaatccctttggaatttatactcataaaaacagtggagtgcaattcagaattaatatttttgcttaggtccatgaatgggttttaggtttgagaaatgtagaattatatttgcccttttttctaagtggaaattccttaataaaatgttatctagacattgtggatatcaagcctgccaatatggaagagctaacagaggtgattacagcagcagaatttcatccaaacagctgtaacacatttgtatacagcagcagtaaaggaactattcggctatgtgacatgagggcatctgccctctgtgatagacattctaaatgtaagtttattgtatctttccttaaaatgattacatattctgtttgtctgaaataagcctcagacatgataagtacaattacagaggttcaaagtcttaaacccgtgtgtccagagccacttgtacccttggtaatctgcctacctcctcatgaggcattccaggttattcctggaagctctcttggggggcatgtctattgattgccaaggaatatatctctcatggaatgctgttgttctttggtaacttgcggttgggctctgtaaccttgtattgaagtagagctgttcctttctttcccatcctcccttcctactttgagcttcctaggaagatttcttctgaggtttccttggcttaaaaaaaaaaaaaaaaaaacaactttggtttaaaaacttcaggatacaatattcttgtcttgttgaatattaactcatgaaaattgatacatgcctgttaccaaaataattttacctggctactagaaaataagatcctggtatgaatttgggatgggcgaggatggtgtgtttctcatggtgatgatacaggcagtcagtgaggcatattgcaggaataataccaataaacctggtgcactgaagtcagaagtcccaggtgagtctggttctaaattagtcatatgactggaagtatactgcatacttatgcatcttcaacttcaatattcaattaaactaagaagctttcaggagaattctagccagagagatgtttttcagttctttattagcctggcattttacctcacttgtagggagtttgtgaatggttgtttaggaaatgctttgtccaagccagaatattgtacaccttgccctttttgtgttgttttgttttgtttttagtgtttgaagaacctgaagatcccagtaacaggtcatttttttccgaaatcatctcctctatttcggatgtaaaattcagccatagtggtcgatatatgatgactagagactatttgtcagtcaaaatttgggacttaaatatggaaaacaggcctgtggaaacataccaggtatttgagttttttctttcaatgagcatataccctgtttactttgaagtgtttatagagaaggattttgttactaggttttaatccctgtatggtgtttgttcaccattaggccttttccctcagagatctatgagtatgttgctcttccttatgttaaatgtatatatacttacataggttgtgttgtctcttgagttttgcagttaaagtgtgattttgctacccatttggttcagtattgacattgtttttttttctgccactatgtacatttaaagtgaggatggaagagcacccttcattgaggtctgggcaggaagaggattggagaaagtggccagtccttagtagaggtgcacctgctcaggttgtgggagtagttgaactagagattaaatttggtgtgccaagtcaaatggactggtgttctgccttttggcagataactgttgtcttcagctaaaagaaagggcttgaaagccttagcagatggctttaggagttgcctatccgttgttggatgtcagttcttgattctcttatcagccagccactactgtttatccgtgtccactacatcaaacagaagagaatgaagtacacagcctggaacagggtgagggacagcacaaacctgtgctaggccctagactgcagtgttgaaatcacttaactctaatttatacatatactttctttatgttatatattctcaatagactgggaagtatgtttctcaaactttaaatcctctgacaaacataaacgaagattgtttttgatacgtgaaatttcaaaataaatactgcactgaaacaaaagacaaaatactgctttgcttttcaaagtatagttcactattgagcaacatggatttgaactgcatgggttcactcatacacagattttttgttttgttttgttcaaccaatgcacatttgaaaatacaatatttgagggatgcaaacccctcaaatatatggagggccaaaacttcacgtgtgggttccgcagggctaactgcagatttgggtatacctggggttcttggaacccatccctcgtgtatactgaaaaaagacttctatttgtgtaactgccaagattgatatatctcctagttaccctcaccatcatttcattcccattgagaagaattgatttgaagcttagcttcatactgatgtatagtgagaaactctataatgtgcattctaaaatgttgctaaattatgataatctacctaattttacctgatttgctacttttctacttataaacagttggagtagtgattaaaagtagtcacattataggcaaatgtatcatatatagataaaactatttttattgaatttgtaccagcatcttgccaagttttgtgtgattgaagggtatttttttcttactgatttttttgtgttacatgctcacttttgatcctaaccccacatgagttgctattcctctgtattacagattttcacttaatgtcacagagacatggcctgaatcattccactatatttaaagttaaaatagacactgaaaataagtttagattgtttcatatagaatagagaattctaagcatttagaaggtaccttctcatttctgtcatttctccttaagtagctccttaaaaagagatggtgaaatatagacacttccttttttcctttgagttacaacaaatactttggaacttttgtttgtaattaatattaatgttgaaatatgtcatatttctcagactttttaaatatgagatttctagtttatccttttttgacatattagtaaatacagaattatataattcaaaaaacaggcacagctttgttagcttttgacattgtataatatgatactatcaaatttttaataatatatgcccagaataaccatataatttatcaccaaaccaaggcatggttacgctatgcatacatgtgcatttataatggaaaatataggcttcagttaaatttatgcccagaaaatggtatttaagaaagaaataggcacagtttcagtgttgttatcagtagttaatggactgaaagccaagaatagtgatattcagatattgctataatgttcttttattagtctcttaactgtgccattttcaagtgtttttggcctgaatgttttattcaggcttataaaggctatgtgtgccatgcccagaatggagttttcctttgtcataccagtaggaaaatgtacctccctgaagggcttgtgtgttttgtaaaaggacaaaatgcctttattgttactgagaagattgagattaataggtttaaaaggtgtgtgtatgtgtctgtatatgccctttttttctttttaaagatatggacttgttaaatcattttcctaatttcagtgcagtatatttgtatttttcccccaggtgcatgaatacctcagaagtaaactctgttcactgtatgaaaatgactgcatatttgacaaatttgaatgttgttggaatggatctgacaggtaattaagtcaaacctctcaaatatgaattttattaaagaaaagaaacaactatttcattccaggtcctaacttcgtctctagggattccttgaaataaatttagtaattttagatatagcacagcagtactggtagataaaaaattaaagcattgtatttcactagtaaatataaaagtacacaaattctaggtaatctaaattatttaaatgtctagaattttttttcttttatgaaccagatcacatttctgacatgctaaccattaaaacggtgaagcttcagcttggttgttattcttccattaaactgttgcagaaacattcaggcggcagataactcatttggattgttagaaacaccaggttttccagatgctacattaacacctcatagaagtggtctttcatatgtatgttatgtatgatgttaaccataatatatatggttaaaattttagtagtagttatcctttgctttttataatttccagttttgccgtagtgtaattcctttttcgtattcatttttagtaaaatgttacccattatttaaagataaaataagtcttactttgagtcttttagttgtctatttgccactatgttccagtagaacagaaagtagtaaaacataattttggaattaaactgacatttaaagtaatcagagatacttcaacaacagttttatcacagagcttaatatgattccgatttcatggtgttgtgtgttacagaggataatagaacttatagaatgttttctttcatctggcttttaaaattatctgatttttgacataaggactagtaaacctagagttctgttaatagcaaacattgcctttgagtgctactactaaacctgaggcatcaagaagaaagaaggaaagggaagaagaaaaaaaagattaacaaatttgaagagtaaagagatactgaaataaggtgtggcgcacagctacaaccagtttttcattgtatttaagcagataattagcagttttatgttctattatcagaaaaaaacgatttgttttccttaatattaaaaatttttttttaactatttcaaacttagagaaaatttgttagaataacacaaagaactcttggctggccttgacccaggttcccctgtcgctgtttgctgtatcacgtgttctattctctgtttatttatagctatatttgtccacataggtacgtgcgcatgtgctcacatgcaacttgtgtgccacatgggaatttattccatttacgccagatgtgatgcccataaccctaaattcttgaatgagtatttcctgacaaaaacactttccaacatagtgacagtgcagcatccaaagcaacattcacagcgatgcagtactgccatctaatccggagacccactgaaactgaccagttactgtaactatgtcctttatggcacagaacaaagtcagtctggttcagtatccagcatttagttgtcatctcttgttagtctcctttattctgaaacagttcctcagtctctccttgtctttcatgaccttggcattttgaagaacacaggccagttattttatagaatgtttcctcatgattagattcaggctatacatttttggcaggaataccacagaaatgctggcctaatgatacctttttaaagtttcaagtagccacagcctaggtgtcctaatacattaaaaccacgcaaactcagatgatatggggatgtcaatctaaattacacaagccatttttaaagaaatacagttttgtcatcttcaggggcacgcattaccttgagtttgattaaagttgttgccaagtgtcctttgggaattgacattactaaatagataataatttgtactcagtaggtgacctttgtatgtaagtattactttgaacaattccccagtatcctgtaatccttatttacaataataatttgaaccattggtaagcagcggtagcagaccctttccaaattaagagcttcaaacttacgaagttttgtttgtgaggatacttaataaatgtcgagcagtaatgggtggcaaatagaactgacaaggaagtgtcttgggcagtttaaaaattttgccacccctttaaactgatacttttataaatatttgcttaaaatgttctaagtggtaaaagtaaaatgatgttctgttaagaaaatattacagcctgggcaacatagcaagaccctgtctctacaaaatatttaaaaattatctggacatggcagcatatgcctgtagtcacagctactcaggagactgaagtgcaaggactgcttgaacccaggaggttgaggttgtggttgcagtgagctgtgattgtgccaccacatttcaacccgggtgacagagtgaaaccctgtcttgaaaaatacatatatataggccgggcacggtggctcacgcctgtaatcccagcactttgggaggccaaggcaggcggatcatgaggtcaggagattgagaccatcctggctaacgtggtgaaaccctgtctctactgaaaatacaaaaaaaactagccgggcgtggtggcggacgcctgtagtcccagctactcaggaggctgaggcagaagaatggcatgaacccaggaggcagagcttgcagtgagccgagatcgcaccactgcactccagcctgggcaacagagcgagactccgtctcaaaaaaaaaaaaattatacacacacacacacacacattatgtaccacttaatatttctcaggagcagattataacataagcatttattaaatgtgattatctgaaccagacaataccnnnnnnnnnnnnnnnnnnnnnnnnnnnnnnnnnnnnnnnnnnnnnnnnnnnnaagattatttatttatgagacagagtctcactctgtcacccaggctggagtgcagtggcacaatcttggctcagtgcaacctccgcctcccgggttcaagggattctcctgcctcagcctcctgagtagctgggactacaggcacgtgccactacacccagctaatttttttttttttccgagacggagtcttgctcagttgcccaggctggagtgcagtggcacgaccttggctcactgcaagctccacctcccgggttcacaccattctcctgcctcagcctcccgagtagttgggactacgggtgcctgccaccacgccaggctaattttttttgtatttttagtagagaccgggtttcaccatgttagccagaatggtctcgatctcctgacgtcgtgatctgcccaccttggcctcccaaagtgctgggattacaggcgtgagccactgcgcccggcccaaaaaatgtaaatcataagataaagcattggtttcttgtgaacagctacagctacttcatgcggggttcttttgttttagaacctgtgagttccacagatagttgctcctttgagaagctggctggcctggttgatcacatagcctgtagttgcaaaaatacttaacaacgataattctgcactcctaagaagttttacttgaggatgctgtcaactttgctgatagttttggtagccataaaaagaataagcagaaaacccagttaattagtaccgtatttctggtttattctagtgattgagttgatgtcaacagcccctgtcccttagtttaaatctgcttttgaagtagcttcctatggtttaattgccgaatcattttacttgaaaacaatttcttgttctgcttgtttgactgagtgtactgtctattttcacagtgttgtcatgactggatcttacaataatttcttcagaatgtttgacagaaacacaaagcgagacataaccctagaagcatcgcgggaaaacaataagcctcgcacagttctgaagcctcgcaaagtctgtgcaagtggcaagcgaaagaaagatgaaataagtgttgacagcctagacttcaataagaaaatccttcacacagcctggcaccccaaggaaaatatcattgccgtagctactacaaacaatctgtatatatttcaagacaaagtgaattagggttggcattcctagcagaagaacccacttcctgcttagttgagatagttgaatctagcattcgttcctataaaagagagaggtccattgtggcgcccctttccagtgtttgacagtgtgccattcgacaacacattgttatagctacatggagaaagctctgtggattcatcactgtggtgttctccatgtctgctagccatttaggtaagggtagggcacttttaatttaaatgacttcttgcaccatcttgcctaatggactagattggactgtatcaacattgatttactccactttttatgccttccattgtgatgacgtcaaacacagtgaaagccttcagtcatgctatgggatttaattgtgtatcctcattactgtatcatttgtggggtacaccccttccccctttttttaaattaaatacagctcattcttactgtggcttgtagcattcctcctcttctggcctcctggactgctccccttcatctcttacccttgccccctccacccggtcttggtggtggtatattaaaaaaagaaagaatgaaagcacacaaaatgagtcagtttggggtcagtggtataaagggggtatatgttgcaaacaaatgttttagtaacagttggctgtaatcactcctcgccgtgtctggcactgaaaataaggaaaaaaaacctactactgaataaaagtgacaaagaatggagaatctggttttctttttctttttaacctacctcttgtagccaatattttgtgtcatacctttgggcacagtgaaacaaaatgggttttcattgtttattggtatttttgttaattatttttaacaagtgttcttttacatgcaggaggagaggtattggttctctatgaacatattttgaatataggttttattaaggatttcacaatctataaatgctactagtttttttttttttttttaccatcatgagggtattggatacattgtgtctctatttaactcattatgtgttaatgaaattgttgtaaatgggaaccaaatttgtagaacttaatttctactttttagagtgcttaatttcatttttgccttactaaatagtcaaagacttataaaacatttttaacaagttagaacttttttgttattcagtcatataaaatagcagaaaactaacatcaagtgacactgcactaaatactttttttgtattttactgctatcaaatcagaatgaaatatactttaccatagatatttttcttctatttttggttttccaaagctatatgaaagacaaatttttaaaggtacagcgttcaaaaagtgcttaatgaactccaacagctgcctcaaataaaaatctgtatatgaatacattttccctaagcggtgatacattatccaaagatgaagagtgctcctatttttaataggtagaatgtacctttgtcagtcttgcagaaactttaatggagaagaaatggactttatttttgaaaggtgaaatgaacaggcatttatattattagagaatggtagtcttattttggtggaacataatgtaacaaccttgaatttcagaggactctgagtgcttctatgtccactacctattgttctattcttcaataatgaaaaagaattcaacgagccgaccgtgattccctctactacaaatattatgtcttgtaagttagcatttttagcacacaggagaaattttatgtaataaaattactgtatcttttggatttaacaaatttgtatttgaaacacattctatgtctgataattcttaatggcacttttactaatttatttggggatcttgggtacattcttaatttgtgtttattcttcacgcttgacttgcaagtgggatattcccctgccacaagtgtcaaacagtgatattcttcctgtgttgtgactggacagttttccagatcttttttgggagattttcctacagcttggttgtatgtcttgagataacaccaccaaacagctctcagaaattcttttttgattgatcagtagctatgatgattctcctccatgacactaaggattagtttatatatttaagagaaataattgctaaaattaaaatgcctctatcaaggaatgctattataaattattgttaacattctcaagtattaattttttaatttcattggtgtagcaaactctaagcccagccactcattttacatggccatggttaatctttttattaataaaaattatacttagaataaacttagtcttgtcaagttgcttgtatttcctattctcttgccactaatatacatgcacatactccatcacttaaccttttagaagagattgtgggtaggaaaaggactttcattctattaacctcttttgatctttacttagtggctgggcaataagaattgttttataaacctgtctaaatacatgtttatgtaaccattaactgctggatggtaagcttctgtgcagccctccgtctcttgggattaaaaaaaatgcatccagtcgggcgcggtggctcactcttgtaatcccaacactttgggaggccgaggtgggtgaatcacctgaggtcaggagttcgagaccagcctggccaacatggtgaaacgccgtctctactaaaaatacaaaaatcagccaggtgtggtg

SEQ ID NO: 17376 - DNA, 37068 bp, Human; identical to SEQ ID NO: 12543

SEQ ID NO: 17377 - DNA, 16216 bp, Human
  misc_feature (1)...(16216): n = A,T,C or G
tcattaaggtacatttttctttttcttttttaagacggagtcttgctctggcaccaggctggagtgcagtggtacgatctcggttcactgcaacccctgcctcctgggttcaagcgattctccaacctcagcctcctgagtagctgggattacaggcatgcgccaccatacccagctaatttttgtatttttagtagagacggggtttcaccatgttggccaggatggtctcgatctcctcacctcgtgatccacccgcctcggcctcccaaagtgctgggattacaggcatgagccactgtgcctggcctaaggtacatttttcaagccagaaacaattaaaggaaaacaaataaactgttgtgtgtaaaagagctcaaagccaaggagggcttcccagagaggacaagaccagaacagggtcctgaaggattggctggatttggataagaaagagaggcagtaggacatttcagggaagccacacaccaaggcctgaagtcagagcagattggaggttgtatgtagagaagtcattattaattcctggactacttcctgtgtgctcaggcaagacactaagcaacgggaaatggacaaccttttctcaagaagctgcaatcttggaggtggagaatggaaggacagatactaaggcagatacaggcaatgtgtattattctacaagaatgtaacccccagaaagtagaaaccatatctgtcctatttatcactgtatctccagaacctacagcagcaccaggaacaaagtaggtgctcagtaaacgcatattgaatgcaggaatgctacaagggaggtatagaataacagcaatactgataattaccatttactgagcacatacatgtgccaggcactgtactaagagttttacatacatcatcttatttgatactctaaccttttgtgagtgctataattatcttgttttacagatgtgggaaccaaggtgttatataagtaatgcttgttcaaggttacctaaccagtaagtgacagaactgggattgaattcatgactgcctaacttcacagttcatcctctgaacctaagatctactgttcaaaatgctgttttgggaagtttggcagctgattaaaaagtgcagggaggccgggcgtggtggctcaagcctgtaattccagcactttgggaggccaaggtgggcagatcacttgaggacaggagtttgagaccagtctggccaacatggtgaaacaccgtctctactaaaaggacaaaaaattagccgggcaggtggcacactcctgtaatcccagctactggggaggctgaggcaggagaatcgcttgaacctgggaggcggaggttgcagtgagctgagatcgcgccactgcattccaccctggggtacagagcaagaccctgtctcaaaaataaaataaaataaaataaaataaataaaaataaaaagtgcaggaaagacctaagatagaaagactactagagtaaaacccacatccagaaaccagcaagaactgaagcagttatagtaggaatggagaaaaaaagatctacttttttggcacttcaaagggcttctaaataaagctcagggctcggtgacctgctggatgtagggaatgtctatgtgtcttgtctgagaatagaaaaaatactggttggaatagcttttctctaattctctgttcgacagtactagttgacattttagatagatgatccaaatttctaggtttgctagtttcccaaagcacctaatgaggtgcgggtcacatacagtagtgaaaaatcagcttgaaaagccccccaaagagggccgaataagaagcctggagaacgcacaaacctcttaggagcgctcacagcctctcaggcaggcgggcactacaaagggaaaggtggggcttctccaagaactacaactcccacaaggcattgggcggaacaccacggtttccggccagtgcttatttccggtctttcggatgctgacgctctcttcctgtctttgtggctccggaaaggcgtttgggatgccaacggtaagtccggaggcttagggcgtccgaacgggagaggcgagagcctcgtgtccgcgcatcaccccgtggctgggggttagctaggggagggcgggaagggcagaggacgcggtggctggaggacgtgtaaccttgcaagaggcgggaggcggggggcannnnnnnnnnnnnnnnnnnnatcccagttctgtcacttactggttaggtaaccttgaacaagcattacttatataacaccttggttcccacatctgtaaaacaagataattatagcactcacaaaaggttagagtatcaaataagatgatgtatgtaaaactcttagtacagtgcctggcacatgtatgtgctcagtaaatggtaattatcagtattgctgttattctatacctcccttgtagcattcctgcattcaatatgcgtttactgagcacctactttgttcctggtgctgctgtaggttctggagatacagtgataaataggacagatatggtttctccccccccgcccgtgggaccaagaaagggatgtgacaggcgaggacgaatgggatctcaggggctggactggagagtggggtacagggatgtgaggaggaccccgcgagtccgcggtgggatcccaatagagctgtggccaaggaggaggggagcagcgggaaggctgtgggcactcctgtgtgagggaaagctacaggctcctgcaggtccgagatcggccgaaatcaggcaccccaaggaagccctgctctggccacatggtgtcccctcagaagactccaccagccggtgggcatcccggggcttctgacaggaagagggcagtagatatattggtgcttgtaccggtttttcgagggctgcagggtgaagatggtaggagagtctggagaacgggtctgctctggtggcttatggactactctgtggaaggggctgctgttctggtagcatcgaaggagctttctacgggagcgctgtcaagaggattttggtgaatttgacgtacttggtttgataactcactttgcttttttctctaaagatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaaggtaactcgaggccctagagttacagattaagcctatttctggattcttagttttcagatgggaatagggagcatattggtgggtagtggtttctctttgggacacttccagcatcagatatattgagtgaatgaatacacttcgggatctacttttggaaaggaggacattcttacctaagctacaagaaaccatctttcacgtttcgggttggaagaattttagagtagggaagtggcaagaattgtggaaaaactaggagggaaagataaagacacagaaaatacacaatcccttgttacctcaggggtttaaagtgtcatcttccagcctggcatggtagctcacgcctgtaatctcagcactttgggaggctgaggcgggcggattgctggaggtcaggagatcgagaccagcctggccaacatggcaaaaccctgtcactactaaaaatacaaaaattagccaggcgtggtggcggacgcctgtagtcccagctactcgggaggctgaggcaaaagaatcgcttgaacccgggaggcggaagttgcagtgagccggagattgcgccactgcactccagcctgagccacaagaccgagtctccatctcaaaaaaaaaaaagtgtaattttccttctttcattagcctagagcatttttgttgcctttctttcattttattcccttataactttctcctctgtattcactgtgttcctcttctccctccctccacacacataggcatgtacatgaagaaaaattgaggcaaggatgaacttggacctattgcctcctggatacttgattattttggtgcttctgagcaatagaatccagtccttgacctggattcttcagtgcaacagaaccaagttgctatattactcatatcttttgcaattctgatttttttggagaagcaggcaggtttgattgtttattgctttaatttaatttttttattattattttttagatggagtatcactctgtcacccaggcaggagtgcagtggtgcagtctctgctcactgcaacctctgcttcccagctgcaagtgatcctcctgcctcagcctcccgagtagctgggattacaggcgcataccaccatgcctggctaatttttgtatttttagagacaggattttttgtattttagagacggagtttcaccatgttggccaggctggtcttgaactcctgacctcaagagatcagccagcctcagcctcccaaagtgctaggattataggtgtgaaccactgcgcccggactattgctttaatttttttgtttgtttgagacagagtctcgctctgtcccaggctggagtatagtggtgcgatcttggctcactgcaacctccgcctcccagggttcaagcagttctcctgcctcagcctcccgagtagctgggattacaggcgctcaccaccgcgcccagctaatttttgtatttttagtagagacagggtttcaccatgttggccaggctggtctcgaactcctgacctcaggtgatctgcccacctcggcctcccaaaagtgctgggattacaggcgtgagccacggcgcccggcctgctttaattttatatccattacttactaaccctttttgtttcatccattttctagtgctgcattagacgtggaactatctgatgattccttccctccagaagactttggcattgtgtctggaatgctcaatgtcaaatgggaccggattgccccgtatcctcttggcacttggtgatgaagggtcggggggcagggagagccttgcctgcaaagcagcaggggtacttcaaataggctggatatgtgtggctgtcctcctgtcatctctctggataagatggagcaagagaggttggtgtaaattgtgtgagcatgatttagagtagacatgaagaaggaggatactgaagttcagattataagaccctgaaacaagctgggcacggtggctcatgcctgtaatcccagcatttttgggaggccgaggtgggtggatcataaggtcaagagattgagaccatcctggccaacatggtgaaaccctgtctctattaaaaatacaaaaattagctgggcatgatggcgcgcacctatagtctagctacttgggaggctgaggcaggagaatcacttgaacccaggaggcggaggttgcagtgagccgagatcctgccactgcactgtagcctaggcaacagagtgagactctgtgtcaaaaaaaaaaaaaaaaaaaaaaaaaaaaaacctgaaacatactatactgggaggatatagacacttaataaagatgtttgtggctggacaaaggtatttaaggtgcttttaaaagaaattcaggccaggcacagtggctcatgcctgtaatcccagcactttgggaggccaaggtgggtggatcacgaggtcaggagttcgagaccagcctggccaagatagtgaaaccccgtctctactaaaaatacaaaaattagccaggcgcagtggcgggagcctgtaatcccagctactcgggaggctgaggtaggagaatcgcttgaacccgggaggtgcaggttgcagtgagctgagatcgcgccactgcactctagcctgggcgacagcaagactctgtctcaaaaataaaaaaaagaaattcactgggatgctagcatgaaggatctgggtgaccttttaaagtctcttattcagtgagtctcttattctaatctaccaattatctcctgagtattgaattagatggtatttttcttcctgtgaattaaagtatatttaagccaggtgcggtggcacatgcctatagtcccagctacttgggagatggaggtgagaggattgctagggcttgggagttcaagcctgcagtgagctatgatagtgctgctgtactccagccttggtgacaaagtgagacctagtctcttaaataataattaattgtattttattaatctgttctcaagttgctatgaagaataagctgagactgggtaatttttaaaaaaagaggtttaatttgttcacggttctgcaggctgtacagcaagcatggctggggatgcctcagggaacttataatggtagaaggcaaagggaaaataggcacgtcttacatgtctggagcaggaggaagagagtaagaggggaggtgctacacacttttaaaccagatcttgtgagaactcatatcattagaatggcaagggagaaatctgcccccatgatccaattccctcccaccaggcccctcctccaacattggggattacaattccacatgagatttgggcagggacacagatccaaatcatatcaataataattatgtatacgtttaggtttattggtgagggtaaatgtggtctttgtatttgtttttgttttgtcttttttttttgtattttcaataatttccttcaattatagttaacaaaagattttctatgagcttggccaggcgcggtggcttacgcctgtaatcccagcactttgggaggccgaggcgggtggatcacgaggtcaggagatcgagaccatcctggctaacacacagtgaaaccctgtctctactaaaaatacaaaaaaattagccaggcgtggtggcgggcgcctgtagttccagctactctggaggctgaggcaggagaatggtgtgaacccaggaggcggagcttgcagtgagctgagatcatgccactgcacttcagcctgggcgacggagcgagactgtcaaaaaaaaacaaaaaaaaaagattttctgtgagcttaagtgactataatttcttttaatcatccaagaagaagcactgattgaatgactgtaattttttttttgagatggagtttcgctcttgtcgctcttgtcttgagtgcaatggtgcaatctcggctcactgcaacctctggctcccgagttcaagcgattctccagcctcagcctccagagtagctgggattacaggcactcaccaccatgcctagctaatttttgtatttttagtagagacggggtttcgccatgttggccaggctggtctcgaacttctgacctcaggtgatccaaccacttcggcctcccaaagtgctgggattacaggcatgagctcccatgcctggccaagtgactataatttttttatccataacatatattgctttggaagtttacttcaaaaaccatgacactgagtataacatgggacccttaaaatttagctggaaaaaaataccatacactttagatttaaaaaagatgcctaggccccatatggtggctcatgcctgtaatcccaggactttgggaggccaaggtgggaggatcacttgaacccaagattttgagaccagcctgggcaacaaagtgagaccccatctctctctcttttttttttaatatttaaaaaaatcagtaaattttaaaaagaagcctatatatatatatatatatatatttttttttttttttttttttttttttttttgaggcggagtctcactctgttacccaggctggagtacagtggcacaatctcggctcactcaacctccgcctcccgggttcaagcagttctcctgcctcagcctcccgagtagctgggactgcaggcgcatgctgccatgcccagctaattttttcgtattttattagagacggggtttcaccgtgttgcccaggctgttctcgaactcctgaactcagccaatccacccgcctcggcctcccaaagtgctaggattacaggcgtgagccaccatgcccggcaaagaagcctatattttttcattcctgcagaatattgccggcatgagatcagcatgtattggcaaatgttttgtaagtggtgcatttagtccacaggttgaaaggctgctacaactttagcttcatctctttccgttccttaactcttgagccagtgctagcaatgtctcccacactgtggtcctgcgccctctcaaggctggttatttcaacttcacctcggcaacaattacttacctggcccaggaggatgggcccgttgtggtgagttgcccaaacccttagctggatggaatttggatctgccttcccttaaaatctcttgtggtgggggtaagagggggatgaagagaggttgattaatagataccaaaatacagttaggactgggcgcagtggctcacacctgtaatctagcatttttggaggccgaggtgggcagatcacctaaggtcaggagttcaagaccagcctggccaacatgcagaagccccatctctactacaaatacaaaaattagctgggcgtggtggcaggcgcctgtaatcccagctacttgggaggctggagcaagagaatcacttgaacccaggaggcagaggttgcagtgagccgagatcacactactgcacttcagcctgggcgacagagtgagactccgtctcaaaaaatatatatatatagttagaaagaataagacctagtgttcgatagtttagtagggtgactatagttaacagtaatctaatgtatatttcaaaatagccagatgagaagcatttgaacatttccatcataaagaaaagataaatgcggccagacgtggtggctcacgcctgtaatcccagtactttgggaggccaaggcaggtggattgcttgagcccaggagttggagaccagcctgggcaacatggtgagacccccatttcaaataattagccaggcatggtgcacgtgcctgtgatcccaggtactcaggaggctgaggtgggaggattgcttgagccccagaggttgaggctgcagtgagccattttattgccactgcattccagcctgggcaacagagtgagaccctgtctcaaaaaaaagataaatgtttaaggtgatggatatccatctaaaaagtatagattgtaaaaacaaaaacctcttacagaaaatttacacagtagctactaaattctgagggagataacattaaccagacacttggtattgtcctaaggaagtatgtttcaaattaaagttctggactagagtgattgaaatggatgggagaggtgtaccatggccttccccttctcttcattccttctgccttccttttcatctggagtgtgtcatttgctgcctactgatgtccttgtctttctgatctgtcttctctgccactgtcagattcttcccagtctccactgttactctctccttcccttgcttagattgctcctgcttacggcatcagggctgagcttttctgcctctcactgcacccccctccagtagtctagctattttctgcctccagccttctctcccactctgcccatacagaccctacatcctaattaggccaagctacttcccataccttctcccccaactcagtccttattctttcctttgtgcctttgttctgtttgaagtacccttttccctccactccattatatctgaagccttctcaagacccagctttgagctatgtctccttgttttctgccttcagttcatattgctctttgctattcattcttttcttttttcttttctttttttcttttttttctttttgagacagagtctcactctgtcacccaggctgcagtgcagtagcgcaatcttggctcactgcaacctccacttcccgggttcaagcgattctctgcctcagcctcccgagtaactaggacaacaggtgtgtgctaccgtgcccggctacttttttatatttttagtagaaatggggtttcaccatattggccaagctggtctcaaactcctgacctgtgatccgcccgcctcggcctcccaaagtactgggattacaggcgtgagccaccgtgcccggccactattcattctttcataaacatatattgactgcatctaaacttctgtagcacttatagtctatggcacttgaacatttaatcactgtcttcagtagtttgtttcttatttatagatcttccctctccccacccccacctcccaatttaattataaactccctgaggccagtaactgtcttagatttctgtttcccatatatgatagaaactcagtagtaaacagtcttttgattgatgtaaaggtcaatagacatttatgaagcccctgcaatgtgccagactctggggaataccaagaggattaatatactgtccaagtcctcaaaaagcttaagtcataaatgtataaagccaaataaatgtataaatttatgaagccaaaatgtgtgatcctccataccagtagggctgtaggctaattagtacacagtagggaagggacttaacacagtcaaccatagaatgaaaagaactaacattcattgcaccttctgcattttcgtttttcataaactacatggaaccatattcttctaaacctagcggtgttttcacatccggtatcatttctgctttcagaaccaacctcaggactctttggttctacctggtagttgatgggttaatagacataaaatcaaaggctttgctgccactttggaataaagttgtttgcagtgtgctccaaactcttggcttcctctccaagacaaaggaatgtggaccagactcaacccctcctctaataatgtacatttgggtagggctttatacttcattatatatttttgctatttcatttgagcctcacattaaccctgtgaagtagtggatttttgctggaggattaagtaaatgattaccaagggtaagtcattccacgcacaccttgccctgtagagggaccagtggtggtgagcaacttcactctttgcagagtctgaggctcagacagaagaatttggctttaatttcagttgcatgcctggcctaccttgtttaatatatgttctccatggggtatttctcaggtcttctggctcctaggtactcctctttataacacactaagagagaatcatccaactctctctagccaaaagctttccctcatcttcttgaagttcttctgagcctttgggaactaagactctaatgcatagagttgggttggttgggactgccctttctcagagtagatgaggtggaacttcatgaggtggacttcccttaatgtcgttcttttcttcttttcagattggctctaccagtgcacctggacagggaggaatcctggctcagcgggagtttgacaggcgattctcccctcattttgtaagctttctagtgttctctctcatcagttccttggtatgagaatgcccttttggttctggaccctcttggcttccacagatttgttttgttggttggttcttgccctgtgtgttttttggtgtctgatatagatactcatcaaatagattgatttagccatgtccagagatttttggcaatgagatcacaattgccaaaaccataaaactgacttaagtagagtcccatctttgagtagatacccatcttaaactcctgggtctattttgaggtttaaaaaaaaaaatctgattagattcagagggtcatagatcattgggtaggttaagtgggaactttactgtggtctagtctaggaaagaattttttgaagatgagcctgaagtactgaatgctggaattcattcagtgaataagtatgatgttccagattatgtgctcattctgtgctctgctttggggacacagtgatgaataagacacagtcccttccattaaagatcttacaggctggcgaggcaccatggctcatgcctgtaatgccagtgctttgggaggcagaggcgagaggaccacttgcggccaagagtttgaggctgcagtgagccatgatcacaccactgcactctagcctgggtgacacagcaaaaccctgcctctgaaaataacaagatcttacgagctcatagaggactcaaaatagtaaatggggaggctgaggcaggggaattgcttgagcccgggatgcggaggttgcagtgagccaagatcgagccactgcactctagctgcctggacaacaagagcgaaacgctgtcaaaaaaaaaaaaggtaaatggggaaaatgctgtgatagaggttatatgccaggtgctggaggagcctgcagcaggaacatctaatgagaggggactttctggaggaggtaaggaagggcaggcacttgaggagagagagcagccgagattgagaaaagcatggtgtgattcaggaatggcaagtagtttatcaaggctgaagggcagaatgtgaggtggaggaatggaaaagagggggcctgaagtgtaaacaagggttagatcataggtggcttgactgtcaggggcaagaccagggcatctccattctcaaaaattgtctggaacagaagcttctcttccagtctggtttgggtcgggtgagtcctttggtttcacagcttgaaagattggtctttagagagccattctatatcaggattggtcagagaggaaccttcttgcctaaagttctgcttaaaatttgtgctgagttaggcctggtggtgtgtacctataatctctgctggaggatcgcttgagcccaggagtttgaggctgcagtggctatgattgtgccactgcactccaacctgagcaacagagtgagactctatctctaaaaaaataaaataaaaattaagaaaatttaggctgggtgttgtggctcacacctgtaattccagcactttgggaggtcaaggcaggagaatcacttgagcccaggaattggagaccggcttgggcaacatagtgatattttgcctctacaaaaaataaaaaaaaaattagccaggtgtggtggtacgcccctgtgatcctagctactcaggaggctgaagtgggaggattacttaagcccaggagatcaaggctgcggtgagccgtgaccatgccactccactccagcctgggcaacagagcaagaccttgtatcggccgggcgcggtggctcatgcctgtaatcccagcactttgggaggccgaggtgggcagatcataaggtcaggagttcaagaccagcctgaccaacatggtgaaacccagtctctactaaagatacaaaaattagccaggtgtggtggcatgcgcctgtaatcccagctactggggaggctgaggcaggaaaatcatttgaaccctggaggcggaggttgcagtgagctgagaatgtgccactgcataccagcctaggtgacagggcgagactccgtctcaaaaaaaaaaactaagactttgtatcaaaaataaataaatttgggctagactgctccctttctcattggactcatattttccctggcttctcctgtgccctaatccagacttctaagcaaggtctttgttttcctttacagctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattgacttgtctgttttcttagcccccgggtgaacacaggtgattattggaactcagtctttgcccagacccctgggcaagcgagctgggttctggccttgctgcaggggttgtgggcgggtcctgttcccatggagatatctgcccttttgaatcttttgcttccatcccttattttcctctgattgttgttctcatcagtcaccacctattgccgtacaccttccttgccaggcagctcctcttcacagctggagaatgtaggatggggaaagatggtctgcagaggaacagctattgtcatccccttagatctcatctgatttattgactcagtatttgttttttttgtgggttttttttttttttttgagatggaatctcgctctgtcacctagtggtgaacaccggtgcctggcacctgagtgttcttgaaaagctatctctcatgcctgacttctagccctttctcgttaagaactagctttttggccaggtgcggtggctcatgcctgtaatcccagcactttgggaggccgaggtgggcggatcacaaggtcaggagatcgagaccatcctggccaacgtggtgaaaccctgtctttactaaaagtacaaaaaattagctgggcgcagtggcatgggcctgtagtcccagcagattgtgccactgcactccagcctggtgacagagggagactctgtttctaaagaaaaaaaaaaaagaactaactttactttttttttttttttttttttttgagatggagtcttgctctgtcacccatgctggagtgcagtggcatgatctcggctcactgcaagctccacctcccgggttcacgccattctcctgcctcagccttccgagtagctgggactacaggcgcccgccaccatgcccggctaatttcttttttgtatttttggtagagacggggtttcaccgtgttagccaggatggtctcgatctcctgaccttgtgatccgcctgcctcggcctcccaaagtgctgggattacaggcatgagccaccgcacccggccaaaactagattttcttgagctttaattttattttctttttttgagatggagtctcgctctgttgcccagcctacaatgcagtgttgtgatcttggctcactgcaacctccacctcctgggttcaagtgattctcctgcctcggcctcccgagtagctgggattacaggcacctgccaccatgcctggctaatttttgtattttagtagagacggggttttactatgtaggtcaagctggtctcgaactcctgatctcaaatgatctgcccacctcagcctcccaaagtgccaggattacaggtgtgagccagccaccgcgcctggcccttttttttttttttttttttttttttttttgagatggagtcttgctctgttgcccaggatggagtgcagtggtgtaatcccagctcactgcaacctctgcctcccgagttcaagcagttctcctgcctcagcttctcaagtagctgggattagaggtgcacaccaccacacccggctgatttttgtgtttttagtagagacagggtttcaccatgttggtcaggctggtctcgaactcctgacctcaagtgatctgtctgcctcagcctcctaaagtgctgggattacaggtgtgagccaccacacctggcctgaatttacttgtaatgcttctgttctttgagctctggcagggaagaagtacctggatcccttgagttgggctctaagcgtgacctgtggaaaggcagtgacttttgctgctgcagcagtggggagaagccactctgagctgactctgtccaactcaggaatgccgtggtctgagaacagcctcccaggcaagagggaagcccaacaaacaccggctttgtttctgctaccgagtttcccagtttagattctgctcccccggctcccctgcccaactggtttaacctttctttagcccagcaatcagagcctccaggc

SEQ ID NO: 17378 - DNA, 27160 bp, Human
ccctcactgagatgagaactttccttgttcccctcccctaataaccaaagttcctgccttaatcccactccagtccctcatccaccccgaggccaggcttcagaacccagaactgagggcctgtccagccctgctttccttgtgtttgagggaagccctgatatcttggagctgtacaaggtagcaacataatttgatttccctggttgctcatcggaggataagctgtgggaggcagttgggcagggcatgcaggcagatgggacccaggcctcaatgctgtcacctcttagagaggataaggtgggacgggcatggtggctcacatctgtaatcccagaactttgggaagctgaggcaggcagattacctgaggtcgggagtttgagaccagtttggccaacatggtgaaaccccatctctactaaaaataaaaataaaaaaaaaattagctgggcttggtggcaggtgcctataatcccagctactcaggaggctgaggcaggagaatctcttgaacccgggaggtggagattgcaatgagctgagatcatgccactgcactccagcctgggtgagagagcaagacttaatctcaaaaaaacaaacaaacaaacaaaaaaaacaaacaaacagaggatgaggtggatggtgggaccaggataggggccaggatgaggggaggggagtggaaggcttatcaaaagggtccttggtgaggcctgaggatggaggctccagagcctgaggtagcgaaccctggggacctgagtgatctcgttttgtgagagagcctggcccctccccagagccagctgcagaatggacctggccagagaggaaagtagagatgagtatggtgctggcctttgcagccagcaaggctgtggggtctttgctgttcctgtcccccactaccttcttgccccccactaccttctttctggctgaaaccaggatagagacccaacattggctgtccagcccccagccctgctccccctttcaggcccctctgggaaccacagaaatctgggacctagtgtcttggcaacgtaatgaatgcatgcacagctctggtatctgttttaaattatccattaaaataagtacagttctgggggaaaaaaataagttgactgggtgcggtaagcagtagaaagggactgaagggggaaggaacccaggcagtgcttgggtccaaaggaaggggacaggagatggaaggggcagtgcctggctcctattcttggctttctttaggggacttctttaggggactgtggcttgttgcttgggtctaaaaacgaatgcttggctttgaagagagatagattggggcaaaagaaagaaaaaaagggaccccccaaactccttgatccctggccccaaactgggggcataaaggaactcaggttccagaactttgctccccccagggaacccaggcattccttctccaccccactcctggcacactgagatgcagctctgaatgggctgcccacgtgtggaggggggttggggtgactcactattactactgggaggacagggggagccagtggtggaagaagggtgagtcacactgatgggcaccagcctcagccctccccccactttcctggctcccagccctgcctacctgaccctctcccttgctttgcgcccacttccctctctttctccccgacccttttgcccacccactctccctccttggctctgccctctagcccagaaggtctgaggcaatgggggcaagcttggagccgacagtgctgagcaggcaggagccaagagaggggaagcttgagcctcacgcagttaggggtgcgctggagagggtggggcccgactccgccacaccccaacggtccttccccctcctcaccactcccgcccccacccccaatggatctgggactgcccctttaagagtagtggcccctcctcccttcagaggaggacctattagagcctttgccccggcgtcggtgactcagtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcggtgagttcgcccaggtggctgcgtgcctggcggggagtggagagggcggcgggccggcgcccctggccggccgcaggaagggagtgagagggcctggaggccgataactttgccatagtctcctccctccccggaactgcccccagcgggtgactggcagtgtcaaggggaattgtcaagacaggacagagagggaagtggtggtctctgggagagggtcggggaggatataaggaatggtgggggtatcagggacaagttggggctggggccggcctgaattcggtcagattgggatttgccaactatttggagccggggggaggggcttgagcaaaacagaactagccctgccagctcgaagaactctgggcacccaggacacatcggagtggcagaaagggtcctgttagaactttgttagcgggcttggcactgtgctagctttgcccaagctggctctgaacacatgatgcccactaagacataactctcaagttggcatctgtccagcgtgttggagcgaggtcaggaaggcagggcaatcccccttttccctcccaagggcttggcggtggccccccctcagcatgaccttgtcctgggttctaagggttgggaagttctccctcactctgccactctgcgtgtctgggaccttccttgggctctgacaggcccaccaaaagagctccgggagatgagagatcggctcccccgcagctcccacagcccttggcctgcttggcccaggaatgcaagggagggagggaggcagagggcagaggctcccagctcaggaagttgtgttatgcccaggtctggccgcactcctcccttggccctctgcctagtgtcttcgagggttgggggcactgtccttccctccttggggtgagccactttcattttcccagcggggccaggcagtctttgctcgggcccatcctcttagctgctgacgttttgatctttgtcttattgaagtgctggaatacagtgacatttttgaaatccagccgttggaagattcaggccactcccactttacccacccctgccccaccctaccccaccctactcaactgcaccttcttcttttctaaaaaagcctttgggagcttggaagtataggccctctcttccagccccatcaaaatttgtttcccttcttcctgccttccctttctctatgcagacccaggccaagagcactaagggtgcttggagatccgtaaagggctgttggctttgacttcttctctctcttttatcatctactccaaacttctgctcttcctagaaccctttgctaggtgtggttttgttgcccaggctggagtgcaatggcacaatctcggctcactgcaacctccgcctcccaggttcaagtgattctcctgcctcagcctcccgaatagctgagattacaggcatgtgccaccatgccgggctaattttgtatttctagtagagatggggtttctccatgttcgtcaggctagtcttgaactcccaacctcaggtgatccacccgcctcagcctcccaaagtgctaggattacaggcatgagccaccacgctgggcccatcacccttctttctgaagagtcaatggaagttgtgtgtaggaagacaggcttaacggtttttttttgagacagggtcttactctgtcacccagactggagtgaagtggtgcgatcttggctcaccacaacctctgcctcccaggctcaaaagattctcctgcctcagcctcctgagtagctgggattataagtgtgtgccaccacacatggctatttttttttttttttttttttttaatttttagtagagatggggtttcaccatgttggctaggctggtctcaaactcctgacttcaaatgatccacctgcctcggcctcccaaagtgctgggattacaggtgtgagctaccatgcccggccatcaacctttattttgtttttttgagacggagtcttgctttgttgcccaggctggagtacagtagtgtgacctcaggtcactgcaacctctgcctcccaggttcaagccatgctcctgcctcagcctcccaagtagctgggactataggtgcctgccaccacgcccggctactttttatatttttagtagagacggggtttcaccatgttggccagggtgatctcgaactcctgacctcaagtgatctgcctgcctcagcctcccaaagtgttgggattagagacgggagccactgcgcctggcttctttttttcttgagatagggtttcactctgttacccaggctggagtgcagtggcaaggtcatggctcactgcagcctctacctctctggctcaagccatcctcccgcctcagcctcctgagtagctgggaccacaggcaggcaccaccacccacagctaatgtttttgtattattttgtagagatggggttttgccatgttgcccacagtcttgaactcctgggttcattctgctgaaagagaccacacctgtccttttctttatttttattatatttttcagagacagggccttgccctgttgctcaggctagagtgcaatggtacaatcataacttgctgcagcctggaactcctcctgggctcaagcgatcctaccgtctcaccttccggaatagctgagactaagggcaggcaccaccacgcttggctaatttttttttttttttttttttttttgctttttgtttgtaaagatggaaacttgctatgttgctcagctggttccgaagttttggcctcaagcaatcctcctgcctcggcctccggaagcactgggattacaggcataagccaccaggcctgacgccaggcctgtcttttttctactagtgatatgaacaatttagttagcaagacagataggaagcaaggaaggggagacccagagaattcgttgcattctaaactagtccactcatctaccaaagccctgtgaaggacatttttagcagttttagcagttttctggtcaaaactttgatcgagaaacagattgagtggattcgatattctcttgctcacccagccacgccagtttgtctcctctgcctcctagtgcagctgtccaggcctgggacaccaggcgggtatgtgcgcatgtggggcagggcggaggtggtgtgtgtacttgttatatttagccacctccctctgttctcccccactgatcctggctggaaaggctgggcttccggaaaagagaggtggatttgcacacctggatcccaagctgatagaaagtggggtgaagacaaaggggactcagactggggtgtctgtcctcttctatgcccacagtaggaggagccaggattggttactccctgctgggtctgctgtgctcagagtgaggtagagaagtgggtagagtaaagaatttgggagaggaaaaaaggcattttcccaacccctcccaccaaagcctagagagaaggtgttgtctggtttaatgtttaattagagctcagagttcagggccagatttggagttgggatggaaagttgtttttaagaccctgtagcaatttttgacccagcctgggtacctcaaccacactcaggagtttgggggaccttctgttgggctggattataggctccaagaagaaacccctttcgccaatactctctctctcttctttttttgagacagggtcttgttctgttgcccaggctggggtgcagtggcatgatcacagctcactgcaacgtcagcctcacaggctctggtgattctcccacctcagcctcctgagtagctgggattacaagtgtgtgccaccatgcccagctaattttttttttctttttttttttttgagacggagtcttgttctgttgccaggctggagtgcagtggtgcgatctcggctcattgcaacctccacctcccaggttcaagcgattctcctgcctcagcctcccgagtagctgggactacaggcacatgccatcacgcccagttaatttttgtatttttagtagagttggggtttcaccatgttggccaggatggtcttgatctcttgacctcgtgatccgtccaccttggcctcccaaagtgctgggattacaggtgtgagccaccgtacccggccactaatttttatatattttgtagagatggggtttcaccgtgttgcccaagctggtctcgaactcctaggctcaagtaatccacctgccttggccttggcctcccaaagtgctgggatgtataggcatgagctaccgcacctggtaccccctgccccttctctgtctctttctagtctgtagcccaagggatttggatacccaagtgcaggcagaatgggaaggttgtaagcaccagggaagcctgtctggagtccaggcttgcagctgggccccaccccaggcaaggcagctgggtggatgactcagatgctgcccccctccctcccaccctggtggctttacagaagacagcaggagacagggtggagacagcagttgtcttaaagggaggagtggtggtctgaatgtctacctcttctgcccccctccccattgcatcctggagtcccttgcctggctccttcctgagaccctctggtggtgtctggacacatagctctctctggacaggtaacatgcacaagtaattagaatccagagttgagttcagagttatggattgggctgcaggatagtgccagggtctgtgccttcccatgtgaaactgatggaggaaggctgagtcagaagtggggagatccgaggcccacaaagcagaagcgctacttccactccaaaaaggccctggtgcttgacaacttcctggattgcccactgttgcagccccagtgtggacaggcagggagatgcaggctccagttcatgtaggctctgatcaagacaagaacagcaaaggccacagaggcacagatgcttgtcccatgtcacacaataaaggggtcagcacttgatcacaggccttatgacttccagctgggtgtgctcttaccattaagcctcacttctctagcttgggggacaggttggagggaggatctagagggtgaggtaaggtgaagtcaggtagctgaggctcacttctgcagcctggaaactctgctctggggccagtgacaccttagtgctctatggccatacttcgtggctcatgcctgtaatcccagtgctttgggaggctaaggcaggaggatcacttgaggccaggagtttgagaccagtctgggcaacatagcaagacccccttctgtacaaaaaaattagccggtcaacacctgtagtccagctgcttgggaagctgaggcgggaggatcacctgaagccaggagtttgaggctattgtgagctatgactgcactactgcactctagcctgggagagagaaagaccctgtctctgaaaaagaaaaaaacaaaacaaaactctgctgtcctgcagggcctgttagcatatgatcgatagcctttgctccagcctatacctggacccaggacccctgccagcccctcaatcgtgagacggtcagagctctgggaggctggtgattcttgtcttgagactatcttgagacttgtcatgggaattgtccacccggattgaaaggaagctgtgccttttggcagacccattaggttaatggggttggagacctttgaggatgcatgggccctgggctttatctgagggtatctcctggtgttacctctccaaccctccaccaccaaatccattctttttttttttttttttttttttttgacagtctcgctccctggcccaggctggagtgcagtggcatgatcttggcttactgcaatctccacctcccaggctcaagtgatcctcccacctcagcctcccaagaagctgggactataggcacgtgccacatgctcggctaatttttctatttttagtagagaccaggtttcaccatgttactcaggctggtcttgaactctggggcttaagcagtccacccaccttgacctcccaaagtgctgagagccactgagcctagcccaaatccacgttctgattcaaagggaaagaagaagggtgcagctaaacctggggggtgagaagtacttaaaaagcccaagagaaacaaaagagagaataattcctcactaggaccccctattgccttcccactattggtgcccttgcttggcacttcccctggcctccaggagtctgagacttactcttccatggatgtgcccattgcccccacttccaggtccaccccccagtgattcggtagcttagtgtctgcgctgaagcccaggacagctggatggacaactggtagatcccttcacctaccaactgtgctttctgctcccctcccccttgcttccctcctccccagcccctcgccacccctagcagctgcagcagccaagaccaagtcttcagagacccagacacaagggcagggttcattccattctcacctccttggggtcccagtgtactgataggccgaactctaatattataggagatctctggaagattgcagggtctcttatccctcaataaggggcaaggcaagccgggcgcagtggctcacgcctgtaatcccagcactttgagaagccgaggggaacagatcacttcaggtcaggagttaagagaccagcctggccaacatggtgaaaccctgtctctactaaaaatacaaaaattaaccagaaatcgcttgaacccaggaggcagatgttgcagtgagccgagatcacgccactgcactccagccagggcgacagagcaagattccgtctcaaaaaaataatactaataataaataaataaataaggggcaaggtagtccaccaacaaaatgacaggcagtgtgatatagtggacaccctagccctcggtgcccttagttctgtgtgtggccctttcactaaattgctgtgtgaccttgagcaaatcgcctcccctttctggctttccttagctgtaaaagaaagggattggagcggaaagtctccagagaccttttaggttccaaagtagtacagtgacccacaaagtgagaaaacagtcttctaaaataccaagttattaatagtaaaatcaaatataaataatgtgaatatagttaatagctaatgttgttctcaatagaaatgtttcccacaagctgtggaattaaacatactaccacatttctctatttccccgtgaaagtttgttagaaatggttaaattgtgacattaccctcttggcaaatgttttgttttcattgctactaggaaagggcaactcgttttcgatgcctctcccttctggacggtggaaagggctgtgtcatagagtaggaacgggagatgcggcacaggaatggctcccattgacccgggttgggggctagggcgaaggcctaggagaggcagaactgttaccttagagctggccaggattagagaacagtgcctggaaccggggggaggggcacggtgaccttgggctgcccaccttctacccttccagcacccatactggctcccccaacctgcggctgggctgggaggaggtcttggcccctaccaatcccttaaggaaggggaaagagtttgggaaggggagtcctcccttcacccctgcctcccccaagttgtgagagaggaagccggaatcctgcctgctgaagccaggaataattctggctgagatcccaggcccggcaggggcgctgagtcatggtagagggcagagtggagagtggacaggagaccctaagcttgtccagtcagaaaagcagaggctgaggggtggccttttcttgagaactacattcaagttgcagcaagaaggacagtggtctgaatttgacggggacaaatggaagggagataggacacatgagttcctttaggtctggctcaggggagctagacttcatttcaaggggtctaggttctgggcagttgagaaggaggctatttggggtcaccaaggctcccctttcttcccaaagctctaacactgccaccttctgctggctaggagagagctgtgtcttctgaggctagagctggaatgcagtgagaccagactgcctaggtcctccctcacttcttctcctgaccttggggtgtggctcccactctctcccagtgtcctcagggttaataactatgtgccaccagatagagagttaaggggctgctgaattggcttcttgtgaagggaatcccctaaatgtccctcgttttggtcactggcctccctcccgcccccttcaggacattctactatcttcttaggccatccctccctcctccaggcactacttcttttgctctatccccaagccccacccctgcatttttgtgacaacaccggaatgatttctagagagagaggccaggaagaaggaaagtggcacttggcaggagaccttgcagggggcggctggtgaggaagccagccgcccattgtccaggaccccagtgccctggcctccggcctcaggcttctcctgcctctgtacaatgccacgttgatacgcccagcagctgtgactcaggcctggccccctgccaggcccagcacttctactggagttgcgtctgaacatgtcaacaggcttcctatccctctctcagcaccagttctccccacttcagcccctccctctgcctggaattaaaacctggctttgtcttagggaaggacagctgggagcctagtggctctggtaggggatctgagaggcctcagaccctaggcatatttggctgtttggcaggtgtcacgcccaagggaagcgtgtggaagcagagccatgcctgctgtgggtgcacatgcccgcgtgagggagtcggggtgtttcatcctggggcacctgtgggcttttgaggtgtatgatattcagaacttcacaggttggggtttggggaaggctcaaggggcttctaagtccctggaacagctgcccccctcagttcctctctctctctctctttttttttgagatggagtctcgctctgttgcccaggctagaatgcagtggcgcgatcttggctcactgcaaactccgcctcctgggttcaagtgattctcctgcctcagcctcccaagtagctgggactataggtgcccgccaccatgcctggctaatttttgtatttttagtagaaatggggtttcaccatgctggccaggatggtctcaaactcctgacctcgtgatccacccaccttggcctcccaaagtgctgggattacaggcgtgagccactgcgcccagcctcagttcctctctttaaggtctcctttccagagagggatagcacctcaaatgccagggaggggaattctccacatcctgcccttacccgagttgtggcagacccacagactagccaagaaaccaagcagtggttactttgccgggttgggggggaggtaggggctatcaaacctcatgattggccgcacacaaaggtgtgagtatgtgtatatttgagggtgggtgggagtggcactttcactaggcctccgtatcactctctgactggggtatctcccagcaagcgagacagaggcagacacgcttcccagactgtcttactgggtctctctgtgttattctctgcagtgtctgtgtgtatcgtgccattttctatgttttgcaccaatctgctgtgagtgtcctcaggtgacctgggggcaggtttttagtgcctgagcctacccgtctccaggctttagtttccccctgtaaaagtataggagttggttcaagagaaggttcctctagaagccttgagcctgtgaaccgtctagtctccgggtatttgtgggacacacagaaaaagccccacgacccaacaggtagaacactggctgaaatcagcagggcagagctgagacaggctcaagtaggctgaggggtagggaggttttgggtgaatgggagggagggacagagagaaggaggatatattgcagtaggaggagttgctggaacaaaaggaggggtggtaggagtggcttggggtggcagcagaagacgccctgtcacatggcgggaagtcagcctgggcagaggtctaggtgtccaggaggggctgggtgtggtggctcacgcctgtaatcccaggactttgggaggctgatgcaggaggatcacgtgaggtcaggagttcaagaccagcctggccaacatggcgaaaccctatctctactaaaaatgccaaaaattagctgggtgtggtggcaggcgcctgtaatcccagctactctggaggctgaggcacaagaattgcttgaacctgggaggtggaggttgcagggagccgagatcgcgccactctactctagcctgggcaacacagtgagactctgtctcaaaaataataataataggggctgggcgcggtggctcatgactgtaatcccagcattttgggaggtggaggcgggtggatcacctgaggtcaggagtccgagaccagcctggccaacatggcaaaactccgtctctactaaaaatagaaaaattagctaggcatggtggtgcaggcctgtaatccagctactcgggaggctgagaagcaggagaatcacttgaacctgggaggtgaaggttgcagtgagatcacctgggcgacagaatgagactccacctcaaaataataataatagtaataataataaatgaaaaattttaaaattaaacaattaaaaattttaaattaaaattaaacaaattagatgcccaggaggatacaggagagcatttgccaccaggcggactccctgtacccacccggccacagggggcgatgttcctgggagacaggaaatgcccaggggctgggagaccctctgctcttctgctcccttcctgtgtgctgcctggcaatggggaactctgagggctggtgagcagggctgctgaggagtgggtctaaggagtccctgcagggctgggccagctcctccacctcccctttgtcttcccctcccacttgttatttttagctacagtgtctgtccctcttgcttctcccccagattgggagaggaaacggaggcctctccctccgggcctagcctgttgcccccagcaaccgggcccaaacaggcctgtggccggccctggcttccatatctggcatcagagttgggctgagcagggtgactcagagggtgggtcagcgcctggcccggtgcccacctagcccctttgctgtgctggtgcctttcttccccaaacagccccaagggcccgggcctgctgcagctggggagccggacttccttgtcccaccaggcacagctcttcagacccctgccttgggtcacatttgcaagtgccaactctcatttctaccttattcttttcctctctgttcccctccccaccccctctcttccctctttctgagatcagatttgccagtgatgggaagagttagaaacaggatgcccagcccttctcgcctcaagaggccactgggatgcagccactcctgtgcttggggaacctggaggatgcaagggaaaggactggcactctgctggcacagcacccggcctggggcaggacacgggcgaagccagggtctcccctgtgagcactagaggatttcccgacccctgcccgggtattgtgtgcctgagcatgagtcacctgaggggcccaggttcccacccttcccagctcctctggcctgccccaccctgtcctccctgccaacccagcacggggacggcactcagcgtgtgctcagctttcctgatgccaacccccagtggagtgggctgcaccaccaccctgggaccgaatgcctggctagggtctactttggtccctgctaggtctgaggacccctcctaggaaggaaatggcacttgggggcgggggcagggaggagggaggagagacactgggctctactgtacccctagtcatctcttggggtgtgcgtgtggctccctggccacagagctcccaaggtctgagtcatgagcccatgggtgatagtggcttcttccccgcagatgggagctccccgtgcctaagaaaaccacaaaggttcttcctcacttccctctctgctcgtggtttttctcatctgcagggtgtgtcttagtcctttaatctcctctctttgcagtgctagtcaaaacctccaccagggaaagacaaataacccccttactgtttttttttttttttttttttttttttgagatggagtctcgctctgtcacccatgctgtagtgcagtggcacaatctcggctcactgcaacctccgcctcccaagttcaagtgatcctcctacctcagcctcctcagtagctgggactacaggtgcacaccaccgtacccagctaaattttttttttttttttttgagatagagtctcactctgtcacccaggctggagtacagtggtacaatctcaactcactacaatctccgcctcccaggctcaagcaattctcgtgtctcagcctcccaagttgctgggactatggacgtgcaccaccttgcccgactaatttttgtatttttgatagagtcagagtttcaccatgttggcaggctggtctcgaactcctggcctcaagtgatccacctgccttggcctcccaaagtgctgggattacaggtgtgagccaccacactcagccagcccccttactttccttggagaccatatactgtggcttgtgccaaagtggtacagcatggatttccagctcccctatctacttgctgcgggaccctagatatagctttctgtgcctatttcctcaattgcataggaatagcacctatcgcatagggtagctgtgaagatgacgtgagttaacataatatttagagcagtgcttggtacctaataagctctatataagtgtttgctattatattattattatcactgccaccaccgcttttgcaagcagcagaaggtgaagaggttagactgaagaaaaaacttctgtgctcatcagcccataagctcgcagagcacagggatcatgcatctatgttttcctcagtcagtgtctgccaggcactggcaaggaaaggctgttaccagggggaactccaggaattcctcctggcacctaaggaggctggggagacaggactagggaaaaggtgcccttgagacaccttctgaaatcatcccattgccttccagcttctttcagctcaggctggctggtcagggaaacgctttgtgccatagtgtctgccctcttcctcctcctggcttctccattctctctggaacttgtggcttaggaaagcagtgaggtggaggaggaggaaccctagatcagcagctagaattgactggaatgctgctgctggctttcggtaattgacactgggccattcaccttcctcctttgcacctcagtttcctcatctataaaagggagagggttgagctgaatcaactctaagctccttctagttctctaaattctgagagcctcctagtacagccagcagcagccattagccttcagggtagagaggcctcttctgggaagccccagccagcctgggggtcagcccaaggagctcggaatctaagttgccccagttgcttcactttaccagcggtttttcttcattttccctcctccccctgcagctgcttcagcttcggaaaagttctgaagtcatggaaagttggggctgtgctcccagccaggggctaggccggatggcagccaaaacctgagctgggttttgactttatttttagcttttctgactgagacagaggagggaatacattctccggttctggaaggggctcttttttgcaggagacagacacttacattaaacaacttgttctgaggtgtggccagaggcctggactgagcaagtgtgcaggctgggggagcttcctctggcttctcatgtccttcccctgcccctctgagtgtcactctatcctcctccctgcctggtggggggaggtgggggtgactccttttttggactctcctaagcagaacactgcctgggtctcgtcctccagagcttctgcaaatctagccttccctatccctcttcacagtgaattgctgggcctcttggagtttaggacttttgtggtagaagaaaaatgttggcagggctgcttttctcctttccaggatagatttttccttctgcccacgcttggttttccttttttccatctgctgtggtgggctcatgcttaagcactgatgagttacagatggcagctggaaccaggtcctctggatctttccctccgctccctgggtctgctgctttctctcaccctatatttgtgaagcaattgtaacatctagaaagttcttgggttctctggaggtttttaagaaaataggacctttctatttctccagtccactagcaaaaataatcaggggcccagaaaaggtgagggaggtggcagaggcagcgctgttcgactggttatagctaaagctttacccactttgaggagcagggaggcttaaagctggggcccagatggacctggaggcctgggatccacatctggaaccagatgctgaggctatggtagatgggtagggctcagccttctcccagggcacggatgaggcaggagggagggaggcagggacccctctgttcagtgcagatcagggcacccagactgggtcctgagaaaggaaagggtcaatattgtgcctggtcatccttgtctgaggtccctctgagctctaaccagactttccttccccacagtcccacatgtgtaaaagggactaggagaggtgaccagtacctttggggctcagatcgagaagtgctagggacatgtgggccatgagcttagttgtcaggctcctcagagggagggaagcttggccaaagggaagtgagtagagtccagggagaaggctaagtaaggccctgtgtgggaaggggcaggagacaaaggtacccctgtctctttgggaaagaatgggaggagagagagggaaaagcattcatatcacggggtagagctctgcccttggccccaggcacgttcctgagccctgagtcatgggaagggtggagaagcaggaagggggttttcaaggaccttggggaggtgggagcccagccccagaggcaagcagatgcaaaccaacctaatgcaaggatgccctctcctggtaattgcaggcatagcagcgccagcccccatggctgacctcctgggagcctggcactgtctaggcacacagactccttctcttaaatctactctcccctctcttctttagcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaaggtgaggccaccctgcagggcccacccatggccccacctaacacatgtacactcactcttctacctaggccctcccccatgtggtgcctggtctgacctgtcacctgatttcagagccattcacctgtcctagagtcattttacccactgaggtcacatcttatcctaatttggctgccaatgggatctaccacagtgaatttaaaataatccaggaggccgggcatggtggttcacgcctgtaatcccagcactttaggaggccgaggtgggccgatcacgaggtcaggagatcgagatcatcctgactaacatggtgaaaccccgtctctactaaaaatacaaaaaattagcctggcatggtggcgggcgcctgtagtcccaactactcgggaggctgaggcaggagaatggcgtgagcctgcgaggcagagcttgcagtgagctgagatcatgccactgcactccagcctgggcaacagagtgagactccgtctcaaaaaaataataataataataataaaaataatccaggccatgtgtggtggctcatgcctgtaatcccagcattttgggaggccaaggaggcaggattgcttgagtccaggagtttgagaccagcctgggcaacacagaccccatctctagaaaataaaaatttaaagaaattagctgggcatggtggtgtgcacctatagtcccagctacttgggaggctgaggcaggaggatggcttgaacctgagaggtcgaggatacagtgagctgtgattgcaccactgcacttcagcctgggtgacagagggaaaccctgtctctacataaataaatacataaaataaaataatccacaagccatttctacttaactttgcaatgaactgtacctgaccctagatccctcccagtttggccctccggtatacaagggcctcctataggcccttgtgatttctctggggaaaaggaggactggagttgatcatttattgaggccatcagaagcggatggctaattacatatgggacatgtgttaataatgctttgtgtatatagagtggcctttactttcaaaacactcttctccaatttatcatgttaaaagctaggaattgggctgggtgcagtggctcacgcctataatcccagcactttgggaggccaaggcgggtggatcatttgaggtcaggagtttgagaccagtctgaccaacatggttaaactccgtctctactaaaaatacaaaattagccaggcgtggtggcacacacctgtagtcccaacaactacttgtgaggctgaggcaggaaaatcatttgaacccaggatcagaggttgtggtgaactgagattgcaccattgcactccagcctgggcaacaagagcaaaactctatctcaaaaaaaataaaaaatagccaggcacggtggctcatgcctgtaatcctagcactttgggaggcagaggtgggcagatcacctgaggttaggagttcgagactagcctggccaacatggtgaaaccccatctctactacaaatacaaaaattagctaggcatggtggcagccacctgtaatcccagctacttgggaggctgaggcaggagaatcgcttgaacccgggaggtggaggttgcagtgagccaagatcgggtcacagcactccagcctaggcaacagagcgagactccatctcaaaaaaacataaataaataaaaataaaaataaataataaataaaagctaagaatcaaagaagcagtttattcctaatttcacagtctcatctgttcatagtggggccaggattagagtcagtggccaagcttccatcctgggttctttcccttcccaggccctaccatcatagtataccagggaaagacctggagaagccagcaggttgaccaccgaaccaaggctgggccaccttcctcctgggtctggtctccagcctcccagttgtacccttcccccagcccttcctggatgcactgatcagcctgtgcttccttgccctgtttttctttataaatagagccatgttctcctctctctctctctcttttttttttttttttttttgagatggagtcttactctgtcacccaggctggagtgcaatggcacgatctcagctcactgcaacctctgtctcccaggttcaagcaattctcctgcctcagcctcccgagtagctgggattacaggtgcccaccaccatgcccagctactttttggatttttagtagagacagggtttcaccatgttggtcaggctggtcttgaactcctgaccttaggtgttctgcccgcctcagcctcccaaagtgctgggattacaggcgtgagccaccacgcctggcaagacgtgttctctctatgttgttgaggctggtcttgaactcctggctgcaagagatcttcctgcctcagcctcccaatgtgctgggattataggcatgagccaccacacttagcccagcctgtgctttcttaaatgaaaatctaagcatacggctgggtgtggtggctcacgcctgtaatcccagcattttgggaggccaaggtgggcagatcacgaggtcaggagatcgagactatcctggccaacatggtgaaaccctgtctctactaaagatacaaaaattagctgggtgtggtggcccatgtctgtagtcccagctactcgggagactgaggcaggagaatggcatgaacctgggaggcagagcttgcagtgagctgagatcgcgccactgctctccagcctaggtgacagagcgagactccatctcaaaaaaaaaataaaaataaaaaaaagaaaatctaagcgtggtgctcccctgctcaaacatcctcaggttcttttcatggcagataagggcatctcttcatgagccagcccctgcctactgacccagccacctctcccatcccttcccaccccgtacttcaggcttcagcagtactgatctttccaaagaccccagaacacacatgccttcatacctctgtgcctgtacatgcttgtttctgcccttgaaatcatgacagtagctctctgtaggccccgctagcctgtcccttgggtcttagcctcttggaggccttcccagagccccccaaaagtaccccaggcatactttggttccttctctcatgtcccctcagtactttgcacatacctcctttatagcagttgctatgttgtgccagagaagggagtcctgtggctggggggcatatatcttttctttttgagacagagtctagctgtgtcacccaggctggagtgcagtagtgcgatctcggctcactgcaacctccacctcctggattcaagcgattcttgtgcctcagcctcctgagtagctgggactacaggcgtgtgccaccatcatgcctggctacttttttgtattagatatatattttctctcttagcacagtacctaccaagagtgagtgagtagatgtcctgacccctgcaggcatccaaggccctccttccctggacctgtttccacatgtgtgaaggggtgcacaggcagcagcccacctctcagcttccttccagttcttgtgttctgtgaccccttttcctcatctctgcctgcttcctcacagcttgaggcagccctaggtgaggccaagaagcaacttcaggatgagatgctgcggcgggtggatgctgagaacaggctgcagaccatgaaggaggaactggacttccagaagaacatctacagtgaggtggggactgtgctttgcaagccagagggctggggctgggtgatgacagacttgggctgggctaggggggaccagctgtgtgcagagctcgccttcctgagtcccttgccctagtggacagggagttgggggtggccagcactcagctcccaggttaaagtggggctggtagtggctcatggagtagggctgggcagggagccccgcccctgggtcttggcctcccaggaactaattctgattttggtttctgtgtccttcctccaacccttccaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaaggtgcttgctctcgattggttccctcactgcctctgcccttggcagccctacccttacccacgctgggctatgccttctggggatcaggcagatggtggcagggagctcagggtggcccaggacctggggctgtagcagtgatgcccaactcaggcctgtgcctccacccctcccagtcaccacagtcctaaccctttgtcctcccctccagctggacaatgccaggcagtctgctgagaggaacagcaacctggtgggggctgcccacgaggagctgcagcagtcgcgcatccgcatcgacagcctctctgcccagctcagccagctccagaagcaggtgataccccacctcacccctctctccaggggcctagagtctgggccggatgcaggctggaagcccagggttgggggtgggggtgggggtgggaggttcctgaggaggagagggatgaaaagtgtccccacaaccacagagaagggtcgcaggatgtggagtcagatggcctgtgtgctgtttctgtacactcttacctcaccttcacttctcagggctttggttttcccattcgaaaatggaggctgttcttaatctccctaactcagagttgccacaggactctgcaatgtgaggtgttaaaagcatcagtatttttctagttggctgtgctatttgtgacaggagaaaaagtctagcctcagaacgagaggtttcagttagacaaggggaaggacttcccagttgccagccaagactatgtttagagcttgtgatgttcagagctggctctgatgagggctctggggaagctctgattgcagatcctggagagagtagccaggtgtctcctacaccgacccacgtccctccttccccatacttagggcccttgggagctcaccaaaccctcccaccccccttcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggtgggctggggagacgtcggggaggtgctggcagtgtcctctggccggcaactggccttgactagacccccacttggtctccctctccccaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggtaggctcctgctcagggtctaaggggatacagctgcatcagggagagagtggcaagacagaaggatggcatgtggagagaggaacatccttgccctcagagggtggaccagggtgagcctgtatatctcctccacactctggttccaggcctggctcctggactctttggctgtgagaccttgagcaggttatttaacctctcagagcatcagtttcctcatctgtaaaatggggatgaatactgatccctaagtctttgagttgtcaggaagatgaaagataaggtatccgtgtgcctggtgctgcgtatgtgtccacagatcatggctattatccccgggggaagggcagtgacaggggtgtgtgtagatggaaggagaggcctcaattgcaggcaggcagagggctgggcctttgagcaagatacacccaagagcctgggtgagcctccccgaccttcctcttccctatcttcccggcaggaccagtccatgggcaattggcagatcaagcgccagaatggagatgatcccttgctgacttaccggttcccaccaaagttcaccctgaaggctgggcaggtggtgacggtgagtggcagggcgcttgggactctggggaggccttgggtggcgatgggagcgctggggtaagtgtccttttctcctctccagatctgggctgcaggagctggggccacccacagcccccctaccgacctggtgtggaaggcacagaacacctggggctgcgggaacagcctgcgtacggctctcatcaactccactggggaagtaagtaggcctgggcctggctgcttgctggacgaggctccccctgatggccaacatcggagccagctgcccccaacccaagtttgccaattcagggcccctttctagagctctctgttgcaggctccagacttctccacccagtaggcaaaccaaaagatgcttcctcaacagcacaaggggtggaagttagacagtgaggattgttaaaggcagagccatactcctacccggagagcttgacagtgtccctctggggtggaaatgagttccttagctccatcaccacagaggacagagtaagcagcaggccggacaaagggcaggccacaagaaaagttgcaggtggtcactggggtagacatgctgtacaacccttccctggccctgacccttggacctggttccatgtccccaccaggaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaactttactcgctggcctggcctttcttctctctcctccctataccttgaacagggaacccaggtgtctgggtgccctactctggtaaggaagggagtgggaactttctgatgccatggaatattcctgtgggagcagtggacaagggtctggatttgtcttctgggaaagggaggggaggacagacgtggggcatgcccgccctgcctctctcccccattcttgttgcatgcatatcctctcatttccctcatttttcctgcaagaatgttctctctcattcctgaccgcccctccactccaattaatagtgcatgcctgctgccctacaagcttgctcccgttctctcttcttttcctcttaagctcagagtagctagaacagagtcagagtcactgctctggttctctgtccccaagtcttcctgagccttctccccttttatgtcttccctctcctcctccgggcccctagcctcccaaacccccattgcccgctggctccttgggcacagaaccacaccttcctgcctggcggctgggagcctgcaggagcctggagcctggttgggcctgagtggtcagtcccagactcgccgtcccgcctgagccttgtctcccttcccagggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccaggtgagttgtctctgctttgtctccaaatcctgcaggcgggtccctggtcatcgaggggtaggacgaggtggccttgcaggggggagagcctgccttctcttccgcagcccgggggagtgggagcctcctccccacagcctgagtcctagacagcccacctctgcatcctgcccctcttgtctgagccccagactggagggcaggggcagggctggagtgtgagggatgggggagatgctacctcccttctaggggccaggggagggagggtctgggtccaggccctgctgctcacacctctctcctctgttttctctcttagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccaggccagcctccgagagggagagagagagagagaggacagcttgagccgggcccctgggcttggcctgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgca

SEQ ID NO: 17379 - DNA, 111509 bp, Human
aaactatttgcttccttatcaatcaacctgaagggaatgatggaggtgacactgggagtcttggtaggtttccagactttcataagttcgggagaaattattgacttagcatagatgtgagctcaaagaaacatttcctaacagcaataaaaataagcattagagttgaacaatggactgtgactgtttcccaaaatagctgttttcttgagtccgcagaacaacaggtactgtattaatggggatacagtatttgtttcacagcgttgttgtgaagataaacgggataccccagataaacagcttgtgtcccccccatcttaacaaccctcctttaggctggcgggccacctgctcaaaagccttccccaggggggttaaaaccgtcttttagtagttctggtacgggtgggctgggggagatcctctaaagccagtgcgaccttgaccccagccaatgtccaggctcttgacacatccagagaatgagttcaaggacaactcagaaaatagtgacaatatgcagatttattgcaaagggaaaagtacacacccaggaaaagggattgtgggtgggagagggtcactcacaacggggcttggggctgctacctttatgggtttctttaaccaaggggtgaaatattcatgaaaattcctggaaaagtgtggagatttttcgggactgtggtgccacccatttttacttcaaatatgggtgtccccggaattgtcatggcactggtgtgacttaggatgttaaagagcgtataatggaggcctaggagaaacctaggtcaaatccaggaccacgtcgggtccagccggtcttagccagcttggtacacaccctggttttcagggtcttatcagcccatagcctccagtcaagtgaaactgctgcctggtattttttattctcctctgaccagcctgcattactcctgtcccatgttcaacacgaaatagggcctcaggaaatatttaccaaatgaatgaatggttgcctgttctaattttgtttaaccacactcttgtcctaagcttctatgatgatacccagggcccccgagttgtgccagttccactacggcgtggatgcaaggcgagcggcaggggagcaggtaaaggatgagtaagggaagccggcggatccgacgcattagagaacaagaaaaagaaatccttagagactgggggccaacaaagagccaggcgcgggcgaacccaccaggggggccccggagccccacatccgccgctgggacgacctccccgcccagcatggtccggggcgcggacccggccccgcgccaggcgcccccggccccgcacccggcgccctccgcagctcccgcccccggggcggtgccgggaaaacgcggcgcctccgccggtcacgtaggggccgctccggcgggcggcgctgccgcttcccaatcgcgccctcccagcgccggggacgcggcgcccgcgctcccgcccgagcccggggaaacggagacaaggaggcgccgccgccccctccccgcggctgcgccccagccctgcgcccgcagcatgcccgccgccgggccgagcgccgccctcccccaggagctcgaggaggcgacgccgctgccggccgcgggaccgcggctgcgagggtagcggggccggagccgggcaccccgaggcgccgcgcggcgggcggagagggaggaggagcaggcatcctccgcggcgcgcgggcggcggccctgctgcccggcgcgcccatggcccggccgcagggagaatgcaagctgctctccacgcgctcggcgtcccccggagccgctcgcgtcgccgccgccccctagccgccagcgctcggccgctggctgcgctaggacccgcggccgccggccgccgagcgcgggagggcaggcaggggcaggagccggagggcccggggcgcggcgcggcatgtagctgcgggctcccgcgtccgcgtgaggctgtcggcccggggccccgccatggctgggatggacagtggcaacctgaagaccgcgaggctgtggcgggacgccgccctgcgtgccaggaagctgcggagcaacctgcgccagctcacgcttaccgccgccggggcctgccccggggccggggccgacgcgctcgagtcccccgcctccccccagctcgtgctgccggccaacctcggggacattgaggcactgaacctggggaacaacggcctggaggaggtacccgaggggctggggtcggcgctgggcagcctgcgcgtcctggtcctgcgcaggaaccgcttcgcccggctgcccccggcggtggccgagctcggccaccacctcaccgagctggacgtgagccacaaccggctgaccgccctgggcgcggaggtggtgagtgctctgagggagctgcggaagctcaacctcagccacaaccagctgcccgccctgcccgcccagctgggcgctctcgctcacctggaggagctggatgtcagctttaaccggctggcgcacctgcctgactccctctcctgcctctcccgcctgcgcaccctggacgtggatcacaaccagctcactgccttcccccggcagctgctgcagctggtggccctggaggagctggacgtgtccagcaaccggctgcggggcctgcctgaggatatcagtgccctgcgtgccctcaagatcctctggctgagtggggccgagcttggcacgctgcccgccggcttctgcgagctggccagtttggagagcctcatgctagacaacaacgggctgcaggctctgcccgcccagttcagctgcctgcagcggctcaaaatgctcaacctctcctccaacctcttcgaggagttccctgccgcgctgctgcccctggctggtctggaggagctctaccttagtcgcaaccagctcacctcggtgccatcccttatctcgggcctgggccggcttctcaccttgtggctggataataaccgcatccgctacctgccggactccatcgtggagctgaccggcctggaggagctcgtgctgcaggggaaccagatcgcggtgctgcccgaccactttggccagctctcccgggtgggtttgtggaagatcaaagacaacccactgatccagcccccctacgaggtctgcatgaaggggatcccctacatcgcagcctaccagaaggaactggctcattcccagccggcggtgcagccccggctcaagctgctcctgatggggcataaggctgcaggaaagactttgctgcgccactgcctcaccgaggagagagtggagggatgcccaggaggaggggacaaggagaagtgctacccaccgtcacctccccctgtgagcaagggcatcgaggtgaccagctggacggccgatgcctcccggggcctgcggttcatcgtgtatgacttagctggggatgaaagttatgaggtgatccagcccttcttcctgtccccaggggccctatacgtgctggtggtcaacttggccacctatgagcctcgccactttcctaccaccgtgggctccttcttgcatcgggtcggggcgagagtgccccacgcggtggtgtgcatcgtgggcacccacgcagacctgtgcggagagcgtgagctggaggagaaatgtctggacattcaccgccagatcgccctgcaggagaagcacgacgcggagggactgagccgcttggccaaggtggtggacgaggcactggcccgggacttcgagctgcgctctgccagcccccacgcagcctactatggcgtttcggacaagaaccttcgacggcgcaaggcccattttcaatacctgctcaaccaccggctgcagatcctctcccccgtgttgcctgttagctgcagggacccgcgccacttacgacgccttcgggacaagttgctgtcagttgctgagcaccgagagatcttccccaacttacacagagtactgcctcgatcctggcaggtgctggaggaactgcatttccagccacctcaggcccagcgactgtggctaagctggtgggactcggcgcgcttgggcctgcaggcgggtctgaccgaggaccgactgcagagtgccctctcctacctgcatgagagcggcaagctactctactttgaggacagtccggctctcaaggagcacgtcttccacaacctcacccgcctcatcgacatcctcaatgtcttcttccagagggatccctctttgctgctgcataagctgctcctagggaccagtggagagggcaaggcggagggggaaagctccccgcccatggcgcggtccacccccagccaggaactgctccgggccacccagctccatcagtatgtggagggctttctgttgcatgggctcttgccagctcatgtcattcggttgctgcttaagcctcatgtccaggcccagcaggacttgcagctgttgctggagctgctggagaagatgggactctgttactgcctcaataaacccaagggcaagcctttgaatgggtccacagcttggtacaagttcccatgctatgtgcagaacgaggtgccccatgcagaagcctggattaatgggaccaacctagctgggcagtcttttgtggctgagcagttgcagattgaatatagctttccttttacttttccacctgggttgtttgcacgctacagtgtccagatcaacagccatgtggtgcacaggtcggatggtaaatttcagatctttgcctatagagggaaagttcctgtggttgtgagttacagacctgccaggggagtcctgcagccagacaccctgtccattgctagccatgcatcattaccaaatatatggaccgcatggcaagccataacccccttggtggaggaactgaatgtcctacttcaggaatggcctggactgcactacaccgtgcacattctctgttctaagtgccttaagagaggatcgcccaatccacatgcttttccaggtaagtggagagagggagaagttcttctgtggtgtgctgtaagatatgtttttggagatacttggttgtcatttggcagaatgtttgtttaacttcacgggttctccaggaaagcttcgtaagggaaacacagggagatttggagatgagcaaaaggtagtaagtacctgagccttatgaaatgcagtcacaagtgtcatcctctcctaacagactcagacttccaaaatgggttccagtcacaacatttgccatctcctttcccctcttgtcgatgtagcccacatttggtggaaggaaatttcaggtggttgaacagatagattctggacagtgtccgatgttagcctcttactgatcgttggctaaagtgttcattagacacgtctcaaaggggtagatgagtttgagtttcaagtgtccagtgtcacaattttttaaaaaacttaaattttcgtgagtacataggtttgtatatttgtggggtgcatgagatgttttgatacaggcatgcaatgcatagaaatcagattgtaaaatgcggtatccatcccctcaagcatttaagcactctgcttacattcagaatgtaattagaaagtaaaaattactgctcacttttcttaagaaattccagagaaaatcttttgtaattggagtgaacaatggatgagtaaagacagaaatttcagactgtaatgcatgactaaatcctggggctgctgctcccctccgcccactcagggacatggaagatagatgactgaaatctttgaggggcgtttcctcgggaatttcctggcagtttcgagttttatagacgtcttaaggtttgttttttggtaagtgttaagcaaatgaagctttctggcagtgcttaataattgagacggaagggacagaaagctaagagttttctggagagtgttttccagtagacttttttttcgttttctttttttaaaccatcataagcaagtggaagaattccaggactagttgtctggggttttttgttttttttttttttgaagacttttttttttttcttagagcagttttaagtttatagcaaaactgaacagaaggtacagagatttcccatatatccccttccccacatgcgtagcttcaccaacgtcaacatctcccaccagagcagtacatttgtttcagttgataaacctgcagtgacacatcagtaccagccaaaggtcatagtttacacagggtttactctgtgttgggcattctgtgggtttggacaaatgtccaatgacctgtatcccccattatagtatcatacagagtagttctactgctttaaaaatcctctgtgctctgccaattcattccccccaaccccggcaaccacagatctttttactgtctccataagttttgcgttttacttatatgggatttttttcttttgagcctggttaattggtatcaaactagtttttagttgggaacgtgtccatttcctcatcctttgtagttctttaaacaactgtttttgtgtgtgtgtgtgtgtgtgtgttttgttttttgtttttttgtggagcaggtggttaacaacattccaagtgtcctaagcacaaaccagacagaacaatagcatccttgcacgtttctcacctgggtccccacccccaggggacccggaggggtgatgaaatggaagactgcgtcccactctgatctttgtcctggtcagagagggacaacaagaatgcagctggtaatagtatcaggaaggaattgaataccaatatttccgaaggtgacatctttccgttgccctggatctaggttgaatttaattcttaagcatgaaaaaagccagcgtattcagttaccagtcaactgagacatccattctgtatgtttatctggaatcttgtcacactccatgacttggtagactcttcagtttgttttatatttgtcattgtgtgttattcatggaagcaagatacttctttattgtgataccaaatggaataaagtgactgggagttacgcatttacagggtagtttactgaaggagcaacctgaagccattcttaatccaaagtaataaaaacgaatgttattaacaacaaaaggagagacataggttattgagcaagtaaagatcttctaagaactttgaggagttaggggcgaggctggaggtttttttttttttttttttgttttttttgctaacgtcagctctttatgtttaatttttaccagtcataaattccacagacaagcttgtactgagatgcagaaacaagccccttgtcttgtgttgtctatttgcctttcaaatgaggcacacctggttttgcaatccaggctataaggaagagattttttttcaatgtggaaaacaaatgattgaaaaattgtaaaattatcttatagattgaataggaataaatcatcagttgtttttagagcaggattataaaatatatacatatacatataattataaaatatgtacatataaaatatatatgtatatatacaccaacgtacatatttttgtcttatagtctttttgtttttttttgaattgtgttgtttttcaaaagtagcagagggtatagaatagtagaaaacatgattatagtacatttctcgttacattaagaagatgcaaaaaacattttcctcttctgtatttttctgtgatagccatcatttgttagtaattgttacagttacgaaagatttggtaaaagttaaaataatgagttagaaataaaagctaaatgtgggaacagaattatgttgagtgtttaagtagagcatacattaaaaatagattcattgaatccctagattattaaaatatatattaattcagcagaaaccctttgaatctattggcagcctttgccttttcatgtttttttgtttgtttgtttgtttttgagatggagtcttgctctgttgcccaggctggagtgcagtggagtgatcttgactcactgcaacctctgcctcctggattcaagcgattctcctgcctcagcctcccaagtagctggaattagaggcatgcgccaccacacctggctaatttttgtatttttagtagaggcgggggtttcgccaggttggccaggctggtcttgaactcctgacctcagatgatccacccacctcagtctcgcaaagtgctgggattataagcgtgagccactaggcttggccacctttgtctttttaagaagtcattttgcttctggggacattaaaaattgtttacttttatgttttataaaagcgttaagttgtcctataaactataacaattttatatgcaacgctgaaaaagttggactttgaattttcttaactttgggatgttacagtaaaagtaaatagtaaattactgtctctcttgattttatacagaaaaaatgtataaagttgcactaatatcttttaaagtatttttatgtgaaaagcctattttggccttgtcctgttggattttctggcctgagctgccctactgtagttgaccacgggaagtataatggtaaatttctcttttcttattttggtttatacaagaaaagtaatgggcagcgtgcagtggctcagggctgtaatccctttgctttgggaggctgaggcaggaggatcacttgggtcaaggagttcgagaccagcctgagtaatgtagccagactccgtgtctacaaaaaaaaataaaaaataaaaatcagctaagcgtgcacacttgtggtcccagctagttggggggctgaggtgggacaatcacttgagcatgggagtttgaggttgcagtgaactatgattgtgccattgcactctgaccctgtctcttaaaaaaaaaaaaagaaatgattggaaaatgcacatccagcaatcactagtttcatagttttttgtaaaaataaatcacattgtcagagagaagacctatttgtcttatttaaaataggtaatctgacaacgtgattatctttttaagacatcttatttaagacaaatgggttgagtgacaggagattcttttggaaactcggagatggcctatgatgaagcctaaatgtcactgtgaaagtcttgacctgctttctccatcctggccaacatcctagcctggtcaacctggtgaaaccccatctctacaaaaaatacaaaaaaattagctgggcatggtggctcatgcctgtaatcccagctactgggaagaatgaggcacgagaatcccttgaacttgggaggcggaggttgcagtgagctgagattgtgccactgcgctccagcctgggcgacagggcaagaccctggctccgaaaagaaagtctttacctgcttcctgcaggtaccctttcttttttgcagacttgctgcccatagctggtagccaggattcccttccttttgctgttttccttctcattggttggtcctgtatacttgtcttagagcaagtttcttcttgtgggatatttgtttatgcttttattctgttctaccagtatgacctctaaactcaaagagttggtactcttgaagttgagtgagggtacattaagatgtggtggttaggacacgggcctgcagcaagattcaagtgctttgatattccttttaagcagatgagtgaatactgtgtttttgaattggaagagtgtgtcttagtgagttaaacttgcattgactgcagattttcactaaatatcctactctccaaattatttaaggtcattttaaaaaataaggagaaagcaacccaaatcagtagacagaatgagttatgtggctttctttagctttactgtctttcatttactcagtaacttgatgcctttttgtatctcatgccaaatgtcttctgtccctcagtttcttgcacacggagtgtacctctccgacaacacagcatatttgacttgttttgttggtgtttggttgcgtcatgatatatctttgattaggttgttcacttgctgcttctgagccagagacacacccgagacttagtagcttctgcagagcctctcagatgtttgctgaatgatagtttggtctttttgtgagaaataactttttttttgggggggtgggggcagggtctcactctgtcaccgaggttggaatgcattggggcaataatggcttactgcagcctcgacctcttgggctcaggtgatgatcctcctacttcagcctcctgagtagctgggactccagaaacaccctaccatgcctggctaatttttgtgttgttttgtagagacagggtttcgctgtgttgctcaggctggtctcaaagtctgcctgcctcagccttccaaagtgctgggattataggcttgagccaccatgccctgcctgagaactatctctttttctttgttattcacacactcagtgaaaatcccaggtagtattgtaatgattatctggctttgtttagcttcccaactccctccccctcacagtgttcctccagcattcccattgtgcgtctatgactggtcttacccttgaatgggtccttcattttgaccactgaagcaaagcaaaattcttgccttattatatctaagttttagaattactggaatttgagcatgacctagttgtttggattgaattagtcattgtttttaattttacaaaggtttttcaatatctctttggttaagctttattaatattgatgcttcttggcttttctttttatgaataggcctctgaactccctgggactttgttttatgtaaaaatcaaaaccttaatcaggcactaggataaacaaatactgtgcagaatagagttctagaaggctagaaaggcctttggagtatttgaattattttaaatattaggtgcctcttctttaaaccctggaatagactcttaagtccatctctgcacaagtagtttagaatttcctaaagtattttttctttaattttttttttctttttgtgtgtgtgtgtgtgtgtgtgtgtgtgtgtgtgtgtgtgtgtttgtgaaatagagatagggcctttttatgttgcccaagctggtcttgatctcctggcctcaaatggtcctccccactcagcctcccaaaatgttgggattagaggcgtgagccaccatacccaaccagtattttttatttagtggatattttatgtcatactctgaggttattcccctttgtccgtgaagaggtgaggggctttaactctgtattataggaggggaatgagtggggaaaggaggaattggacatttctgtttttcttctcatctacctattaacttgcttctatccatgggagccctttcttttttttttttttttttttttttgagactgagtctcgctctgttgcccaggctggagtgtagtggcgctgtctgagctcattgcaacctccacctcctgggttcaagtgattctcctgcctcagcctcccgagtagctgggattacaggcatgcaccaccacgcccagctaatttttgtaattttagtagaaacgaggtttcaccatgttggccaggctcgtcttgaactcctgacctcacgtgatccacccaccttggctgcccaaagtgctgggattacaggcatgagccactgcgcctggcccatgggagccctttttgattaaggacacctgaccatccatccattagggcatcagaatgcctgctgattttgttttgttttgttttgaaaaccagcgggtgggtgcaggcccagtactgccctctcttgtctctggcagccttggcgtccctgttccctggggatggaggtctgctttgtgtttccagtctttgtggaaagcacatcaggtaggctcaggtctcagtcctctctggttcagcttttcttttcttttctttttgtttttgttttgagacggagtcttgctctggcgcccaggctggagtgcagtggcacagtcatggctcactgcaacctccacctcctgggtccaagtgatcctcctgctccagcctcctgaatagctgggactacaggggtgcaccaccatgcctggctaatttttgtatttttagtagacacagggtttcaccatgttggccaggctggtctcaaactcctgacctcagatgatcctccctcctcggcctcccaaagtgctgggattacaggcatgagccaccgcacccagcctggttcagcttttctgattgcaacattaattgctggggggtggttgtcaggtttaccttcttctgggggctggcagccttcacttcagcagggagggattaggaacccctgtttggcctgccttctccaaggctgctctagcatgaatgaagctgtgcaatgcctggcacagggcagatcaggtagaaggggtcagagcaggttggttattttgaaagaactcaaactctcatttttattttattttatttatttttttgagatggagtctcactctgtcgcccagggtggagtgcaatggcgcgatctcagctcactgcaacgtctgcttcccgggttcaagtgattcttctgcctcagcctcctgagtagctgggattacaggcgtgtgccaccacgcacggctatttcttaattgatgcctggcaagtgcttttttggttgtttatgatattttgtttgtttgtttgtttgtttgttttgagactgagtctcgctctgtctccaggctggagtgcagtgccactatctgagctcactgcaacctccacctcctgggttcaagtgattctcctgccccagcctcccacgtagctgggattacaggcacataccaccacccccagctaatttttgtgtgtgtttttttttagtagagatgggggtttcactatgttagtgaggctggtctcgaactcctgacctcaggtggtctgcccgctttggcctcccagagtgctgggattacaggtgtgagccaccatgctcggcctgtgatgttctttatctttatgcattttaaaggaagccattgtcattgtcccatgtggtttttctggtatacatattcctgccttccatatctaccgcctaattcttacagaaatgggggaagagtgggcaaggggcacttagcagcaggatgcaaatgtgcatttaatgcaggagctggccacagaaagccttctaccacctggccttgaggcagtgaatactccaacctcccaaagctgatggttcactggctgctgctttctttttttttttttttttttgagacggagtcttactctgtcaccaggttggagtgcagtggctcaattctcctgcctaagttcaagtgattctcctgtctcagcctctcgagtagctgggattacaggcaactgccaccacgcctgactaatttttgtatttttagtagagacagcgtttcaccatggtggccaggctgatctcaaactcctgacctcaggtgatccgcccgcctcagcctcccaaagtgggattacaggcgtgagccaccatgcccagccaacattctatagtggggagcatatagatggtgaggagcgtgaggtctgatggtggaggtggaataggtgcaggaaggaagatgttttcagtggttcccggaaagtgtgtacaggttacacctgctggtgtgagttcctggaaggtcatggaagggtggctggcgtaatgcagagatgattgcatgtgtactctatatgatggtggctgcgtggataacagttcccagaatccactgctagcagggctgacttatttctggagaccaagaaggaaacattctgagttatttttatttttggcactaaatccttcagaacatttttccttcctcaatctcttagctgaaaatactggggctttgtttattaaaagagtaaatttaatgaaaagctatcaccaacaagtttttttcttttgctgtaaatttatagaagcaaagagtctaaaaagtgcacgttggagcaggagaagaatgtgggcagaggaagacagaggcatcgggttactgctggtgggcttgcagggacattgtgagtttggagcctgtttcacccatcttaggaaggtatgggtcaggcgtgatggctcacacctgtaatcacatcactttgggaggctgaggaggtggatcacttgaggtcaggagttcgagaacaggttggccaatgcggtgaaccctcatctctactaaaaatacaaaaattagccaggtgtggtggtgtgtgcctgtaatcccagctacttgggaggctgaggcaggagaatcacttgaacccaagaggcggaggttgcagtgagctgagatcgcgccgctatactccaacctgggcgacaaaacaagactccatctggggaaaaaaaaaaaaaacaaaaaaggaagggatgtcctgccctagaccgacagcccccagcacccagcctattgcaaatggtttctttcacttttgcaaatctgaacaagcatgcttgggagaagggcgaggaggcagggaaactggagtcatgttaagactactctctggaggtttctgttgtgcgtgtgccattctgccttttgggtgatgtggcttaatgagtcaagccctgatgactgatgctgcttttcttcctcatcttcctcctcctcttcctcctattgagtgaaagtcacataatatgaaaaagccattttaaagtaaactattccctgtcatttagtacattcccagtgttgtgcacctgccacatctcagccaagcacctttggaggggtggggcagatacattggtgtcattcttcctggggccaagtgactgggaattcttttgccaggctttgtagcaactttctttccaaggtgtaacttaagagtaggggttttggggctaggcctggagatgccatgttgattggagatcttggacacggttgtggggatcctcttagtgtggatgagaggacagaaaggagggcatccgagcctcctggtctgttctagggtgtatgtgatttaatgaggggtgacatacacgagctccgtaaagaacacgtagaagagaagtacaaataaatgttgtgtaattcttgtcttctgcatagagcttttttttaaagataaattttaagtttaactcctggaatgactggcaagacctaatgaaggtagagtggcagcgggtggtgatggtggcagtgatacaaatgtagatgattaccagattagataagtgtcgtcaatcactgttgaatacctgctctatacagaagtttgtactgaactgggagttctaggaaaataaaatacctgatcttgggcttggggagctgtgttgggatcttggttaatgtcattgttgattcttgtaaatacggaatctgaccccatatggagaaaatcatttgcatatttgaatgttactttggggggaaccctggcttttgatttttccagaaaaaaaatgtgatcctactgagcaaagcaggccacagctttgaatttccttcagatgtatgagtaggtggaaagtaatggtcaagtccttcttttgagttgactttcagtttggattacttgtttgcgagaaatctcaggcagaacttgtgaggatgctggaaaaaggaaattcattgtatatgaggatctctaaaaacttcccaaacgaatcagcctttccaaggaaaagaaatgccttttcttcaggagtccttaccttttttttttgagatgggagtctctctctgccacccaggcttgagtgcagtgatgcgatcttggctcactgcagcttccgcctcccgggttcaagtgattctcctgcctcatctcccaactagctgggactacaggcatgtgccaccacacccagctagttttttttgaatttttagtagagacggggtttcatcgtgttggccagcctggtctcaatctcctgacctcaagtgatcctcctgcctcggcctcccaaagtgctgggattacaggcgtgagtcaccatgcctggcagtagtccttaccttttttgtcatttatagacttgctcccatctggggaaggattcaaatcatcagtcatttctgaacaccaaagactatatgaatgctgactccaaagacagcatccattaaagtgcatatcatcataataaaaatatatgactgctggatttctttgctgagagatgctttgaagtacttttgtactattagcatattaaatgttgagaaaattaaagagtttaattttcttagatcctccttattcctaaaatgaagtctatgctattaacattgtattagtactaggttatagcagtagtgaattttaggtctctagaacaagcctccctcccttcctcctcactctttctgtccttccctccttttttcctttttttttttctttttttgaaaagaaggaatttttaaaaacgcaatggaaagggaaaacataaaaccagaaaaatatttcgcctgggtgccgttgtttgacttaccaactttattattgttttaatatgattcttgtttttcatgtcataaaggtaattgtgttaatcatcacatcagtctccctatttttggagaaaaatagaagaggtgacaatgttgacgttttctcatgttgcagagacagtgctaagtgcctcctaggggtgatcttatttaatccccacagcagccctaggaagtaggtattattactgtctttgctttcagaaggagaaattgacatttagaaattaagtgaattccccagagttagagaactctaggatatcagccccaaacctctgctctgacccaccgtcacttgggtctcagttaggttgccattgatttccagagtacaccagctcacctcctctcccttcatattctaagttctgggcagacagtctggtactgcacaggagctgcccgtgcagaggtcagcggaggtcatggtcaggtggaggtaaggtggggagagcgccatcaggggtctcagagaagggttcccagaaaggccacactgtagttgagtgtcagaggatgatttctagttaaccacctgaagaagggaggtgggtggagcatttcaagttagaatgccatttaaaaggcagggagcagacaaagacttcagcaggcctaggggtgggcatgtgtgggcacagatgcgttttgcatttagaaattatagtaagggagagacttctttgtttaaatggcattcatggactggtagacacttgccagtgacccactggcccatcaactagagttttaaaagcattgttctagcctgtccctttgtcattgggctgggctctcttgagaccttggaagagatttatggctgggaaaacggaagggtagtttcacatgatttgctcagactcataatcaagttattgttaagctgacagaacacctgctctgcagagccatgtctaagcgtgctgctggtcactttcactatgtcggagtagagggagaagagtagcattggttattcattctaacatcagccagagagccgcatgcctctgtaatccctaggaatgtattccagaacatcgattttccctgctctaaatcttaccctaatagaccctgcaataaaggcaaattcggatctgacacaattaccattttattgtgggctgtttaagtttcactatatttactttatgcttttttgtgtgtgacactactcactgactgaaaatgccatttttattaaatttgcattaatggaacaccgtagtttttttttttttttttttgaggcagggtctcactctgtcacccaggctggagtgtgcagtggcacagtcacagctcactaaagccttgaccttctgggctccagtgatcctcccacctcagcctccccagtagttgggactacaggtacatgccaccatgcccagttagtttttatattttttatagagacaggattttgccacgttgcctgggctggtctcaaattcctgggctccagcagtccactcaccttggcctctcaaagtgctgggattacaggtgtgtgccactgcgcccagccctggaccaccatgtcttatgcacttcatttgttggacaccacttaccgcactatgacagtggtttcattttttttcttttttttttgactgagtcttgctctgtcatgcaggctggagtgcagtggcatgatcttggctcactgcaacctctgcctcctgggttcaagtgattctcttaccttagcctcccgagtaactgggaccactatttagaagagtgataagtttgtggataaaaagtcttttcttcatagaagaggtggaatacagtatgatctctgttcatatgaacaccttatgctcttttaaaagtactttttcccctttataaaaacttataggccaggtgtggtggctcacacctgtaatcccagcactttgggaggccgaggcgggaggatcacgatgcatacaccactatgcccggctaatttttgtatttttaatagagacggggtttcaccacgttagccacactggtctcgaactgctgacctgaggcagtctgcctgcctcatcctcccaaagtgctgggattataggcatgtgccaccacgcccggccgacaacagtggtttcttgcatcttatcatcatttgagtttgtcttcccttgcctgccaacttatcaaagtttcctcaattacatttaatcaaatcctaggaagtacaaggtatttttaagtcttaggttatattttgtttgtatttgctttatagattgacttgaaacagttgggattttgtgtagttttcaaattgaagcattataatatggtggttagttgcaagagctcttggagtagactgctgggctctaatccctgtgccactgcttcttagttatgtgactttaggcatcataatagtttgtgttggttctgaagattgagttatatgtgttaaatgcttagaacaatgcttgacacctggcaagagctcagtaggagtttgctgctgtttccaccattccagaaggtacaagagtctaaacatacttttagaagagtgataagtttgtggatcaaaactcttttcttcatagaagaggtggaatacagtatgatctctgttcatatgaacaccttatgctcttttaaaaatgctttttcccctttataaaaacttataggccgggcatggtggctcacacctgtaatgccagcactttgggaggccgaggcgggcggatcacgaggtcaggagttcgagagcagtctgacatggtgaaaccccgtctctagtaaaaaattgcaaaaattagctgagcgtggtggcacgcacctgtaatcccagctactcaggaggctgaggcaggagaatcgcttgaacccaggaggcagaggttacggtgagctgagatcgtgccactgtactccagcctgggtgacagagcgagactgactcaaaaaaacataaaaaatttggagagtagaagaaaaaaaagtttctcatggtgggtatctaaagtaatcactacacattttgctctgtgtcttttagctttgtttcctccttaagcttaggttttaaaaatatgtagttataattgtataaataattcaaatattgattttttaaacttatgctaacatggatataatttcctgtgattagtatttatacagtaattaaaaatgcttgcataatagtacatcaaggtgatttttcacctttgtttatttaaccttgtgttctttttgtttatccaaccatttgtgctcttgttcccagttttttttgtgagtgattctctgatgactgtatttctttataaaaactcttttttatttgggcagtaatccccgaagtagagtcattgagtcaaaggcaaaaaatgtcattaaatctcaatgcacgtttacgttgcttcccatgaggatgggcacgtcagatgcaagatctttttcactgtacctcctcaacattgggtatcatctataaaatgcactaccgtttaatggaaacaatatgtcactggtgactgaagattttaactagtggatgtgaacgttttcttgtataaatgttgcctaattgtgttgcttcttttctgaatcctctaataacatcttctggcatcatcttggtggtttttctttttttttttttaatcacagtgttttatcagtttatattaactcttcatatataaaagataaccttttgtctatcatacttaaggcatttttttctagcttgttcccctctttgctttaaaaacctttaacgttttgaagtttcaaatttcattcagtatattaatagcttcctctgtgatttcttctagagcttaaaaaaacctcataacatttttctaaatacagaggtgacagcgggaatcacatagtgattcttcacccttataactttaactgaaaataaaaaaagtgctatccatatgtggatggtagattcattagcaaagccccctttttcataacccctccccaaactgtctcctctgtaaaatgtttcttgctgatttcttccagggaaaataaagcatgtatttgcatatattttaacaggaatgagatcatgctgtactccttgttctgcacctcgcatttgatcacttcaaaatatatttttgagatgcctccatatgaacagttagaaccctgttatagaagattattatgtgtgtgtgtgtgtgtgtgtgtgtgtgtgtgtgtgtgtgtgtagaatgttatagtatatcctacaaatatagcatagtagtctaccaatggatgtattgttcagtcacacctataccggcagacctttgatcctttccagattgttaaactaagtacgttctccaccttccagaggtgtaagaaatactcagttttatttccttcagggttaataatccctctctgtgctcggaacactcttgagatgcaattagaaaaagacaaatctctaaatcaaagtggtgggacctaaaaaaagcctcgagggttatgaaggcttcgctttgtgatttgaaacaaggtaatttttttaaattggctttggtgatgtgtattggaacaccattgttttcagcataattacgcatttcacagcttaattcagccattacacgtgatgcagtgtttagacatagcaataattacaaattgtacatgtttacagatagatataccgctgatcaaaataaaacagtggcagcaagaatgatgttctgtccatgtaagaaatcaatgaaatataattaagaacgaactgtatctcattgactcaaaacattgcatctgcctttctgtcccatctgttttctaaacaaaaatcttcccgcgctgcgtggttgtttttatttgtatcctagaaccatcctctcgagttccacaccgttgtattttctacacctaagcttggtgtgttctgcacaggaaatgtttcttggatgttttatcctcataccaagtgggaatttaaaatttaagagattacccacactctttgcctttctgtacatgtgatgaagaaagagtgggtgtaacccagcactctaaaatgtgtttgacctgtaaaaaaaaaaaaaaaaaagtaagcaattaaatcctgttatagttgcttctgtgtttaaaacatacttaatgacgtatatatttatttgaagctaacaaagtccccagtcaggttcttgggagtttttttcacaggactcattgaagtgtttggtctttaaaatccttcatttcatgctaactgccaagtcaatgcagacagtatggccgaacagagctggtcacattttccctgaacatgctattaaaaaatatattcactgggattctcttgactcatggcatagctgaggtgactttgattccggagggctattgcttatgaattgcatgtggaagaactaaaaatagaaatgtgaattttccaaaagaacactatgataccaaaaatggctcactggcttgcctagagctgggctgttttgtgcccaaggtacagtaataagaactgggatgcaaagccctgtagggtgcatctgtccccttccctgacacccctcactcccagatggctcacgagtggcactgcccggttgtctccgtctcactcttgcacgatgttctgctgcctgtctgggatggagcaggtgttcttttgaatgtatttgttaagcctctgaaatatatgcatttccccctccccaagaaaaacacacatgtgcatgctctgtgcttttccctggttactgtattgttcccatctttttttttatttttattttttcccttggaatagggaatatccactcattttctatttagtcccttcaggaatttgccttaggggctgttgggccaggcctcactgcagccagccagagcttatcagctgtgtgttaacctctcccagacacttcttgaatgctgttcatgcatccgagcctatgcatctgagcctcctctgtgtaatgtggtgcggcattaaaagcttacccaaatagcagggatgattgcatcttgttgattaccagggctgataacattttcttgcttagctaaaaagaaaagccagatgactgtttccaggaagtgataaactgccatgcatccggccccaggtggtccgcatgaaggaagctgcaaggttggaatcctcctgccgtccccttttacagttcataaatcttctgatttatggggccatttgtgattgcagacacatttattcatggggggatttccatcgagatcataacccactgtaaagcaggaggaagaatcaggaattagaacggtgtacattcctctttgttagaaaagaatcccgattctttggtcatagacaaatatttgcttttgaagaatctggtggtgtgtcgctggctttgttcatatccgtgcacagtcacatgctcccttgcctcccatggacccagaagcttatgttacacagatcgttttataatgcttgccatccgggcatgtttatgcaaagtgtgaataactttttgccttagcctcctcttccttccttctccctcctttgatttagctcatttctggaatggggcagattttcatctcagggagttgatacggtttcctaggtagggtgacagaacaagtgtcaccttagctgtagctagagatgaatattgccatgcagcttacttgctttatattaaaccagcattagagaaagaggccttgcatcttttatcagcagtatgttaacctctcccaggcacttcttgaatgccattcatacatctgagcccatgcatctgagccttggatgtaattaaatcagtggattaggaagtcgggggcctggacctctgggaagccacttggcctccctgggcctcaatttcgtctgtaaataggtaaaaataattctaacagttcccaagcatttacacctgctatcagagtctccttagatgttgtgagggggaaatgaatgaatagatgtcaagtccccaagtagttttttctttgtttgcgtgtttgtgatcactctgttgcccaggctggagtgcagtggagtgatcttggctcactgcaacctccacctccctggttcaaatgattcttgtgcctcattgtcatgagtagcagggattacaggcatgtgccaccatgcccagctaatttttgtatttttagtagaaactgggtttcaccaagttggcgagggtggtctcaaactcccgacctcaagtgatccagccccctcggcctcccagagtgctgggattacaggtgtgagccatcacgcccagctgcaagtagtttttaccatataataagggctcagtaaacattagctctgattaccatcatcctggtttacagatgaggagtggagacagaggagggctaagtcatatggccaggggcacacagcatgtagcagagcccaggttgtcctcaggaacctatggtctttgctgtcaccctgtgctgcttctcaggaaggcaatagcttgtcacccattaaaaatgggtagttatttgaatgaaaagcagaataacccccggaggcagaggttgcaatgagctgagattgcaccattgcactccagcctgggcaacagagtgacgctcctgtcaccaaaaaaagaaaaaaagtaaggactccttgtgtgaaatgcacatggttgcttttaacattgcagtactggactataaacatttgctggggattggcagtgaccagccatggggcagagcatggggcatgggaggggagcaaggccttgaccccgggaagctgcagtccagggaagcagtgtggacagtaagcagagatttgcagggctgtgtaataaattccaggagaaaaagatctccaggggctcggagaggcctgcgggatggaatctgtcttgatccacgtgtgtgtgtgtggggtggttagatggatgggaggtctccaggggaggtgagtcgtagggactttctgtaaaaccagggcccctgacgtgtgatgggctgtacaaattactggcagcccaactattcatttatcaatgcacgtctgtaaatatttttgttttctttttaaaccttttttgttttcctgggagacagagtcttgctctgtcatttaggctggagtgaggtggcgcgatttcagcttaccacagcctcaacttcctgggctcaagctatccttccactgcagcctcccgagttagctgagactgtaggtgcgtgccaccatgtctggctaatttttttttttttgtagagacagggtctcactatgttgcctaggctggtcttgaactcctgtgcttaagtgatctgtgcatcttgtcctcccgaagtgctgggattacaggttgaaccactgtacatatcccgtgtaaataacttttagcctatctattcactagctaacactttttcaccagaaggaacttctggcatctgggtgttaagctaaattaaagcctgatggtttttttcagagggtgagaggaaaatactgaagggtcaaatggggaaatgtcaaatttccattttgtcagcacactcagggcagcagtgtggaagatggatttcaatggagtaagaatggagtcagagggaccacttagaggtaattcagacaataataaacaatagaggcccccaggtaggtccttggggatgaaggcaattgagtcttggatgttaatgaggcagagtcctgggcctctctcctcctagctctgagctcttgaaccttcccaggctccggtttcctcatccattagacagaaagcatgactgatttaagtgtatgtttcaagaaaaattttaaccacagcgggaagaagactgcagcatgttttaaaaaacagaaagcggaagtgatttgataagattaatttcaacaggactgatgtggaacggctgctagcttaattggtttattagggtcgtgtagccaccctcttatgatggataccaggtgaattccaggagatatatagtcttaggtttgtaagcagtgccatttgcagaggaataaggttctttatttcttaaatttggaagggtctcatagaaataagagactttataaatatctagtaacctgtcaccgctttaaaataccgcaaagataaatgatgctgattgtcgcgtgcttggcatgatgaattatgtatgtagcgtgccccggagttctttatggttgtgcataacgaatcagcttttgttctagcttattttcagtggtagtgcttgtaaaagcagaggtcaaagcagatgcactgaagagatgtggttggtgcaggatgatcgggttttgctatcctgttctgtgcattgcttttgtttgtgctttgatttttcattatcaactttggggagggtgggagagcagccttgtggcattaacagctgcatgatggcacagagcaggcagcgactcttcttggttcatgcacctcaaaagcggccctctttttgccttcctcctcctcctctctgcacctgctttgcatagctgttaactacttttccacctaataataaaggaaattgaaataaatggttaggaacatgcccataatcttttttctcactgactttctctaaactctagacgaaactagagaggattaagaaatgtaaaacacagcagagaatgtcttttttttcctctccctttttctcttcccctagcaaagatttctttagaatctgagtgagatatcagaggtgctgtttgcatatgaagtagcgatgactatgggtggaagccagttgtaaggttgcatagtcatttataacttctttctatgttaaggttactaccgactttatgagaggagcctcccagactcaggtgtcatgcctgactcatgagtaattcattagagagggcccaagccatgtatttcattgtgggtttgtgagcggcctcatcttccataagatgctcatttgttgggctgatccaaggcaaagatccgagtagttgggagtagctccaaattgggatgagcccaggcctactgtgcatatctgtttggaagggcacatctgtctaccaagggctggttccagtgtattagccgagtggcactaggtaatcagtttacagtcagtttaaaaaagttgaggctatccttctcggtgattaattatggcttttagttcatactagattaaaaaaaatctttgcatctttgcaagaataatcattaacttagtttgtctatattattagccgaaagatacaacacagtgctcatgcagtgtagagaaatgagataacatctagagtttacatgtaagtagctatttgtcaggatatttattcattgattctagattcataaagcaggagtttccagaggccttgcagcaaggaataagcacctgggagattcaactgaatccccctcagagcctgtgcgttgggaacttggtctagaaaatggatcaggtttgtgcgctataccacttattataataaatgataaaagtcagtctggacagagtgccacagaagttcaggcgagaaagaggattcttccaactgagtggggccatggaaaaactcgagttccatttattagcggtaggaaacacatgttgagaatgaagaatggagttaaacaattggtctttccctcagatcccagggtttttaacctgttactaaaaaagtatagcaatttatggccaggcacggtggctcacgcctgtaatcccagcactttgggaggccgaggtgggcccatcacgaggtcaggagatcgagacaatcctgcctaacacggtgaaaccccgtctctagtaaaaatacaaaaaattagccgggtgtggtggcgggtgcctgtagtcccagctacttgggaggctgaggcaggagaatggcatgaacccgggaggcggagcttttggtgagccgagattgcgccactgcactccagcctaggagacagcgagactccacctcaaaaaaaaaaaaaagtatagcaatttataatgtttgaattatcattagcttattggcgtgtaataatactttgcatacttttaaaattctggggttggattaataataaaagagtagaaacattgtttttataaaaaaaattttctgtgcgacacctataggcaagtacctatgggcctccttttaattttggactgttttaggaatgttttattttatttttggtatcttaggaaccataagaagcatactttcaaaaatgtgagggtatatttttaacttttgttataaaaatgtaacaaaaagtttatatggtgaagaatttagtgggtttgcatatgctgatgaccattgtgactttcataaaaccccacagcctgtgtttaattccatttcctactagtacagacttgaagagctcagtccatctcctttattatcttgtttcctttaatctatattaatgcaccttagcagtatcagaaattttgttaatatattatgtgtagctgaactgtaagctaaaaatagatcataccaacccatctctctttctctttcttttttttcccactgtcaccttcacatttattcttagtgacttgcaaatgatgggattacaccttaaaaattgtcttgtatcagatatgtatttccccattctctaaagaaggctaattatgcaagtacacggttctttcctgattcatgaattcatatcacgattttattttcagattcctcaaggtaattgcttgttagactggttcacaggatgagagatatccaagtagtcatatgaaccgtttccgtcccattcatgccattctgtcttctgcagaaaataagtgagtcaatcactgtttatgagaatgtgtaagagactggggagagagaagggactcagtggccattttgtatcacggatcctttttactagggataagagtgatccttactggctgactgcagtggctcatgcctgtaatcccaaaactttgagaggttgaggtgggaggatcgcttgagcccaggagttgaagaccagcctgggcaacatggcaaaaccccatttctacaaaaaataaaaaattagctgggcgtggtggtgcatgcctgtagttgcagccgttggggaggctgaggtgggaggattgtttgagccagggcggcagaggctacggtgagctgagattacgccaccgtactccagcctagaggacagtaagaccctgtctcaaaaaagaaaaaaaaaaaaacaaaaaagaagtgatccttgctaagttgccatagatccctgttctaggttcccattcagcgtcagagttttatcgtctgataaaacagggatcagttagagagcttttcgcaggcaaaatgacactgattttactgaaccaatggtaaagagaagtgctcctaggttcccaggccctgttcttctgtattcttcctgcttagaaaaagagaataataaaagcacttcagctaggagtagagctttctaaaaattggccagccaaatccccagggaaaccaggatttcagcttctctgtcatcacctctgtttgaggttggcatgctttggcactttttccgtggctgcactgtcaggagagtaggccaagccgcctgaacaaggagaggtgtggaggacagtcattctgtagctgcagtaatccctgccctagtttttctgccttcctgagagaaataatagacaccacttgttttacatcaaccaggcttctgacctttttggactatgaaaattaaattcttctaagacactaagtgttaaatttgggacccaaaaatagttggactaagtggctgcctggtttaatagtggcaactcagttcagataataattactagaaatttcaaagaagttataggagcctcaccttgagtagactaggatttgacagttgagtgatatacaattgtacttaacagccattttctaaaatgaagttttctggacagtaattcatgtcaagtgtcatctgttgcttttctatgtgattccacttcaccagggctgtcctgggaggggtccttggttgtgtttagctttcatcgagttagggtagtaactcctagtctccttcctctccatcctctgtaccttgtgtctcttttcccatttctgatttttgtatccaggagtttctgatttttgccttttgagttttgtttcttaaactaagtggagctaggtttttatggggaaataatttctcagcctgtcatcttgacagtgaaacatttcttttttttttttttttttttttttgagatggagtctcactctgtcatccagggttgagtgcagtggcacaatcttggcttactgcaacctccagctcctgggttcgagcgattctcctgcctcggcctcctgagtgactgggattacaggtgcatgccaccgtgcccagctaactttttgtatttttagtagaaatggggtttcaccatgttggccaggctggtcttgaactgctgacctcaagtgatccacccaccttgccctcctcaagtgctgggattaccggcatgagccaccagacctggcctgaaacatgtttttggtttgttttttaatctaggtggaaactagataccctttctagtaactaatatgtggttcatacctaaagccaaaagaaatctcaagtaattttttggatgagacaatttcggcaccatgttatataactttatgatatcatcttatctgagtcctctctctctccctctctccttccctttccttttttccctagtgcctgtaggtgtgagtttaaagataaaatgactgccaagtgaccccaagttcaaggacttttatcctggcatgcaactggaaaattcagtttacatgatacatttcaaaagtgtctggtgggtagctggtacaaatgataggaagagagtagctaattttatgctcattgtggttctgtaagatgatgtaaatatatgaggattttaggagaaataaaaagtgatctcactgaaacagttatttgtagattgcattttgacttgtctgaaacacatcaaggttaacataagaatatttaggatatgaatttggtccaaggaacattaaaaatatttttacttggtgattctgataggaagacattgtttctactaatgtgggagggtgggcaaagaggaggaggagtcgggcagggccattttgttgcttggtgtgaatggcatccttgaatcgtgcagtgggcggccctcatggccagtagcagcagatttggttgagcataggggcagaaaatggctttgtttttttaacttacccttctgtgtttatgttaccagaacaccagagatttggtttaggtcctgctgcttgccgcacagaaagccaatcactgctgagacaagtgttgccagggaagaaggctttaatcgggtactgcagccatggagatgggagctcagtctcaaatccatctccctgaccaactaaaattgggggcttatatagtgggaaggcaatgtaactacatgccggtaaacaggaattaggaaggtataaggaagaggagttggtcaacaggaagctggtggtcactgaggcagccataatgggtgaagggtctggtgtctccttgtccaaatgcagtgatctggtgagtttcagctccttgatatctgggagccctgatggttggttttctgagaaaggaattcagataaaacaaatgcaactttcttaagttttaagacagggtgggtcaatttctaagctcattagaaactgcatattaatagattagttctgtgagatgatggggtgggtttcagttacaggtaagggccagactcttagtgaaaacaggccatggtctgggttaaggaccagtatgttagggaaatgattctctgaggaagtccaaataggtaggaatcagatggtcaaaacagaggttagaaacattttaatgatatggtctggaaaaatctaaggactagagaccacgggtgcaaggggttatggccagtggaacaagaaaagatcatacgtggtaataaatataggtaacagtccattctggatgaggtcaactgggcaggaattctttatgctccatctaggcaggaaatacatggaggcctttgaagtcccactggcatgtgtgcaaggagccactgttaatttacacaggaaaaaggaatggagggagtaacagcatcagtttgaggtcctgtgatatatccattgggggtgaattgtcccacagttattaaattatttaaaaatcagtactgtattctaagttacactgcctgatttcagtgcttactttccggctatagtaattaagacagtgtagtattggcgtaagtataaacagatagattgatggaacagaatagacccacacatacatgcccaattgattatggacaaaggtacaaatataattcagtgaggaaagaatattttcaagtggtgccaaaacaatcagataattgtattaataaaaatgaaccttgagtcattccttgtactatatacacaaattaacttgaaatgggtaatcgatctaaatgtaagtgctaaaaatatacagtcttaccaaggaagcataggagaaactcttagtgaccttcagacgggcaaagatttttactgttaaatagactatgttttagagaagttttaggttcacagcaaaattgcacagaaggcatgagattgcccatctgttccctgtccccacacatgcgcagcctcctccattagtagcatccccaaccacagtgggactggttacaatcgatgaacctacattgacacaacattgtcacacgaagtccagtagttcacactaggtagggttcactcttagtgttctatgagtttggacaaatgtgtaattagatgtatccaccgttatagtatcatacggaagagttttactgccctaaaattcctctgagctctgcctgttcatcacctccaccccctaacagcagacattttttctttttagcatagaaactaaataattttttagtttaagaaatttttttaacttaatctaaatttaaaactttgggtcttcaaaagatctgttaagatgaagagacaatctatagtctaggagaaaatatttgaaaaatatatatctgattaaaaaaaaaaaacctcttatagctgagacaacccagttaaacatgagtaacatattttgaatagagattttccaaaatatgatacatgaatagcaggtaagtataagatgtcaacatcattaatcattagagaaatgtaaattaaaccactaggagatactagtgcatgttccctagagtggctaagatgaaaaagactgaccataccaaatgttgacgaggagctgtgacaactggagctttcctacgctgctcttgggagtggaaaatgatacagcatttggggaaacagtttgctagtttcatataaagttaaacacatgtttactagctaactcagcaatttcattctgagttaattcacccaagggaaatgaaaatacattttaaaaagatacacaaatgttcataacagctttttccacaattgccacatactggaaacaacttgtctggtgcacagataaacacattgtggtatgcgacatagcaaggaaaagagatgaactactgataaagcgacatggatgactctcaaaagcattatgctgagtgaaagaagccagtcgagtacatattgtatgactccatttatatgaagttctagaaaaggcaaaactgatacactgtcagaaagcaggtctggggccggtggtatggggaagggatttactgcagaggggtacaagagaacctttttgtggtgacgggaatattctacctcatgactgtagtggaggttacgagactatatctgtcaaaatgcatcaagttctacgtttaaaattggtgaattttattacacgtaaaatgcctttattatatcttgttaatttaaaaaataagttttgattatacgatttccttagatgtcctgaaacatgctgttttcacactaatttggtatataccttgtgattatatcctttgtatatgaatattgtggtaagtggaacattgttgttggagatatatccagattttctaccttagtttgtgtgattgattatattctgttagactgaaccacatgaaattgttgatatccaatcattcttgacctacaaaagcagcaatttcacgtggcataagtatagtagaaattttgtttgctttttaattcattggaaagacttggcaatggtcacatctcgattgtgaagtttcaaggattttgtaagacacaaggcctgagtgttctgttttacattacatgttttattttgctttaattcagttcggtagatgttttatatatgtctaccacttttcaggcattctacttgaaattacagtggatgaatgtaaagatgagtttgatattacctcagcccaagaaacgttaagtgatgaaattaaaaggcacgtgtagactttctgtcataatcgctaatagggactgtgaaatagaactcccagttcttgtcatgtccattgcagtgattataataaggtatttgggctttcatagtgatgaaataagtggttgtgggtttgtatacgtatgtatacataaatatgtatgcgtatgagcccagaagaaatggaaacgagaccaatgatttaatttgcatgaaaattagaactgtctgccaagagcaaacatctctctcaccctttttcaagagaaaaaaaggtcttgtagtttggcatgactcagtggatgacctcacactgattctcctttagttattgcttgaatgcgtggagccctcagtcctaagtgaggcggtctgggtgatgttatggcatttcatttgggaaagcggctgtcacttcatccttaagcctcctgtttgctgtgatggtggcagagccactctcagcaccacaggaagagccccggggaattcctgaagacacattctagagaatccggtacaagtgtatgtaggttggtcaccttgatgccttattttctcaggcttctagtagagatgcatgccagcaaaatggaaaggaacagagggcgttcttgaagtttcctaactggcgtattttctccttctctttttctaataattaagtacaggggactgagaaggcaggggttgttgttatttttacatggaatggacctaacctagcagtcagatgagattgttgacgcgtagcacagtctgttatctttgggcatctgccaccaaagagagtgtacccaagaagggctgtcgtgtgagtgggatgggtttccatcttttgttctgtgctctttctgtggaatctcaggcctgcgtgtgctccctctgaccgtaccttgactcttgatgaaggatttgcagccctgagagggagcaggcagacccaaattaattatttccattttttttgtggcactgtgggacaatgggagagaatacaggctttggagccagccaaatgtgtttcagatcctaaatcctccacctaaggtatgcagtcctgatgggtaagttattttaatttgtttgaactgccacttaactgaaaatgggattaataccagatatcacttaaaattagtaaaaaatacagttgacccttgaacaatgcaggcattgggggcaccgaccccccattcagttgaacatctaacttttgactttgcagaatttaactactaatagcctactgttgactggaagtcttactgatagcattaacagtcaatagcacatattttgtacattatagatattagatactatattcttacaatatagtaaactagagcaaagaaaatgttactgagaaaaccgtaaggaagaggaaatatatttactgttccttaaatggaagtaaatcatcggtgaaggtcttcatccttgtcatgttaaaattgagtagactgaggaggaggaagaagaggaggggttggtcttgctgtctcaggcatggtaggggtggaagaaaactgtcatataagtagaccagcacagttcacacccgtgttgttaaacgatcaactgtattttattaagctgtctttgaatagcaccaagtatcttagtgtatgagaaggcctctgagaagttccacagttaggaaacatggtgaacttttttttttggtgtgaggggcacagagtcttgctctgtcacccaggctagagtgcagtggtgtgatcttggctcactacaacttccacctcctgggttcaagtgattctcctgcctcagcctcccaggtggctgggactacaggcgtgtgccactacacccatgtaatttttgtagagacggggtttcgccatgttggccaggctggtctcgaactcctgacctcaagtgatccttgcatctcagcctcccaaagttttgggattacaggcatgagccatcactaccagccgtggtgagctttgtttaaccaagcatttttcaaacttattgactgaagaatctttatgtgtgtgtgtatgtgtgtgcatatgtaagaagtaacatccgctggagctggtattgtgcagaaaatatgttgagaaatataaaacagatatctggcttgtgttcctctatatagtcttttttgactgagaatgctttatccttgttgttacggatattttcactttgtttatttctattttggtctgaatcatgagtgtagttgatccttgaacaacatagatttgaactgcttgggtccacctcgacgccacctgtgcatacggagggctggctcatctcatatgcaggtcccgagggccaacttcaggactttatgcatagattttggtgtgctggggatgggggccctagaacccaaccccccatatatataccgagggaggactgtctatttttgttttttacctgtgaggccatcgccacaatgaagagagtatcccccaaaaggcatatttttaatatagttgtaattatagcattgcataatcgttttcagtaacataggtctcatctgttgctctaggtcttagtaaaataaatcactcttgttgaacccttcctaggctccaaaactggatgggccatttaatataattttaaatattaaatttaaattttctttcatttattagaattttcaaagggtaataatgttatatatttagattttgatgacatggagacatctgagacttgcttagttttaaaaaagcaaaatttatgtcatacagctcttgtaaggactgaataaaataatgcatataaaaatgcctaagacaatgcttggcatgtagtgggcacttactaaacaatttccttccttcccttgctggcttcttaactactccctgccttgtataccccctgtgctccgtcccaatttctgttcagatactagacagatggctgttgctttgggataggtcaaaggctgtcaggcgtggaggcaggcaaatgacccagatcagtgaacaccagtcattgtctcagagcattttgttttgttcagctcagctatttgaatcatcttggattttctcatttgtttagaaaaaggtttccccaaaattggtggtgttgggttcctgatagcaaaatgtatcaacaagtgggcagtcagcatatggaatttgcccaactctacagggaaacttgctttaggtattttaaaagttaacttgtcaatgtcactgtaggacagttatatatctactgagtttacaaacaaaagatttttttttgttttttttttgagacggagtcttgctctgttgcccaggctagagtgccttggtgcgatcttggctcactgcaacctctgcctcccgggttcaagcgattctcctgccttagcctcctgagtagctgagactacaggcacccgccaccatgcctggctaatttttatatattttttggtagagacggggtttcacaatattggccaggctggtctcgagctcctgaccttgtgatccacctgcctgggactcccaaagtgctgggattacaggcgttagacaccgcgccgggcctgaactcatttttaattagaattcttattatttcagtggctgaatggaggaaaaaagaaaggacctaagcccagaaaattcacaggtttgtttcagggtagaaaaatttggcatattttggcctggaagatatctcattatggaatcagaaatctgaaagggatattaaattaggagcaaacttgtgctgtgttggttaaccactgaaagttgcattggcagtttagtaactaaacaatagggccacacgcggaatttattgatgtctcatgaactttctgtttaaatctttattgctttgaattgataggcttcttttttcccttccactttgcttaagggactgaatctgtttttggcattctaagactctttttagaatttggcagtgcctctctaggatgttttcttctgcactgcctccaaaacaaaattatgaacagcctggctctttcggtatctctcctctttttttttttttttttttttttttttcactttcctgatgtgaaagtgtcaggttttgagccagtttgaaagatgagaactagaatatatttctctttctgatctagagaatcctagtggcttctagggcagtgtataaacaaagccctgtggctgcaaggtttcccgtgtgcagcaataaactgatacatgccggtgacaggaatctggctcatgggcttgaaaccatccattaactcattaattgaccagacatcatgggggtctgctgagtgccatggggatgctctgtgctgggaaagatgcaaagatgaataggctaggaataaaagaccaatttcattttttaatgtgtcagtatttttaatattgaaatgtaggaccttgcaagtaaaatactattaagctaatttcccaatttagagtctttgaattattgtcttggatattaaatatattcagtgtttcccaccagtggatcccaaagcctcacctgatatgtttggcaattgtcaggccctcttttttatactccagaggaattccaacaggaaatatgtacacaccatcccttacctcccttgcttcttttcttttctgcgtcctactttgtttgatcttgaaatacggggaagtatcttctgggcaagtgctgtttctgtgccaggctgtgcaggtcatgcttgccccagtgccatgagaaagacactcgagtgagctcgggacagatctctccagcactgtcctggcttgaccccacctgaccagtgactcttgtaccatgcccagctcctttggctgctggagcaaaaagatctagggagtttgttttccaaataagggccccagatcttactttcagagctgtgcatgtgaggagttcatggggaatccctcatctcagcagacatggggaagaccgtcttctaaactgtagttctgaaacaggtaaacattcagtccccgctcgctttcaaagcacaaaagtgaggaggcttatttggcattgaaataactgagcatcttttctcatctgtgtttctgaatctgttatggccagtgttttataacccccttcacattaccttgtcagtaacttgcttcagatgaaaataacggcagaaagcataattttttgtttttttcttttttgagacggcgtctcactctgttgccgaagctggagtgcagtggcgtgatctcggctcactgcaacctcagcctcccaggttcaagtgcttctcctgtctcagcctcccaagtagctgggattacaggtgcctgccaccatgcctggctaaattttgtatttttagtagagagtaggttttgccatgttggccaggctggtcttgaacttctgacctcaagtaatccacccgcctcggcctaccaaagcgccaggattacaggtgtgagccaccgtgcctggctgaaaacactgtagcgagttcatgaatcaggattaaagaatctgtgggatatatagaatgatagaataaattctataacgttcattttcattgtgcaggatggagacattagtgtgcatctcagttaggatttaattgctccttccctgtgttcttgaaagcgcttggaaagcgcctccaatcctccattgtatgattctagttcaggtctggctctttcaccagacaatgagctcctgtggtaagatgccatgtcttaattcatctgttttccgcttgtcctaatacaatgttaagattgccagataaaatacaggatgtcggctgagtgtggtggctcacgcctgtgatcccagcactttgggaggccgaggcgggtggatcccctgagcccaggagttcgagaccagcctgggcgacatggcgagacctctctcaacaagaaataaaaaataattttggtatgctgggggtgggggccctagaaccaaaccccccatatatactgagggaggaccacgactgtggtcccagcttcttgacaggctgagatgggagaatcacttgagcccaggagatggaggctgcagtgagctgtgatagtatcactgcactccagcgtggggtatagagtgagatcctgtatcaaaaacaaagaaacaaacaaacaaaaccccaaaaacccaaaaccaaaaaaacaggatagccagttaaatttgaatttcagataaacaataaagtgttgcttatgggtgggtctcatgtatacatctattcttacatctgaatttcacgtaagcaacgaataatttttagtgtaaatatgttccatgtgatgttctgatttagtcataatacatatttttttctttcttcctttttttttttttgagacaaagtccccctctgtcatccaggctggagtgcagtggtgcaatcttggctcactgcaacctccacctccaaggttcaagcaattctcatacctcggcctcctgagttgctgggactagaggcatgcaccacctcacctggctaatttttttttttttttgagacagagtctcgctctgttgcccaggctggagtgcagtggtgcgatctcagctcactgcaagtacggcctcccgggttcactccattatcctgcctcagcctccggagtagctgggactgtaggcgcccaccaccaagcctggctgattttttgtatttttagtagagacggggtttcactgtgttagccaggatggtcttgatctcctgacctcttcttgacctcccaaagtgctgggattacaggcgtgagccactgcacctggcctaatttttatgtttttagtagacacggggtttcaccatgttggccaggctggtcttgaactcctgacctcaagtcatcctgccaccttggcctcctagagtgctgggattacagctgtgagccaccacacccagcgtatatttttgttttgtaaattgggcaaccttatacaatgcccatgacttacaaaggattttttgctcctaaatcagtgtaatttaataatgtgaacacaactaagacaaatcaaggtgttcatggagttggttggtgtcttttatggaatgcaacatgggaattggaaatagtaattatccaccttcaccagtgtgttagtgagtatggaccatttaacctacaacagttggataaccttgacaatagaaataggtagctaagccaggggtggtggctcctagtactttgggaggccgaagtagggggatcacttgaggtcaggagttcgagactagcctgcccaacatagtgaaaccctgtctctactaaaaacacaaaatttgccaggagtggtggcgcatagctgtaatctcagctactcaggaggctgagacaggagaatcgcttgaaccctggaggcggagtttgcagtgagctgagattgcgccattgcactccagcctgggcgacagaacaagactccatctcaaatatatatacgtagctaggacctgacctaatggttgtacccacactgtttgccttgtacgtgccaggcactagcaatctaagttgtgtgtggttttttttttttttttttttttttaagaatgagcagacaccttgtgcgattgtccaggttaactaacaaaaatagttgtctgggtttatggaactgtaattacgagtcagatcctggttcccttccgctttctctgctatttctggttgctcctttttattcccaaaaggtagaaaggggcaggtaggacaggagcttgccgcctgttgaactagagggagtagcttccgagcaaactgtgacaaaatggggtattttaagcctccattttttttggggggtatgtgagtgtgtgtgtgagtcggtgtatatgtacacagtgcaagtaaataagcctgagtgggtggcaagagccttgtttgtgtagtaggagaaatggagcctgcaggggcatagtcggggtcttgagagcagacacacggactgagccaggcagttgctgctgagaacagaatcaggacctcctgcttcctttgggtgatattgggttttttaggccaccttcccagccacaaagtaggactctgaaatacatccgggtataaatgttcttatggaaatgcaatcacttctgactttaagtatgtagaagtgagggctcatacccttctcccagaatgtaaatttgactcatcggggctaacaacaatgatagcctaatataagaaactgtttaccggactctgttctgatgtcagccaagctagagctttgcatggtgggatgctttctcttggctgtgccctattagggaaggcaaaaatagaaagctttttctctggacttcagaacggaattaatgcatggttattaaaagcatcaatggcaaatggccatggaagtcagaatctcagccttaatgaagggcgatggtgtccacagaaccaattattttgcaaagaaataaaataataaaatcctcccattggttttagagtggctgaaaccagcaggcaccaggtctaaaccctcttgtgggtgtgtgtgtttgtgtgtatgtgtgtgtgtgtgtgtgtgtgtttgagagagggtctcgctttgttgcttacgctggagtggcgtgatctcagttcactgcagcctccgcctcccaggttcaagcgattctcttgcctcagcctcccaagtagctgggattacaggtgcatgccaccacacccagctaatttttgtatttttagtagagatgaggtttcaccatgttgcacaggctggtctcgaattcctgacctcaagtgatctgcccgcctcggcttcccaaatgtgattacaggtgtgagtcaccgcacctggacattgtggtatgttttaagtactcacgctaatgacatttataccttgcttggcactcctgaaacctcagctctctggaggacagaatatctgctaagggtgcgactcccatggtgctggagaggggtctccttcgaatggaagccggcattccaccacccactccctatgtatccaaaactgggcttggcatcgctgttcctgagggagcgctctgtccttattagggatccgcctggtgacctcagatttacacttaagcttcaactttgttgagggaaaacattttttctctgtcaccaagagaatggagaacactgtgatcgcttttcaagtctcacctgccaggaaatctttattttgcggggggcatcacaacttcctctttttccatgtaccttagtttactattactttaagtgttttggttggattaacttcctgtatttgttcttattttaaatacattctttagttaaagtgttactcagtgaatggaaagagaaaaacaaggcaagaggaaggggtataatatgaaagaatagagttttgtttccagttttgttttgcaacagtagataagaactgtaaactttctagtccctggttttttaatagtatatggaaacacgattttgttgtactacatggtaggatgaatttaattaagctgccaagcaaacttgttgatttagataacaactccacacgtagagtttgaagagcctgttttgtggtatctagacctcacttttaagagtatttccctgaacctgtccatgcatttctgagacgtttgtgtgctgactgtttgttttatgtttgtgcaaagcctagtgtcctactgacttgtagggactcattgaaatggcagaaactgtgtgcattttaagtgctggaggaatgctaaatattaatatttgggatcaaccacaaaatatagtttctatttataagacacccaagactaaataaactgtaggacaaatgaagggtgcacattctttttggtaacattcagcatcctgaaaaccaccaagggttaggaaaaagagaaaaatgtatttttcatcttctgtaattcatctagccttgggattttctcctaacctcttgaggcacgcttatatacgtgaccctatgtaagacttttgggtgataaagtcgaggagattcactaaggaggaacagagcaggtgtagtgcccagggtggtaaaaccacagatggagctatggggtgaatatggaacctgctagctggagatggggaaagagaagagatcgctgagattacgtgagtgttgaagggttagatgaattggtgtgtagcgggtgctgacctgatctttctgggtgttctgatttttttttttttttttttttgagacggagtttcactcctgttgcccaggcacgatcgccactcactgtaaccttcgcctcctggattcaagcgattctcctgcttcagcctcctgattataggtgtgcgccaccaagcgaggctaattttggggtttttagtagagacagggttttgccatgttggccaggctggtctcctgaccttagtgatccacctggcttggcctcccaaagtgctgaaattacaggcgtgagctaccgcacccgaccctgggtgttctgattttatatttactaataaactctgtggctttggacatttcagaggctctggttctatctcctaatctttaaaatgagaagctggatgaaatgatctctaaagtctgttccaatttaaaaattctgtcgtttgctaggaaaatattagcaccacagtctatctctctaatatgggaagttttttcagattgggtatcagtgctattaaacatttaataaaaagtgggaaattattagtgtgtattgtcacagacatgttaagctatttgcattttaatgaatgaaagagaactttaactgttaacatttaccaaggggtgtagctgagagttaatagtttacaaggggtgtaggtgagagttaatggtttataaatgttaactagtttaatagctgttagttgcctcgggatttaaaggtatacacactgatttttggttttggtagcctcaaacctagtcaagaatcatacaaaattatcttcattagaacaagcatagtattagccatcagtgctatgtaaggtaaagatttcaaactctctctgaggcttcattaaattcctttgctttcctgaaagtttctaccatcctgagaaagtctagcagcttcttcagagacctggttgctttctgtctcagaatatttaaaggaaagtacattttcttaaaatggagttttccctgggtcataccaggcaattagggctttgagccatgaaccgtcttcaggatttggttccctctgagagaaagggaaaggagataacttttgcccttgctagaaagtaaagcttatctacccttacctgtttgaagtttagacaaatagtttatttatacaaaagcatagtttcccttgaccacaatgaagtgtccacttggactgctcatttcttgaccaggagacacaaaatgcattttcagcccaggggaggctctttggggccacagttggactgaacaggaccgcagctgtgaaggtctaatttgcaactggcaaatatctttataataaccccacgtttcttactgacacagaatacacacacgtgtaagtgcacacacattatgcacatgtggggtggtgaaggcagaaaatcagtgaactgaaattacttgctgcaagtattactttctgcaaggctttcagaattacttgctacaaggctgggtgcggtggctcacacttgtaatcccagcacttcaggaggctgaggcaggcaggccacttgaggccaggagttcaagagcagcctgaacaacatggcaaaaccctgtctctattaaaaatacaaaaattagctgggcatggtggctcacgcctgtagtcccagctactcgggaggctaaggcaggagaatcgcttgaacacgggaggcagaggttgcagtgagctgagatcgtgccattgctcttcagcctgggcaacagagctagactctatgtctccaaaaaaaaaaaaaaaaaaaaaaaaaaaaaaggtaaaaaggaattaattgctgcagagctgttctttgcattgtgtacctttaccctgctagtgggaggaagtggtcaattccatcatgtagcaatttaagaaaaaagtaagtataatagtgttttgaattcagaagtaaatccctcttcctaccttcagaagaaaaaaggtaacttgatttaaccagtttttaaaaacaccagctttgagaacggaaaccgacttcgcactgtttgattaaattggttctgtggctatttaattcatttgtgttaagtagcctgtgggccgactgcttgccatagcagtctgtgtttttcatttgtttgctttaaaaaacacgtcctaatgtaaggaccaaaatctttgtccattctctattgagtactcaatttatggtttaaaaataactacctcttgcgagatctgattgtttaaaaaaaattaataactgcccagctccgttagtagtaaaagggcttgtctttatctcatgaagtattttaattcaatttccagttaaatgatcaggggtttttgagttctgcctgagccgtttgccctttacgtgtgtctctttatgttaatggctttcacttttattcctttgcctgcagtggagaggaaaatgaagtgggatggcatggcttcttttttttttttttttcttcctctttaggcctgactggccctttttaaaatggaaagtagaggcactccctccaaatggctaacacgggttcagcggtgtgtaaattggagtcataatcccttctttgaagactaggaggaggctattatgataaatgttggagaaatgattaaagagatgagaacagcaggatgcagatggcaactgcaaaccctgtggtgtcaggtggaacactctgggagctcggctaaaagggacagagaagcaaagggactagccagtgcagccctgggcgggctgggtggaaagcagccgtcccagatgattgtcccagcagttcagttgcaacccagtgtctaggctgtgctttgttttttctcaccttttatcctaggatggggaaaatatcccctaacagggaaggatgtttggatagtgtttttaatgttacatgtgtgcatcacagcaagtatactgcctctttcaatatttacaaatctttttttaaagcataactgtggtgtgaaattgaggttgttcagcaacatgggctataccagatattgattagactaagctgagcatcccttaatgaatgaattgactttaaacacctgctgtctgaagcggttgggaatagaaactctcctatcactgttgatgataaaatggaattttagttcatacacattttctgaaggtccagagtgtgcagggaatttactgcaaaattgttttatacgtctgtcatgagatgtcttcatcaggtagttagtaaatgacaattctaagcatagggctctttttatttcttagtatataaccaccagctgtcttatcaataatgaatttccattctgtcttttgtcaagtagatcctgcctgcttctgagtagatcctttctgcttctttgtttcttaagatatttctggccgggcgtggtgactcacacctgtcatcttaacactttgacaggccaaggcaggtgcatcacctgaggtcaggagtttgagaccagcctggccaacatggtgaaaccccgtctctactaaaaatacaaaaattagctgggtgcggtggcacattcctctaatcccagctactcaggagactgaggcaggagaatcacttcaacctgggaggtggaggttgcagtgagcccacatcaagccattgtactccagcctggatgacaagagcaaaactctgtctcaaaagaaaaaaaacaaaaaatatttctaactagcgagtatacacaagtacctgtgtctccagtcttcctgccaattacgaaaaatatcattggtgttagcctcattttggtgattcctctgaaaaatctaagacaattgtttttctgagtgtgtttggaggagggatgttggaattcactcattcatttattcatccattcaacaaatatttattgtgtctggcatatagtagatgcataataagtttattccttcattctgcaagcatttgttgaatgcagtgtatcaaaggtcatcgtagacactgcacaaagtcattgtttttatgggttttacatacttgtgatgagagacagaatgatgggcggggtgggtcgctgctattttaaataaagcagccaaggaaaacctgtctaggagggctaattcagcagaaccttgaatgaagtaagggaatgagcaatcttattatgtgagggaagagcatttgaggcagggagaacaagtgcagaggccccgagacagctgtgttcttggtttgtttgaggcacaacaggaaggctgcaagcaggggaagaaggagaaaagagatcagagaggtgccagcagcagaggggagattctgtgaggcttgggaactttgagctgagaacattttaaatgaactagttttaaaaggtcctggagagtgtgtggtgaataggtaagggtgaaggcagggaggtaaggcaggagacttttgcagtagtttgggcaaggaacactgataccttggacttgcatagtagcagtggagctggtgaccagtggtcattttcttctccttctccttctcctcctccccctcctccccctcctccccctcctactcctccttctcctccttcccctcctccttcttatcctcctccccctcctcctccttcccccccccccttttttttggagacagagtctcgctctgtcgctcaggctggagtgcagtggcatgttctcagctcactgcagcctccacctcccaggttcgagcgattctcctgcctcagcttcctgagtagctgggattacagatgcgtgccaccatgtccagctaatttttgtgtttttagtagagacagggtttcgccatgttgtccaggctggtctcaacctcctgacctcaagtgatccgcctgccttggcctcccaaactgctgggaatacaggtgttagccactgtgccaggcccattttctagatctgtttggaggatcgagttgaaggggttgttgatggatttgttctgggttttgagagaaagaggtaaagacaaaggtttttggcctgacaaccagaaagatggagttgctatttattgaactgggaaagctagggagaggagcagattttgtggggaaaattaaaattgggtgtgggacccatttagttttttgctgtggttgttatgaaaagctattattgtctcattcagtcttctctatgcttttctatagggataagtgtgcttttgttaacaaatctcagagtataacactaagcttaagatagggaaatattaagtcaaaaaaaggaaaattcaggataaagactagaaaagaccactgaggaagaagcattccccggagcctgccatgggccccccagcaggagggtcttgtcaaaggccatttaatgaaattataagtgtctcattgagaacctgtttccggcagcctcacagatgccactcataatcttctgctcctgggtctgccgctagataagcgtgcacccaggcttgggtttcactacccggtatgctctgtgatatgctaatattactgaaaaggaatatgattttctgctgcttcacagatacatcaattgtaatcttgccaatactggtattgatgatgaaagcacctttttaaaaaagtttttaagtgtctataggactgtttctgacttttatgtgaactaacctagaaaactaccattatttgttcagctgattaaatctgaaaaagaatggcagttgaagcagaacataaaaaatccacttgattttatcctctttgcatatgaatgacagagggtcagtttaaatttctgttcgtaactctaaagggaaaaacacatgtgcattcagaatactgagggtagttgtatcttaatccattttataggtcttcttagttttcctcttactccaacaaaaatgaattcttttcttcttcttcttcttttgttgctcttgttcttatcttcatccaaggattgctttgtcatgcagatagttttgggccttcttcttgaaaatacagcaacaacctcactgaccagtattagaacttaaatttgcttatttggccagtggttatggcctctgtgccagacactgttttgatgtagtagtagtgccaggtaacacccctcctctctaggagttgaaaatcaagttggggaagaggaatggtcagtaatccaatatgccaattataatttaagctttgagaagatgtaagagaggttcaggggatagagtgtgatgggtggtgcatgagagatggtctgagaaggaggcatctgaagcagagagctgaccttgcggagcttcccgtttatgcccgagaaggtggacagaagccagccctgcctctgcagaattagagcacgccagttgtgtcatttttagatcttttcagataagaagctggtgcaagagtcatgctaactttaaacaatgacaggtgtgctgtgtatatgcctaggcttatttgtattttggtaaacaagactggctaagtgtgaatagagtcatgttttgaagaagtctggactatttcctaaaatgagcaaatgacacatttgaagcctgcatctggtgagactacctgtgagtcatttttcccattttaaagagaaatagtaatattgagacaatgattaactgacttagaatcatacagtttttagggctcctatggaaggacctttggagacaacgttggttgatttttcctgtttctttggatgacaaagctgagcctgagaaactgcccacagttctcttgctaggttagtagtagaagggctgacactgcattctgggcttgctgacttcagagttctttcttctccatctgtcattcttttcaaaaggattagaatttgcgtttctgtgcctttcagcatgacacccatgtaggtagagtcccagagaacagtggattgttaattacttaaattgatcccacaatcccttataaaataagattctgctattttttaatattttgtcctctttaggcaggtaatactgctttggttaatgataaaacagaggtaattaattcttcaatttctacctttccatttttggaccttagcgtaaaagttaaatttaagagaaatgtgactccttttccagcctgtaagatagggatgagttcgctgatgtttatgggagcaggtgcagggtgacgtgtggggagaaatgagcctctgccctctcttctgacctgcttcttccacaccggacctgctcacctttcactttcttctttttctctcccaaacagaccccgctccctgctttctctctcactttctttttatttatgtgtttatttatttttgaaacggagtcccactctttagcccaggctggcatgcagtggcatgatcaccactcgctacggccttaacctcctgggctcaatccatcctcctgcttcagcatcctgagtagctgggactaaaggtgcacaacaccgtatctgagtttctttattttttgtagagatggggtcttgaaatgttgcctaggctggtctcgaactcctggcctcaagtgatttgcccacctgagcctcccgaaatgttgggattacaggtgtgagtcacagcacctggccctctttcgctttctttttttttttttgagacggagtctcgctctgtcgcccaggcgggactgcggactgcagtggcgcaatctcggctcactgcaagctccgcttccggggttcacgccattctcctgcctcagcctcccgagtagctgggactacaggcgcccgccaccgcgcccggctaattttttttttgtatttttagtagagaccgggtttcaccttgttagccaggatggtctcgatctcctgacctcatgatccacccgcctcggcctcccaaagtgctgggattacaggcgtgagccaccgcgcccggcctctttcgctttcttagatgctaaccagatactactcttttgtttttctgttaattcaaaccatgctaatttgtaaatgcagattgcaaaggcccaagtgagaaattggagagatcacagggagcactatgagcatccgtcctgtgtcctgcagcatcaggtgggaaggaagaggaggcagtgtctgggatttctcatgatggtgcatgggttactaggattagggcattgcttctctagctttaacgtgctgtccgatcacctgggcaccttgctcaaaatggatgatgctgagtccagagattggggcaggggctgaggttctcctttccttaccagctcctgggtgatgccggtgctgctggtgcagaccacacttgatagcaaggctgtacggatgaggcttctagtgcgatttacacgtgcgtcctgtgtcactttgatgttgtgagttactgtgtaccgaggaaatgttagcattcaaaatcagacgtggggtcgggcatggtggctcacgcctattacaatcccagcactttgggaggctgaggtgggtggatctcctgaagtcaggagttcgagatcagcctggtgaacgtggtgaaaccctgtctctactaaaaatacaaaaattagctgggcttggtggtgggtgcctgtaatcctagctactcaggaggctgaggcaggagaatcgcttgaacctgggaggcagaggttgcagtgagccgaggttgagccaccgcactccagcctgggcaacagagcgaaattccgtttcaaaaaaaaaaagaaaagaaaatcagacctgtgaagttacagtttctccggaagaaggtagggtgggtcgtgctgcttctttcaggacttcccttgaaaacctgcagcaggctgtccggttactaagatgattataaaggcgcagccttgttggcactcagcctcccacattgcttggctcattctttcaccgtagagaaacaccggctctgattatttttaactgcatgccttgctgagactgagtaggggtttttatttctggagctaatgcagaacacacatccctctttctttaaatgcagaaaatctcacataaggttgccaaagtaggatggcatatttcctaaaattctgcagcaacataagggtggcttattctgggatacgaacaggaagatcaagtctttttggttcaacccaaactctcgtacccgtggggtgtggcccatgtggggtctggaaggcttcgtggagcagggaagagtataaccaggggctggcttcttattcctgttcagtctctctgcagcctggaaggagctacttaactcccttttggccttaccattgccatttttgaaataaaagtcctccactcgactgtctgaccgagtgattgtcagctcacaaggcctcttacattcagcatgtttgcttgaggggaatgagtgagtgttttacatgtggtggatccattcccagcaaacaacaaaaagaagtcttttttttttttttgagacgaagtcttgatctgtcgcccaggctgtagtgcagtggtgcattcccggctcactctgcctcctgggttcaagcgattctcctgcctcagcctcccgagtagctgggattacaggcgtgcgccaccacgcccagctcatttttgtatttttagtagagatggggtttcactatgttggccaggctggtcttaaactcatgaccgcaggtgatccgcctgcctcggcctcccaaagtgctaggattacggttgtgagccaccacgcccgacccaaaaagaagtcttgaagtacagcccgccatcggtatttttagcacatgaagaatatcttaaggaatatgcgaaggagatgttacataggtagcttgacctttattaaggcacttggtaattgccctacattttattattttttacttatttaaggttaaatgaagacatttaaaatattacatgtgatggggcttatagttttacatacaatgtcatagtttgtgtgccttgtttaaaacaaatccaatatgagaatatgctcttgtgtaagaagtgtatcattttactaaaggatttataagatatttgaatcaggaatcctgtagtactttaaaaagtggtaccttctacaccatctttttaggagcatgtttatcacacaaggcaaggcaaatcactaggttaggcatccagtacatagaattcgactagaagtgtagtgaggtgtgagatttagggggacagggattctaagaaccaacggcatctaactaatggacttgttcctaaaggaatgttgaagaagtgatcatccatcttaaaagattgtgccttcagaagaactgaaggatacttttgctttcgtgtacagtgtgccgagtttgatggtatgtcattaccgggtcgggtccatgaatgaccggcaccatcatggctgccaagtccttgagatttgaacaagatgttccagatggtaatgaaccattctttttttttttttttttttttgtattgagatggagtctcactctgtggcccaggctagagtgcagtggcacaatctcggctcactgcaagctccgtctcccaggttcaagtgattctcatgcctcagcctcctgagtagctgggacgacaggtgtgtgccaccatacctggctaatttttgtatttttagtagacacagggttttgccatgttggccaggctagcctgaaactcctgacctcaagtgatctgcccgcttcggcctcccaaagtgctgagattacaggcgtgagtcactgtgcccggccagtaatgagcattttgttgcgtccctggagtcttcctaataatgaggtagtggcagtggggttggaacagtaggtgcttggatatgtcttttgatggataacaattccttaaaaacattgagttacactgtacaaacatatatgtgtatatatacgtatatgtatatccatttactagaattaagagaatgcattcaaatactagtgggtttgtatcttttttttctttttcctccaattattgtgtttatcttgacttgctattaaagctctggaaatactcatctgagacagtccaggcatggtaggttctggatcttccactgtaatactatgtgaaatgagatattctttgtttcttagaaacaggtggattcagccaggtgaccgttactctttgggctcgtgttacaaggatatcatgatggtgtttcattgatatatgtaatcaataatatattacgttatttcagccagacctaggaataaataatactgctctcttttattgagagtggcttggtgattttcaaagtttgtttatatgccatcatcagatctgcagagcaagcttatgagatgaggaaggcatggattggtggacataagaaatggagggttaaggcaagtggttacttacccacagtcactaatttcataattggtagatttgggaccagaactaggatatctcatttccagcctagtgttctttctgtgatatttgttaaaggggccatctggttaaaaggatagtctggctctttaatgatgatagctttcaaatatataacactttacagtttgacaggcttttacatagatagcacattttcttcacaaaaagacaaataatggctttacatatgttggatgaagatgtggagaaattagagtctttgcatactgttgagaagaaaaaaaaactttatttttctctttctcagtcagtttttgcagcaagtcttttatagtccttattttttttttaattctctcttccccaggtttaattttcttaagaggcagatttataatactaagtaatatccagaatagatagttcctgcaggaaatgggtttattgttctcataaattttagtggtctagtttgtcaatattactgtcatttcttaatagcatttgtctttctgagtagtaacttgtacttgaattaaaatctttcacatgtatagagtggagcaaagagaccctgcatatattataaaatggtccatgcctttgcttagttgtcattgtgttagatcagagaaagagaaagtcctttaaaatatgaaaataactggtactcaggaagggagaagagaagcttgaaggtacgtggatttttttttttttttttgaggcagggtctcgccctgttgctcagtctggagtgcagtggtgcagtctcgactcactacaacctctgcctcccagttcaaccgattctcctgcctcaccctcctgagtagctggaattacaggcacccgcctccatgcccagctaatttttgtatttttagtagagacacggttttgccatgttggccagggtggtcttgaactcctgacctcaggtgatccgcccgcctctgcctcccaaagtgctgggattacaggcatgagccaacgtgcccagctgatatatggaattttatgtgaggcttattagaaggtgtggggtatagggggaagaaggacagcttcgcttcttttcatctttcaatatgaaaacacagcaggatagcgtaaaatttttttaatgatgtatagtttgcatacaataaaatgtaccattttaactatacatttgggtgaattgtgacagatttaggtatctaccaccacaatcaagaatatagacccttcccctcaatcctggggttgctttctgcctcttcccagccaggcctccctcatgccagcctcaggcaaccactgatgggctttttgtcactatagattagatctgccttgtctagagcttcgtagaaatcctaacggatagtcttttgtctgaccttttcactcagtgtaatgtatttgacactcactcttgaggtgttgcacaggtcagtacttcatccatcttattgctgaatatgccggtttatttatccattcaccagctgatagacatagaggctgtttccagtttggggtgattataaataaaattgttatgaacatgcatgtacaagtctttgtgtgctggacatgtcattgtttctcctgagtaaacatgtaggggtggaatggtgggtcacatggtgttaaatcatttcgctgattttactgagcagtcataatactgttttctgtagcggttgtaccattttacattcccacccacagtgcacaagagttccagtttctccacatcctagctaacacttgttatttatttatttttttaatagtagccctcctaatgggtgtgcagtggtatctcattgtgttttaaatttgcatgttcctaatgataagtggtgttgagcatcttcttcctcttctttttttttttcagttgagatggggtctcactctgtcgcccaggctggagtgcagtggcgcgatcttggctcactgcaacctccgcctcctgggttcaaggaattcttgtgcctcagcctctcgagtagcttgggagtataggtgtgcgccaccacgcttggctaatttttgtatttttagtaaagacagagtttcaccatgttggccagactggtttcgaactcctgatctctcaagtgatccgcccgccttgcctcccaaagtgttgagattaggcgtgagccactgcgcctggccaagcatcttcttatgtacttattggatgttcttctttggagaaatgtctattcaactcctttgctgcattgctttttaaaatatttggacttgaaagcccagcaaggataactattttgttcttctgctctaagaatatataaagatcttgctcaactcagcagaacatttgtatcatcatttcagaactgcagtggtatgaacatctagttgctaattacatatttagaatagttcatatttcaaaatgctaaataaatatttgtgggcactgagcctagttattatgttttgccaaagtcacaagttccgccattgcacgtcccaatccagttcagcttgtacaaaaatgcttaaaatctcttttgcatgaaactatgttttggtcatgacattaagcagacagaatgagacttaatatgtctttaaagggtcattttaaataaacaacaagatgactgtcactgcggcggaacaaaaagaggaaagaagaaaggttggttaacttagagaaaaatggcaagattcagatgggaaagggaatcagaatttttagacccctgtgtgcagaaaggaaactaaaggaagttatctagctctacttcatttgttctccccaaccttgagttcatggatagagatgaatggagataccaggaagtgttcaaaaaggaaaagtggatggttgggcgaggtggctcatgcatttaatctcaacactttgggagactgaggtgggaggatcacttgaggccaggggtttgagactaacctgggcaacataggaagaccctgcctccacagaaaaaacaaaattggctgggtgtggtggtggacacctgtagtctccagctttttggaggctgaggtgggaggttcactcgagcccgggagtttgagactgcagtgagttccgatcatgccactgcactccagcctgggcagcagaacaagaccctgtctctaaaaaacaaaacaaaacaataaagtagaaaggaaagctgggtactttttctaagaagccaagagccattgataattacaactcacagaagcagactttttgagagggacgccacccagaacctgaggctactcaaactattattttgtcagaagcaacagggttgcctgaaatttgcaattgaaacagtgtgcttttctcacatacacagcctttatgtaattgttcagttgtgttttaaaaagaaataacatcactgaggtgtttggttttctccttttctttcctctctgtcttgcatggttcagcatgttgttttaggtcaacagatatattatagattggagttcagcacactttttctttgaagggctagatagtaattatttctcgcttcgcaggctatagcctgtgtggcaaccacctacctgtgccactgtagtagcatcggttagcagaattgcactaccttggaaagcagtcgtagataatatgtaaatgactggctgtggttaagttccaataaaactttatttacaagaacaggcagcgggccatgttttgccaacttttgttctaaataatcacaagaggccatgaaaagtttaatttccatacatgagaactgggtctgaatattgactcttctacgtagtataatgggtgtcccaaatactcttacccagtaaaggatcttttaaaattttaagttgaaaccatattcagtggcaggaatcctgaggaagtgagagagaaaagctttataaatattaataagtgctgaaaattaagttgttgaaaaaattgttcacataaaagatcattatatagcaagtttggaatttagtttcaattttcatttccttgtagaaacatcttcatcgtgaggaaaatgagggaattaatgaacatttgtttcctgagtgtgagctgtgataccttgtagtcactgagatggcggctgcatgatgggtatctcgtaactctgctccgggatgcccaccatctagaaagatgctcaagacccgtgggacaggatagtgtttaggaatgtgtgttttaaacttttcttgcagtatttaatttctaaataaactttattaaggtataatttatatacagtaaaaatgcacctatttttttaagtgtgtgatagattctatgggttttgacatgcattcactcccaatcaagatagagagcattcccattaccccaaatgtaccctcactcccctaatgctcaccctcgaacaaccactcatctgctttctgtccatgggaattaggttgccctattagagagcttcctatacattcagtcatttagtatgtactttttttgtgtctggtttagaggtttgcaaacttccttggttcacagtgcctttagaatccataattttttatggtgttgaaagttaaaagggatacctaccagttccattagatccagagaactcattaaaagtagcttacatggtgtcccacaattattgctgtttccctccaagatttaaaatatccagtggcatgtctgtgagttcactgggggccctggggtggtttcgtgcacagttgaggaaccacagatctggcttcttctacttagcataatgttttggaggtttatttatgttgttacatgaatgaatacagtcatgcatcccttaatgatggggatactgagaaatgtgtcattaggcaatttcattgttgtatgaacatcatagagtggacccacataacttacatgttacaacctattatgcacctaggctatatggtcaagcctgttgctcctagaatagaaacctgtgcagcatgttactgtaatgaatactataggcaattataacacagtggtacttgtgtatctcaaatgtgaacacagaagaggtactgtcaaaatacagtataaaagacagaaaatggtgcacttgtatagggcacgtctcgtgaatggagcctgcgtactggaagtgtctctgggtgagtcagtgaatgagtaatgagtaaatgtgaaggcctagtacattactgcacattactgtaggctttataaacatggaacacttaggcaacactaaatttattttaaaaaattgagttatggcggctatgatgtcactccgtgataggaatttttccactccattataatcttatgggaccaccatagtataaaatgtcattatgctgcatgtgacagtagtctgttcctgttttttgtttgtttgtttgtttgttttgttttttttgttttttttgacagagtctcactcggttgcccaggctggagtgcagtggcacgatcttggctcactgcagcctccgcctcccgggttcaagcgattctcatgcctcaacctcctgagtagctgggattacagacatgtaccaccatgcccagctaatttttgtatttttagtagagacggggttttaccatgttggccaggcaggtgttgaactcctgtcctcaggtgatccgcccacctcagcttcccaaagtgtagcctgtttctttttgttgttgagtagtattccattttaggaagtactgcagtatgttcattcatttgatgggacatttgggttcttctcatttttttggcaatgtgaataaagtcactatgaacattcacatgtaaggctttgtgtaagcatatattgtcattgctctaagattagaattgctaggtcatatggaaagtgcatgtctagctttttgtttatttgttgatttaatttatttattcttaaagacagggtcttgttctgtcacccaggctagagtgtggtcgtgcaatcgtggctcactgcagccttgaactcctggtttcaagcagtcttcctacctcagcctcctgagtagctgagacttcaggcatgtaccaccacgcctggctaatttttaatttttttgtagacatggggtctccctgtgttgcccaggctggtcttgaactcctggcctcaagcgatcctcccacttccgcctctccatatgttaggattatggcatgaatcactgcactcagcccatgtctagctttataggaagctgccaaatttttccagagtgtttgtaccattacattctgatatgatttagatctatgtccccacacaaatctcatgttgaaatgcaatccccagtgctgaaggtggggcctggtgggagatgattggatcagggggtggtctctaatggtgtagcaccagtccccctttggtggtgttgtcacgatggtgaattctcatgggatctggttgtttaaaagtgtgtggcaccttcccttctctttcttcctcctgctcctgccatgtaagacacctgctcccccgttgccctctgtgatgagtaaaagctcgttgaggccctcctagaagcagatgcttccgtgctttttgtacagcctgcagaactgtgagccaattaagcctcttttctttataaattacccggtctcaggtatttctttatagcagtgtaagaatgggctaatacacaattcgaccaatagtttgtaaaaattcttagcctgggcaactaaaagagacctcgcctcgacaaaaaattaaaagtgaaaacttagcatgtagtaatggcatgtgcctgtagtctcggcgagtcaggaggctgaagtgggaggaacgcttgagcctaggagttcaaggtggccgtcagctatgattgagccaccacactccagcctgggcaacagagagagactctgtcttgaaaaaaaaaaaaaaaaaaaagaaaaaaattctggttgcatcacatgttcatcagtacttggtattgtcagtcattttaattgcaggcattctagtggttatgttgtgtatcttcgtaaggtttctgtttgtgtttctgatagctaatgatgagcatctttgctcattgtgccatttctgtggttactggctgtgtgtgtgtgtgtgtgtgtgtgtgtgtgtgtgtgaagtatcttgttctaatttttgcccatttttaatagggttgcttgtcgtcttatcattgagctgtatgagtttttaaatatattctagaaacaagtcctttgccagatgtatgtattacaaacatgttctcccagtgggtggcttgctttttcattttcttcaagtgtcttttgaagagcaagagttcaacatttcaatttgtcgaagtcttctggttagtacttttttttttctttctttctgtccctctcaaggttaagaagaccttcacctagaagtttgtgattttggcttttgcatttaggtctaggatctatttcaagttactttggtgcgtgtgtgtgtgtgtgtgtgtgtgtgtgtgtgtgtgcgtgcatgtgcgccttgaagtaaggattgaggtttattttcttttccatacagatatccagttgttttagcaccatttgctgaaaaaagctattctttctcctttaaattgcctgggctcttgtcaaaaatcaattgacggctgggggcggtagctcacacctgtaatcccagcactttgggaggctgaggcaggcagacggatcacgtgaggtcaagagtttgagactagcatggctaacatggtgaaacccgtctctactaaaaatataaaagttagatgggtgtggtggcgcatgcctgtaatcccagctactcaggaggctgaggcacaagaatcgcttgaacctgggaggcggaggttgcagtgagctgagattgcaccactccagcctgggcgaccgagtgagactgtctcaaaaaaaaaaaaaaaaattgaccatttatgtgtttgtctatttctgaactctattctgttctattgatctatatgtctgttcacattaccctgattcttgtagctttgtggtacgttttgaaatcaggtgattgtggagatgtatttttcccatccaagtactaacgaggcccgaccctgcttagctttccagatcaggtagtatggctgtagacaagaaggtgtatttttaagttggatttattcgatcaaacttttatcaaatgcattattctactcatattggaaaaatgaagtaagagtatcatttttcaaagttggcattgcttgggactgatttgtgactcccaaattatatgttgaagccccaacccccaatgtatattggagatagagtctataaggaggttttaaggttaaatgagatcatgagggtggttgctgattcagtggggttagtgtccttattggaagagacccccgagagcccactgtgtctctctctgccatgtgaggacataacaagaaggcagcattctacaagctagggagaggccctcaccagacaccaaccatgcaggcaccctgatcttggacctcccagcctctggactgtgagaaactacatttctgtagtttaaactacccaatccgtagtattttggtatagcaacctgagcaggctaagacaaagagcaagctgactttaaaggaagggaaagtatactgagaatattggctgggcacggtggctcatgcctgtaatcccagcactttgggaggccgaggtgggcggatcacctgaggtcaggagtttgagaccagcctgccaacatggcaaaactccgcctctactaaaaatacaaaaattagccgggcatggtggtgctgtaatcccagctactcgggaggctgaggcatgtgaattacttgaaaccgggtggcggaggttgcactgagccaagatcacaccactgcactgcagcctagaagaaagagcaagaatccatctcaaaaagaaatatataggataggattccttgctttagggccaactttggtgaccttgggtacatgtttcctttcctgtaaaattagaaaattggtccagagaactctagaatagcccccactaatgtcctatttaaatttaataacctgtaattttagatggattatgagtgattttctcttttacttgtattctctgccctgattcaggttttaaaatagctgaacaaaaacaatactgaaagccaaatcgtttgatgaaaacggtggctgacacttaataataacttagtcttcttttagttaaaatgcttcaggaaaatcctgatatagatagaaccagactctagtttattttaggagtttttacagtcatttcttccttgagccttttgcttggtgtttcctgacacagaactcgaagccatgctttctccttagttaatggctccccacgccagaggtgtggggccacctcatatatgtgtcctgggacagatcccaggattggagagaaattagaggtcatctagtcccgggcatttcaaatgtggtccctggactagcagcttcgacctcccctgggagaatattaggaatgcagaatcccaggccacaccccagacctgccgaagcaggcacactctaaagcaaggctgagaagcactgttctagttgaacagtgaagaatcttctgtatggtcttcccagcagaccatctggcctctgggcacctctgaacgtgacctcacgtgaggcaatctgttccatttgtggacagttctgttcaagtctcttttttgtatttatctgaaatgtgtcttcccctcccttctagtttaacttgctgtcatccattggtcctgccattgtgtcaggcactgaggataccccacgcaatctcctttctcaaagatctcgcaatcttttgtttgttggtttgagacagagtctcactctttcgcccaggctgaagtgcagtggcgtgatctcggctcactgcaacctccacctactgggttcaagcgattctcctgcctcagcctcctcagtagctgggattacaggtgcctgccaccttgcttggctaatttttgtatttttagtagagatggggtttcaccatgttggccaggctggtcttgaactcctgacctcaagtgatctacccacctaggcctcccaacgtgctctgattacaggcatgggccatggcgctggacagatctcacgatctgatatagaaatagagatgtccatgaatgaactagagcacagtgtgagaaaggcagtgaagaagatgatgtccagggtgctgagctgcacggagaagggtgctggagaggacctccaggtgggggtgcagcccggtacacatactgagttggaatctgccagactcaggatggggaaggggttctgggagggcgctccgcacccagagaagagcttagcagaggcatgagaggtgacgtattggggtccctgaaaagtttgatttccttatgttaaagtagcaaggagctgggaaagtgggcagggggctggatcacaaagggcccattctgcagtgtccaaggagttcacttgaatgtgagaggctggggagaatagatttgcattgtaggaagaaggctgctggctgcagtaacgggccggaagagggaggcaggggtgctcttagcagattgacagagcctgatctaaaggaaagacatgaaggactgagctaggggcgggataagagctcggccactagtctctaaggaatctacctcataaatctaaagcagcaaatcctgtcccctcagttctccacttttgctcaatgcttattcattaggggccagctctttccaggctatgcacgccgtgaggactgcacagataaaggtggcgtgggccttgcccgcattacagagtgtcactgcttagtgggcagtgggcatctccagttattccttcttcatgtgatattgttttaaatgcccttagcttttgcgtttttcctccgtggagtggtctagttgatattccccttaactggtcgtgtctgaaactgaattgcaggctctaggtaatggtgtgagcaatgtggactagggcccgggctgttaccttctttctgtgaagacggcctaagatacagtatggccctgcgtctttgaaggccatctgagaacactgcagcttcagactgccctaggtcagagctactggcagtgtcccaaggaggccttggcatgtgttctgcctccccactatttctcttctgtatctgatggctttgatttcaccgcacctaagtgtaagttcaaactatatcctattagacattatcttgttaaacagttcctgttgctccatgcttttgagatgttttttaatctctggtttcatcctgttaatttattctcttggttgtaagcgacacaaatgattgacgagttcccttgtatatttgcatcagcatcattcactgaaacgttctcgaaggtagggcatatgtcagagtcctggcagatgtaggctgcttcacactgtgcctccagattgggaaaaggtggcattcctaatcaccgggggaagtaaattcatcaataaatgtggtttaggacagctgaagagctgttagaaaaaaaagggagctggggtccctccaacattccttagataaaaataaactacataacaaagaaagtctcttaaaaaaaaagaaattaaattgtctgaaagatttagacttaaataatgaactcataaaaattattagacgaaacatgagtaaattttaaatatatcttggaatgtagacagaagacttttttccccccaaagcgtgtcacaaaacacagaagctgtaaagaaaaaggctaactttcctaaaagaaaaatttcatgaggaaaatttaaagttctgttgggcaaaaattccataaatgtggtcaaaaaacaagtaatatattggagaaaaatatttgcagcctatgtgtcagagctaattcctttcacatggaaagaagtcttagaagtcaataggaaaaatgaaaaatggaatagttaaaccaatgttcattgctagaagtgagcttgtgaaaacatagtaaacttcactttgtttaaaaatgcaaaggaaaataaagaggtctcattgttttcatctgtgaaattggatgtggctaagtctgataatacccaccttgctggtgaaaggatgagaaaacagacatattgagttgaccagtgctgttgaagggcatttctacaatatccttagactagaatttaaaaggttcgtattcttagactcagtcattccactaatgaccctgtaaatgttttccagcatgtacacaaaaataactacgcagatatttgtaataatagcatttatactagcaaaaaatagaggtagcttatatgaccatctgtaggtgtccagcaaaatattgtgtagtgttaaaaatggcacaattctctacgtactaactaggaaaggttcaggatactaaatggaaaagcaaatcactatgcataggaggatgttgtgttaaaaattaaaaagatatacgggatatcagtaaggaagatattagctataaattaacaaaaatgaagggaatgtatttaccttgtacaacaagacatcttcatatgtcagcagtgcagggttgggacagggtctcactatgccatccctgcctcagatgccatctttctcctctgcggtactaattatgtgggtgtgtttccttatggcagcaagatggctgcactgtaccggacctcacatctgcatttctgatggaaaaaagatgtaaggaggaaggtaagaagttggaatcggaaaacccaaaatatttccagaaatgtccaaccagctcttttttgagatggagcctcactctgtcacccaggctggagtgcagtggcgtgatctcagctcactgcagcctccaccttctgggttcaagcgattgtcctgcctcagcctcccgagtagctgggactacaggcgcccgccaccacgctcggctaatttttgtatttttagtagagatgaggtttcgccgtgttggccaggcaggtcttgaactcgtgaccttaagtgatctaccctcctgggtctctcaaagtgctgggattacaggcgtgagccaccatgcctggcccaacttctgcttacatttcattggctagaactatcccatggctacccagaccttcagggaatctgtcaaggcaaaaattttgattaggcacgtgttcttccctgacacacaatccagagttctgtgaatatggaagaagaggagaagggatattgggtaggcagcagtgtgcgacacacacacacacacacacacacacacactctttgtgtttgcatgcagtatttctggaaggcgcctgagaaatgggtaacagtagttacctctgtggaatagactggccgtcaggaggaaggtggacatttatttttcactttatagtgttctttcctgcaaattttttaaaaaaacaatgaatatgtgttaactttaaaggaaggaagttgataggaagctgacaactatccattatcagaacctcttgggtacagctgtccaaccagttactcagaaccaggtcatttaacctctgtgaacttcagcctcaactgcaaaatgagaggctagaatagatagtatcttaggctccttctacctctgagcctcctccagttaattacacaatctccaggagctgaaggagagaactaagagtcagctcctttagcaagaaaagacatccaggattttaaacaggttcttacttagcctttgttatggctgaattgtgttccctctaaaattcatatttggaaatcttaatctccagaaggtagtatttggagttagggtctttaaagaggtaattatggttcaatgaggtcattaggttgggccctaatccagtaggactggggttcttacaagaagaggaaatttgtacccaaacatcctcagagggaaggccacgtgaagacaccgggagaaggcagccacctgcaagcagaggagagaggcctcagaagaaaccaaccctgccagcaccttgatcttggacttccagactccagaatttgagaaaataaatacctgttcttaggctgggcatggtggctcacacccataatcccagcactttgggaggctgaggcagatggatcacttgagatcaggagtttgagaccagcctggccaacatggtgaaactctgtctctgctacaaacacaaaaattagctgagtgtggtgacgcacacctgtaatcctagctattctggaggctgacgccggagaattccttgaacccgggaggcggaggttgcagtgagcagagattgcgccactgtactccagcctgggcaatagagggagactccatctcaaaaaacaaaaaaaccgcaacccttttctttaagttctccagcctgtagtcctgtgttatgatagccttagcaagctgatgcagtcttctgtccctttacactttgtgaggggagctctgcattttgcagaatctctaggacagcatgagattgcactgacttagctactgcctctattcccttccttggtgaaagcaggtcccctaggagtctagcctgggaacctgcaaatgctaaacgtggcctgggggcagagaagcgcatctgactggaagaagcaaatctgttcccgtgaggccagcgcagccttcctccagggtgcgatcgctgtgcacacctccttcctgggttccttggggccttgcctccaacttgcttacctgttctctaatctattttctttccttgaacttcagaattgatggataccctgtctcactctagattccttgcctggcttctgaccgctaaacccatctggactacaaatggtttatcttttagagatgatctatatctcttcagctggtgagatttgagggcaggatcttatgttacatgagtgaccttcttatagatattggcaagaatcattttcttcttctgatggagcagaaaggggtgtgtgtgtgtgtgtgtgtgtgtgttgtgtgtgtgtgtgtgtgtgaaagagagagaaagagaaagactttcattgccctttaagccctcaccctagcactgcatctgagccagaagactctgaaatggcctgcagtgttccaggccatttaagggagactggatcttttctgaggctaaatgagggctggttttcctgtgctggagtgggtaaggactccggggtaccctgtgtgcttggagggaggcagtcctgtatttcttaagatgcttaagaagatgcaagatgtgagatgcttagatgatggaaggtgaggagagattggcctccaggcatcctgctccccgcagagcccctgagaaggtggccttatttatggagtttgcctgtctgtttactggcttcttctcaagggagcatagaggaccccactggtcaggtgtcagacaaaagagctgtacggatgcatagatttagttctgcctcacaggcaggtagcctgagctcctagggggaactgtttttgctaagtagggaatgaaaagcatgtttatttaagcacaaaattaaatctctcctatttttatatgatttcccgttgttttcttccctgtagggaaatctgctgtgatagagaactgcgtaacaggccttttctgtgagcgctcactcatacattatgcacgacgtggctaagatctttgaagcgcatggagacaggcacatctctgagaggcgagattctttcttttctcagcccccactatcttctgtgctacatcagagatggagcacagccaccgtgggtcttgaaatttcgcaggtgatgctcttctcggtgacctgtgggttcattacctgtgtcaaagactgaagacgggagaattagggaagtggtggcctgggagaaccaaggacatgtttgtgtgccctatttaggcgattgttctacttcatgctaaatttgtgaggagttttatgaagcctagaaaattaagtagaaaatatatttttacagtattttaagctggaacagactatttaaagctcgaagagaccctagagataaaccagttcagtctcttccttttgcagtagaagggacgaggcccagaggactcacggtgtttcgggaacttgcagggagttagcgcagcaccaggatcggagcgcggggccccgtgtccagctccttactctttttgttctggcagcgatgcccaccgggccttcacagtacatttctctggatacagagagaaacattattcatctgaaagcaaggcttcagaagctgtttttataataatttgttagagccacatagtaacttgcaaataaacatttacagttaatgagaaaaatggatacccctgagaaaaaccgtttgtagttactgtgttctagtcagagctcttgagctaatttgaaaggaaagtcaggattctggcaggaggagagctatccccagattccaaggatggggaagagaatctctgtatggactagaattcgagactgtcctgtgtccctctgtctctccttcccggtcttctgtctgtgtcctctgtgcgggatcccatgcctggctctgttaccctcccttcccgccaccagcctgtcggtacctcctgtcctgattttctggttttcagtcattccaaccccttctcagtttccctgacttggtccctgtgcccgtctcagtccccctgacttggttcctgtccctgtgtcagtccccctgacttggtccctgtccccttctaaatccccctggcttggttccctgtcaccatctcagtccccctgacttggttccctgtcctcatctcagtctccctgacttggtccctgcccccatctcagtccccctgacttggtccctgtccccgtctcagtccccctgacttgggtccctgtctccatctcagtccccctgacttgggtccctgtctccatctcattccccctgatttggtccctgtcctcacctcaggccccctgacttgggtcactgtctccatctcaatccccctgacgtgatccctgtccccatctcagtccccctgacttgggtccctgtctccatctcaatcccccctgacttggtccctgtccccatctcagtgcccctggcgtggtcccctgtctcccgctccatcccctgcccccatctctgtccctctgcatcaggcatggtcacgtctcagtgccatctcaccctctccctgaggactcgctccattttcctctcccctcagaccagcttgctctgcagctgcgcacgatgcaaatgaccgccccagcctctcttggcttcagtcccccaccacagactaattctatctctcaccccaatttcaaatccccagggagctgtctgatctgcctgcttcagctcctctcagcctgcctggtgctgccgcacagaggaattggctgcccgtggccgggtggagagtcctcgtcttgtgtgtggccagggtctcaaggcctcatgctacacacttgcgtatagcatctcgtgcaggcttcaccacagtcttacgaggcatgcggtgaccttgcccttagacgtgtgcactcaggcctagagctgtcagagccatttgtcgagcgacccgctgctaggagatggcagagctggagccagaccccaaagccagcgctgcgctgttctccttttgacgcgggcttatccacagttaatcagtgatttcctcagatgtccacatgctcctacggtgactaaacccagctgtcttttgcacatagttggaaaagttactattaggcacctagactaggtttgatagcaataggattttattaaaaccttgatggaaaacctgcgtagtatctgctaacatctttgcatgcttggaggcagaggaggatttaatatacatcaagtctgtgtagcaacatcaaaggaagatttaaacactgctggcttttttgtgcgatatttaaaaagcaccccccaccttttaagaaaatgtgaagttctggcataaatcaaagtgtgattaatcagtgatgattgactggtattttcataacctgtggcattaataacaactttgtatggacataagagttgtaagcaaatttgggagggaggttactgcttcatgctattctccatgccgatcttcgatctttgtacatacttacttgcattctgtaaaattcggcgtgatgaaatccaagaaccaaaaatgcagggtggaaataggcttagtagtaagtgaccttctatttccacttcccacctccttgttaagattctttgacctcctgccacaggggccttagaggcatcctgtaagctttgcacagaagctgctaatcccccggcaggcagttcaggcaggcagttcattccgtttccacctggcagctgctccctctgacacccaaggactcgcagggagtggccgttggacctgcagacccctgggaacaggcagggggaagatatgtggaactgagacccagaggcctccccacttccctgtgctgactcacgtaggctgtcatctctgttggcttttaaaggaagaggggtaggaaggacagtgaaattagaagcattgccaggtcttgcttgagagcttctctctctcactgctgctattttttcttcattaaatgtgtgatgtgggtttgttcaaagcatccagtggctctccacttagatcatttaattccacgatgcaaatggcagcacagctttggcctggaatcatgcttcgcacttggtcaaggccacctttaactgcctggccagacggctagagattttcccggggcacccctggagtttttcccatcctgactagagataatctcagagcgggagccagccccaagtgagagggcctctgaaagaccacaggatgggaacatggacgtgtagcctcatttcctcaaggggatgcaaggagattgattaggcaatgggggattccatgaaaaaaaaattcatgatattagtctacttacgtaaaattgtttgggtgagcacgggtggaggggcagggtggggaagagaaagacattgagatcaagtgaataaaggaattgggaccaaataccattctcacgctaacctgactgtcagatgaaagaagagaatgttgcagttatgcttatggcttgattctgcttggaagaaaagaaatcaacacaaaaaattcctgatgtgtgcatgcgcttttggaaaaaggtgtagggaagggcacacagcagtctaatcctggggacttgagaagggggagcacagcagtcccaaccctggggacttgggaagggggagcatagcagtctaactctggggacttgggaagggggagtaagggaaaggattatattcttttctttgcacatctttatatttatttccttattcaaaccagcactgttaatttttgtaattaaataaatttagagaaagactttttaaatgtgagagagctgttctgggggaaaaatcagaacaaaaactaaatttacactgggattgtttattttaagttttgtgtttcatagatagtctgtatagactgggtgtggtggctcatgcctgcagtcccaacactttgggaggccgaggcgggaggatagtttgaactcaggagtttgagaccagcctgggtaatgtaaagaccccgtctctatcaaaaatagaaaaagtcagctgggcatggtggtgcgcacctgtggtctcagaaactcgggaggctgaggcagaaggattgcttgagcctgggaggctgaggctgcaatgagctgtgatcataccaccacactccagcctgggtgactcaaaaggtacaaaaggctctttggggaaaaggaagttgtctgttctgtccacagccatgtatttccctttctggaggcagccactttggccagattcttggatattcttttttttttttttttttgttttgagttggagtcttgctctgtcgcctaggctggagtgcagtggcgtgatcttggctcactgcaagctccgcctcccgattcacgccattctcctgcctcagcctcccgagtagctgggactgcaggcacccgccaccatgcccggctaattttttgtgtttttagtagagatggggtttcaccctgttagccaggatggtctcgatctcctgacctcgtgatccgcccacctcggcctcccaaagtgctgggattacaggcgtgagccaccgcacccggccaattcttggatattcttaaagaaatgctctatggtttaaaaaatctagagatttgtttataatatatatatttgcatgtatataatgagtagggagagaaagtctcccaccccaaaatggtagtagaatagaaacagtgttttgtatgctttttaaaagtttaatatatacactgcaaaatattgatatatagagagctgtttgattcttttttactggccacgtgatattccattatataagccgactttatttagccagccttctattgatgagcattttgattattttcaatattttactccagaaacaacactaaagactcgagattgtattctttgacacatgttagtatatccgtagaataaataccttgaagcagaataatttttctccaaaaaggggctacaaataatacacttccttcagaaacatgtgaaagtgctagatattctttatagaacaaggtctgcattggaagtgggatgaaatataatgatagcgacagggactttagagaaggaagtaggaaagtcagggcccttgcagttgcttctctcatagacacctctctttctagaagatatttttgcccaaactttggtttttatatttcagggtaacaaggatgtgaggaaggaagtcaacattgagtgagttgctattatgtgccaagcctagggttaagtcagttgcaagtattgtttaattcttgtagtgttcctataaggtccatatttggcatttactatccacagagcacagatgagaaaaatgaggctcaggaggctaagtcagttccacagggttatccagtggataaatggcagagtcacctttcagacttcatgaaagtactctagctttttacagtccttctccttctcttcctcgtagaaaaatagaaatctctgtagctcttgctttgtgaaggatctggggatgcatgaaccaggaactaggtggaagaccagtttcacctgaggttgacctgtgatgtatgactttgcttgtacttaagaagtcacttttaataaggttgtagggtgtgcagagaaaatttactgttggattatgtggattgtcttcaaccacaaagggctgtgttccagaaactcttctgagtctactgactttaaaggagaagagccagccccgaagtatgacgctctgaaagctggtcaggtttcaaggtggacccacaaagcccacctaacttagaacattctgaaagagtatgacgtatgggtggccatgatttcttggtgttcttagtccataatgggatgcataggtgagaatgtatgtatagatacgggctagagcaggggtcctcagtccccgggccacagaccagtaccagttcatgggctgttaggaactgggctgcagggcaggagtgagcagtttcatctgtgtttatagctgctccccgtagctcacatttctgcctgagctctgcctcctgtccgatcagcggcagcattacattaggttctcataggagcttgaactctattgtgaattctgcatgctagggatccgtgcactccttatgagaatctaatgcctaatgatctgaagtggaacagcttcatccagaaaccatccccctcctccgccatccctggaaaaatcatcttccacgaaactggtttctagtgccaaacaggttggggactgctgggttagagccacagcaaggagaacaggaggggcgagagcccccccatctgcgggctgggatggagtccaggggcactgcggcagcactcgaggctgcagcaaggctggggctgtggccaaggatacagggcaataggtggcctcttaggtggaattgttgaaagcctcagagagagcactgtgaggaggaatgaggccatttattatttttgaaagtcaagtatgtgtaggttggcaactgcccatactttttatttcaaatggctttattaagcgaattacctctgatacaaatggacgtcaattaacaaagagcttggaggtaatttaatgtaatttctcagctcaagaaatcaagtgctttttttttttcctttcatagaagccagggtaaattttctcatagctgacagagattattatggtggttactcattttatcagaagtgatgtaatatccagtttagatggagagaggatggtgctctttggagctagttttcggagtctgccactagattgctgtgtgcttctatactgaaagcagccagtgtcctgatctctaattacccttagccttggtgtctctttgacatttcgagggggatagtgttggatgaactaaagctcgtgtctcacttttaagttacagttctctgaaccttgtaaacaggtagggagtcatttcctgaggctgaagaagaagaggagaaagaagccacgcttatatatgtctttagttgattagagatgggtaagagtatgttaaccttggcttacctttccctaaatgtcagctcttacatgtgggtccttcagtcagtaggtgtgtttccatgttattgctactccttcaaagtttataaccatcaactatgtttaactactttgacctactgatataataaccattggtaggtagtgtcatctaccaattattattagatagcatctagtattattaatatgagaactttctacatgtttgcgtagagcttcagcttgaatttcatctcatagaatatactttttttcttttaccaacaatacagtaaggcacaaatgaaataatcataaatatttcacagaacgatgcacgcttatatggcatttctgcctgtgtgtgcatttgatctatgagattccctgattctttagcatgaaactcatgggatatgatcagtgaaatttgtcccgctcagaatctgtcaagcattttattttcttggggaggatggtcatgccataaccccaattgatatttcttggtgatagtttaggttttgggttaaccatagggttttgtgtttttgtttgtttgtaattgagatataacttgcacacagaaaaatgcatagttgagggtccaatttgatagattttgatatatacatacacccataaaatcgtcaccccagaccccatcatgagtatgtccatcaccctcactccttgctcacttccattccttcctggctcccatcctcacccccagcagccactgatctgcttcctgtcactccagcttagcttgcattgtctagaattttgtataatggactcatccactatgcactctgtttttggtctggcttgttttactcaacatagttattcccaggtcatcgatgttggcgtatatatccatggctcattccttttccttcctagatagtagtctattgtacgaatatgccacaatttgtttatgtgccgaccttttaacggacacttgtattccttcaaatgagggagtttctactttttgactacttcagatgaagctgctacaagtctttgtatggatatatgctttgttgtctgttgagtaaatatctaggagcggcatagctgggtaacatggtaggtgtatgtttcaacttttcaagaaatgccacccacagtgtaggagagttccagttcccccacatcctcagcaacaattgattatgctgagtgtttttcattttataaattctagtaggcatgcaacaaacatatgaaaaaaagctcaacatcactggtcattagaaaaatgtgaatcaaaaccacaatgagataccatctcacaccagtcagaatggcaattattaaaaagtcaagaagcaacagatgctggcgaagctgtggagaaataggaatgcttttacactgttggtgggagtgcgaattagttcaaccattgtggaagacagtgtggcaattcctcaaagacctagaaccagaaataccgtttgacccagcaattccattactgggtatatacttaaaggaatataaatcattctgttataaagatacatgcatgtgtatgttcatcgcagcactattcacaataacaaagacgtggaatcaacccaaatgcccatcaatgatagactggataaagaaaatgtggtacatatacaccatggaatacaatgcagccataaaaaggaacaagatcatgtcctttgcagggacatggttggagctggaacccatcatcctcagcaaactaacacaggaacagaaaaccaaacaccgcatgttgtcactcataagtgggagctgaacaatgagaacccatggacacagggagggaaacaacacacactggggcctgtgtggggggcggtgagaaagggagggcattgagaagaatagctaatggatgctgggcttaatacctaggtgatgggttgatctatgcagcaaactcccatggcacacgtttacccatgtaacaaacctgcacatcctgtacatgtaccccagaacctaaaataagaaaaaaaaaaaaaaaaagaaattctagcaggcatgaagtagtatctcatgtggttttcatttacagctccccaatatgcatcacgttgagtgtcttttcatgctcctatttaccatcggtttaccttctttggtgcctgttagaactttacccatttaaaaaaattattttatttattttcttaagttttcagagttctttacatatttggcacataggtcttttatcagatacatactttgcaaatattttctcccagtctgtgacttgtcttttcattcagcatttttggaagagcttaacttttttaactttcatgacaggcttaccatttaaataaagaaattgcagtcattccttgcttaacaatttgcatatgttctgagaaacgcacccttgggcgcttgtgtcatcgtgcgaacatgacagagtgcacttacacaaacctagatggtctagcctactacacacccaggctgtagggtctagcctattgctcttgggctacaaacctgtacagcatgtgactgtactgaatattgtgaccattgtaacaacgatggtaagtatttgtgcatctaaccttagaaaaggtacaatcaaaatacagtataaagataaaaaatggtgaccaggcatgctggctcatgcctgtaattccagcactgtgggaggctgaggtgggcagatcacttgaggtcaggagttcgaggccagcctggccaacatggcgaaaccctgtctctactaaaaatacaaaaattagctgggcgtggtggcacacacctgtaatcccagctacttgggaggctggggaacaagaatcgcttgaacctgggaggtgaaggttgcagtgaccgagatcatgcccctgcactccagcatgggcaacagagcaatactctgtctcaaaaaaaaaaaaaaaaagataaaaatgtggtatacacctgtgtagggcacttactataaatggagcttgtaggaatggaagttgctctgggtgagtcagtgtgggtgaatatggaggctcaggacgttactgctgctgtagacttcaacactgtacatttaggccacatccaatttattaagtctttatttctttaatagtaaattaaccttagcttactgtaacttttttactttataaacttttaatattttaactttttgattcttacagtaacacttagcttaaaatacaaacattgtacagctgtacaaaaatattgtttctttatatccttattgtatgagttttttctatttaaattttatagttttttaatttttaaagcttttttgttaaaatgaagacacacacacattggctcaggcctacacagggtcaggatcatcaatatcactgtcttctacctccacatcttgtcgcactggaagatcttcagggacaatgacagtgatggagctgttataccctgtaataaaaatgccttctcctggaacacctcccgaagggcctgcctgaggctgttttacagtaatgttttaaaataagtaggagtacaccctaaaagaatgataaaaagtatagtatagtaagcacataatccagtaacatagtcgtttgttattatatactgtacataattgtatgtgctagcattttatgactggcagtgaagtaggtggtttataccagcatcactgcaaacataagaataatgcattgctctacgacatcactaggtgataagaatttttcagctcttttgtaatcttatgggaccacccttataaatgtggggtctaccattgctcgaaaagtcattatatgaaggccaggtgcagtggttcatgcctgtaatcccagcactttgggaggctgaagtggacagatcacttgaggtcacaagtttgagaccatcctggccaacaaagtgaaaccccgtccctactaaaaatacaacctttagttgggcgtggtggtgcacgcctgtaaccccagctactcaggaggctgaggccagagaatcgcttgaacccaggaggtggaggttgcagtgagctcagatcactccactgcactctaagcctgggtgacagcgagactctatatcaaaaaggcaaaaaagaagtcattagacagtgcctgactgtattttattcacagtatcaagcactaaaaaacctatggcaaaaacaagcacaaagcaaaagcaaaacatgcctgtagccacattaccccttcccgccaagacagtgtcacaggaaccatattcatttgcacacctagggcaaaaaccccagtcaaatataagaagtaatgatttccaagaccatgagcatcaggcaacaaaggacagtgatcctgagctatgagaaatgaaggaggcaagccctgtcattgccccagcttactgtcttgagagtttccaggctgtggtgccaggagggtggcctagatagccgacccagaggagagaattgcagaaagaaagatctccagagatgtgcccaccaccctgggacccagcagcgtactgaccagcccgtgtaagtaaccaagactggaggacaaaaagggggatgctaagatcttacgccggcttcagtctccccctaccccacacccctgaaccactaaatgattcttcgtatctctgccctttccccctcaaaggaagccatttgcaactacgattcagaagaggacattttgcactacacgggcttctccgagccatgtaatcctcaaaattgagaaaatattctaagaggttggcattggagtcgccgcacatggaacttgactttgttgtggttttctctttagtttgaaaaagatccagtaatctggtaagacagcaaagcagggtgaccacttcctggagtgcttctggttttggggttttttgtttgcccttggatggcatgcggagaaggtagtactgcccagggaagtctggaagcttcctaggtggtgacttgtgtaccctgtggaagaagagggtgtggactctggcccccgcagcctaaccctgtgccccaccagtgtcggattcagaaccacacgcttgagggcacttgagagacctccgtgtttatgccccaacttatggattcggggatggatgagtttcgttctttaacatatatctagggcctgccgtgtgcctgacattgttctggatgcttgggatcccacagtgagtaaggaaaatcccactcttgtggagcttacgtccctgcagaggagacgcagcatcagctagtatgcgtcaggtggacgttagttacccaaaggagaataaccctggccttggccaggcatggcggctcacgccggtaatcccagcactttaggaggctgaagtgggaggatcacttgagaccatgagtctgagaccaggctgggcaacatggcgagacctcatctctacaaaaaataaaaataaaaaaatgaggtatgatggtgtgtgcctgtggtcccatttacttgggatgctgagactgcagtgagctatgattgcgccactgtactccagcctgggtgacagcgcaagaccctatctcaaaaaaaaaaaaatttttattctggtttgcaattataatttttcagaggttgaagaggcttggcagtgctgggtttaaattagttgtgcaatttagtgcttttcccgtcatcatagatgctgtgggtttcaaatggcctcaagtcccggctggattttattctgcggatgacacttgggtaggggagtagataaagaaaagctggtgttgagagaggattccagctggaatcctctccctgtagtgctgtgggagatgtttctgcctgcgcgagatattattcatgagcaaaaggagaaagttgagccatttcaaggttccttctggccttgaggtgctgtgggtccgattgcaagcctgtgggttttctcctctctcccaggactcttcagggaggcctcagctctaccagacctcccagtcccaaccttcactccttctccttcctccccttccttggagaaaaatgaatctgcagaaatgttaggagacaagaagcaagtacacttgacccttgaacaactcggggtttaggggcactgaccagccccctcccatggaatcacatccacatataacatttgactccttaactactgatagcctattgttgactggaagccttaacggataacatcagtagttcatcagcatgtatttcgtatgttttatgtattatatactgtgctcttacgataaactaagctaggggaaagaaaatgtttagaaaatcataggaagagaaaatgtatttactgttcagtggaagtggattgtcataaagatcttcatcatcgtcttcgtattgagtgagctgaggaggaggaagaggaggggttggacttgctctctcaggaggtggcagaagtggaagaaaatttcctgtaaatggacctgcatggttcaaacctttgttgttcaggagttgactgtatacgccttctgatcatttgttttttcccaagacggtcttgctttgccgcccatactggagtacagtggcatgatctaggctcactgcaacctccacctcccaggttcaagcgattctcctgcctcagcctcctgagtagttgagattacaggtgcccaccaccatgcctggctaatttttgtatttttagtaggatgaggttttaccatgtcggccaggctggtctcgaacttctggtctcaagcaatctgcccgcctcggcctcccaaagtgatgggattacaggcgcgagccactgcgcccggcctggcttctgatcattattaaggacttcacatgattccccttagtacttcaaagtcaggtagattttgataaggtccttgggcgctagttttataatttcaggtcataagggttcgtcctattttctcttgcaaggaaaatgaatgttggggagagaacgttgtcgtctgaatgcttttatgccgtctgcagtaacctctctgagtctggaaccattttccagtaagaagtaggtgacaggctatcaaaataaagagtaaccttttgaaagcacttcagtgcagcactgtgggctttttataatcttgacttgtgttttgtgagaggagagggctgagctaggtttgtgctctgctcctccccctccccctctccccaactgtctttgatctgtgaagcttgtctcatccttagccaagtctgctggaactttatccagagcaggaaaaggggaaatagttttcctttcttgggtggatttgtatttatataaacccttagcgagcaaaatggagccaagtggcacacgcgtctgcagggaggcgtggtgggacgagtgagtggcgggaagaggcggctttgacttgggtcacatggtgtcagacctttttagggtcagtgaggagaggatggtgtaagtccttgtgcacattttcttaaggacatacttacatgtaggaccattgtagagcaacaaagggcagggtgtgtgtgcatctcactgtatgtctatatcaccaagagcagctgtctccaaccttgttcggcaccacagactggggttggtgggatggtttcatgatgattcaagtgcattacatttgtcgtgcactttatttctactattattacattgtaatagataatgagataattatacaactcactataatgtggaatcagtgggagccctgagcttgttttcctgcaactagctggtcccatctggtggtgatgggagtgacaaatcattaagcattagattcttacaaggagcgcgcaacctagatccctcacatacaagttcacagtagggtttgcccactcttatgagaatctcatgctgccctgatctgacaggagatggagctccggtggtaatttgagcaatggggagtggctgtaaacagatgaagctttgcctgctcacctaccactcacctccctctgtgctgcccatggacgcgtaccagtccatggccctggcgttgggcacccttgctatagagtcattcctccaacccttatttgcgggggatgctttccaagtaccctactggatcctgaaaccaccaatggcaccaaacccaattgccatcaattggaaaacgtttccggtcatatcttttgcccacaaatgtaatgtctttttcatcttaactaagcacttagcaggtgctgtaaccataccttttgcagtttgaggtgtagcagcaaaactagcatggatttatttttcctttttcacagtttcacagaatattcattctcactgtagatctggtaatttcagcatgcaattttttttctttccttattaagtcaagacctttcagctttttactaaagcacttaacagcttctctttggcagatccaaatcgccagcatcactactcttacactttcgggccattatgaagtaaaataagggtgacgtattaagcactgcaacactttgacagtggatctgataaccgagaaagtgcctaagtgatgagcaggtggggagcgtttacagcgtggggacactgggcagaggagggttcccaggggagcgtctacagtgtggggacactgggcagaggagggttcccaggggagcgtctacagtgtggggacactgggcagaggagggttcccaggggagcgtctacagtgtgggggcactgggcagaggagggttcccaggggagagtctacagtgtggggacactgggcagaggagggttcccaggggagcgtctacagtgtggggacagtggacacaggagatttcatggtgctggggggtatggagctggacaggtcgagatttcatcatgctactagaatggtgctagatttaaaactgatgattgtttatttctggagtttttcatttaatattttcagacccagattgatggctggtagccgaaacctttggaagcaaaaaccacagatgatgggggaccactgtatatctaaatatatcactatatatagtgatacatacagatgaatgacaagttcaagttcattttgctttttaaattgttactaagagaataatgttgtagaaggccttagctctcctttgcaacattgacctcggaagttttagctacttacagtgtgtcccactattaatttacttccttgaattagtctcagcctttcacaccagctctggccacttcttgtggatggtgaggtttttaagtgtgcatgccatccacgcgaatgccttcttttcattgtagggggtacagggaaaactttccctttgctctcagaagaaggttcagtgaaaatcaactgatgaaaggcaaattaataagaataagaagattactaaggcaaataaatttattaacattcaaagggaatcacagtgggatacagaagctatacgctttttcataggggagggaagagatgagaatgtagacagctcttttgagaggcagtaagtgaggattagggagaatgaatggaccacagagaccgaaatgaaattgtaagtgattctctttggaatctgaatgggcctgagaggcagacattatctcgggaaaatgtctgtcaggtgtggtcacattcgtcaggctttttttctgagataatgagattccagggagggcatagaaagcatttatgtttcttttggtgagcgctcttggtcagataaggacgttccaggaatagtccctgcccttgtggtttggggaggcacaagacaaggttagagggaccttcattctgaggcttacttcaggggccgctcagctttcaaaagcgcccagcgtgctcaggtgccatattttgaggaatgattttctatacccccaacatcataaaaccacctcattgaagcttcaagtggtgcctcatggttcctttctgtgttttctttttttttttgagacagagtctggctgtgtccccagggctgtagtgcagtggcacaatctcggctctctgcaacctctgcctcccgggttcaagcgattctcctgcctcagcctcccaagttgctgggattacagatgtgtaccacctcgcctggctaatttttgtatttttagtagagatggggtttcaacatgttggctaggctggcctcgaactcctgacctcaagtgatctgccagccttggcctcccaaagtgctgggattacaggcctgggtcaccggacccggcccctttctaggatttttagaaattccagagaaatctcatacaaaatctagagaaagcatctattgttcttgtgttattgcaatttgtatagtatcagggttaatctgggactgatgaagatgctgagaacagtaagtttaaagaactttgatatagaacaatattttactttgctattgttctgtcttttagaaccaaaaataaagcccttcttagtaggtgactcagcttcctgcaacctcgctggggaaatttctccaaatattaatgcatgccacgtaagccaggttcacttgctggccctggatgtttattctggcccccagttatatttattttgtgtctggtagagcctcacacttcaaagtggaatgctcctgaagtttctacctggcctctcatcccagtgttgtaatggacacttggggaaggaaactccccagggactctggagatgccaagactctgacgcttttgcagcaggtgggcgtcccgtgaggaagagtggcttggaggaggggagatgggctctcctgttgcaggtattagaaacagagaaagcaggaggaagaggaattgcaaataaccaggcatgaggaagacgtagggaacaatgctacagaggattggatttgtatgaattatttttaaaacaaaacaaaacaaacaaacccccaaacggccaggcacagtggctcacgcctgtaatcccagcactttgggaggccaaggtgggcgggtcacctgaggtcacaggagttagagaccagtctggccaacatggcaaaaccccatctctactaaaaatacaaaaattagccagtcatggtggtgcgcgcctgtaatcccagctatttgggagtctgaggcaggagaatctcttgaacccggaaggtggaggttgtagtgagccaagatcatgccactgcactccagcctgggcaacagagtgagactctgtctcaaaaaagaaagcaaaacaaaacaaaaaaccctccaaacaaaaggttgtcatgaaagggaaatgcagttgacccttgaacacacacgagtttgaactgtgccggtccacttacagaaggattttcttccacttctgccacccctgagacaaccagaccaacccctcctcttccccctcctccccagcctcctcaatgaacagacaatgatgaggaagacctttatgatggtctacttccacttaatgaatagtaaatatattctctctcaagattgtctcaatagcattttcttttttctagcttattttattgtaagaatacagcacatgctatatgtgacacacaaaatatctgttaatcagctgattacattattggtaaggcttccagtcaacagtaggctttttgtagttaagttctgggggtggtcagaaatgatacgtggatttttgactgcttggggtgttgattgttcaagggtcaactatataagcttgtaatgtgagggaagagactaaattctggtagagatttgaaaaatagtagcagttttttccccttggctttctgtggttgaacgtttaccaaatgcattggaagggccgttgtgatctgaggcctcagctttttgatctagaagagacctgactgatgatccctcaaggggcccttggaccaactgcagctcttcttggtttagcaaacctgagatcatttagtcatccccttctccctcctatctttcaaaccaaaaaataattttaacaaagctttatgtaattagcaagcaaacattactgtcaggacgatcgtcttctgccaggagttgggctaaacaaggaaaagctgaggtcatgggctccaggtggagcacctgccatgaaaggaaaactgaaaggcgcccgtcatccgtgcccagtgtgtgggcctggcacggcttccctggcgttattcattgggagaatctgagaaccattgtgtgagtcgcagaagtaatcaagagtgtggccttttttcttccttctgcctataactatcaccactttggaggatgcttggaagaagtggaagaagccaagtgctgacactgagtttgtttagtgttgcctagtgaccaggccatgaatactcactgaagataggtgctgagggctttctgatttaagggcatctctgagaggccccaactggcctggtttatttaccctaccgattgtactctgtgactgctaagacttcacaaatggtttccaaagcttcaagacgctgaagggtgtttatgaatgttgtttttttgtttgtttgttttttgtttattttattttattgaagtttcagcattcaatatcaaaaccggacttgagaattccacaaatgcctgaaaatggaaatttccttacattgttaaattgcccagaactcagtggattcctacattttgaagagttgcagagatgtgtgctgaaaatgaaaacggttctaggagagggtcataatttttgatggtgtaagtttttgtagctgtcgttggaaccataccttacgatatattcaattatcaagtgagcctatgagtttgagtcgttttgaaaaggaatgatatctgtggggcactggttccaggacccccatgggtaccaaagtctttggatgctcaagtccctgatatccagtggcatggtatttgcacataacctacgaacatcctcccggatgctttattttattttagtttagttttctgagacagagtctcactctgtcgcccaggctggagtgcaatggcacagtctcggcttactgaaacctctgcctcctggattccagtgattctcctgcctcagcttctggagtagctgagattacaggcatgtgccacgatgccccgctaatttttgtttttttagtagagccgaggttccaccaggttggccaggctggtctctaattcctgacctcaggtgatttgcctgcctcggcctcccaaagtgctgggattacaggtgtgagccactgctcccagcctcctcccttactttaaatcatctctaggttacctataataactaatacaatacaaatgttatgtaaatagttgttatactatttttgtttagggaataatgacaagaaaaaggtctatacatgttcagtacagatggaatttagttttctttttctttcttttttttttttttgagacagggtcttgctctgtcgcccaggctggagtgcagtggtgcgatttcggctcactgcaacctctgcctctcgggttcaagcgattcttctgcctcagcctcccaggtagctgggattacaggtgcctaccaccatccctggctaattttcatctttttagtagagaatgggggtttcaccatgttggccaggctggtcttgaactcctgacctcaaatgatctgcccccacccctcggcctcccaaagtgctggtattacaggcatgagccaccacgtccagcccaggtgcagtttaaaaacaattttttcgacctgcagttggttgaatccgtggatgcaaaactcactgataaggagggctaactctgtaattgagccaagagcaaaccttgttcacaggaagaatgcaacatccctacagttttggggaaccactctttgaatccccaaaaccccttaagagtatatgtggcttagtggtagaatatacctgtgggtaccccagctgacttgttagtggctatgcaggaagattgttgccaaatctaccgatagcctgcataccttgggtaagtctcttgcaagttcagcagcaactcagcccctttaaggatgttccacctgccttccccatgaattcagcatcccgtgtgggtggccttccagggaccacagctgttgcctcatcatgtttcccagaaagttctgtagcctgctttccgcacagcctgctccttcaccccccaagatagcttcccagggaatttgttggcacccagaggacagtcccctgcctgctagctttggccagctgatcatggacagtctggcctagggcagtccagccagcttctccaccatgcaaggagctgctccataccctacccttcattccttgtaactgggtagcttataaggaacagaaatctgtttctcacagtgtgggaggttggtaagtccaagatcaaggcaccagcagatttggtatctggtgaggggtttctcattcacatatggtgtcttctcgccatgtcctcacatgcgcttgtatgaactctttgtgtatttagaagagtaagcctttagagaatcttctcgtgactacagtaatagggtcaagtacttactaggtgccagatacagtgttcagtatgtttcgtgtatgtgttacctaatttaaacatcatgctatccttgacacaggatatctggtagtgatgagtttagtcagtcctactgtcagagttcagcacagccacttcttcctgtgaccattggcaaactacctcttgcatctgagcctcaatttcctcttctgtatataatgaggataataattgtccctcccttctggtgttgttgtgaagactgagatggtacataaacaacattaagccagtaaaaagtgctcgctcaatgtcagttgctgctgtggtcatcttttcttcttcctggattaacttaggcttattttgcagtttgacatacattacaccatgatggtaaggtaaagtgcacgcatcgttctccattctgataacaaaagttgctgggtccttcgtctaagtgttccccactctgaagtctttcccagtcctgtgaatcagtatgaatctctccttctccgaactccaccagcatctcctgtaaatttccttgggggcctcatcatacaggactgtagttctttgcacacctggcctcccctgtggacactgggatcctccatggtggaggctgtgccctcaactctcagacccctgcgtcttcttcagtcctcacccacagtaaggtctcaatagttagttactcagtgaaataatgcactttattttgaagatcaagtttatgttcaatttgagaatgattagcttctgttttgctagatagcacacaaataaaccattcttcatatgtgagttaagatcattttgaaaggaaaaagctgtttttcttatgttcttaatctaggaactgtgcacgtttcttaaatcctgaggatactggcaccgcgtagtaggttgttggagtatacaaacatgctggaaactgtggactgttctgcttgctgctcagtatttgttaacatcaagtgaatttttcacatgtgtgaaacttctcagtgccttccaccttcgtgctctgtttccatggatggcagtcctgctagagataagacccaaacaaaaccagttacctggctctgtgtgacgtggacagtctggggtacagttagagttgataatggaggcttaatagtctgctgtacattctttctttctttctttttttttttgagacagagtctcaccccatcgtccaggctggagtgcagtgtctcaatcttgggtcactgcaacctccacttcccaggttcaagcgattctgctgcctcagcctcctgaatagctgggactacaggcgcgtgccaccacgccccactaattttttatatttttagtagaggcggggttttaccatgttggccaggatagtctcgatgtccggaccttgtgatccgcccacctcggcctcccagagtgctgggattacaggtgtgagccactgcacccagcctgttatttcaaattctctggcaaaatgatctgaccaccgaaagctgtgacatactagccaagaagcctgctgcaccaggctggtgccagggatgggtgctgaggacaggggcttggcatctgctgttgttattctgagtgtccaggcagataaaagcaggtggagctggggcctgtgtggaattccaaccaggagagagttttcaggggaaaccaaagaagctgcatctgtgttcaagccctggggatgattttaggacaaaagtagaacttgaagataagcaggcaaggagctaggtgagggcagtctcagaagtaagagtgttaagagactggggtgcccacagcaacttctcgttggagtcctggcccctgtggtgcatggtgggtgggttggtttacagacctgcagctctctgtgggacttggagcaaatctgttaaactcagagggcttctgacttactagttgatgtttggactggatgccttccaggttccagtctagctcgaacatgctgttacttgggttcattttattactttgataagcatttaacatttacatttttaacttgcatttttatatttgaggatcttttcctagctggtgtttgaagtgcatttttgatatccacatagccatgctacaagctaatgatgctaaattaacttttgtagcagtttgctgtttacaggagtttggttaaggaactcaaattacattcacttaatattgtgcgacactatataaaaatgtacacgtcaggaaattaatgtttttcataaaagtatgccgcttagttcattaattaaaaatagcgtttttagattgctcatttaggaaagatgagttctggcataaagaagcagtccctgctttggggaggcattagcctgggggcaaagagtaagggccccagaagtgggttcccaagttcacatcccaagtctgctgctggttagctcctgactctgggtacatcgcataacctccctgagcattagcatcctcatttgtaaaatgaggataaacccatctagggccattgtgaagattacacgaggtgtacatttaaaactgcaggcccagtgctgatatgggcctgcgctatcagtgtggcctttgcgggggatgagacatttagaaatacggtgtttttgttttcttttgctctttgagacggagtctcactctgtcgcccgggttggagtgcagtggcctgatctcagctcactgaaacctctgcctcctggattcaagtgattctcatgcctcagcctcccgaatacctgagattacaggtgcccgccaacatgcctggctgatttttgtatttctagtagagactgggttttaccatgttggccaggctgatcttgaactcctgggctcaagcgatccacccgtctttgcctcgcaaagtgctgggattagaggcatgaaccactgtcccagccagaaatacagtactttgaagcaaaggaatttcatatcattatacgtcagcagatacagtggtccccttatccatggtttcactttctgtgatttcagttacctgcaatcaactgtggtccaaatacatgtgaatgcagcataataatagtttttgagagaccatattcataaaagtttaattattaatacagtatattatcattgtcctatttattgttgtaaatttcttactgtgcctaatttataaattaaactttatcataggtatctacttataggcaaaaacatagtctgtatagtcttcggtactgtcctcggtttcatgcatccgctggggtcttggaacgcatgtctgagggataaggggggactgctcttctttggagtctctagaatttcttttctttttttttttttgttgttgttgagacagattctcactctgtcgcccaggctggagtgcagtggcgcaatctgggctcactggaacctctgccttccgggttcaagcgattcacctgcctcagcctcctgggtagctgggactacaggcacctgccacaaatgcctagctgatttttgtatttttagtagatgtggagtttcaccttattggccaggctggtctcgaactcctgaccttgtgatccacctgcctcagccttccaaactgctaggattgcaggtgtgagccaccgcgcccagcccggagtctctagaatttcaagtcagcagtagaagtggttggtgcagagagttgaagttgtaattgcagtagtgtctttccccagttggtgtacatttcacatccttgatttggttaattgactttctagaagccagacatggtggctcacacctgtaatcccagcactttgggaggctgaggtgggaggattgcttgaggccagaagtttgagaccagcctgggaaacatatcgagactcctgtctctacaaaaataaagtaaaaggttaacatttagccagatgtggtgctgcatacctgtggtcccagctatttgggagtctgaggtgggaggatcacctgagcctgggagattgaggctgcagagagctgtgattaggccactgcacttcagcctgggtgacaaaccaagagcctgtctccaaaacaacaacaaaaaatttagttcctaggtttaagtagggcagtttgaacaataatgtgtcccatctgcagccaggagctgtttcttgagtactctctgagaaagggcagggtgccctgggtatatggatgagagaatggaagtcatcactgcttttagagatgtaatgatctagttgaagagagattacatccagggcatgcagagtaatagcgttcctttaagtattgtggtgatccattaggttaattatgtgtttttgctagactcgttagatagtgttgtgtcgtgcatctgcttcacacatacctatcagggcaatccccttgcccagaggaggctgggctgatcttaggctgtttgtgtttttaacacttttagtctgctgtgtttccagatcatttatatagggctttgttgaatggttgctgtggtctgcttgagtcccatctgccccaaatcctaattatgaacacctccttggcagcccttgcttcggtgggctctggggactctggctcagtcgttgatatctagataaagatccctggagtcagtctgttaaaaggaaggtgagcagagcagtgacagatgctgtctttgtctagtgtgggccttcctgccataaccatgaaaattttctccacggtgacgcagaggaggatttaggcgctggagccggcgcccaggcagttctgctgttcttggttgcacatttgttctcacatccttcgttgcttcacctctgcccttctccccctgcccccatccccgggcagtgctgtctttgtaaaatgagcccatttttagtgcacatctccctaacacgtttttctctctcctcctacaggggagttgctgagtcagcccagaccggaaggagtggcagagatcatttgccccaagaacggcagcgagcgagtaaatgttgccttggtttacccacccacgccgactgtgatcagcccctgttccaagtgagttctcaaagtccctctggccccgggacctggctcctgatcccagctccatagatatgaccacaaaaatccaggttaaactgcatctgcacaaaccttgcaaagtcctcctgaacagacataattcttctggatgacatcagcatcatgatttatgcagcaaaacaggaacttttatttcctcttttttgtgatttttttttttttttttactttagctaataaagtcagaacattttttaacagcctttttgagatgtcattcacataccacagttcacttacctaagtgtacagttcattggttttcagtttatttgcaggtatatggaaccaaaaagaacattttttttgttgttgttttttgagatggagtctcgctctgtcacccaggctggagtgcagtggtgcgatctcggctcactgcaagctccgcctcccgggttcaccccattctcctgcctcagcctcccgagtagctgggactacaggcgcccaccaccatgcccagctaatttttttgtatttttagtagagacagggtttcaccctgttagccaggatgatctcgatctcctgacctcgggatccgcccgtcttggcctcccaaagtgctgggattacaggcgtgagccaccacgtccggcctttttttgcctttttttttttttttgttttgagacggagtcttgctctgtcgcccaggctggagtgcagtggcgccatcttggctcactgcaagctccgccttccgggttcgggccattctcctgcctcagcctcccgagtagctgggactacaggcgcccgccaccgcgcccggctaatttttttgtatttttagtagagacggggtttcaccctgttagccaggatgatctcgatctcctgacctcgggatccgcccgtcttggcctcccaaagtgctgggattacaaaagaaaatagttttttgacgggcagtcttaactctgtcattgcagaatgaagttggctctcacatcaaaaaccagcgcaggcccattccatgagcaaagcctgcagaaagtcagtaataggccgttttctgttgcatggttctgattgcggagtcagtccctgaaaatcaagggctgtgcagtttgccaccaccttgccccaaaatggacttgaagacagagaacgcacacatgccaagtaactttcagatagaacattgggttactactattctagataacactcatcctgttggtttgggttttatgtatgtgtgtttttcgttttgttttgtttgtattaagaaccaaagaggccgcttttaagctgagatgaaatgcctgttacttcaaatcctgaaaagcagcagccacagatcttcttgggtcagatctcatgatctgggtgatgtcagcaccatgatttctccagcatagtattcatatccatgcagcaaactcgactctttcttcctagctggccacatggaattttttaatgaaaaaattatgtatgaatctaagcctgtttttagggagcttggaaagtgcgcctttgggaattgtgacctgtcatctcctcttgggaaacttgctgtccggctgcattccaggcagtgtgacaggcatccatctcacccctcacatggcagcttccctgcctttggtgtgctccctgcaaagcgagggttcccagtggcattcttactcattagctgctgcagtagaagtagagggcactcggctcagtgccccgtttctccaaactgggaaactcattacatagaacatccctaatctatccttgctggaaaatatcaccgaacacccaagggaaactgttatctaatgctcttgtattcagagtactatttaactatcatgtgcatagtttaatttatcactgaccctaagacattgtgaatcttgaagtgcttcttaaatattaaaataggattacagaataactgttaaaagtaattgcacaattacttttgcaccaactgaatattaacctgaatatcccctgtcctgaacatatcaaacaacggaaattttattgtttctcttttaatttctttgaaattgtacatattggtccctttctttcagatacacctgggtgaggatggataaggggatattatatgttttctttttcttctgtctcttttttttaataccccgcaagttcttaaagctcaaggggatattacagaaccagcaaggtatgaaacagaggaaacaaaaattcaatatactttgcattggcgtaaactttccagagccaagagagacatgaacctattgttttgccatagccaagtgccgtcgaataggtgcgatagaggtaggagttaaaatatccatttgcgctagaaaccttcctggcaccaagccagctttatcagtgttttcccatgggcttcttgtactgccgcagaaagaccacgtttataccaacctgaaaaaaatgttatcagcctctctctcgacagcgtattgaacctgaacgaacaagcagcctaaagtcatgggtaagcggcggtacatggcgccagacatccaaatgccgaggaagcctctttaggcattgaaccacttttgacctagctatcagaatcattttattttgaaagaggttaaaaaaaaagtctcatgaaatggatgacagctttgcaatataattctcaactctaaatgaaggaatgttctctaagtagggaagtttcatattcctggcaagacgtttcttggaaaattaccatattttagtgcagctgcaaggggtaaatgatctcttgtgtgactttatagaaaagcacacgtagatgtgaagcctgtgctcgagctgcccagtgttcccccaccttcaccgccttaagcacccacagtttacatccatgaacacatggacaaaaacaaactcatgtggaggccgggccaggctccggggaaggtcccattcatgggtggttgacagtggattggaagcgggagatttggggggatcggttaggatagctggcaaagaatctgtgcttaagtcaacacagcttgggcctgagcctgagacttggggtctcagcaggcactagacattggaagtccggggctattgcactggctttcaactccagccgaggtaacttaagcaggtcaccatagaggtcaggcttttttttttcttttttgacaaagggtctcactctgtcacccaggctggagtgcagtggtgcgatctcagctcattgcaaactccacctccagggttcaagtgattcttctgcctcagcctcctaagtagctaggactacaggcgcacacaaccacacctagctaattttttgtattttttggtagagacggggtttcatcatgttggctgggctggtctcgaactcctgacctcaagtgatccatctgcctcagcctccgaaaatgctgggattacaggcatgagccaccgtgcccagccaaggtcaggctttcttaatcagacctgttaagttagaatttctcagggaagggaccaggcatgagtcactaaaaaacagaagaagccacccagatgagtctaacgtgtgtacacgactttctgatggttcagttccagtccatgcctctaagggtgggttccctggccagtggggccttaggactgctctgtggtcaatacctgctctgcagcacaaaggcaaaactgtccatgctgtctgctctcagcctcagcacagtccctcccactctcaggtaaggtgaacatatcactcactgttcaaatcaggagaggattgagagtgatgggacggctgtcagtcatgttgggatgatgggtgccctagagaaagctcccaggtagaccagaataattaccctaggtgattgctggcttttgtggggcttaggtggctgatctggatctcatgatggtttttaaaaagacattccaagctcttctttggctggtttagccctctcctttattggtcaaatcagagacttgtcatttaactgcctgtctttgactaatggtgctgcaatgctttctttataaagaagaaactgtagatgactgttacctgattggccttttttaaatgaattccaagcttttctatttcttattttaaacaatttgtagacattttattcccccatggggagagacagagaataagaagtaggtagtgatatttttttttttgttttaacaacatgatttactcttataacttgtctcagtggattggtggttgaggtctccaccagcgtttcattgggaagaggtttcaggaacaggatgaaatgcctccccttctgcacctcaccctccagggagaaacaggagctgagtggcttcttctcccccttgctgattatcagatagaaatgtgagtcatttccatgctttgaatatcttgagatgattttcaaggatatctgcatttaagatgaggtgaacattcacctagtagcaaatttgcctgggtcgctctgaaaaattctggcctcctcaaggatacagattgtgacagatacatttttaaaagctttattgatgtataatttccataccagaaaattcacctgtgcaatgattactaacgtatttgcagagttgtatttatacaaccatcaccacaatctaattttagaacgttccttcaccccaaaaagaaatctcctgcctatttgcagttaacttgtgtcttatccaacacctagttcatgcagtcagtaagttttttttggtttgtttttttggttatttttttgagatgaagtctcactctgtagcccaggctggagtgcagtggcgtgatcttggctcaccacaacctccgcctcctgggttcaagcaattcttctgcctcagcctccagagtagctgggattataggcacacgccactgcacctagctaattttttattttttgtattagtagagaaggagtttcaccatgttgaccaggctggtcttgaactcccgacctcagataatctgcccgccttggcctcccaaagtgctaggattacaggcgtgagccacgcgcccggccaataaatatttttagtgtcactttcaggaatggttttgcaggctggtgtgttagtatgaagcagatttctgagcttttgttttgggacagagtctcactccttcacccaggctggagtacagtggcatgatctcggctcactgcaacctctgccccctgggttcaaatgattctcctgttatccctgccgagtagctgggactacaggtacatgccaccatgcctggctaatttttgtatttttggtagagatagggtttcactgtgttagccaggatggtctcgatctcctgaccgtgatccgcctgcctcggcctcccagagtgctgggattacaggcgtgagccaccgtgcctggccgatttctgagttttaaagaggttctcataaacacgttatccttggcacagttcagtctaaaggcagtggcttgtcttgctcctgccactgccagccccctatttcctggatggtggagaggagctggagctgcttggagagctcctcctttagaacttcttcatggcagcctaattaggccctagatatttcaggggtactgagccttgacattaggagtcaaaagatagggcaaacctatacttcccgtgggcaaggtaggaagcaagtagaccgcattatcttttaaagcttttatttgtgaattcctgtctctgtccagctactcttcaggttgagacccaatattccatttcccagggagtgtgagcttctctggacaaatggcagcttgctggttgcgtttcatttctagggttcctgcagaatgcttctctttctccttctaaagagctttagagcaaatccgtcctccaccaaactgaagactctttgataacctgccagataacccagtttatctactgatttttgggtaaaagaccaagcaaattcaacaggtcatcatatgaaaatgttttaccttgaggcattactggaatgcgacccacattctaacatgtggtttcttaatggactgacccttgaatatacaggaaatgggcatgtgtcactcttatttcctgatggttgacgtttctcctgcagcgataccgtatctgtctgtgctccgatatgtggggaatggtgggagttctgagactgaagaagttagttcattctgattttggctgatcatgtgttaacagaattagcaaaaaaaaaaaaaaaaaacgggtggggtggtggtttgaaaatggttgagctaagctttctccttttttaggaagtactaataataatagaggggaaggctgagttattgcatttcgaaatacccttttaaaatcttggattattgcctctatactgtagagttcccattcaagcaagatccccactaaattccagttacttgctagctgtttgtaagtattctcagaagtaccgtggttactttgcacaggaattttggcagtaacatcgttttgacataaagacatttaagaccagttgcagtagcctttcataaaaagcaggatgaagtctgtagcctttatatcaccaaataaacaggccacgtatgcctaacagcacacaaattagcatgaacttgataaaatatttttaaaaagcagtggcgtgatatgaattaggcttcatcacaatggagaatttttcactgaccacagaattttaaaatatagagggtgaggatgggatggtattttataagaaaaggccacatgtggaggttgcctgtggggtgtttcacattgatttgcattgatttgttttgttctatgcaaggagtgaggcagctctttgccttgctgttttaacaagctaggaggaattgtgtttctttaattatttagtctcccgtcagccacattgatactggaatttttccctctctgcttaggtatcttcatactttcttggaaaattaagtggaaaagatagtgcttcttttccttatgccatcatttttactgtacccaaactgtgactttaggagcaccaatttttaagggtaagtctccgtgaaacagagagaatttcttaaataggtaaggccctcttgaggactcagagagattaggggggatatgggggtgttgggatgaagagattttggagaacaggaatcctagacaaaccttatacatctctagaatcaagttgcatatgggaattaggaagaagggaactgcttgattcttttgcttaatttactatgatattgcatagacagtgatcttagatccttgttcaaaaaaggaagtcatttttgaaaaatgttaatattatgcagaaataaaacatcaagtgggtccacaccttcaggaactacacaggaaagtaccgggatggtcacaagtagggaaagggagggactgggggcaggaggggagaggggaggaacgggcaaggccgggtaggcaggtctaggacaggcttatttgaataatctcagtggccctggggcagaggggttgccttagtcgtctggcacctggctcaggggtgattagggcaggtggatggtggcctggagtgtgagagccagtaaaggaggtgttccaggtgtgggttcaggattagttggtttgtattggaagagtatactccgggcaaattgttttaccatctctaggaattggctaatcctaggaggggcagtccctccagagtttgcaaggtccggagtaggaaagcaccagaatacagaaaataaaagacatggttaatacaacatgccatggcttcagtttcagcctaagtgtctcggtaccttgcgtcataatttctttgttgcatcctggaagggcagatttcaattccctaacctgggaggactcgggggctgggtgccccccaggctggaccctcccttcagccccagacctctgtttccaatgtctcacgtggcatcatccctggatgtctgtaggcttcacaggtgtacagctgaatttattgccttcctcccgcaaagttcttcctcagtctgtgacctgtcttgggtaacagcgtagctttgtaccatcggctccaagctaggagtccgtaagcctcattgccttcctctgctttcttccctatatgtagtaattctccaacaccttttatcccatctcatctgtgtcgtgacatgaatgaatttgacccacatcttcagcttcagcctcgggcttccctctagggcccaacccccccagccaccacttcccccgtctctgccaaggttcctgtgactgagtctcagctggctgcctgctctcttatctttttgtccttcaaaccgacaataattgtcttttaacatcagacctcatcacatctctccctgttgaaaagccttggatggcttcctggtgatcacaggctcaagttcaaactcctggccgtggctcacaaggccctgcacaatcagacccagccactctgccaacacacagatactcccttaccatgggaggtcagccgtggtgggccgtggctgcctctcagtccactggctggctgctgcccttctctcctacccagttaaggcccattggtcgctgaggccaaggtcatatgtcagctcctctggggagcctcccgtaaccatcctaactgtaaccagtcactctgttcttcatgtctcctcaatactttttgtttctttgtttgagacagagtcttggtctgtcacccaggctggagtgtattggcacaatcttggttcactgcaccctccgcctcctgggttcaagcaattatcctgcctcagccccccgagtagctgggactacaggcatgcaccaccacgcctggctaatttttgcatttttagtagagacagggttttgccatgttggccaggctggtctcaaactcctgacctcaggtgatctgcctgcctcagccttccaaagcagtgggattacaggcatgagctgccgcacctggctctcctcagtactttttatatacctcttttggtaatgatctcatagtatcttggctactttttacctgtggctttttcatcacatctgacccatcattcattcaacagatctttgttgagtaattatcctctagtaggcattgggccgggtgttgaggatacataaagaactaaatcaaatcctgccctccagaacctaatagcctctttggagaagataggaatcaaagccataaccaggcaaacttatcagagtctaattataattgaaacatggtacctgccatgataggtgtatgaacagagtcttgtaagcacagggaagaaagaactctaccaggaagaatcaggaaaagttccaggaagtcgtacttgagatggatcttgaagaaggaggacaagtttatggagctagagaggtggggagaaacagagaaggttggtgattttgatggttgttttctctaagatcccaaatgtggaaaaaggcatatagatgtgaaacaattttcaagctggttgaacagtgggattttccgtctaggtgtccttgattaggtattcttgtgtttctcagtcttacgtgtagcccggggagcagactgtctgcatttctgaaggtctgtcagattcagtgggaaaatgtttatgtaacacatctcccacgtgaacccaaaactcacaccaccaaagttagctgctaggttgagacgtgtgtttttacactggcgtcctccttacagttagattgattatattattagttgaatttgaggcagttttcaaaaccctctcttctgggagtttactatattaataggcattcaaaaaattctcgtggcagagtgccttagaaatgtgaaactctttcctagggctccaaatatccaacttctctttgagctttggagtcagatcaccctagtgaaaggcctggctctgtcactcgctagtatgcacccttggggaagttatttcatcttttggaaccttagttcccttcctagtaagatgctgaggccgggcgcagtggctcacacctgtaatcccagtactttgggaggccaaggtgggcggatcatgaggtcaggagatcaagatcatcctggctaacatggtgaaaccccatctctactaaaaatgcaaaaaattagccgcgtgtggtggcgggcacatgtagtcctagctactcgggaggctgaggcaggagaatggcatgaacccaggaggcggagcttgcagtgagccgagattgcgccactgcactccagcctgggcaacagagcgagactctgtctcaaaaaaaaaaaaataataataatactgagtaagatggagcttacatggtgggattattaggagttgaagataaataatgcactagagtgaacaacctaattcctggcatgtagttagtaaatgagaggtttttggtttttttgttttgttttgttttgttttgctttgctttgctttgttttggtgatgtcgttattatcatgcttgaatgagcccatgactgaatcttgtatggactggagaagtgtttaggcagatgctgaattatcagtgtccatgaaatcagcgtctctcctaatgagagatgggggattggaggaaacgaatcgtaactcctttttcctttcctttcaatgtctttgtatattttattaaaagttgctaaaaaaaaaaaaccactttcaaaaacatcccatcacatgtcattgtagggaagcaaaaatgagaaaaacacttgatattttttcctctaaccattttatcggaactgaatcccgctttatttgctgaggctgcagtagtttattcattctatattgatcagactccagatttgcgtggacaacttaacttataacattttaagtaaaatcatgcattttaggcagacagacatctcactttttagtatatattccttcttctagaggattatttggtgtgtgtctgcgtgtgaccgtgtgtgtttattgaaaggaaacagttccgtgtttagagttttgggttgttagttagaggtctagttaagctataaaattacagtggaataagtgatgacagccagttagtacagttccctcttatagctgaactgagcttaacacaccaacagaaatgtttggcaaatagactgctaaaatgactctttcctttgtggggacattagttgcctgacatttacatgtttataatgagtcctggaagtagaaatgaaaatatgtgcagaaaatagatttctatcatcacttccttttcttattgagggtagcattgtccagtacgtttttgtcatctctgtgctttcttcttgtccacccatacaggaagaatgttggtgaaaagcacagaaaccagtgacgtttgtggctgtggaatttccatggagaaaagagagcatctgaacacctggaccatcttttgcacctggcagaccctctgcactcaccccagcgtgttctgtgaacttgagtgacaacgcgtgcttgcagggtgctttttggatgactggggaagaggtggggagggggtggtggggggaagcatggacgagaacatggagcaaatgttttacaacctgaacctcagaactgtgatcctccaaggagcgcgctacttgaagaaaagaaaaaaaaaaaaaaaaagtcgaatggcttctcagggattttgttttccgtgcacatataagccatagttacagtacaggtggcagtatttagagcactcagatttcagttctgttaaatgtgaaagagggatcgactgacgttcattgctgttccataactagtgtaaaatatgtatatgtttatctttatttttataatatgcaaatacatttaaatttatacagtttgaagcttctagcgttagttcacactgggtgcaatattctgcatgagaactgtgccaagatggggctgatttcttattttagtataagacttttttgttttttctttattctttaatcctcttcacattaaaaaaaaaatctctctgttagcccatggattaagtgttggttcatagagattgccaataatcagaaagaaccttaaatgtgcatttaagacagtgtcccttcccttcttttcaatgaaggtccctgcctatataaatcatctggcacgctggtgggaaatcctttgctcttccaacgtgttattagtgctgggcagagatggggcacactcaggggccaaagaggacaaaaagtccatgcaaaacttgagtcttttaatggcttaagataatcaggagtcagttctgaatcttacaaagtgctctgcttaataagtaccttacttagcagagcactttgcaaacatattacttattagcagagctctttgtagaccttccacatctggctgtcagatcttaaggttgtgaatttaggctccagttatattcactggagagcataatcccacacgggttatttataaatacagagcctctgattggacggtctcctgccaagaactagtaatacccttgttttaaaatcttcacaaggtaaaacttaaaaagccaaccaaacaaattgctctccattctacttttaattgggccaaacagcatatgctacagtagtaacatgtttttcggagagtgtaaaaaactctgtttacatttgcctcctccgtgggttgatcgaaaatgtataaaactgactgcttctcgccagcctcagacaagaagagtgagttgctggtactcgctactcttttacttcttttgtaaagtattgactcttggaaggctacagtatacaaagtctcaacatgttttttaaaagaaataaggagcaagcgactgccctgctagaaatcacaaaccgatttttgtagaatattttgtgccccaggcattaatttcactgactccagaacctgcagttcagagaatgatttcttatgatgataaaaatcgaatgggatcagacgatgtttgcatttttttaatacttgaataggacacctcaagtttgagatttcattttcttttagaacacagtcacaagattaatctggtgaatccttttgtcacagttctcgtgtgtgtgtgcgcgtctccgtgtgtgtgtgtgtgcatgtgtgtaaaactgaatggtcacatttaattgctttttggaccattgaatagttgggaagtaagaattttttaattggcatgagacggttcctcaactgttaaattaaccaactttgacctgtctttagaaaaaggcttatttgtatgattttgggctaactccccggggaccatattaaatgacaaaaatgctcctttgggtgacacaccctacaaagtatttgctgttacgaacataaacgcccacattcttaatatctaatatttttgaccagtgatgttttatgctgtcatctgaaccctagagaagcagtgtcagaggaaaccttggtgtcacatgtgtcttagcaaaagggttaccatgatcgagggtcatgtgaccaaaagatgctccagagaagcttgagaatttgtttcaagttgggaggagggttggagatacaaaaatcactctgctctacaggactcttcagctgtctatgcaagaaattccgttttctctttcagcacctggaaagacacagcagcccaccgaggcgataggtgattcactaagcacaagaggaatgttttctaagcaaggcgtcccttgcctctcaaacaaatgccctccaagtttgttagggtttctattcctgcaacttgtggtatcaaaaccacttcctggaattgtcaaagcactgccaaaataaatgtttttcccccttctaagaaaaaaaaaatgacagtgctcatatttgacacttgtgtat

SEQ ID NO: 17380 - DNA, 41941 bp, Human
  misc_feature (1)...(41941): n = A,T,C or G
ttagatttctagtttggatgatttgataaaaggcaggaggaaaagtgggtttggggataaagttttagatttggtgagcttgatggacctgtgaaatgaccagaatgagtgtttaggcctgtcacttggggactggaagtcaagatttgagattcctcttgatatgggcagtagttgacgtgggaatgtgagtgacagcgtgacacaggctgtatacagaaggacgttcaggaatggtcaggaaagcctaaattgagtacagccagcaaaggagagtggtcagagtaaagaggagatgcaggagaaggtggagtcatggaaaatgaacaggaaattcaaggaggaagtgtccaaacgcaggcgagaggtcaattagaataactaaggcctgtaccttggtagagcttaggaaaacccacaaacgattatttcaatggagtagaacagattggagtaagagatacagtgaatcctcctcattaacgccctaggtgttaatactttaggtcaaaagctaggtgaattcctggagaacctccgtggatgtagtccagtttcaggcttgctgcatgaggcagatctggcttctccttgcaggactatttacccagagcccagcaaggagcttggcacattcacatgcattctttaaatattgggggaaagaatggatgaacggtttgtggccgccagaaacctgccttggtacagcgctgggcgctcccagtacatggctagctccaggaagttaggaggcctttgggagttaccaaagaagttctgttgttttggtaagaacaaattcattagttatagggttgatctggtcgtttaatgcctgtgctggtgatgatggtgataacgggtctactcaggtgggtcctgttctgaaacgtaggtaagctcttggtacagtttcagatgtgactttctgagtgagtttgctttcttagctgttttatttccttcctgtgtgaaggtgtcttatctctccaactggatactacatttctgaagggcaaggaccacttactccacaggagtcttctgtcctccttgcagcacgaatttgtccacttgatcctcagctcagaatcctagtgctcctcagcctcagttgatttaacgcccagggcaggtcacacctggactgtccgccctgcgtgactagaccctcagtgaaaaaatgtgtagttgcttcccgaaacttatcctgggcgggccgaactgaggggatactgagagctagcagtaggcaggcaacctggactcccgcagcccggccttgggtctcagtgcaccccaccccatctcactatagggttaccccaactgtctcccagtagacaggtctggggagagcctggtcctcactaatggagtgacagccaccgcaggggggggactaaggtctcccctgggatgcccacgcgagggaactgatgtaggtctgatactgagattggggggaaaaagaagaaaacacggggcagggggaggtgtttccactatcttctccctttttttgatactgatggggaggggaggtctgggatggatgaagctcctcaaccatccgtttcagccgcccccagctgctcaacttatccgccgccgctcgtgcccgcttccagcctgcgtagacccggccgtggtcgtccggaaggaaccgcgtaggaaacggaggtggggtgtcccccggcgcccccaccagagaccgcccggcgcggcaggaggatgtcggcgcgcggagggcttgcgtcgcccgcccctcccccgccgcgccccccgcccccgcccactccccgggggacccccgcgcccgggggaagccccgcgcggggcgccctccgcctgcctccgtccctccgcctccccgaggtccggggctgcctcctcgggccgcgccgggccgccccgcactgcgcatgagcgggagccgggcaagcccgtgagaggagccgccgccgccgccgccgtccattcgctgcggagccggaggaggaggggagaggcctggaggacaccaacatggtgaggcactgcggccgcccgcccgccctgccggctgggggccggcgctgccgcgcacccccgccccggccgccctccgtcccgcggcgaccctgcagccccgagcctcggcccgcggcctccgtcccgctcccaggcgggggctctcctgcctgcctctcccttcctccttcgccccttcccgcccgggcgcagccgctacgcgagagccgaggaggcggagcggagccgggcctagtcgggagccccggggagtttggggcgcggggagcggccccggtgccccttgccggggcccggcgcgggtgggggaggcgttggggcggggggaggggagggggcaacggccttgcccctgcccctctgccggctccattgtgtctggtcggggactggggtctggggttccgggtgagtagcctccccccgccccgaagccggggcttccctctccgcccggccggggagaaggaaagactttcccggcgcgcctctccctcctccgctcccggctccaataccccgcaagtctcccaggcagttttgcttggggcggggtatcagcccttttcctttctccatcacctctcgaggcgtcccatgcttttggagaaggagagtttccccggccagttggtggaggttatatttacctctctactgaaaacatgggagactgctgagcttgggggagggggtacggaagtgcaacctgttctcatttcataaaattagggaacacagactagcgagcgccctttcgagcacctattttatttgcttgggggtgggaggagtaattgctttattatagtagttaagggccatttgtgattttttttaaaacagtttgtcaagttactctccttttttgtttggggggggggaaaaaagtcctctccaggcttgcagacccttgtggtcgagttgtttactttggtaattaagtacctgactctgctggacgctcttcgcgtttcagaagcgctgtttggcattgtacagtctgagcgtgagttgaattccgtgcaggttactgtatgaatagtaaaaatgatattgttgtcctttgctcgtggggaacataaaggcctctttgaggagggtgtgtgtgcgcgcctgtgttaagggaatgctccagtgtctttgtttttagttggtcttatttttgctgaatgacacttctagtcccatcctccagcttggcagtattttgttgtcatgtatggatatatggtttagtctgacacatatttaacacttatgttctgtggcaagttgtgtaggaatttacagtttgaattggtaagaaaactttaaagtgcaggttaatgtatagattagtattacagtgttcagagatccaccaggcagtctaaacagtttctagtttcttaagtatttagatggtcatagacattactcctgaagtttccagactcttagcatttagataagtatagtaagctcgaagtaatgacgttaattccctgggaaacactcagccacagctgaaatgtgtgctcttcaggatggtctccagatccgcatcatcccctagacagtggggtcccggaaatactcatcacctgttcaggaattcaggcatcaagtggttcgtagggagagttcagcttgtaagcttctattcttttggttaatattaaaattagctagttttgaaacttagccataacccatgtaattctaccagtggtgacaagatattaatttaaaacatatcctgtggctgaactcagtttatgtcatgagaattgtcgtgatattctctggtttagctaactcaccgtaggggctgggcacggtggctcatgcctgtaatcccagcaccctgggtcaccgaagcaggaggattgcttgagagcctaggagtttgagaccagcctgcgcaacatagtagtgagactccatcccaaggaaaaaaaatagccaagcatgctggtgctagcctgtggttgcccctactccagaggatgaggtgggaggattacttgagctgggaggttgaggctgctgtgagccctgccactgcaccactccagcctggctaacagaccttgtctcttaaaaaaaataataagaaaggaaagagactcaccactggccctaatcgaagttaggcagtaagaattttatagttaagaagttgtttcattataaagttatcttacatatatttgtttctttatgcagtttcggggctgtgagttttttggtgtctgtagctgcagcccatttccagagcacatgttattgtcagttctagagcaaacttaaatgatgggatatttgaaatactttgtataagtaaaaaagttctgttaacttcctccctccccccacacacagactaaaaacgactccaaaattagataatattctgttactttggaacttgttttttgttgttgttgttttttttttttttgagatggagtttttgctctgttgcccaggctggagtgcagtggtgcaatcttggctcactgcaacctgtgcctcctgggttcaagcgattctccagcctaagcctcccaagtagctgggattataggtgcccgccaacatacccggctgatttttgtatttttagtagagacgaggtttcactatgttgacctggctggtctcgaactacttgactcaggtgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaattagccaggcgtggtggtgggggcctgtagtctcagctactcaggaggctgaggcaggagaatcactggaacccagaggaggaggttgcagtgagccgagatcgcgtcattgcactccagcctgggcgagagcgagactccgtctcaaaaaaaaaaaagtgttcaaaacgtgtgggttgttttatttataagatggcaggattggacttgatgatttctaaagtttcatccagcatagacattttatgattctaatgatttttagactcatagcatcatagaatttttagacctgaaatagactcagagatcatctaattactcctccccatttttacacaagaagaaattgaatatcaaggaggttttgaggttcaggtttgcaggattgttggttgcagaactgaaactattttctcctggtctaccatttcccccagtattatctgttaactcatatgaaatccagaaaattacatttgaaattaaatcatatccatcacttaaacacaggaaaccccatgttatttatgaatatgttaagtaacaaaattcatattaatgggtgatcaatgatgttaatgcctatgttttcaatggctttaaatatatatgaactttgaaatttaagattatgttgtcaacaaatactagaatttgtaaattcaaatacatgtaggtctattcaaggttgtcttttcataacttgttgcacattctttgcatgtctacaaataaaggaggttatcagttcttttcagtgattattatacgtctgctgtgtgctagagatagtgttaggcactgaagggatgtatatatcacagaagagacaaaaatcctcactctggtgaggggtaccttttagtagggagacataaataataaacatagtatatagttttcttctttactatgttagaaggtgttaagtgctgtgggagaaagcagtgttagggaaggggattgggggtgctagggcattgatggaagtagggttgctaaatatctgtatcaccaatgagataattttgaacagagtaggggatgagggaataagccatgcagaaatgtagaaatcttgaggaacagtgagaccaatgtggctggagcagtgtgtgtgtgtgtgtgtgtgtgtgtgtgtgtgtgtgtgtgtatgtatgtatatgtacatgtgtatatacagggggtcgttggagcagatgaggcctaggtggcaaggagtgggggtaggcatgggtggacactgtaaggatactgggcttttatcctagagaaatggaaatccattgaaggattctgagtggtacgatataccttgtttttttttgttccatagtgtcctgtgacagtattacagataattatttttaaaagcagttttttcagaagacccttattacagttttctttaccatgcagcttctatgtacagagttttgaattctgtttaagatgactgtctaatgttcaataaaaactaatggattatcaagtatacctagccacactagggttaataaaaacacaaccaaacctctttgatagattgttgaatatgttctagtggtttatatgtagttcagtgactatatgcagaaaactgggcctttggggacaaagaaacgaaattaacatttatcgagaaggtacactctactagtcagacaatttacaattgtcattaatctccactcccacttttgaaataggcattattactacttttttttttttttttttttttttagcatatctgggaatgaaggcttagcgattctaaatgatttcatgctagtatgtggcagagcaggggttaggaccctggtctctggttccacacttttatctccccctgaccctcacctcctcccatttttctgttttttgttttttgtttttgtttttttttttttttaacccagcaagcactccttcagtgtagatgtggaatctttgtttagttttactctggtttcttccttgtcatgctgaataatagtgacctagttgtttccatatccaatcaaatgatctgatgtaaacattaagtaattgaaaaattataacttttggtgcatatagtaagaaagttggaggtacagttaattctgtgttaatttttggctgggcgcggtggctcacacctgtaatcccagtacttcggggggctgaggcgggcggatcacaaggtcaggagatcaagaccatcctggctaacacggtgaaaccccatctctgctaaaaatacaaaaaattagctggatgtggtagcaggcgcctgtagtcccagctactcaggaggctgaggcgggagactggcgtgaacccaggaggtggagcttgcagtgagccgagatcgcaccactgcactccagcctgggcgacagagcgggaccctgtctcaaaaaaaaaaaaaaaaaaattctgtgttaatttttttaaaaaagttttaaaagaacaggtcatttgggtcaagtggctgctttgattgtgctcttatagattgggtcaagcataaggaaagtctgggagaaaactccttttaaatttcagtattaagttgttcaatactgtgtttgccatgaaatttgatgaagagaaatagttccaaataggattcagttgctttgtggacagaaacaagctcttgactaatttatatagccactttaggtgtgcgcccacccccacaagaaaaagcaaaacagaaggaaaaaaaatcactgaaatagtcttttattactttattgaatttgttttatataattagtacctagtcactgagagtgattaggctgcttgtctgcattatgggatttagttttttttttttttaaagtctattatacttttgaatcactcaacacagagataagttgctgaagtacacagcccattcccttattagagtattttcattttaataaacatgtggagtgtttattcagaggattctaatacttcctgatttaggatttgagaaaatatcaaatattagaattagattttatttttcaaggatcatttattctgtctgtgaaacaaatatagtatgttagaacttaaccgtggaattttaaaaatctcatttaatttttcattttttgtgtgttggttttttttttttggcctcagtaatcttttgttaatttaagattactttagaaaacaatgttaaaggaaagtaaatttaaattagctacttggatttcttgttagaagttcaagaaacaagtttgagagaatcaattgcgatatgatgactaatccaggtattttaagatggttattttttatttatcataatcagaaattagcaaaaataacttttgttttttgtttttttgagacagggtctcactctgtgttgcgcaggctggagtgcagtggtgcaatctcggctcactgcaacctctgcctcctggattcaaacgattctcctgcctcagcctcctgagtagctgggattacagacatgtgccaccatgcccggctaatttttgtatttttagtagagacagggtttcagcatgttggccaggctggtctcgaactcctgacctcaagtgatccgcccctctcagcctcccaaaggagtgcacctcctaaaaggccgggcgcggctggccttttgacttgtaattttgactagtaattctgaggggtggagagaaaatcttttaaattttcattagttgcctactttttaaaaacctgttaagaaaagtatacaaaagtctacaaaatctatttgaatcttacagatatacttctgaatttttttttttttttgagccggagtttcgcacttgtcacccaggctggagtgcaatggcacaatttcagctcactgcagcctctgtctccggggttcaggtgattctcctgcctcagcctcctgagtagctggggttacaggcgcacgccaccatgcccagctaatttttgtatttttagtagagacggggtttcaccatgttggccagggtggtctcaatctcttgacctcatgatccgcccgccttggcctcccaaagtgctgggattataggcgtgagccactgcgcccggccgcttctgaatttttgaaaggtagattgccataatgtatcattgtgcacaataattacgtagtatgtatatcattcctactggacttagtagtacagtaataccctcttgtctgtgatttcactttgctcgatttcagttacccgcaatcaactggtgatctgaaaatattaatgaaaagttccagaaataaacagttcataagttttaaattgtgcgttgttctgagttagcatgatgaaatctcactgttgcagccgttggtcatccctttgtccatcttattcatgctgtattcactgcccactgttagtcacttagtagctctcttagttatcaggtcaaaaaaacatagtgtatatgtgtatatatagggttctatactatctgtgttttcaggcatccactgaagtcttggaacgttcctccctcccccatgtggataagaggggactaaagtaatacagagcccccccctttttttttgagacggagtttcgctcttcttgcccagattggagcgcaatggtgtgatctccgctcaccacaacctccgcctcccgggttcaagcaattttcctgcctcagcctcctgagtagctgggattacaggcatgtgccaccatgcccggctaattttgtattcttagtcgagatggggtttctccatgttgatcaggctggtctcggactcccaacctcaggtgatccgcccccctcttggcctcccagagtgctgggattacaggtgtgagccactgcgcccagcctcttttttttgttgttgttaagactgggtgttgcactgttgtttaggctggagttagtgatgtgatcatggctcattgcagcctcaactttctggactcaagtgaccctcctgcctcagtctcctaagtagctggaactacagctgtgcgccaccagatcttgctgtgttgcccaggctcgtcttgaactctgggctcaagcagtcctcctccctcgacctcccaaagtgctgggattacaggcgtgagctgccttgctcagcctcagcacctcttaaaaaggagttaatttcaagagttattcaaagtgcaggaaatttaagaatgaatgaataatcgttatccataagcaattattttaaacttcaaattataagagtactatgagggttttgttcgttttgcttagtatttgaaattgtacatatttccatatattttctggccataacctgtacaagtatttgtattttctctgagtttcaagccttctctttggaaaagggaaccctgacttagagtgccctgtgattttttttttcaacctgtgtacatttaaaactatagattatagccatctgtttttaaaatagactgacaggactataaatacatttttctttctgttgtattgcttgtcttaaaaataacttatacccttccttttctccttcttacccccaaccaaaaaaaaaaaaaaaaaaaaaaccctaaatagaagctccatccccaaattatctttttagttaggttgtgagagaatgcttaatggggaatttttagttggaatgcaaatcgttcacatttgactacttttccattaaaataggtgaagaaatattgctcacagttttcctcccttcaacagtcagtggttgcacttttgccctttttgtttttcttttcacttgaagacagtatgtagtaaatggcgagactgcatgccttgaaaccaggcaccagggtttcattctggctctgctactttttgaataagtaaataaatgatgctgaaagtttggttcctcattggtaaaatggaaccatcttgcaggattaataagtacctagcacagtgcctggcacacagtagaagctcaaatgttagttgctagttttattatagctgttgtttaccatttaaatttttttttctggagttttttttttgtttttttttttaagatagggtcgcatgccttctcttgtccaggctggagtgcagtggtgccatcatagctcactgcagcctctatctcccgggctcaagtgatcctcccaccgcagcctcccaagtagctaggactccaggaatgcaccaccatgcccggctacttttttgttgttgctaattttaatacagatgaggtcttcctgtgctgcccaggctggtcttgaactcctgagctcaagtgttcctcttgccttggcctcccaaagtgctgggagtacaagccatgagcccaccacacctgtccatctttcttcctctgtggacttctgtggagtccttaccatgtgctagttacagttctaagagtttaacctgaattgattcgtgtaacctcaacactctgtttacagatgaagaaattgaagcacagaaagattaattttcccaaagtcatacagccattaagtggcaccagtagagttaaaatcttgacagtctggtttgaaagtctgcactcttcactagtgaatcatattatattgcctctgtacaggtagaaggaaagagatagagctactcctacctagattcctattctgactttcctggagtagaactttgtttctaggtgaaagtctgctctgggagttgtaggtaggctcattggctgaattgatttttcctgcacttttgacttcggacctgtagtctattggagggccttttgtgagtgagtgattttggatattggtaacgttttgctatgtctgctgaataccgtgtattatgtatggaaagtatgatcttctaaagttaaaactagctcttctaaatttcagatgaagttaaactgtcaatatgataattacataacaacatacagagcttttagtgagaattataggtgatcgtaaaagtgttttgattttgaaagcattgacttttgtgagctagattcatcaaatcctgagataacaagaattgagttagaaaattaattcctttaaaaatataaaggcctaagtgtctgtttctgaagttcaggctgaaatataaacttaaggatgagaaggtgaaaattcaagataatagaaataataaaatggatcttatttttttgctgttaaaaaatcacttattaaaattacttctattttgcaattgttaggacttagttgactagaaagtcattttccatgtttatttttccttggggaaatacttttaatgggaaggctttttaaactttattattttttcttcagataaactattatttaaaatgtgattcttaaatttcttttcttttcttttttttggggggttaagatttcgctctgtcacccaggctgtagtgcagcggcgctatcatagctcactgcagccttgaactcttgggctcaagtgatcctcatcttcccacctcagcctcccatgtagctaggactataggtgtgcgctacaacaaccagctaattaaaaaaaatttttgtagcgacagtctcattgtgttacccaggccagactagtcttgaactcctggcctcaaatagtcccactgcctccgcctcccaaagtgctggattacaggcgtgagttactgcacctggctgattctcttaattcttgaatttcttgagtgaaaaaaataatgcaaatatgctagatttaagaataaaacaatatgtgttgataacttggcatgttatattttggaaagatgaacaaataaattcattttactgttcagattatgacagtatttctaattttggtaatctttgataccgttgtaattagctttctgttacaagagatagcatttctcctcccccctgctttttttgctggggttaaaaagcaaaatatattctgttttatgcattttacagccttacaactattgcatttctttgaaaacttgataatacctaggtagttttaacattggaatactgaagattatattgcctgatcttatttaattattactctagtttattccctttaaataagtatttaaataaatggcatatattacatttgagtgctgaatcattgtagctgtcacatggttttgctcttgggaagttccccactgggtttgtagtagaaacagagaaaaaatccatctgttttttcttccacctcaattttctatccaccctctcatcccctataaaatcattcttctctggttagtcacctttttctcttccttgtgttgataaaaatttaaatctttagtgccatactgtcaaaatcagaacactgcctggtacacctttgtggcttaggaaaaggggatgggagtgttacagctcccctaaattggtcaggtatactccagctttattctaggatagcctttgagactacagaattgaattcccttagtagggaatcaaatgttacaatgtattctaggaacagagagctgacagagaagtggtaagagtgcattgtaagtgtaagaagtggagggtacttatcagactttataggaatgggattgtcaatatcacttggcttagctggagtccgtactgtcagttcttggcctggtagaactcagtagcctttatggtgttggaagtgggtaggtacaccctgtttcttcaaatatgttgatattgccctatatagtggaaatttataccaaaccagttaaaatagtttacatttggcctggcgcggtggctcatgcctgtaatcccagaactttgggaggctgaggcggttggatcacctgaggtcaggagttcaagaccagcctaggcaacatggcaaaaccccatctctactaaaaatacaaaaatcagctgggcgcagcagtgcgtgcctgtaatcccagctactcgggaggctgaggcaggagaatcgcttgagcctgggagatggaggttgcagtgagctgagatggtgccactgcatttctgcctggcaacagagcgagactccgtctcaaaaaaaaaaaaagtttacatttatatatatatatcatttattacataaacatttttcaaataagatatgacatggaattaattcatttgtataattttgtttttagttggtgtgggtaagacagttttttatctttgtttccctggtcttctattatcttactttttgataggaatagtatagtagaatgaatagttctttttggcttgtagaaatgacttaagctatgatttttccttcctcccttcaacaaaggtgattgaccctgcagggaacagagcactggatttaaaactatatgataaaaccccagacaaatctgattgttttgccacttccaacttttaggaggatgggggaaaagttatgccaatatgttatatcaggtttaattaaaaagtaatttccaggccaggcacagtggctcactcctgtagtcccagcactttgggaggctgaggcaggtagattgcttgagcccgggcgtttgagaccagcctgggcaacatagcgagaccctgtctctaaaaaaacaaaaaaacctacgtaatttccaggatatggtctgtggttggtgtacttgcaggttaatctccaacacttcctgcaccattgtgcagtggtcactgacagtcacagtgatcctttggtactttactttgttcctcagaggaggattaaaacatgttagggtactctgtcactcaagggagaaaggtatactgagttttaaaataaatttcagtaacaaaagttggaatcaaaatggtttccttgttaactttcatttaagcaaaattaggacagttctcttccttggcatttgatttcattgtgagtttgttgtcattgaacagtaaatctcaaggaggagatagttttcaaaagggaagaatcctagacacttgagggatgtgttttgcaatgggatatgacttatctgatgtgcagatgttgtagagttattagtgaagtagcagaagagtagtgaatttatagtttcttaattttagtggagtacagaggttgagattttaatctgtaatcctaacagtaacatatttacaaagagaggagtgtggctgacatcagattctagagcatagatatttttcatattgcaagaaaaagggaaatagggctagttttcatatttgattttgcatagtcttgtttttactgtgatcggtagaagtatgttgtaaaatctcaaaagctatgtaaatatgtacagcaagcagtatgatttatggaaagattactcagattcatgagacctctttgttcttgtctcatttctactaataacaacctgagtgatttttttgaacaaatgccttaaccttctggttaaggttctctgatctgtctaatctggaagttgatgtttacgatctgtctgtttgggccagatgagggaatctggggctctcaaatgtgttgcttaaaccacagaaaatatatatatatatatatagtttttttgtttgtttgtttggaggtgaagcctcgctcttgtcccccaggctggagtgtgatgatgtgatcttggctcactgcaacctctgcctcccgggttcaagcagttcttctgcctcagcctcccgagtagctgggattacaggcacctgccaccatgcctggctaatttttgtatttttagtagagacggggtttcaccatgttgggcaggctggtcttgaactcctgacttcaggtgatcctcccgcctgggcctcccaaggtgctgggattacaggcgtgagccactgtgcccagccaaccacagaatattgtgtctattcatgagtacctcaagttttccctcttcatttacaatagtagcttaggaagaacccaagtattttgctagaagatggtattggagcttgggaggaggaagagtaacagtggtgaggctgcagttgctaggaggccggcttgggtgagagggaagggagaacatggtctttgatactgggagagagtatcctgccttcttttcctgtgggtttaggtcagatgagaaatgaatccttgacaatgtgcagcaagtgagaagaggtgattatctcttcacctcttcccctctctgagaagaagtagaagggctgtttggagagaccaagggtctctgctaggctctggctaagggaatgaagtgattctttcaggggaaaaagaaaaaaaaattattttgataggatatgaggaaattttgttgataattttcttggttcctggatacaactaggagaaatgtcgaatactcctattttattgctttctcctatttggtaaaaacagcaagaaaacaaggtaggtggtgttggggagggaggatcccccctcttcccacgccatatcctttatagtgggtattaggactgcagtaaacacctgttaatctcatggttccccaggggcatttgctgactgggcagatcatgtcatcttcttccctgcgtctgatcatgtcaccttcttccccgtgtctgcttgtgcatccatctcagagcactgtgcttggtcggggtttggagggtagcgcggcttcccttctgcagcctttctgtatgctctcaggacccactgtaggagaaacgctgggtggttgagcttccttcgcttctgtcctatttctcttccaaaactgtaccatattttctgtttcatattttttaaaagttagcctttctgatgaataatagatcaaaaataaatcttaagctaaaatgttttaatgttttgtgaggaaaaagtattactaagaatgtttagttagccatatagaaatatttagtcttatgtgattttacatagagtttcagtttattttctggtttcaatagaacaagttgaaatcatcgcagaaggataaagttcgtcagtttatgatcttcacacaatctagtgaaaaaacagcagtaagttgtctttctcaaaatgactggaagttagatgttgcaacagataattttttccaaaatcctgaactttatatacgagagagtgtaaaaggatcattggacaggaagaagttagaacagctgtacaatagatacaaaggtgagtgcttgcttgtgactttaagtaaattttggaccagattttccaaagagatgggcttatgagaaatgaaatactatatataacttaaattgggtggatgtgtccaatagaggtctgtagatcttagagttatttcaagaggtctgaggaaaaattattttcttttcactaaaatttcttcttggcctctttattttcctcccccattgtgcaagttgagaatggggatggggaactgttttttctgccctcatatgtataaaactcagctgaaccagtctaaggaaacctgcatactgaatctttaaagaattataaagtaatgcatacttttaaaaaagttcaactgcataataggtgaataagaaaaggttaatagtttgtcttttcttattcattctcctgagtaaccagtgctgtggatccttccatatcttttatgtttatgcagaaatatatttacagagtttctttcaaagtttttctgaaaatgggatatttattttatgcataacttgtgctccaaagtcaaattatgttcatgttttttattgctggaaatattgccagattacttttagaaaggtgttagcaaggctgggcgtggtggctcacacctgtaatcccagcactttgggaggccgaggtggtcagatcacaaggtcaggagttcaagaccagtctgtccaatatggtaaaaccctgtctctactaaaaatacaaaaattagctgggcgtggtggcgtgtgcctgtagtccccgctactcaggaggctgaggcagaagaatcacttgaacctgggaggcagaggttacagtgagctaagatcatgccactgcactccagcctgggtgacagagtgagactccatctcaaaaaaaaaaaaaaaaaaaaaaagaaaggtgttagtaaatcatatttgatagcagtctatgagtgcctctttctctttgtttttgttatttaaaatttttgcctctctgataagtatagatttttttctttaaacaagagatatttacattgttgagattagggttgaattgcatagtttagttcacagtttttctgatactcttaagaagtaattgttgtggtaaaatgaactttgttctaagaaaaaaagaatttctgttcagaatgcctacctaagcaaaatatggatatcttgaattagaatcccatgtccctatatacgaatgtctgattttctgaatgtgtataagtatgggacatatttcacatgaataaatgagactttaaaaaatcatgtctcatctgcatatatctctacactttaagaatgctgttagtaaggagaatggctttaaataatgggaaagtgtatgttagagtaatatcgtttcatgccttccatatattgtggtcatttaaaaaatggcatataaagcattacctttttcagttttcataatgtagcataatatgacactactttaatattgcattgttatttttaaagaccctcaagatgagaataaaattggaatagatggcatacagcagttctgtgatgacctggcactcgatccagccagcattagtgtgttgattattgcgtggaagttcagagcagcaacacagtgcgagttctccaaacaggagttcatggatggcatgacagaattagggtgagtatataattacaataggaaattagatatgttactgtggaactgaattatgtcatgaactttttagtgtaaatttaaagatttgctggcccacaaacattggtataaatagaaatgggttaacttgctagtttccatgttatacagttttttgggtttgtcaagttatttatatagttagtacagcctattctatttggctatattcttatcatttacttctaaggcaggttcattagtattaaaattatgcattaatatttactatggaaaagtgaaatgaccaagttttaaagttatttcctaatgtgagactttgaaccctgcatttataaaatcctagaatttaaaaactggaagatgccttagaagttactacttgtttcacttaacactttgacagctgattagctgaatgtctttggataaattgattgaaaagtcatgggtagaggttttacctgtgacctctagttgtccatatttaatgaggttgcagacagaagtaatcagtctgttggtaggtaacaagctgccctttctgttttttagtgggccactattgaataataatagctaacatttattgaagattattttatttcagttaactgtgctaagtacttctcctacctcttcacagcaactttttgagaatagttttctatccccattttagagatgaagaaattgaggtacagagaaattatagaattaggtagtattagagtcatgattcgagtctgagtgacattgcagtcagtcagcgtccagtcaagatacaaaaaccacaccaggggctaggcgcggtggctcatgcctgtagttccagcactttgggaggccgaggtgggtggatcaccttagtttgggagtttgagaccagcttgaccaacatggagaaaccccgtctctacaaaaaatacaaaattagctgggcatagtggcacatgcctgtaatcccagctacttgggaggctgaggcaggagaatcgcttgaacccgggaggcggaggttgtggtgagccgagatcacgccattgcactccagcctgggcagcaagagcaatactccatctcaaaaacaacaacaacaaaacaaaaaccacacctgtaattttaacagagaaaatttaaagacttgctttactctgtcaaagggataaaaggaaactccaaggcataacaggtagcagttgcagtaagctgctaccacctctgggaagtaagggaagggaacagacaaggaagaaatttagaagcttaggagatccccacaaggctgagattcagatctggggtttggggggagagggtgtggccagctgtgatgctggtgaaaaaactgcctggagaccacttgctgcaggctgtgagattgctaccactagtggatactgctgggaccttcccacacactaaaacccttgccctctggtgaaaacaaactgggataagaaaagttccttcttcctcttccagcctttcattggctcttggtagaacctaacacagagccagctggcaagaaaaatgaagtctcacagtttgcagtccaatatcacaaagtagggcaaagaaggataggtttaaagctgagaggcagtaaattaactggcctggacactatgtccttcagccaaagccaggcccatcctgaacttgctgggattttctgtgctaggacaggtttcatcagaacttaaggaagcaatgtttttaaacatttgaaactgaattcatgtaatatgtaatgaactttcaaatcaaaattttaatttacaaactaatgatctggaaggtgttacaaagaatgtagaaggaaaatgaaagcaaaaaacgattagaaggaaaaaaattgaattgatttgtttgtggaatctataagaaatagggtatttctaccataaggctctatgaggaaagtaaggcttggtacttagagcttttcaaactcttcgaaagttgaatgttttgcacatacagaaaaagcttaatattaatttgagatgattcagttggaggtggtaggaggttcacctgtttactcctgtactgtgtatataacaagaagcaagttttcagaaggaatgtttcctcataagcaagagaccatacttttagttaatttagatagtagacgcgattaattactgtgtcagtagtgtctaatacagtttaaaatgattgttatgctgattactatacattcttatttatccactgaagctgacttctactagtgaaagtgttgatagtctagtgaattatgtaattaaaacgaatagcctgtttcttttaaaagtaattatttagaacatttaatcactctagacctcttcttcccgcagctaacccccatgcgtgtttatatttatgtaatataaaaagactgaattcgaactatttgatttttaaaaaagtagttctaggaaataaatgtaagccctcatgggaataagtaagttattaatttatagtgaaacagttaatcttttataaacttaattttacgacgcagatgtgacagcatagaaaaactaaaggcccagatacccaagatggaacaagaattgaaagaaccaggacgatttaaggatttttaccagtttacttttaattttgcaaagaatccaggacaaaaaggattaggtaagaatttttaaaaattatatttggtgtttcagatatattcaaatacattgacagtgtcgtttttgtaatagaaagttatgtgttttgagcataaagtcatgaaaataccagttattgaaaagtaattagaaacaggaaatttttaatcagaaaataccatgcacattgagtaagtttaccctgggtactatatgtgaaccactgacttttgctttatgaaaactacagtcaatatagaagatagttgttaaaattccactgacagttatttatttatgcattcatccattcattcattttttcattcatgaccctgaagatattttaggatcttaggatctatagaaatagcactataagatttctgagtcatagaatgccagataaatttattcttttttgttatgatttatttgaaaactataaggatgaaaaatgaagtgcttatcattcatagtcttattatccagaaataaccactgtaaaagtttagatcaatccatttgtatttgtacatttgcttttgggatagttaaggggatatgagagtaaaagatacagtgtaatttgcaaattacctaaaaagattagatagtgctagtaggtaattacaaaataataaaagtatgtaagggttttagagggagaaatgagtaaaagcaggagtggttgggaaatgcttcctggacaaggtgggatatgaactaaaggatttggtatttggctgaacgagggaagataaaagatgttccagtgagaagatagttatgaatgaaggtctaaaatttcagcaataagcttggctttgtgcaggagagaagttgttggtttgattttaatgagaatgcttgtttggagatgaaattggtgagacacaagaaagctgaataaccacaggcttcttttgaaatcagaaaggattttgtttttattttttttttggagacagaaaggtttaaattggaatttgtgggaaatggggacccaatgaagattttgatgatggtgataacttccatttaatgtgagcttttagtatgtctggcactgtgctaagtactgtactttacatatactacttgtcttgtatgtaagtccattttgtgttgctataacagaatacctgagactgggtaacttacaaagaggtttgtttagctcatgattctgcaggctaggagtggggcatggccctggcttctgcagagggcttttatgctgcatcatcacgtggcagacaaggtcaaaggggaagtggactcctgtgaggagagagaccaaacaggaggggaagcctcgctttataataacacactccaggaactaatccattccctctggcaagaactcactgttgcaaaaggagaatagcaccaagccattcatgagggatccacccccatgagttaaatgctgcccaccaggcctcatcttccagctccaccacagtggggataaaatttcagtacgagttttggtggaacaaaccaactatatccaaaccatagcactgcctcatttaatgtttaccaattttttgagtgattcatcctttcattcagtaatttaccacctgctatgtgccgtgccaaatacatagtaataaagtgctagcagtttattatccttaatttgaagatgaggaaatttaggcacaggaaggttaagtaacttacccagtgaaggtaaatgagggttttttttttttttttttttttttggtttttgaagatatagtagttggagaggctaataaggggccttctgcactaattccactttattttttaaattggggggaaaaagtattgagaaacagattatatgaacggattagattgaggaagtgacggaaaggtagagaggaagggataaatgtataacctttgtaatgtggtatggccccacgagttactaaacatgactgaattgatgaaagattcataacatatttgtaaagcgaaattctcaataataaagcctcctttccaacttgattgctcaatatagataggattttattcttaaaggaaaaatcctcattttgcaggcagaataagccgggatacctacaattagtttttctgtctggggccaccagttaactgggatgttttttctgtttttctctttccttccacaaataataatctgttaaagtctttgaatttacatgtatgtgtaaaataattattttgtcatatttagaagtgtagtacaatattttgataagattaaatataatgtgaatgtcaaatgttgatttaaagggacataacctatttcttagttatatcgctaccctttactggagcacaaaataaatggtgttttgggtgaatatatagttttgagactgaatcttagtttttattacttgtggtaagaattgagcaaaattaaatttttataactattggatatattaatatggtaaattggaattttagattacaggaaaaaattgagaaacagattatgtgaaagcattatgttgaagaattatgtgtgtttattctgttatctaataagtattgtgcttaagaaaaaatgtaatatttaaaggatgtagagtttttgtttcataagatgagcattctgaagatcgatggcacagcaatgtgaatgtacttcacactgaactgcacccttcaaaaagattcagatgataaactttatgttatatgtatttaactacaatgaaaatgttatttaagacccccccacagccatacagtgtacaatacaaagaatgaactctaatgtagaatatggaccttagtcaataataatatattcatattgattcatcagttataaaaaatataccacactaaagcaagatgttaaaaatagtaggaactgactagggaagagggtatatggaaatctctactttctgctcaacttttcataaacctaaaactaaaaaagtctattaattaaaaaaaagaaaaatgtagtaagagacaaatcatagtttttttttttggtttgttttgctttggtgttaggtatcaggaaatgtaatgacttgcttatttgcagagtttaattaaaaaggaaacagttttttataacagcctttctaagggttcacagtgctcttaaattacaagatttggcagagaggaattagaagatcataggagaagaggtaaggcccaaaacaaattggcagagagtgagtgacaaccctgtggtttgtttataaatagctgtgctaattaaaatgagaactggtgtattccatgtttctgttttttttttttttttttttttttgatgcagggtcttgctctgttgcccaggctggaatgcagtggtgcaatcgtggctcactgcaggcttgacttcctgggctcaagtgatcctcctgcctccgcctcccgagtagctggaactttttagggaagcaccaccatgccaggctaattttttaatttcttggggagctggaaacttgcggtattacccagcctgggtattttttcactttttataaccttacttcttgtgataccaggatagggggcttcctctgttgccatctgctttagtaatctgacttaaacatttttttttgatttgttttagatacaggatctggctctcttgcctaggttggactgtagtgccatgatcgtagctcactgcagtctcaaactcctaggctcaagtgatcctcctgcctctgcctccggagtagccagactacaggcgtgtgccaccatgcctggctaatttttacattttttgtagagataaggactcaccgtgttgcccaggctggcctcaacctcctggcctcaagtgatcaccccgccttggcctcccaaagtcttgggattacaggcatgagccaccacacccagcctgccattttctgataattgcctgaatcttaaaatttgaaaaggatttcataagtcctctataaaatttaacctacccaaagtagcatccttacctgatgctcattcagtttctccttttgaacatgcagggactggacacacattgttttaggaagttgtccattcctatcacagaatatccttacttgttattacacagttcttccttattaagctaacatctttgtctttattacttctatcattgctcttacttgtcccccagtgcaacactgataaaggctaaaattaaagatccactctcagttacctgttgtttttctccaggccagcattccaattattttaactattcttcttacaggagacatttgttattcccactactatccccccaaacacatttccaatttctttcaaaatagagcccataaagttgaacatcatatttcaaaaggagcctaagtaatatagaacaccgtgggtctgttaatttttgtgagactattcattatgttaatttgatcaaagattatatatgttctttagcagccatatcatttttagggccatactgaacttttattagactaaagtctatgagtcactttcttgtaggttgtggttcagctggaatcttatacctctacaattgatttaaatgatttgaacattatttgttaaatatttagtttaatatttaggaacaattgtatagtgttttaaagaacacgataatctgtataatcccatttggttctcataacaacccctttgagctaagtaaaagcatattatcttctccatcatatagatgaggaaactcatagccagagagactgacttgttaataaggtcgcctaactggagagtggttggactggcactgagactagatctcaggccttatgactccacattctgtgttttattgttgttgttgttgttattttgtgttagccgtagatatttctaagtaaattaagacattgtggcttttgcctgctcccagtgaggggtgattggggttttggtgatgagctcccagaaaggcaacgtgcctcattccaggcctcagaagcaccagaatatatttagcttcaaaaatgacaagttcaactgggcatggtggctcacgcctataatcctagcactttggaggctgaggtgggtggatcacttgtggtcaggcgttcgagaccggccttaccaacatggtgaaactctatctctactaaaaataaaaaattagccaggcatggtggtgcctgcctgtaatcccagctacccggggggctgaggcaggagaatggcttaaacccgggagtcagaggttgcagtgagctgagattgtgccactgtactccagcctgggcgacagagcaagactctgcctcaaaaaaaaaaaaaaaaaagtttgataagcatgtttagaccaagaaaagtaacacaaaaccatggtgcggctgggcgcggtggctcacgcctgtaatcccagcactttgggaggccaaggcaggtggatctcctgaggtcaggagttggagaccagcctgaccaacatggtgaaaccctgtttctactaaaaatacaaaaattagccaggtgtggtggtgggtgcctgtaatcccagctactcgggaggctgaggcaggttcacttgaacttgggaggtggaggttgcagtgagccgagatcgcaccactgcactccagcctgggtgacagagcgagactcagtctcaaaaaaaaaaaccctcctgatggagtatgtcagcactgtaaagaagttcttgagtggcatgtaaaatatagcaaatacaaaccattatccaacctaaaaaatgtgttaaatgtttacaaaagacagtggaagattcttatctcataacgtgtagaccatgtgcctatgaacttgaagtttgcgcaaaatgtggaaagaagaagacattgctattctgttcaataaagaaccaggaaaaacagagaatattgaaaataatctaagttccaaccatagaagaagctgcagaagaagtgaagaaagtgatgatgatttggattttgatattggtttagaaaacacaggaggagaccctcaagtgaattaatattactgtattaaaagtcagtttaaattagccgggtgtggtggcgcatgcctgtaatcctagctactcggaaggctgaggcaggagaatcccttgaaccctggaggcagaggttgcagtgagccgagattgcaccattgcactccattttggacagcaagagcgaggctcagtctcaaaaaaaaaaaaaagtcaatttaagaatgtgaaattctgaccaacttctgactatttcacaaaagatactgtgaaatcctaatgaggaaatcagaaaaacctttagaaaagtagacaaattttagacacgaacaatataaattgtgtatgatgtattatctaataccaaactaaaccagattcagaattgatggttgtataagaaaggaaccacctcatgtaaaaataaaatgacattattatattgctagcctcaaaaattggtcctcagtaagtgccttttggtaaatgatctcaagtaaatgactcatagcaaaagcctcatacttatgtttgcatgttaaaaagcagaagcagcattctcaaatactaatgtttaacaagtgtatggcgatttttatttgtatttttatatacctcatcacattgtttttaccttttttctcgtgaaatgtgcacacagaaaaaaatgcatagaatttatatagataatttaataaatataaagaaaagttcatgcatttatacagccaggtgaagaaactgccggcatcagaagatcccagcaaggctctcgttcagcaaaagctcatctttcttcccagagttggaaattattctgaattttgataattatagtcttaattcttttactacccatgtttctgttcctaaacgatataaattagctttgtctggttttttaactttcctctttttgttttgaaaaatatcaattgaaaatatcaatcagaaaaggtagcaaaatagttctgtgaacttttgcgtattcttcacctggattcccaattgttaacattttaccacgttttctttatatctcagtagatggatgtacacacatattttatttgctgaaccatttgaaaatgtgcactggttttgaactttgtatgaacagacttatactatatatgttattttatatctcttttttcattgttataaaatttgttgagattgattaaaaaagacattgtgaataggatttttaatcaccattccatcctccccagtgagctggcaacattttgtttcttttagggactgtgattgggtctagtctcaattcatttccatgttcatcctgcattcagctgatcatctgttgtgaaataccacattattcttgttgattctctttgaaagaataacatggggagtatctctgtttgcattttacattttaccgtaaggacttaaggatttattctgcaaggatctcaattttatgcaatagcttgttattaggacttagttatttctttttctctatatttgccttccatttattttaactgctgttgcttcttgttaccttatcactgactttgttgtcttttccaatactgcttcagaatctaatagttctaaatgatttaaaataatgataatagtaagaactgatatgttatttaccaggtactgttacgaatgctttgttatgtattaactcatttagtccttagaacaaccaggtaaggataggtactattgttatcttcattttaaactgaatcaaggagaagtcagcccagttgcccaaggtcacttaactggtggtagagtaggggtttaagagactaaaactcatactgtaaactactatgttaaatcacctctcgctagctaagctgctctcttcatcacttataaatttctttctaagggcttcttttcctatacctgtgacaattaacattttatccttgtttaatcttatgtatttcagctcttagttataacttattaatctttttgagttaaagtcttccttttttattcaaaaacacttgactgctttcactgagagcatggagtcaagagcatcattagtcagtctggggtagtttgcagtaccttcaaaaagggtatagtttttgagccttgaagaatgaatgcacattttcaagaccaaaggaaaaaagaagccatttcaggttgaggggttagcatgttcacttgctcagaggtgaaagaacattccacctttgaggaactgcaagtgagttcatttgacaagaagtgcaaattttatctaaaggtaattggaaatgattgaagaattttaacatggaagtgacaccagattcatgcctgaaaggtcgatctcaaagcactgtggtcctttgaaaggagtgaaagctgaactagaagagagattggttatggagctatcccagtgatttagttagaaatgaggaatatcctaacataagccttcccagtggggatggagaagagatagatttaaaaggtactttggttggttgtgtatgatgaggaaggaaggagcctttctcagggattatcaacactttcaggagacatctggggaacctgtggggtttttgtcgtaatgacctaaggtttctactggccatgggaagggggtgcagggtggtggggatgggggtggtgctaatgagaagtgttccattgagaaatactatagtgggtggtgacatagaaggaagagcaggtctatagaggtaagatagagttcagtttgagccctcctgagttgaagttgttcgtggataccaagttggaagatgtcttcaggcagttagatatctgagtctagaatatagagataggtttcagatttaggagctgttaggggcggttgaatgtataacatgaaaaatgatataggtttgaaaatctgagggaggttggaaaagtggttattgttgacacacgttgttacaaaacaccaacatgtaatggacgaatggaggaagaggagccccaggaaaagaaagtgagaagcctagattgaatggaggaaaatcagtagagtgcttatcattgaagctgaaggaagtgacagttctatcaggaggtatgctcagttctctaagataaggcagagaggacataagagtattcatttagtaaccagagggtctgatgacccttcagagtttaatttcattggagtggatgacaggtagacattggttaacaggattagaatgtgtgggaaatggggaaaccgggcaatgagtgtagactataagaaattcccttcttttggatgtgcgtggtggctcacacctgtaatcccagcactttgagaagccgaggtgggcggatcacctgaggtcagaagttcgagaccagactgaccaacagggagaaatcctgtctttactaaaaataaaaaattagctgggcatggtggctcatgcctgtagtcccagctacttgggaggctgaggcaggagaatcacttgaacccgggaggcggaggttgtggtgagcagggatcgcaccactgcactccagactgggcaacaagagtgaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtgatccgcccaccttggcctcccaaagtgctgggattacacccgtgagccactgcgcccagccagtattatgtattttttagttctcttaaaacatgggcatcagaatttgattttcaaacaaattatgtataaaagtagaagactctgagtgctatttcaaggttacctgtgaagggaaggagaaaaagggtatagccagtaaaggtgatcaagagatccaagagagctacagagtgagaccgtgtctcaaataataataacaataataaaaacaaacctattttgattggtcaaaaaaaaagatccaagaaagatttttaaaagataagtgataacttggctgggcgcggtggctcatgcctgtaatcccagcactttggtaggctgaggcaggcggatcacaaggtcaggagatagagaccatcctggccaacgtagtgaaactccgtctctactaaaaatacaaaaattagccggtcgtggtggtgcgttcctgtaatcccagctactcaggaggctgaggcaggagaattgcttgaaccagggagtcggaggttgcagtgaaccgagattgcaccacagcactccagcctggtgacacagtgagactccatctcaaaaaaaaaagataagtgataacttgagcatgtttcttgatggagttcgaaatgccagagaacaaggtaaagttggagatgttgagaagaggggaaagcaaatcaacagacaagattccttaaagaggtaggatggtattggatttagaatagagctataaggggcttatccttggatagaagaaaggagagtttcttctgttgagtttgaaggaagatgaggatgatggatttgaaggtaagtatgtttgtatgtgaaaccataggaagtttgtcgacttagcagtttctgaatgcctactgtgtatttcagtctgctagttgaggaatatgtagtctccatcattgaagaaagttaagggtcagtcttgcaggtttccagctactgtgtgtgtatgtgggggtggggaagtaggtattgttttttatgttgttgtgttgtttgtttttaagagatgtcacctgtcacccaggctggagcgcagtggcatgatcatagcttactgcagccttgatctcctgggctcaaaggattctcccgcttcagcttcctggagtagctgggaatacaggcatgcaccaccatgaatggctaatttttaaattttttctagagatggggtcttgctatgttgcccaggctggtcttgaactcctgatctcaagcagtcttctcgcctcagcttcccagagtgatgggattacaggcatgagccactgcatgcagcctataattgatttcttacaaatcatctgtttttgacagtgaattagcatcaagtttgctcttttttgtttgtttctgagacggagtcttgttctgttgcccaggctggagtgcagtggcatgatcttggccccctgcaacctccacctcccaggttcaagaaattctcctgtctcagcctcccaagtagttgggattacaggtgcctgctaccacgcccagctaatttttttgtatttttagtagagacagggttttgctatgttggccaggctggttttgaactcctgacctcaagtgatctgcctgcctcggcctcccaaagtgctaggattacaggcgagagtcactgctcccagcctactctttgttccttgttttttttttttttgagacggagttttgcttttcttgcccagactggagtggagtggtgtgatcttggctcagtgcaacctccgccttccggtttcaagcgattctctagtctcagcctcccgagtagctgggattacaggtgcccgccactatgcccagctaatttttgtgtttttagtagcgatggggtttcaccatgttggccaggctggtcttgaactccttaccttgtgatctgcccgactcaacctcccaaagtgctgggattacaggtgtgagccaccccgcctggctctttgttgcttttaaaaattggggcagcacttgcctcaatttttgtctttcctaatcactcatgatttctcaattataaagaatggtttcgagatgtcatctatcaataaaaggacttttaagttacttaggatgtaatttttcttgtgctggagaagtaaattcactcataaaaactaaacactttcttaactgctatggttccttgaaagagatcatagttctctgtcatgtgataagtgtagttctctgtcatgtgataagtgtagttctctgttgtgtggtaagcgtagttctctgttgtgtgataagtgtagttctctgtcgtgtgataagtgtagttctctgtcgtgtggtaagtgtagctctttcttatgcggcattattgccttctctacccttctctggtccatgcccagttaaaaagtcatttatattgtctttggcaaactttaagaaattcttggtttcttattaattttaagttttagatcagtatttttaatgatctctttgtggtcaggatcagtcagtaaataatttagagcataaggttacttaggattgaagagcagtccttcaccttccaacctgtaggtgtacatcagggattctcatctgggttggccctcaggttgtctttggcaatatatggagacattttttattgtcaccagtgggggctgagtgaagctgctactggcatctagtggatggaggtcagagatattgctaaatttcctacagtacacaggacagcaccctacaacaaataattatctggcctaaaatgttggaagtgcccaggttgagaaaccctggtgtacagtaactaatatttgaacacttttgtgagctactatgtttaactgcattctctaatttaaaacacagaattcccccgtgagataagtagtatcattttttgccctaaaggccctggtcatttttgaagagggaggatacaaactttggactcatttgtataggaaatttttaatacataagtattcaggatacaagttttttatttttagactttctttggtcatacctgtttttttgtttgtttgttatttttgcagggacaaatatttatagcatttaaatacataattcatttttactatttcagatctagaaatggccattgcctactggaacttagtgcttaatggaagatttaaattcttagacttatggaataaatttttgttggtaagttcacattttctacatttctctctgttttctcaaattctgctatgtttaaagataaattaacataatgtattggatatagaatgagaaatttgattaccagaattttgttacataattgttttgcattcttgtatttcaaattgtccaaactgtttttgtgcagctctttttagtgatacaaatgtattttgtttttgttttttaaataggaacatcataaacgatcaataccaaaagacacttggaatcttcttttagacttcagtacgatgattgcagatgacatgtctaattatgatgaagaaggtaatgaaaatttttgccacaccacttttttttaatgtgcctttttatcccatacccttgaacttcttaggtacttttgtttttctcggagttggaattccctccgctgagcttttgttttgtttttgttttttttgagatagagtctcattctgttgcccagggtaggtgcattggtgcaagcatggcttattgcaagtcttcaaactcctgggctcagcagtcctcctgcctcagcctcccaaggagctaggactacaggcatgcgctgcaatgcctgactaatttcttaatgttttatagaagcaggggtcttgctctcttgtactcctggcctcaagcaatcctcctgccttggcatcccaaagtgttgggattataggcatgagccactgtgaccagctccaagctttttttaatgctcttctgaatgtatgaaataccttcatacatttaccaatccatattcttctgtttctttcaattcctactcagcattcatgtcttccagaaaggcataagtaatttttatccatgttttaggttttcagtttaggaacctttttacttcttgatgtacttttgtacttatttgtatctctttttcatctgttagtcttttgtataagcttggttgtaaattccttaagttcagtgactttttttttttttttttttttttgagatggagtcttgctctgtcacccaggctggagtgcagtggcgcagtctcagctcactgcaacctgtgcctcctgggttcaagcgattctgctgcctcagcttctcaagtaactgggatttcaggtgcctgccaccacgttcacctaattttttgtatttttagtagagacggggtttcaccatgttggccaggctggtgttgaactcctgaccttgtcatccacccgcctcggtctcccgaagtgctgggattacaggcatgagccactgcgcccagcctatttttttttgaaacttacttcagccgcctaatatagtactattggcattcagtaaataatcactgaatacttttctgctatttcttcataaatgtataaagatggtgctaccatccactactaggatgtggacttgtatttttctatatgtagaagtgatttacattgatttcttcatacatatttccctagtccacttgagaactggcaggatgcaagatggagatattttttgaaaaaccccctgtgatctcggtgtcctggaatcatttaaaagtgtcctggaatcattaaggctaatcagggatgatgttatttcttttcttcatttcgttgtcgtttataatcttccctgcaaagtgagaaatgtttaatcctgcatatacctaataattgtgtcttctggtaggttttacacaaaaatggagagctttctgacttggtgatgggcatgtgaatgtgtagaggcatgcatatatgcaattttacaccttttagtaacgtattagcatgaaataggatggaatttgacacttcctgttaatttcctttgtgagatggccacagaatgcttgaaaacttgtttctcctcctatgccttcagcactggcagcatgctatcatttcatagctgctccttaggctgccagttttttgtttgtttgtttgtttgttttgagagggagtctcgctctgtcccccaggctggagtgcagtggcgcgatctcactgcaagctccgcctcccgggttcacaccattctcctgcctcaggctgccagttttgaccaaattacttccattggctgactgcagtggccttgagaaaatcatattattgatgagttgccagacaagttacttttatcactcaaggaacaaccaaatgttggagtaataaatcacaaggaatacaaggaatatttggggtaaaaactccaaaaagtttgagttttgaaagacttaatcagtgggaatagataagaatgatatactttaacgcttatgaggaagtcttaaaaaaaggattctactaaaatgttagccttatttctgcttttttcccccttctctttctttcatattttttcttttttccaggagcatggcctgttcttattgatgactttgtggaatttgcacgccctcaaattgctgggacaaaaagtacaacagtgtagcactaaaggaaccttctagaatgtacatagtctgtacaataaatacaacagaaaattgcacagtcaatttctgctggctggactgaactgaagatcaatcctcacaattcagactgagggttgagacaaaactttaaggatacatcttggaccatatcgtatttcattcttctaatggtggtttgggcttgtcttctagtctgggccgctctaaacatttataattccaacattgtggatttcatcttatatctgtggaccatcctagtttattctcccataagtcttagaagctttatggtgattattttgaggttttcattctcgcataaagcacaatgctgtcttcatcagaaaacagttggcataagaattaaacatatgaacatcacaaaacaatttataaaaacttcttaaatatacgctttgggctagttgcaaagactatgctaatagcacttccagtgagagtgatatatttaagtgtactggatctggaatggtgttttggtttggggggaattttttttttttcctggcaaatcacatgtgttgttgatgtgagtatctgatgaaaaaacaatgtcagaataaccgacatgaaaattttttaggataacttggtgcctacctgaaaaatgtattgtgttttagactcttgatttcaaaaggttccacagaactagtctgcgcttaccttacccatgtttatatatagctgtcctacagggagcttttatttagaaaatgtctgcataatgttagattcttctcctgtctacattatgcactacataattggacttcattatgcttttgaaatgcttatctgcctgtcacataagttaaactatttaatttgttttgaatgttttggattgctacacaatacaatattctaaatttaggcatgagggtttttttgttttatttttactttttttttgtcatcgcactatggaacacaaatggaattctcttaatttataagaagatagttgcagttaaattttgaaaatggttgtaatgagccatgaagttcaatctttataatataggtactgctctttcagacaaatagtccattttcgatgacttattattttgttgaaattgctttaactgctaatcactgtggttgccaaatatttacttcaggagcaaagattttcaaacaagcatacacgatgcaaaataccaatctggcttctagtctctttactgttttcgtttcactcagattagctcagttttctcatcaaagcagaatgctatcttgtatgtatttttttcattacaagccccatgagctgcttttatgctgaaaatggtcatttccctgttcacttactgacatgtgaagaagggtttcttgctttcttaaacatttccgtaaggcaggctagaaatgtaatacttcaaatgtttgatgattatggtcttttgataggaatagattctgcttgggatatatatccaggcactctctaaggtctagggttgatattaacaaaggaatgtacttagaatagcagtacattttatgcaaatatggaaattattttaagaaacaatgacatatcaaaactgctttttacatgattttgaaatagactagaaagctttccctatagacatattaatattccaatcataactttaattcaagaatgcagttttaccaaaagaaaaatttgaaaatttctattcaggctactggaattggttattaaaagaaaaaggaaaaagaagaatcttgctgctttcagtatttcctgatttttttgtaaatataaagaggaacttcaattatgaaaaatttttaaaagatatatatatctatatatctatatatatgtactgttttgtttcctgtcttgaagattttgagttatggttattggtttcagattgattaattcacatatgctgtgttttgaaatgagatcccattagcttttttttttttttttttttttcaatataaagtgttttctttaaaagtcatattggttcgtggcctagtgccttggattttacatatttttctttttaaatgcaaaaccttttcaacaaaatagtgtttgtcatcaggttggtactaaacatttataattactgtgtaattataaacaaaaatacataaagctttgaatataattatgtagcataaaagttaaggttgttcactatgatggcatcttagaattaaacaaaacttttactagggctgaaaagagaagactgatttaatgtggtgtgattattctgaagataaatgtctggctacagggaatattttgtactaaaaaatgattacacatatggctgtgtgtgtttgagtctgtgtctgtgagagagccagagagagtgagagagattgacagagaaagggagagacacacacacgccccttgaattgctttaactcctaagtgtttcagtcctcattccggtaaactccccatgctgattctttgttttaaactgaaccataggtacagtttcctttttgccaaatgtcaaaacaggtacaaattttaaaatgtaatgctttttaaatagaaaaatgtataaaattagaagtgcccacatataaaaaatacttgagatgaagattatctttagtgaatatcatctgcatatctctgtaagttcaattgtgtttcttacagtccctgtcatattaccaacagaggcaataaaagctgcagtgaaattgccatgactaaatcttttcacatatttcagtgtattttttttatagatttaaaatatacctgaaaacttttctaggaagaataattattcatggaaagagcattgtaatggcatgttttggggagaaaagacatgccaagtcttgtttactacatttaagatgtttacaactatactgggctgctttattaacaatactgtacttgcgtaatatggcattataagtacatgtccttccttagacttttaaaaagttttaatgagagaaagtaaatttactcaacaaaataacatgagaaatcctttacgtaatatctttactggggaattcttatttaagcaaggtacactattttttcctcagacttaaatgaatgaagtgttcatttattttttatttgatgataatcaagaagtgagtagtagtagctaacttaatgtacactttgcttaggtttttaaacatgttactattaagactacgtattgtaaaccttctgtaattttcacatatgaatgacaggagaaagttaaacctaatcgaaggagttttggaataaaaaagtggtgctggggaaattcaccatggttcacaaagtatgcctttgtaaaactgaatcaacttttagcaagaattaatttatgtagttttaaatgttaaattgtgtatatttaacagaaaatacttatctggcacctcagcagttttaatgttaccttatacttttaacagtatgatttatattgaatacttagatgttttcataagattttatcaaatttgataatgtaatgataaaatgtttttttaaatgtgaactatttaacatataaatggggacacaaaacctgaattgtgatttctacataatgtgataattagggttcaaattatgactcatcatttaattgattataaatgagtatatttctgaactctttattgcctccatttttacaatcataatatagcaataatttctatttttatttcataggactgtggtgaagttatttatcatgacacctttatctttgatttctgagggaaaggggtgtatattttgtagttaagataaatgagaaagttcctaatagtacaaatgcccttttccaggtttatctttgctatttgttgccatttttcttaaatatttgctttatttgtacccgatttctggaggcaaatagtgctgttttttcaaactcataatatagttacataaatgattttatcagagcattcttgctatcttattttctttcctacctgttgagtaagtagcatttcttgctcaccaactcatttatttgactaggttcagtgtttcctattaatgtgtttttttattttcctttggttgattttgaaaaatctgtcacaaataaggaagttatggtaaaagatgcacagcctttgtagttagtggaattctcaataagtaatgtctttatggagttttaaagggaaattatttaaagggaatcatgttatagttgtccattttttaaattgagattttaaaagtgtttttaagtatagcccaattttctatttacttacaagtgcttcatgattgttttcttttttattttttgccatcatgctgtgcagaaatcataatgtagcttgtaatacttcagagcattggtcttgaagctgtaacttggggctgctgtccttcatgaggtagggccatagcaggcaggccctttcccacttcctttatgacattctacttttatctgttgtaggctgttagtgtttcatattcgatttggtttggggaaaaatactcagttaaaaaaattttttttaatgattggctttagagggactgttacctctttggcatatctgtcagcggaatggaaagaaatggagtcagactgaaattcatgccagcttaatcactgaaggcagcactgctttgaaaagaagaattttcaacccacatcgtaaaaacaaagcctgattggaaacaatgaagtgtttgaaac

SEQ ID NO: 17381 - DNA, 38969 bp, Human
gtccatcttctgagaagttactgtatagtgtattagttaaggccttgctacaagagactttacagtgtgttcgagaaatagcagagttggtgtgagtatagcagaatgaatgaagataatggtaggagctaaggtccaagcagtggtatttagggaaggaatgaggtgggaagatttgactggacgtaagccactgtaaagactgggcttttaagtccgaagtggagcgtgtgagagtctttggatatttttgaacaggaggatgatatgatctgactttttacaaaatattttttactgattccttggacctttccttccttggagtctatgggtagaattcaggagggcccctggaatttagaagaaattacatctttattttcactaacttataactgaagcagtgtttccttcactcaatgtagccagttaaccatagtaatattagaattacctgtgactgttaccaccaataaaaatcacctctttgttgcatttatggtcgtcattactttgaagttatagtagttactagacccactgctagatcccatttaatgtgataataaagaagcacttacattacatttttttatatttacagctcttttttttacatttatgtatcaagatagtttcctttgtaactaaatatgtatatatatgtacatatatacacacatatatacatatatatacatatatacatacatatatatacatatatatatatagtgtgtgtgtgtgtctgtatttaaaaacactatctgagaaagtatccattgattataccaaactgccaaaggagtccatggcacataaaaattaagacttcctatgaggattactctggttgctgtcattatactagactctggaggaagacagagggtaagagcaggagggctacatgttaggagactttcacagttatctagttgagagataatggtacgttggcccagaatagtagcagaggaggcagtgatatgtgtttggattgtatgtcttgaaggttgaaccaacaggatttgctgacagattgaatatgtaatgtgagagaaaaataatcaaggatggctccaaggtttttggtctttgcagctgcaaggatggagttgccatttgctgagatggcaggtggagtgtattaaagatcaaaagttcagttttggatttaagtttgtgatatttattagacatctagtatgactttctgagttgttaccgctacgtaatacacagtcattagaaagaataaggtgaacctgtatgtaaaaacagattgaacttatattgtttctgaacatttgaatgttttacagtgaacacacatgcctgtagtaagtaacttaaaaaatgagaaaaatatgtttaaaagtaaaagaatggccatggtgtgccatagaaaattgggtgaccatgaaaaataataaaataggtctttatacaccaccatggaatatctctaagttctataaacaaagtaaaccaaaacaaggtaaaaaacaggatagatagacgtgtcagaatcatggtaaatctaacagtgttttctatgagataaggaaattgtgggtgagcaggagggctcctttggctttttttcgctttttttttttaaatagttgaatttactaatcttgtacgtgtgttattttttgtaatatcatcggttcatatgaggggtgagattatgggctcttttattctttgtacctctgtatttttataaaccttatattatagtttttaaaattgtgatatagccaatattgtattaataatttcaaagagatttttcatgttttgcaatatgaatgggaaatgaagattgaaaatcatctacatagtatgatttttattatgagtaagatttgactttatatccatatggctaaaagaaaagattagaggtgtatattgaaatgttaatagtggttttctctggataatggaatttgaggtgattttaaaaatattttcctttaatttttttgtagactatgagaagacaacgaaatgaagttgtagttgaattaaggaaggtgagtctgattaatattgggtacttctaagcataattctaacaacattatagcattatatacaagatgccaaatatatattatgtttttaggtaaaatgtataacctattgtataactaaattttatttactaaatttagttaaactttttaaaatctcaactgctaagcatttttctttagaaaaaggagagattttgactaaatttgacaggcttttgaagttgaaaggatacaactagttacttgttcattatgcaaaaacagatataaagaacttaaagtataagtcattgagatacagttgtattaaatagttctgctattaatgggcagtagtaagtccctgaaaagaacttgttgcaaacttcttcaacttttaagtattatagttgagaatatatttataaatttgctccaagcattttaagtgaagttgaaatggcccttgatttttgtaagacattgttggtttttgtctaactttgaactgcccaacttctgctttgactttgcttttaggtggtaaagaggagctcccagatcatgtataaaatggtttagtacttttaaataaatatttgtgtttggttctggcttaaactgtacactatattttttagtcaaacttttgtttttgttttgttttgtttgtttttacatagttcacggttcattaaaaatgtaatatttgggaactgggactcaaattagtgttgcgtgagtggttaattcacagtttggtttaattttttacatttgaattttacttttaaaaggcacttcatatttcagtttttaggcacaggattgcctgagctttgtatgaaagtattcaggttttctttttaactcaaattctctgtttggttttttttttttttttttttttttaagaataaaagagatgaacatctcttaaagagaaggaatgtaccacatgaagatatctgtgaagactctgatatagatggtgattatagagtggtaagtcattgttattgttattctggtaacttaaaagtacgagtgaaagatttcacattaataagagaattttaaggtgactttttaactgagttttctctttaacttttttcccagcaaaatacctctctagaagctattgttcaagtaagttggattttttccctctcttcatttgcatttcttgtcctcaacagctaatcgtgatatatttacatcataaattattttattttttatagaatgcttcaagtgataaccaaggaattcaattaagtgcagttcaagctgctaggtaagttgaatttggaagacatgtttagattttacaacttacacaggggttctattttgaatttttactattgagtagtccctgttaatcaaatttaacttgatgacaaacaatagtaaatagtaatagatcaactaaatttatttttttaattctgtggtttagaatattaaaattggtgacagttttttaaacaatttttatttttagttgaaagtgtacactgaaggtttaatatacataatgcatacagatgccaaggaaagttgatttaacaaattaatgccatagagtaagagaaaaacattatttgtaaagctttaccttttactaatgaataggtttaattttataaagtcagattcttcagatccttaccaggtatcttaattcttctcacaatcctcatattgatcaaacaataaatccagaattataatgttactatgtcagtgtacatagacaagtagatgtagattaagattaatgacggccgggcgaggtggctcacacctgtaatcccagcactttgggaggccgaggtgggcggatcgtgaggtcagaagtttgagaccagcctggccaacatactgaaaccccgtctctactaaaaatacaaaaattagcccagcatggttgtgggcacctgtaattccagctacttgggaggctgaggcaggagaatcataactccatctcaaaaaaaaaagagattaatgactgcatacactcccagtgtctttccaggtaggaaataccaagttgtttgaacatttctttttttttttttttttctgagatggagtctcactctgtcgcccaggctggagtccagtggcgcaatctcagctcactgcaacctctgcctcccgggttcaagcatttctctgcctcagcctcccaagtagatgggattacaggcgcccgccaccatgcctggctaatttttgtatttttagtagagacagggtttcaccatcttggccaggctggtcttgaactcctgaccttgtgatccacctgcctcagcctcccaaagtgctgggattacaggcgtgaaccaccataccctgcctgttttgcacatttctattgtaaaacctatgctctcatattttaagggaagaggcagaaaaatctattactgagacctttgtattaataaataggttggggaagacatggttgtatcataatgcaatttagtggttgctttgtatatttatgaatataagaataacaccctatgttgagtttatcagtaggaaagagacaagtaagaaactgatcctagttacagaatttgaaagtggaaaaagtttgtaggtctatccaataccttatccagtgctgcacgaatctgttttatatttattagacttttccagtatttgtttattcaccttaaataacttagaactgatagggaagttataaaattacagtattgtgtaccagaggtaaaagaacttcttagagaggaattctttatgtaggcagaaaaatctcagaaccattcacattgcaaaatagcaaattaatgtttataggaagaatgattaagaaatcgattatgctcaccattgtcagagttgaatattggatagttttgggacagttcttctcaacatgcaatctgcaagaaaattaaagcccagtgtaccctaagaggttttcaaagtatgatctgtggatcactgggagattccaagacaatttcatgggtatgcaagagcaaactgattttcaaaataattctaagacttcatttgcctttttttcactgtgttaatgtttacactggtattgcaaagcaactgtgagtaaaattgcgggctccttaatgcaaatcaagacagtggcaccaaactggttttatattatattttgtaaaaattatattattcaccattatgtaaagaataaaagacatttctcttctaaaatatcctcagtgaagtgtaaaaaaaattttttaaattaaattttgacccttgatctcatgaaaccttgtttgagaaggctgggttaagacttcttcgaagtggttttttttttttttttaaatttccacttaatgctaagcactgtgccatgtgttgaggaaatagcatgtggtataattctttctctttaagaactttataagctaattggaaaggcaaaactgtattttaaaaaatagggggctgggcgcggtggcttaacgcctgtaatcccagcagtttgggacgccgaggccaggggatcacttgaggtcaggagtttgagaccagcctggccagcatggtgaaacccccgtctctactaaaaatataaaagttggctgggtgtagtgtcacatgcctgtaatcccagctacttgggaggctgaggtgggagaattgctcgaacctgggaagcagaggttgtagtgagccaaggtggcaccactgcactccagcctgagtgacagactgagaccctgtctcaaaaaaaataagtagtgatagcaccaaacgtagggctatgctgtataaatcctcttgaaattcaaagatggtgttatgtaaaacatagaacttgaaatggactttgaatagagtttgaatacatagaagaccgggcatttcaagtgaggggtttaggataggttcagtcttatttcagttgaaatgctgtgacagacaactaacctattgtttagttacacagaataagattagttataagatggagccaacttgtgaagtagtttaaagctaggtcaaggagtttacattgataaaggtagtaaataagcagccatcacatagtttatatagggaaatgatttggttaagctttcataaacattgcttttatatagtaatacagggtgttccagtgggtaaagatatgattaggccacactgaggacttatcagctaaacctgtagtctcccacatgtgaaaatagacactaggttttgtttttatcttataagctccatgagagcagtgatgtgtctgtcttttttacctcagattctctagcatctctctggctgttttcctatcagttgctgtgcttattccatttctctttagttgctgagatgaaaatgttgttgaacttttatggccttaaatttggtgtgtaaagtagaaggaagaattagggactaatatcagctataacatatttcagcagactacctgcttttgtcatttgactctcttgtgacctagtgtgaataattttggatattttggtgacctcttaattcctttcttagcaaggtaaaagctgtgttgaagaaatctgcccatttttttctctgaactcaaaattatgtccaaaagtaacatgtattttttaaaaattagttttctttttataagtcacaatcaggactttactgagggaataataatgttgtaccattaaaagtagtaaagtggccaggctccgtggctcacgccggtaatcccagcactttgggaggccaagacgggtggatcacctgaagtcaggagttcaagaccagcctggcaaacatgaggaaactccgtctctactaaaaatacaaaaatagctgggtgtggtggcgcacgcctgtaatcccagctactcaggagactgaggcaggagaatcactggaacccagaaggcagagcttgcagtgagccaagactgtgccactgcactctagcctgggcaacagagtgagactccatctcaaaaaaaaaaaggtagtaaagtggttcatatctacattcttatttttctaattatttgtcatctctataaatttaatttgtatatctttttataaatttagagaaaaggttgcattatataaattgttaatttcagagaaggcacttgtaccaaatattcagatttatgttaatatttgtcaaatatgaatttatatttaatcataatattgtatgttattaagtttcacaggagtgtttttatctcttacaggaagcttttgtccagtgatcgaaatccaccaattgatgacttaataaaatctggaatattgcccattttagtccattgtcttgaaagagatgacaagtgagtacattatttatttttttttttttaatttagaatgtatcctttggagaagacaagactctagtaattagtttgatctttaaagaaagaagaaaagggctatgggatggagttgaaaagtcaaagtgaaaagcagtgcaaggtttgttaacaccaagagatgaaggtagtagccaaaaaaggaacttgagaatgataaatttaacttttatgctttgaaaattggcaagaactagtttgaccagataggtacttgagaaaactgtttggggagtagtatgcaagtatcttaaaaaagatttcttactaaaaatcaggatgctggaggaggttgtatgctttttatactgaagagatgttttaaacagttgttgagggttaaaaaaatatgctggatggatagataacttttgaaacaaaatatttaatgcattttaaatggtagaaggaagaatggttagatatttggcccaatgtaaaaatccctgctgtttaaaaatacttgtttttttttgtagtccttctttacagtttgaagctgcatgggctttgacaaacattgcatctggaacttctgaacaaactcaagcagtagttcagtccagtaagttggttattaataaacataattgtgattttttttaaaagaagtcggtaaaaaatagtgatcttcccaaaagactatggcaatttaaattataaaataatagctactacgtagttattgaaataggtcaacttaagtatgttactttaatcttcttattctggtgactgatgttttttgtatttccaaaaattcacttgattcctttctaaatatgagaacatttcctaattatagtagcagattacattattattgttacactttatttataggacatcagtagaaataaaggagtttttcctgttgccacattgcctctcagcctctctttttttgtttttgtttttttgttgttgttgtttttctttctcagacaagatcttactcttttggccaggctggaatacaatggcacaatctcagctcactgtagcctcggcctcccaggctcaagagacccttccgcatcagtccaccaagtagctgggactacaggcatgtgccactgtgcctagctaatttttgtaatatttttgtgttttttgtagagacagggtttcaccatgttgcccaggctggtctctaactctgggctcaagtgatcaacctgctttggcctcccagtgtgctgggattataggcatgagccaccacaccgggcctcagcctctcttaatgagatttttctctttttttttttttttttttttttttgagatggagtctcactctgtcgcccaggctggagtgcagtgatgcgatctcggctcactgcaagctccacctcccgggttcatgccattctcctgcttccgtctcccaagtacctggggctacaggcgcccaccaccacgcccggctagttttttgtatttttagtagagacggggtttcactgtgttagccaggatggtctcggtctcgatctcctgacctcatgatccgcctgcctcggcctcccaaagtgctgggattacaggtgtgagccaccacgcccggccatatcatatattttaaagaaatcttctataaagtagtcctagttgaaagaatggctcgaatttttttttcattgttattataataggattgcttttttttgtttcaagaaatgtaagtggaaaattattggaagtaagaacccgagtgtattgtcttcatgaatagtatttgattgttctaccaaacaaagaaattaataattttaaagaagatacttttaaaatcctctttaaatatgtaagcagcatacttctctgagcttattaaaaatgtaagcactaatttgtacattttgaaggggaacaaagatgttatccaaataatcattttactgtagacacttatgttgtaatattacttagaaaagataattacctcacatcctattaaaactggtttggttttgggttcaggtggtttttattgtggttttttggttttgtatagctgactcttaggaaaattttttggtttcataacaatgttttattccctctcacactttttcctttctgttatgtatgctctctaaagattagaaagaggcttagaatttttttgaccctgctagtctgctttaatataccaaaaataataaataaataaataaatgaggttgggcatggtggctcatgccagtaattctagcacttagggaggctgaggcaggcagattactggagtccaggagctagagaccagcctgggcaacatggtaaaaccccatctctacaaaatgcaggaaaaaaaaattagccgggcttggtggcatgcacctatagtcccaacaacccaggaggctgaggtaggaggatcacttaagccaggggaggtcaaggctgcagtgacctgtggtgacaccactgaactccagtctgggcagcagagtaaggcactatctcaaaaacaaacccataagtgaattaccttttatgatattacaagcatgattgagctacatatacttaaatagtgctttttaaagtaatatcagaaggaaagaagaagaatcatttgttcagtgcagtattttgttcagatacagacctatctctgtttcccatcctgttgagtaacagaatcactttctgattcggaagatcccacatggcccaggaatcactggcctgtcttaaagacccacatgttgttaacataaatttgtgttcaaaagttacttcaggccgggtgcagtggctcatgcctgtaatcccagcactttgggaggccaaggcaggcagatcacttgaggtcatgagtttgagaccagcctggccaatacggtgaaaccctgtcgctactaaaaatacaaaaattagccaggcatggtggctcacacctgcagtcctagctacttgggagggtgaggcaggagaatcactgaagcttgggaggcagaggttgcagtgagccaagattccaccgcttccctccagcctggatgacagagtgagactccgtctcaaaaaaacaaaaaaaaagttacttcaataatgtacttttttttttcaaactacagataatctataaggaattaatcttgaaattaattccaggtttaattgttaatgaaatttcacaagcctaatttaacacttgtctggataactcattttgatactgagtaaatagtcactggtcaaaattcttccaatgatgctattccaataaaattcatttaatgaggttatattttaagtatatttttataggttcccttttttttgaggtctcagcaaaaaaataaagattgatttttggtttatggtatcttcaaccttaagtattgttattttttcttccatcagatgctgtgccacttttcctgaggcttctccattcaccccatcagaatgtctgtgagcaagcagtgtgggcattgggaaatatcataggtttgtataaaacttgtaatactagtctaaaaattgttatcatatactaagtaataaaaatagctactagtaatccaaaagagaaaacagtttgccttcagtactagtttttgtgaaatagcttacagaaatttgaactgtattactgtaaaagcataaagtcatagtaaatagaatttttgttgcttaagataccatttttttggtatatagttagctcttaattatttgaataattatgcaagatgtatacaatttagaccttctgtctcatgctaggatccattttttcttcccctaacccccatgttgatcagtggggtccctttttatttctcagctttctccatcaaagaaagtaacaagaaaaaagacaaaacttaaaccaataatttttctccgtaatgacagttctgagaagagtctaaaatgaaattttttctctcttgcagacttcagtacattagaatttagtaatgtataaaatatagtaatattatttcctgtcaccatgaatcaacaagacataaccatagccttttgacagtctggttaaatatttaacactgtgattactataactttcaggttctctctgataaataattgtaaggaaaataaagacaattctgatatttcaaggatttgtttttttaactagagcctaaactcaaaaattcaaagaactattctccagtaaaggatggaaaaaatctgaattgtattgtgccccagtatagctcagagacctaacagttatgagtgggggctgaggtactgtttgtaggggtattgctaatctagtgaaggagaatgattctaaagattatttttgccaaattctttattcttgcatggaaataatcattgttgctttgatatgccatctctttattgcccttatacagggccaacatgaaagtaaagagtggttatgagtttttaagggagaatttctctgtaaaccattcttgacattgggtttatactattaggaatgctattgtttctatatccagactccctcactcttttgcttttataccaaatgttagatttagagctattatacagcatcttgatctttcatttttttattccagtgacattccgtaattaacatgaatataaagatgcaaaaagaacaaacattttatctccagatattatagtgcaagggaaggtgctttcacttatggtaacatttcaacatggcttcatattagaaactgcagtgatgcttcagatacagaaattaaacttggcagttctctgcagcagtggttctcaaaccttagcatgcaatcaggactacatggggtgcttgttaaaacacagaattccaaacccatagagtttctgcttcaggaggcctgagctagagcccaataatcacattgagaaccactattctagcactggttcacccttttcttctgacatagttttctaagtgtatagagtaatttatagttcataaccttgatgctctgatacgggatcataagtacaaattcaacaaatattttcttgatacatcttttttatcacatgaaagtttgttaaaccaagagtattgttgagagagaagttaaaagcagcagtttaattaagtgagcagcaaaatgctgaagatgggaataatgtgcaaaagaataccttatcactttatgttgcctctcttggctcagagaccttgaatgtgagcctgcttgttattgtctaaaactgaacagtgtatctggataaaatacatgaagcagcatattcccagtgctttgtgttttctgaaaatgcttactgtcagtatgttttattgagtaaattaatcctttttttctacaggtgatgggccccagtgtagagattatgtcataagtcttggagttgtgaaacctttactttccttcataagtccatctattcctataacattcttaagaaatgttacttgggttatggtcaacttatgtcgccacaaagacccaccaccaccaatggaaaccattcaggaggtaaacacttttaaaaaaaaattaaaagagataccattatatatatattttttatttgtgtatgtttttaaatctacatatttctctcctcagattcttccagccctttgtgttttaattcatcacacagatgtaaatgtgagtaaatgtgtcctattatatatttatgtatgtatgtatgtatttctagggcttcccctgtgacataggggagaaatattatactaacacattgtgtcagcatactatcagattttcccatttcaagagttattttatattagattagttattttataatattttaatatttactctatgtttatctatatcacaaaatataataccagttaagaaatcaagcataactgttattttggtgtggacaatattgtatgtatgtgtatatattagtgttataaaaactgacattaaaagtttttaaagttgccagatagtggtgatttctcttactaagatcatgtctttaattgttcttgtgctttttacagaaggtcattttgacagtttggccaatgaaagcacacacaaatagtgctatttttgttttttgaaagatgaaaaaggaaaatgtttgtgcatggatttgtattcatatacacataccaaaccatggacatcaattgccctttaattccatttttattctatttctcagttacagtgactggcagtggcttcatttatcaagataacttgattatccaaacaacaggaaaaaaaaatcagtgcaggcaagattttaaacatagcaaatatattttgcttatttttactaacacagatggcagaggaaaaagcaactcagggagtatgaatgaggtggaaaactgccctgagtgcttgtaaaagccagaccagcctttggtgtgttagagaaaccaggaatataatgggtaagggaaaacacatgaatgaaatgtttagcaacaatcaggaactcatgtggttctttaaaaacagtttggcatggtgaccagtgttggacaagctgcttcatttctttacaatttaaaggcctatgccttttggccagaatttaatttgtatggaacaaattaaaattagaattttactgtatcaaacagtgacataatatataaaattcattagatgaacatgatctctgtggtagagtttttgtttgtttttagccccagatagtttaggatcttaaaaaatgtgtaagtaatttttggttttggctccttaatagccaagttctttgattaaattgtgaatttcaatattttgctttgaaagatttacaagaggccaggtgtggtggcttatgcctattgtcccagcactttaggaggctgaggcaggaggatcacttgagtgcaggagttcgagaccagcctgggcaacatgacgaaaccctgtctctatgaaaaataccaaaaaattagccaggcatagtgatgtgcacctgtagtctcagctactcagtggctgaggcaggaggatctcctgagctggggaggtcaaggctgcagtgaactgtgatcatgtcactgcactgcagcctgagtgacagagcaagaccctgtctcaaaaataaataaataaataaataaataaaacgattggcaagaaagatttaacttcaaagtttatacctctactagaaaacaagacatcttggttgactttatttagagatagattgtgttctttccacctatttactccaatctagatgagactgtgactccattttcttgcctttgatgtatcttgaagaatttctcaagcctgtttacattgttctttttagtaacatgattaacaaataatattgcttactaaataatgtgttagaagtttgatttgaattatgattttgatctgagcatattagtgacatgtcctttaaaaacatgtatctagcttttatatacagttatgagcaagtaacttgaaatttttggcctatgtcaacaaattttagcatatgttaatattccagaaaagaaactcagttacatttgcaaattgaaatttaggttttttcacatatattgataccatttttttatgtgaattcttttttttttctttttgagacagagtctcgcactgtttcccaggctggagtgcagtggcatgatctccactcactgcaacctctgcctcctgggttccagcgattctcctgcctcagcctcccgagtagctgggtttacagatgcccgccaccacgcctggctaatttttttgcattttttagtggagacagggtttcactatgttggccaggctggtcttgaactcttgacctcgtgatccacccaccttggccccccaaagtgctgggattgcaggcgtgagccaccacacccagcctgtgcgaactctcatttgatgtcttctttttacattagaaatatccttagagctttcttgaatttcctaagaaacaatggcaaagcattattttcaccttttaggagtttcggggtgtctttttggttttttttatcttatttttttattttctcttgggtgtcctaagcataacattagtttacagttttacgatttttttaaagtcagggtcataaaaacaagaaaaaataaacaatgccgaattgtttctgtttttcatagagacggggtttcaccgtgttgcccaggctggtctgtaactcctgggctcaagcagtccacctgccttggtctcccaaagtgctggggttacaggcgtgagccactactccctgcctagtttattgttttaaaggttttacacttctccagcttgtcttgacacagagttcatattctggaaaggctttggaagtagttttaggcacaattattattcccatgtctttgtcaataatttgtgtatttatttgcagcagttacagttgtttgtcatactgccctttggtcataacttctaattaggacctaacgtactaggaaagatcaaacacatggcctgttgtacttaaagatgtaatcgttaaaaaaaatggtaggctacttagtagaagttgattacacaggcttttttttttttttcataagtagcagctgtagtgaagtacgtattttttgttttaattacaggtctcacagattgacctatgattattttaatgtcttgatctgcagctgtaggggacttccactatttaagaagttgctggccgggcgcagtggcttacgcctgtaatcccagcactttgggaggccgaggcgggcggatcatgaggtcaggagatcgagaccatcttggctaacacggtgaaaccccgtctctactgaaaaatgccaaaacttagccaggcgttgcggcatgcgcctgtagtcccagctactcgggaggctgaggcaggagaatggcatgaacccgggaggcggagcttgcagtgaaccgagatcgcgctgctgcactccagcctgggcgacagagcgagactccgtctcaaaaaaaaaaaaaagttgtctccagttctgtaaggcaaaacaaactggttggaaaagattaaagtattttatactacaatatgaatacttgggttattggctttaggcatatctacatggtacttacaatactagagaactccttgaatatattcatctagcccagatgttttgaacaactgtgcatgttggatacatgtagtctttccagctttatacatgagccacaatgtttttggacctgttatccctcagcctttgggaaagagaatgtctttttctcctgttttatgagctgtgtagtgtgcgtgtgtatcttagtgaactaagattggatactaatctgggatcagaatcctgaatatggctaaaagatgtacgtcttagtacagacatttatagatgatgatgtttaataccgtagcgatcagattccaatgaattaaactgagagaagaaaagaaggaagaaggtagttgaacaattttagaatggttgtttggtcaagaattactaaaatgagaaaatatttaaaagttgtttgaatttttattttattcattagatactggtagacacagtctgggccctctcttaccttactgatgctggcaatgaacaaatacagatggtaatagactctggaatagttcctcatttggttcctctgctcagccaccaggaagttaaagttcaggtaagtttgttcttagttaaattataagtatttcttaccactaattgctttaagcatggcattcaaagatggacaatttcagtagtttaaagtatattcttagcataacaacaaatctgtgatggaaaggggaaaataaataataagatgccattgtagattactaatttctttttttaagatggggtctcactgtcacccaggctggagtgaggtggcgtgatctcagctcactacaacctccacttcctaggttcaaggaacattctcccacctcagcctcttgagtggttgggatcacaggcacacaccatcatgtgtagctaatttttttctatttttgatacagtcagggttttgccatgttggccaggctgctcttgaactcctggcctcaaatgatccttccaccccagcctcccaaagtgctgagattacaggtgtgaaccaccatgcctggccggattactgatttttaatgtagaccagggaagttcattatagcaacatgcatggcatctgaaacaagtattgacagacacttattttttcctactcctcttctttttgttcttcctctttcacttccctacttctttttttttcttccttgccaaccatccttatttactcacctggcaagtttagttaactcttatcttcattggtgctgaaataagggtactctactgaaatgtgctgtttagggactttctaaattgttgcttttcacttatttaaatttattttttattgtttaaattctttcacataatatttatcccaaagaatttgcatttagaaagagccaaaaacagagtgtgagaagttctcagagatataagcagtagctgttaagctacagttgtaatgggggagacgcagcaagctccctctacctttctgaggtaaatagtatattttaatctgctaatggcttagaatctgtaaagtacaataatcgcataagagaaaccgttagtctgtagcctaagtcattatgcctgaacatcaaaataaactgtgtggagctgtttttaatttctcctgctcaacccctggagatttctgtttcagaaaatatttcttagaaacttgagctttaaaatgctcttcaggtgatactgatacatagtcagattagagaccctgtaccttaaaattaaagcactttaaagaaggaacacttagctaaatacagaaagaattaatataattggctggacatggtggctcacgcctgaaatcccagcactttgggaggccgaggtgggcagatcacaaggtcaggagactgagaccatcctggccaacatggtgaaaccctgtctttactaaaatacaaaaaaaaaaaaaaaaattagccaggcatggtggcatgtgcctgtagacctagctactcgggaggctgaggcaggggaatcacttgaacccaggaggcagaggttgtagtgagccaagattgcgccactactctcctgcctggcaactgagcaagactccatctcaataaaaaaaaaaagaaaaaacaataatttgtcatttaaggctatttatgacttatcttaaatattcttgccatatgtttatccttaagtttgtatttattttgtgtggtacttatgtcttggtacagaattttggtttgtattttgttttttgtttttccagaaataatcttcagttttcataatggacttcattaaggatctgtagggcttggaatttacctttagccagtgctcaaagaaagttgaaattctctactctacctgacaccttatagagattttcttatacttttcaactttcatgccataatttcataaaataaaatagtgtaatggaaccccatgtagcttttttctctgtacctctactcctccaaatttattttgatacaaattccagatatcattttacacagcttgcagctctaaaatttaagcctatttttttttttttttttttttttttgagacggagtctcgctctgtcgcccaggccggactgcggactgcagtggcacaatctcggctcactgcaagctccgcttcccgggttcacgccattctcctgcctcagcctccccagtagctgggactacaggcgcccaccaccgcgcccggctaattttttgtattttttagtagagacggggtttcaccttgttagccaggatggtctcgatctcctgacctcatgatccacccgcctcagcctcccaaagtgctgggattacaggcgtgagccaccgcgcccggccgcctattttttttaacataaccacaataccactagtagactttttaaaaccttaatgttaaatattcagtcagtatctggattttatttactgcttcattattttttcacaattttaccaaatcagtatccagataaagaccacacattgcatctgcttgctatatattttaagcctcttactgtgcaactttcttctcctttcttttatctttcctcttttcaatttatttgttaaagaagctaggctactacaaaacatttttggaaaacattaaagaagacctaaataaatggaaagacattcatgttcatggattgtctaatattgttaggatgaccgtgcttcccaagtttgtctacagattaaacacaatccctattaaaatcccatgtgcttttggtttttggcagaattttacaaacagatcttaaaatccatatggaaatataaggggcctagaaatagccaaatgatcttgaagaagaacaaagtttgaggacttctcattttcaaaacactgcaaagctacagtaaataaaattttgtgatactggcataaatatagacatgcagatcaatgagatagaatcgagttcagaaataaacctatgcattttatgattagttgatttactttttttgtgtgtgtgtgtgagagtcttgctctgttgcccaggctggagtgcaatggcatgatctcggctcattacaacctctgcctcccaggttcaagcagttctcctgcctcagcctcccaagcagctgagattacaggtgcctgctaccatgcccagctgattttttgtatttttagtagagatagggtttcaccgtgttggccaggctggtctcgaactcctgacctcaggtgatccacccgcctcggcctcccaaagtgctgggattgcaggcgtgagccaccgcgcccggccaagttgattttcaataaggaagccaagccaattcattggggaaagaataaccttttcaacagatgggcaagaacgactggatatccacaagtaaaataatgaagttggaccccacttcatactacatgcaaaaactcagaataggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcagctactcgggaggctgaggcaggagaatggcgtgaacccgggaggcggagcttgcagtgagccgagatcgcgccactgcactccagcctgggtgacagagcgagactccgtctcaaaaaaaaaaaaaaaactcagaatagatcaaacacctaaatataaaatctataaatttaaacctcttagaagaaaaatacaggcataaatttttatgaccctagattagacagtggtttctaagatgtgacaccacaagcaaccaaagaaaaagaattgataagtcaggcttcacaaaacttacaaacttgtgtgtgcttcaaagaacaccatcaagaaagtgaaaagacaacccatagaatagaagagaataggtattagaaaattatgtattggcaaagggatttacatctaaaatatttaatgtataaagaactgttactactcaaaaatagacaactcagtttttaacttggcaaaatatttgagtaagcaggcttctaaagaagatataacaaatggtcagtaagcacatgaaaagaagctcaacatcattagtcattaaggaaagggaattaaagccacagtgagatactacttcacacccaccaggatggctatagttaggaagacgataacatacttttggtgagggtgtgagaaactggaattcgtatatactgctggtgagaatataaaatggtacagccgctttggaatatagttttggcagtgcctcaaaaagttaaacataaggttacaatatgaactggcaattaattactcttaggtacatacccaagagaaatgaaaatgcatatccacacaaaaatttatacacaagcattcacagcagcgttatttgtaatagccaaaaaatgaaaacaatttgaatgtcagccaatgaatggttaaataaaatatgatacattcacacagtgaaatattatttggtcatgaaaaggaacaaagtattgatgcatgctgtaacacgaacttttaacaacattatgtgaaatgaaagaagctagacaaaaaaggccaaatacattttgattttgttaatatgaagtgcccaagatagccaaaatcttagagacaggcatagtgtcttccagggacctagggatgaaggcagtgtgggagtgatcactaatggatacaggtgttctttttggggtgatcaaagtgttctggaattagatactagtaatagttacacaactctgaatatactaagaactactgaattgtacactttgaaagggtaaattttatgttatatgaattttatttcaattttttaaaaaatttggatcatttgtcatgtagaaaggaaaattagaggagtaaaaagctttacttaacaggaaatgacctcatgcaaccacagaaaaataattgataattcaaattcataccatagtgaaatctcatgttaggcaggtatcttctttccttcagaaaggcactatgttttttgtctttttgtttttgacagggtcttactctgttgtccaggctggagtgcagtggtatgatcacagctcacttcagcctggacctcccaggctcaagcaatcctcccacctcagtctcccaagtagctgggactacaggctcgtgccaccacacccagctaatattttgtagagacagggttttgtcatgttgcccagcctggtgtcaaactccagggcttaagtgttccacccacctcagccttccaaagtgctggaattacaggcgtgagccactgcacctagctgtttttatttttatattttcaacactaaatctaaagttctgtcttttttttttttatggcactatctaaaattatccttcttgtttattgactcctctcttacaataatataagctctgtaagagctggaacatgtgtctatcttcacatctctgttcctacatcagtgcctgatgctaagtgctcaaaaagaataggtttcttggagcagggtgcagtggctcatgcctgtaatcccagtactttgggaagccaaggcaggcagatcacctaaagtcaggggttcgagaccagcctggccaacgtggcaaaaccccatctctcctaaaaaaaaaattacagaattagccaggtatggtggcacgcgcctgtaatcccagctgctcaggaggctgagccaggagaatcgcttgaacctgggaggtagaggttgcagtgagccaggatcgagccactgcacttcagcctgggcgacagagtgagactccgtctcaaaaaagaataggtttgttggaagaaatagtgaatgaatgcatttgtcttttataaggtacctaacatgccttttaataaggagtgtttcagctgggcacaatggctcatgcctataatcccagcacttttggaggctgaggcaggcagatcccttgagcctaggagttcgagaccagcctgggcaacatggtgaaactctgtctctacaaaaaatacaaaaattagccggacagggtcgtgcactgctatagtcccagatactctggaggctggggtgggaggatcacttgagcctgagaggcagaggttacagtgagctgagatcgcaccactgcactctaccctgggcgacagagcaagaccttgtctcaaaaaaaaaaaaaaggatttcacatagaatgtcatctcattgtgcatttcagactgctgcacttagagctgtgggcaacattgttactggaactgatgagcaaacacaagtagttttgaactgtgatgctctttcacacttcccagcactcctgacacatcccaaagagaaaattaataaagtaagtactattaaatactacttaatagatagcacttaaaatgttaacagtttctatttgtaaaattagagtcttagaaatgtctgtaatattgattcttaatacaaactgtcatttagacatcaagagaaaataaaaattttactctccataacaagcattaataattttttcatacataaaaccagttatgaaaagtgcaattttggctctcttggaaatgatgaaatagagataattgggtgttgaatgttgtatgactggaaatttttaatatgtatattatgtaattcttataagtttagtgttttataggtacttaatagagagtgtgtatgcatgtgtgtgtgcttgtggtggctatggaaagggggcactgactggtgatgctgatattggagtgcatctgaggctgttgtagaaataacatgggttgttgattacaacattgccaatgattataacccaagaacagctcacctaactagcctggcaccctaaaatctctaacaggttcattaaaatggtcctgtgatctgatccaaaagagcctagtatacattagctaatactaatattttttagagtaaaacttattagttatctatgattataacgcgtaaggccaccattattttgtcaaaagtagcaccaactgtgatgtaaagggtaacataaaaagattaagataggccaataaaacaatcaaatatctggttccacttttccttgagagaaattatgcagtgaatgactattacaaataagtatactaaaacaatgcactttgttttttatgtctccattgttgtggataattgatatttatctactttggctaagattcttcatcagaatagaatagagaataaagcacattatgtgagggaagggcactgaatcttatttacagctgttttaggatttgtatttgtattatactcattattcatatttgctcattcattatttcatatttgctcattcaaatttgttcagccaagcttcttttgagccacactgtttgggagcattgttttcaataattcttccgaagggttagttcattgtgatttgaattaggtccattagctgtttgtccaaagaaaatatggaaaggggtgtaaaggaattgagattcctgagatttttattatggagctcatttcgtagtaaaatcattgggacagtgtagtgaatgcttttttacttagttcagatgcagattttattttttaatgagaaatattcaaatgctcttgttctacaggaagcagtgtggttcctctccaacatcactgcaggaaatcagcagcaggtacaggcagtaattgatgccaatcttgtaccaatgataatacaccttttggataaggtaagaaaatcatgttatatgtatcatttatctgatgtaaggggaaggggatttaaatctgagacattatgtgaatttatactttctgcttaattagaagccatacagtggcataaatatagtaaagtaatattaacattacgacttttgaacctagccatttttatatacaagaaactttttggggggtggggggcaaatcctagccctttctgtgtatcattcttttaccaaaattgccattatcctaggccatactaaactttcatatcgttactgttgataataaatgcttacatagtattctaagcactttacatacattacctcattgaatgacattaagcctataagattagggattattcccacttgatagatgaagaaaccctggtatagacaaataaattgtccaaaatcaaatagcaaataagtatgctattgtatgccatatcatctctcatgctcatattagcatttgggagaaacagtttatcgcaattacagcatgaggctgggtgcagtggctcacacctataatcccagcagtctgggaggccaaagcaggaggatcacttgagcccaggagttcaagaccagcctgggcaacatagggggactccatctctacaaaaactttttttaaaaaagaaattagtttggtgtggtagcatgcgcctgtggttctagctacttgggaagctacggtgggaggatcatttgaatccgggaggttgaggctgtggtgagccatggtcatgccattgcattccagcctgagtgacagagcaagaccctgtctcaaaaaaaaaaaaaaaaaaaaaaaaccacaaagtagaagaaacaatcacagcatgagggttctgaacactgatctgtaattaaagagaagataaatctgtttctctgtgtttcctgtaaatcgagttcagttttttaggcaagaatatgtcatgcacaactctatttcctaatgattcacatgaggagacacagtctgtcttacatgtagtgatattaagattgttgagtgatctgaggtgttacagcctattccagctgatggttataaagttatccattaatctttcacctatggtttttaggtagccattgatgatccttgttaggatcccttgttttactaggagttgcaaaatggtgactttctaattccgtcattctttgtgtattggccatgattctttagtaaagaacttgtcttgttttttgttttgttgtttttttttagacggtctcgctgtcacccaggctagagtgcagtgacacgatatcagctcactgcaatctctacctcccgggtttaggcgattcttgcgcctcagcctcccaagtagctgggactataggcgcacgccactacacccagctaatttttgtatttttagtagagatgcggtttcaccatgttggccaggctggtctccaactccccacctcaagtgatcaggtgtgagccatccatgcccggccaagagcatttctttatcagctattgtttattaatactttgaaatacagttcatttaggataggcaagataaatgtttgattctttgtccttatcagtcattttttagaatgactcgttccctaataaccttgaaagcagaccagagtagatttttttttagtgtcatttggaaattatgaatttttaaaatatattttgcaagttttaataccttttagttgttactctttttgatactctgtttgttcctgaccaacaggaacctcttagaattggtgacctgtatcttttatgttatcactagtttttgagagctacaccttttggatatgacatgattcccaggcctatcttacatgttttctgatctagaactggaattaactatttttctatggtatcttgattttgttttgtagagaatggtgtttaaggatcatatttcagctataaaggtgatcattgttataatgttgtcattttttctaggcctgaatcaacaaaataaatgataggcattgtagaaagtgaaagatgatgagttcaggaacatgagagttcataaaaaatgaatcatgaatgaaagggagctattaaatattattggatatttaagataacagggtttttaatttttattcctatgattttatatttacatctcttttatgctgaaaatcttcctaaaaacattagcataattacttatttttcttacattttggtatgtatagatctgtggatacatgtcaatatacattatttttaagtacatcattgatgatatatatcctaaagaccataaaaaactcctaattttcagcatgagacaaaagagatgcaaatatatttatatatatatatataaaaataacaaagccgtattgcccctgacaacatgactactgaatgtacttttaagatttctttgacatttgtttgcccttagaatatatttcatcagtaatgtacttaaaaaaatgtcagtcccatagcactatatagagagcttctttattccttgtttttttttcttattccttgtttttcttattcctttcatagctacatagtactgcattgtacggatgcactataatgtatgaagtcaatctattaatgatgatatttgagatgtctccagtgtttgttgttaaatagtactttaaagaatagtggccgggtgcagtggctcacgcctgtaatcccagcactttgggaggctgaggcgggcagatcatgaagtcaggagatcgagaccatcctggctaacacagcaaaaccccatctctactaaaaatacaaaaaattagccaggcatggtggtgggcgcctgtagtcccagctactcgagaggctgaggtaggagaatggtgtgaacccaggaggcagagcttgcagtgagccaagattgcgccactgcactccagcctgggtgacagagcgagactccatctcaaaaaataaataaataaataaaagaatagcttgtggctgggcacagtggctcacacgtgtaatcccagcacttgggaggctgaggcgggcagatcacttgaggtcaggagttcaagaccagcctggccaacatggggaaaccgtgtctctaccaaaaaaaatacaaaaactagccaggcgtggtggtgcattcctgtagtcccagctactcaggaggctgaggtgggagaataacttgaacccaggaggtggaggttgcagtgagccgagattgcgccactgcactccagcctaggcaacagcgaggtcctctcaaaaaaaaaagaatagcttgtaagtttttttttgatgtttttgcccgattatatttgggattactagatctacagataaacatatatgtaaattttgctattatagggctaattcccctataagaattatgccattttatactaccagcctcacacacaaatatttagattttcttattctgataaatatgaaaggagatatggatattttaatttgcatttcttttatttatgtggttttttaatacatcataagcattttttcaggttgccacttgtcttaatatttaatagttgcttattcagtagatttaccataattagacaattatgcttattgagaattttagttgtttttactttttggctattatggtgctgtgataaccatatatagaaagatattattactctgctttatgttattttcttggtaaattctcaaaaatgagattatgaagtttatgtatatgaattttttaatgacttttaaatatttcttcgcttcatatttgaaaaggcaatgtataacatctttatcatagtttcattaatggtgggtatcatttttgtgtgtaaaagctttgtgtgtaaaagaatatgttcgtttacgtgactttgtagtgaaattgtagatttttaaattttttctttactatttttatttcattttatcatcaacttcatttaatctgataatattagataataatatcaactcagtttgtttccaggagatttcacagaaaggtgtctccatgtatttagggtagattgggaatagttcaaagacctgtcttaataagaaaaaatgatatatacagaaagactaaaaggagaccttgggaaataagcagttgaaaaatcatcacagcaaacattttttccagtttactctatgtggcaatttttatagcctttgttttgcctttttacagggggattttggcactcaaaaagaagctgcttgggccataagtaacttaacaattagtggaaggaaagatcaagtaagttgagctttttaaaatttatttctcaaaactggtaaaataaaagtacaggtaatattgatttagatttgagtaagttataatttaaaataatagcaacaccctgggaggccaaggctggaggatcacccgaggccagggttttgtgactggcctgggcaacacagtgagaccacatctctattaaaaaaataaaataagagcaagataacaggtactaacttttatataacaggtatataactttctttgtcacatagaagtatcaccttgacttcctttcgtcatacttcatagaagtgttctttttcccaatttattggcctacaagaattttttaatccatggtaaaattgaggcccctatagtcaggagttttttgttttgttttgtttttttaacagtattaggaatgaacagacttcttaagttaatatggaagaaactgcatcacacattctcctaacaaatgaacaacaacaacaaaaagtaaaaagacagcaacaataacaaattcatcagcagcaaaccaaacaaggaattaaaagctcaaccagatggctaggacttaggaactagggtgaggaatgtaagatgcctaggaaagaggcacccactctcaggtcgtgcgggtgacaaagcttaacattgtgccaactggcaaaggaaaaacagttttaaagaggttagatctgtttcacagagtaggtaaaaagaacaaatttagagctgaatagcaataaattgataactgtaacaaaaaggctgcagactggtggttttcagtgaattcacataaatacagagcagaacaggaatattaatataatgcatggaaattataactaatgaaatactgaaatcattggaaaatattgtgaaatcaatagaatagtgaattgagaggtagccaggcacatgtgagccactggatgctgtcacattgagccattgtagttttttgaaactagtatccaggcgggatgcagtggctcatgcatgtaatcctagcattttgtggggccaaggcaggaggatctcttgggttcaggagttcaagaccagcctgggcaacatagtgagacccccgtctctatatattaaataaataaataaatcctgcgcaacatagtgagaccccatctctctatatttaattaattaattaattaaattaaaaatagcatacagcctccattaacagcctccttaactgatttcataatttcttactcttaaagggaaaaatctttgaaggaagtatttcttatggcaaagaaatgtttaatatgaagttgagtgattcctttattttaactttacgttgtttttttctaagttcgggaaaaaggaaactaaatttaaaagaaaaggaggttagattaataatgtgggcacacttaacatgagagagatgaggtcatatttctatactcgaaatttcaaaatcagaattattccagtgagataacatggcacacaaagtttacctatattgcattattttatgttgtttttattcttcaggtggcttaccttatccaacaaaatgttatcccacctttttgcaacttgctgactgtaaaagatgcacaagttgtgcaagtagtactcgatggactaagtaatatattaaaaatggctgaagatgaggcagaaaccataggcaatcttatagaagaatgtggaggtaagtttattataagctcttattccacatcttaatgttctctttgtaactacctttatttgccgactaatatagcacatctatatttttctgtcttagatattcaagtaacagaataaagtaaatattgtattctatatgtgcagtcctgctcagcctcttgcatatgcttaggtaactgaattgctgccatatattgaacaggcactgtgataagttactgggaagacagtggtaaacaagacacagtccttgccctcaaggcatgtagtctagtcttgataaatatgaactgatttaatgtgctaattaccctaatagaaatgtacaacaaaatgggatgcctaatccattctggaagaagcaggaagtgcacctgagctggattttgagagatgaataaggattaataaggtaaaaagggatgaaaggtgttccaggcagagataacaccatgagcaaagtctgaggtcagaaatagcattcagcaaattataagtagttcagtgttgctgaatcacacagtatggggtagaaactatgaagagacaaagctggagaagtaaccagcctcctatgaaggctttttttttttttttttttttttgagacagtgtcttgctctgttgcccaggctggagtgcaatggcacaatctcggctcactgcaacctctgtctcccaggttcaagcgattcttctgcctcagcctcctgagtagctgggattacaggcgcctgccaccacgcccagctaattttttgtatatttagtagagacggggtttcatcatgttggtcaggctgctgttgaactcctgacctcaggtgatccactccccttggcctcccagagtgttgagattacaggtgtgagcaactgcgcccgacctcctgtgaatcttaacaagctttatggcacagtagatgttttattctttagggcaatagtttcgaaacatggccatgtaccagagcctcctggaatgtaaacaatacatattagctttcaagtcttagagttaatatatagacagaacatgaaaatttcaaatgtggctgtgtaacacagtgtgttatcaatctggataagcataaatataaaggtatttctgacagaagttgaaaagtgaatgaaaagagaggtaactgcaaaagtaggagaacccataacttcaactaaatgggaatggtgagcggcttcaaaattaatgtagtaagaaatagatatatttaaagttactaaagtgactcatagagcaacaacaataaaaaaatctataactgtcgagttaggaacaagagatggggaatagtgttacagaactaattagggattaagtaacaaaaaataacaataggcatacttaattatttttactacttgatttttttaacttgtaaacattttaattactaaaatatctttatacattcaagtaaaaatgtaagttcttgaacattgcctacctcactggaggtaagacccaggaatccccagtggattgtgccataggagtggcaggccattggtgattcatctaggggatggggtgcattcaggtggaacatggatatctggggaatgaagcctttggagaaaggaggcaggaagagaccagttaagaaagtatttatggccgggcacagtggctcacacctgtaatcccagcactttgggaggcccgaggcgggcagatcacctgaggccagaagttcaagaccagcctggtcagcatgatgaaaccccgtctctactaaaaatatgaaacattagctgggtgtggtagcgcacacctgtaatcctagctgcttgggaggctgaggcacgagaatcatttgaacccaggaggcagaggctgcagtgagccaagatcacgccactgcactccagcctgggcaacagagtgagactctgtctcaaaaaaaataaaataaaataaagtatatagtggccaagccacaataaatgaaggcagtaataatagagacaaaggggagatgaggagatttaaagtccagtggatggactttcaagtttttgaggtttgattgtgggatattgagggaaaggggaacttgggctttctcttaaatttcaagctattgttgattatcaccaaataagaatacaactgtaggatgaaccgtttaaatgaggaaggcaaataacaaattgtgttttggacagtttgagttttaggtagctatgaaatttcctggtagaattacacaagcattttagttttatgcatgtgaagctcagaaaagaaatgaagctatagatttgcaagtcctcagcctatgtgtagtagccagattttttaatgggaagatcaccagaatgagtgtgtaggtgagaagtgagcctaagataactttctccatttaagaaatggatagaggaagtacactcatgaaggggcaatttcacttttttcaaagactttaaaattatttttcctctaaagtaaaacaggatccaatttgtgtatcaacaagttaagtatatactttttaatgtttctgcctataatttaaactcattaatgtttacagggaaaattctcttttcccctgaaatactgtgttagatcttcatcattttccagtaaacttaacaggtatcttaagcatcatatttattaatcaccagtattttaaatttattttcatacgtgctcactagaaaaacttggcaggtgctggaaagtaggaagattccgctttttacttaaatggaattttacatgttattgctggttataaacattggttatgtattctgatgaataggcagatgtctcattacttatttatacacttatttgtacatttacaagcagttagacactcaggttgttgattttaagataaatatgctgtatctttgtgcataaaatttttttatatttaagattcacctttaaattcccaaaaattataattcaaaaaatttgcgattcagaaattggattatgtgttccaaagattattctaacttgtcactgctctttaaatattactattgtttcacattgcaaaatttcttgcagggctggagaaaattgaacaacttcaaaatcatgaaaatgaagacatctacaaattggcctatgagatcattgatcagttcttctcttcagatgatgtatttaataattttgtagttttcttaattttatatataaacatagatctggataaagtaatatatatagtaagctgggggacatacatgtgtatttgtttggaatggaattaaaatagatgtatgacagtaatgtcacctgctttgaaaacaaatatttcaatattttaagatcccttcagggcatattagctctaatggcaagaaataaggacttttttgaccaaacgagatgagtcagactttattttcacttggtgtctttatagttctcattttttaaaattgttaatagcataccatatttataaacaaaacagtgatactagtatatcctgtaataagttctttatgacagtagttaatccacacttgatgggttgtcactgtttttatttcatggccaaaaacaaatacgaaaataaataagatggaaataaaaaggtaaggcactatataatgtaaggtatagtatacaaaaatatcttcagattgttagtaatagtagtggaaattaaagtattaacttatttttagtatttcctctttggaaaagtaaatctaaaattaaaccaattgctccttagaaaattttatagtggttcagtgcagccaccagaggatttctttaatgatttctcagcttttcaaagaataagtcttttactgcatgcctttccatattatcaaaaagaatagaatgttattaaacattttgttaagtatgtatagtttgaacattaacttgacaaggacaatattagaaaagaaaattatagactatttacttacagttgtttaagcttagtcctatttagaatataatgccagttaaataaaccagaaataaaattaagaaaagttttttttctttctttctttttttaaagacggggcccaggctggagtgcattggcgcagtcacagctcactgcaacctccccctccctggctcaggtgatcctcccacctcagcctcccaaatagctgggattacaagtgcttgccactatgcccggataactttttaagtcttttgtagagacaaggtctccctatgttgccctggctgagcttgaactcctggactcaaacaattctcccatcttggcctcccaaagtgctgggattacaggcatgagccaccacgcccagcctggcatattcttttaagagtaactttgatcgtatgtcttgaagttggatttttgaaaatcataatttgcaatttggtgactaattgtaatagcctcataatttctaatacctcaacatgtagttttcgttcttgacttagattgtgaaaagaataattcagatgatatacatagttataggaagtacactacaggtttgtaatattgtggaatttccaaaaggagcctttagatgcaaagcatatagaataatgtatataataataataataaccattattagcagaactattataggtggagtatcccttacctgaaatgcatgggaccagaacagttttggattttggatttttttgaattttagaatatttgaattatttctaccacttgagcatctgaaattcaaaatgttccaatgagcatttcctttgagcatcatattggtgcccagaaagtttcagattttggaatattttttgttttgtactttcagattagggatactcaatctgtattttactattttaagcccaaataccatttgtctctaattgctattgaaagatataccaaagattcactttccaaaagtggtggcattagatttttttttaatgtgattgtctttatgtacttgcccggggtttttttgttttgtgatttgttttgttttgttttgttttgtttgagacagagttttgctctgtcacccaggctggagtacagtggcacaatcttggctcactgcaacctctgcctcccaggttcaaggaattctccaccctcaacctcccaagtagctgggattataggcgcatgccaccatgcccagctaatttttgtatttttagtagagatggggtttcgccacgttggccaggctggtcttgaactcctgacctcaggtgatccacccgtctcagcctcccaaagtgctgggattacaggcatgagccaccgcgcctagctgtacttgcccaggtttaagggaaattgtaatgagaccaaattttgcatcctctctttgagacttagggccatcattactgttccttcattcttttggaaaatgcccgtcttacatattctcttttttctcattttggcatcccttaagaaaaagtcttgggtaggcactgtggctcacacctgtaatctcaatactttgggaggtcaagacaggcagattgcttgagcttaggagtttgagaccagcctgggcagtatggtgaaactccgtctctacaaaaaatacaaaaattagccaggcgtggtggtgcacacctgtagtcccagctactcgggaggctgaggtgggaggatcacttgagcccaagaggttgaggctgcaatgagctatgtttgtgctactcatctccagcctgggtgacagagtgagaccccatctcaaaaaagaaagaaagaaaaaaaaaaccttctataaactgtttcaattttctaaaggatggtaagacagtgttggcattcatcatctctccagacctttttttaagggtaatgggattagtactataatactgtttatatatattttaaaactaattatcacattctttttcttttttttcacctagattgatgaagaccctagccttgttccagaggcaattcaaggcggaacatttggtttcaattcatctgccaatgtaccaacagaagggttccagttttagaaagatgttgtggaagttaggtacaatgcagcactgagatatatatatatatatgtgtgtgtgtatatatatatatatatacatatatataaaaaggtttgatccatcaagcttggctcatgggatctgctgctgcattaaatcgggaaagaaaatgtgaagatttcatttggaatcacagaaaatgcccaaatgaggtcaagatggcgagtgggtgcgagtgagaatgagtggcaaaatgtaatgaaaactttacatgaatgcttatttaggttgttcaaagtaaaaagggctacaggtcacagatcgtcagtgcctgagaaagaacattgacttactctatatcaattgaggggaaagtgcagtaccgtcatcttcaagccttgtaagcataaaagagaataggctgcccatataagtcaaaggaaaatgagcccaggccttgctatgaagcagtgtgtgaatggacaatgttgaatgaatgtctggctcagtgatggagagccaggttcatctttgaaatctagggctcttcactcatgaagcagactcctagtcctggagtgactgtgtacgagagcgtggttgtggtgctgtatgtgaacgcatgcaagcttgattcaccttcagggggctgataacctagtaaatcatcaaaatgagatcataagtgttaatgtacactggacatgaaaacaaagactggtttagcagcagacattggtttactctgcagcctgtgttttctgtttccccctttcccacctccttccccccacccaatccttttttttttcttttttgcttttcttttctttttttttagtttttatttactttacctagtatgcctttttttagttgcttctcaagtcagaaaacttttcaggaaggtttccctgtgcatttgcaccagatgaatgtttgatgctatgaaaagctttccatatcatcaaaactaatttgtgtagatttttgcatgaaaaaaatcataaatttccctcaaaatagactgtgttgcagtacacaagttgccataatagtataaaacagtaaaatgtgcttaaaaggccatccttttcattttcagagataacataaagatctttgcatgaggtaaatctacagcatagttcatttttagattttgttgagtcctgtaaagaagaagaagaaaaaagtttcagttgtggtagaataccgtgctgtgtttaaatgttacttgttttcaaactttgttttctatgaaaatgatatggaaacttctaaaatggaatttggtgcatatgtactgctgaataaagaccgatgaagaggtttgagtagatgtacaaatcaagtaatggtttgaacacctttaataatatgcctaatctgttcaattgttttagaatctttttatcttagatgtaggcagccatgaacaatctattttgagccactttagggagaaaactttgtatttttaaaacttgcataaaagttatgcaagtggtttttataaattggaataatacctcagttttgaggttatgcacactaaattaaatgtgacataaattaatttgtacaaaaagaactctttataaggtggctcattgtaggaaatcctgtgccttcccctttgagcacaagtgttgcatgaacaacagtttgctataagaaacataccagattagccaccattagcatctatatctactttgtgtttaaaaatcaactggtaattctgaaacactgtagaatggataaaaattattttgtgatcataactctttgttgaactagagtatttttgcagcattccttgtcatcagaaacatggttaaagtttaaaactagaagcagcagaaaactagcttgtaaaatttatccaagtagagtgcaggctaggctgtcttggggaaataaacattaaaacttaaagcaatgttttacatggggtgtgtgtgtgtggtgtgtggatttttttttttttataaagttagagtataattcaatggcttacattagcttcctgtctttttacctagaaccagcataataagaaatttctttggttctgtcatttcagtatggacatattaatattttagcccactgagtttgtccagttgacaccatcagtgcttcagttttctctctatccaaagcaaggttttaactttccttcattctccagtaaaacagaccgagacaacttgaactatattttgagtattgcta

SEQ ID NO: 17382 - DNA, 13537 bp, Human
tttaatatctgtttttctccttctcttattcggaccttgtgtcttccgtttagtttttcaattcatacaaaaccgcatccaggccatcaccaatcgttctatacaataaatgctccttctaacaaccccacaatatcgccccttaccacaaaatcttccttcagcttaatctctcccactctaggttcccatgccgcccataatccctctcgaagcagccctgagaaacatagcccattatctctccataccacccccaaaatttttgctgccccaacacttcaacactattttacattatttttcttattaatataagaagacagcaatgtcaggcctctgagcccaagccatcatatcccctgtgacctgcacatatacatccagatggcctgaagtaactgaagaatcacaaaagaagtgaaaatggcctgttcctgccttaaccgatgacattccaccactgtgatttgttcctgccccaccttaactgagcaattaaccttgggaaattccttctcctggctcaaaacctcccccactgagcaccttgtgacccctgcccctccactacccacccaaatcctataaaatggccccaccccatctcccttagctgactccttttttggactcagcccgcctgcacccaggtgaaataaacagccttgttgctcacacaaagcctgtttggtggactctcttcacagggacgggggtgacaacaacacggacacacatggagtggttttaaggagcagagagtttaatacgcaaaaaagaaggaagaggctcccctgtacagacacagagggagggggctccaagccgagagaaggaaaccccatgtgcagtggaaaagtggttgattatactgggaggctggaggaggcggtgtctgatttgcacagggcccaggggattgggttgaccaggtgtatcattcatgtaccccgcaaaaaacctggccctcccacctcagccctttaatatgcaaatgtgggttgccatgatgttctgaaaacacatgaattatctggagggggccatgacacttggtacatgtgctgacaagaagagggtgggaatcgccatggtggccatgttgggtggacctagtttttaatagcctgcatttgcatatcaaagtttgctggcctggctctttaagctgtcttttctgttagaaaaggaatggtttggaatgggtgagggttgcttcttattacaagaaaatttccaaaaacctttactctttctagctgccaaaaaactatttcttaataacttatgtattaccataattaggcagcaccaaagatccctgcaggtcagaccactgcaattaacatgctggctttactgctgattatggtagctgcatccacctagcctctcatattgcaactgcctgacctctgccaccccacgagccacttatccccacttataatcagcccatttcgattgtaacatctgccacttattcccgacgttgtggtatatcctatagatgaattcattcaacatccattccaacaccacctctcttgccttcctatactctctggagagtgaattactgagtcacatgatcttcactgcagtcatttgtggctatgtgacatagttctggacagtgaacatagacagaagtccctggggcgggcttcctttctgggatgagggcaaaacgcctggagatacagcaattatcttgcaactgagagacaggactagctggatttcctaggccgactaagaatccctaagcctagctgggaaggtgaccacgtccacctttaaacacggggcttgcaacttagctcacacctgaccaatcagagagctcactaaaatgctaattaggcaaagacaggaggtaaagaaatagccaatcatctattgcctgagagcacagcaggagggacaacaatcgggatataaacccaggcattcgagctggcaacagcagcccccctttgggtcccttccctttgtatgggagctgttttcatgctatttcactctattaaatcttgcaactgcactcttctggtccatgtttcttacggctcgagctgagcttttgctcaccgtccaccactgctgtttgccaccaccgcagacctgccgctgactcccatccctctggatcctgcagggtgtccgctgtgctcctgatccagcgaggcgcccattgccgctcccaattgggctaaaggcttgccattgttcctgcacggctaagtgcctgggtttgttctaattgagctgaacactagtcactgggttccatggttctcttctgtgacccacggcttctaatagaactataacacttaccacatggcccaagattccattccttggaatccgtgaggccaagaactccaggtcagagaatacgaggcttgccaccatcttggaagcggcctgctaccatcttggaagtggttcaccaccatcttgggagctctgtgagcaaggaccccccggtaacattttggcaaccacgaacggacatccaaagtggtgagtaatattggaccactttcacttgctattctgtcctatccttccttagaattggaggaaaataccgggcacttgtcggccagttaaaaacgattagtgtggccaccggacttaagactcaggtgtgaggctatctggggaagggctttctaacaacccccaacccttctgggttggggacttggtttgcctcaagccagcttccactttcagttttcttggggaagccgagggccgactagaggcagaaagctgtcgtcctgaactcccggcagtagccggttgagatcatggtgtagccagaagtctcaacagtcgcccatgcatgcacccctatctttccttctgacccatacctcctgggtcccaaccacaactttcttcaaagtgtagccccaaaattctccttacctctgaatatacttcctctgatccctgcctcctaggtactattggttcagacttccatttcctctagcaagttgtatctccaaagggatctaaggaagctctgcgctgcgtccttaggcacctaggctataacccagggagtcttatccctggtgtccctcccaatttaggcatacagctcttgacatgggcagttatgtaggacccactccccaccacccttgccagggccccaagtttgtaaatggctgagggaaaagagagacagaggagagagagagaaatggaggagaaagagagagagacagagaggagagagagacagtgagagagacagaagagagagagagacaaagaggagagagagagagtcaaagagagaaagaaagagaaagaaatagtaaaaaacagtgtgccctattcctttaaaagccagggtaaatttaaaacctgtacttgataattgaaggtcttctctgtgaccctatagcactccaatccactttgtggtcagtgtaaataagagcataggccgaaagcactgaggccattgacaacccgtagcttccctatcaaaaatccttaacccagtaacccgcagatggaccaaatgcattcagtcggtagcgcaactgctttgctaaaagtagaaaagtaacttttagaggaaacctcattgtgagcacacctcacctgttcagaattattctaataaaaaaagcaaaaaggtagcttactaactcaaaaatcttaaagtatggggctattctgttagaaaaaggtaatgtaactccaaccactgataattcccttaacccagcagatttcctaacgggatttaaatcttaattaccatacaaaggtccgaccagacctaggcggaactcccttcaggacaggacgatagatggttcctcccaggtgattgaggaaaaaaaccacaatgggtattcagtaattgatacggggactcttgtggaagcagagttagaaaaattgcctaataactggtctcctcaaacgtgtgagctgtttgcactcagccaagccttaaagtacttacagaatcaaaagactatctcaatcctgattcaaaaggttagctacaccctctctgtaatgcatttgcataagaacttgtttatgggaatgcatcttgatggggcagctgggttgttataaaataggaacccagcccagctctaggactcacccctgagcgcaaaggcaatgttgggcatgctggtaaaggaccactagaatccagcagcccagacccctttctttgtggtcaagaaaggcgggaaaaggggtgcaggactgctacatcggtaagcataactaatccgataaacagaggtccatgggtggttacgcaccctggaaaggaactcacccctgagcacaaaggcaatgttgggcacgctggtaaaggaccactagaatccagcagcctggacccctttctttgtggtcaagagaggcaggaaaacaggtgcaggactgcaacatcagtgagcataactaattcgataagcagaggtccatgggtggtgatgcaccctggaaagaataagcattaggaccatagaggacactccaggactaaagctcatcggaaaatgactagggttgctggcatccctatgttcttttttcagatgggaaacgttccccgcaagacaaaaacgcccctaagacgtattctggagaattgggaccaatttgaccctcagacactaagaaagaaacgacttatattcttctgcagtgccgcctggcactcctgagggaagtataaattataacaccatcttacagctagacctcttttgtagaaaaggcaaatggagtgaagtgccataagtacaaactttcttttcattaagagacaactcacaattatgtaaaaagtgtgatttatgccctacaggaagccttcagagtctacctccctatcccagcatccccgactccttccccaactaataaggaccccccttcaacccaaatggtccaaaaggagatagacaaaagggtaaacagtgaaccaaagagtgccaatattccccaattatgacccctccaagcagtgggaggaagagaattcggcccagccagagtgcatgtgcctttttctctcccagacttaaagcaaataaaaacagacttaggtaaattctcagataaccctgatggctatattgatgttttacaagggttaggacaattctttgatctgacatggagagatataatgtcactgctaaatcagacactaaccccaaatgagagaagtgccaccataactgcagcctgagagtttggcgatctctggtatctcagtcaggtcaatgataggatgacaacagaggaaagagaatgattccccacaggccagcaggcagttcccagtctagaccctcattgggacacagaatcagaacatggagattggtgctgcagacatttgctaacttgtgtgctagaaggactaaggaaaactaggaagaagtctatgaattactcaatgatgtccaccataacacagggaagggaagaaaatcctactgcctttctggagagactaagggaggcattgaggaagcgtgcctctctgtcacctgactcttctgaaggccaactaatcttaaagcgtaagtttatcactcagtcagctgcagacattagaaaaaaacttcaaaagtctgccgtaggcccggagcaaaacttagaaaccctattgaacttggcaacctcggttttttataatagagatcaggaggagcaggcggaacaggacaaacgggattaaaaaaaaggccaccgctttagtcatgaccctcaggcaagtggactttggaggctctggaaaagggaaaagctgggcaaattgaatgcctaatagggcttgcttccagtgcggtctacaaggacactttaaaaaagattgtccaagtagaagtaagccgccccctcgtccatgccccttatttcaagggaatcactggaaggcccactgccccaggggacaaaggtcctctgagtcagaagccactaaccagatgatccagcagcaggactgagggtgcctggggcaagcgccatcccatgccatcaccctcacagagccctgggtatgcttgaccattgagggccaggaggttgtctcctggacactggtgcggtcttcttagtcttactcttctgtcccggacaactgtcctccagatctgtcactatctgagggggtcctaagacgggcagtcactagatacttctcccagccactaagttatgactggggagctttattcttttcacatgcttttctaattatgcttgaaagccccactaccttgttagggagagacattctagcaaaagcaggggccattatacacctgaacataggagaaggaacacccgtttgttgtcccctgcttgaggaaggaattaatcctgaagtctgggcaacagaaggacaatatggacgagcaaagaatgcccgtcctgttcaagttaaactaaaggattccacctcctttccctaccaaaggcagtaccccctcagacccaaggcccaacaaggactccaaaagattgttaaggacctaaaagcccaaggcctagtaaaaccatgcagtaacccctgcagtactccaattttaggagtacagaaacccaacagacagtggaggttagtgcaagatctcaggattatcaatgaggctgttgttcctctatagccagctgtacctagcccttatactctgctttcccaaataccagaggaagcagagtggtttacagtcctggaccttcaggatgccttcttctgcatccctgtacatcctgactctcaattcttgtttgcctttgaagatacttcaaacccaacatctcaactcacctggactattttaccccaagggttcagggatagtccccatctatttggccaggcattagcccaagacttgagccaatcctcatacctggacacttgtccttcggtaggtggatgatttacttttggccgcccattcagaaaccttgtgccatcaagccacccaagcgctcttcaatttcctcgctacctgtggctacatggtttccaaaccaaaggctcaactctgctcacagcaggttacttagggctaaaattatccaaaggcaccagggccctcagtgaggaacacatccagcctatactggcttatcctcatcccaaaaccctaaagcaactaaggggattccttggcgtaataggtttctgccgaaaatggattcccaggtatggcgaaatagccaggtcattaaatacactaattaaggaaactcagaaagccaatacccatttagtaagatggacaactgaagtagaagtggctttccaggccctaacccaagccccagtgttaagtttgccaacagggcaagacttttcttcatatgtcacagaaaaaacaggaatagctctaggagtccttacacagatccgagggatgagcttgcaacctgtggcatacctgactaaggaaattgatgtagtggcaaagggttgacctcattgtttacgggtagtggtggcagtagcagtcttagtatctgaagcagttaaaataatacagggaagagatcttactgtgtggacatctcatgatgtgaatggcatactcactgctaaaggagacttgtggctgtcagacaactgtttacttaaatgtcaggctctattacttgaagggccagtgctgcgactgtgcacttgtgcaactcttaacccagccacatttcttccagacaatgaagaaaagataaaacataactgtcaacaagtaatttctcaaacctatgccactcgaggggaccttttagaggttcctttgactgatcccgacctcaacttgtatactgatggaagttcctttgtagaaaaaggacttcgaaaagtggggtatgcagtggtcagtgataatggaatacttgaaagtaatcccctcactccaggaactagtgctcagctagcagaactaatagccctcacttgggcactagaattaggagaagaaaaaagggcaaatatatatacagactctaaatatgcttacctagtcctccatgcccatgcagcaatatggaaagaaagggaattcctaacttctgagagaacacctatcaaacatcaggaagccattaggaaattattattggctgtacagaaacctaaagaggtggcagtcttacactgccggggtcatcagaaaggaaaggaaagggaaatagaagagaactgccaagcagatattgaagccaaaagagctgcaaggcaggaccctccattagaaatgcttataaaacaacccctagtatagggtaatcccctccgggaaaccaagccccagtactcagcaggagaaacagaatggggaacctcacgaggacagttttctcccctcgggacggctagccactgaagaagggaaaatacttttgcctgcaactatccaatggaaattacttaaaacccttcatcaaacctttcacttaggcatcgatagcacccatcagatggccaaatcattatttactggaccaggccttttcaaaactatcaagcagatagtcagggcctgtgaagtgtgccagagaaataatcccctgccttatcgccaagctccttcaggagaacaaagaacaggccattaccctggagaagactggcaactgattttacccacaagcccaaacctcagggatttcagtatctactagtctgggtagatactttcacgggttgggcagaggccttcccctgtaggacagaaaaggcccaagaggtaataaaggcactagttcatgaaataattcccagattcggacttccccgaggcttacagagtgacaatagccctgctttccaggccacagtaacccagggagtatcccaggcgttaggtatacgatatcacttacactgcgcctgaaggccacagtcctcagggaaggtcgagaaaatgaatgaaacactcaaaggacatctaaaaaagcaaacccaggaaacccacctcacatggcctgctctgttgcctatagccttaaaaagaatctgcaactttccccaaaaagcaggacttagcccatacgaaatgctgtatggaaggcccttcataaccaatgaccttgtgcttgacccaagacagccaacttagttgcagacatcacctccttagccaaatatcaacaagttcttaaaacattacaaggaacctatccctgagaagagggaaaagaactattccacccttgtgacatggtattagtcaagtcccttccctctaattccccatccctagatacatcctgggaaggaccctacccagtcattttatctaccccaactgcggttaaagtggctggagtggagtcttggatacatcacacttgagtcaaatcctggatactgccaaaggaacctgaaaatccaggagacaacgctagctattcctgtgaacctctagaggatttgcgcctgctcttcaaacaacaaccaggaggaaagtaactaaaatcataaatccccatggccctcccttatcatatttttctctttactgttcttttaccctctttcactctcactgcaccccctccatgccgctgtatgaccagtagctccccttaccaagagtttctatggagaatgcagcgtcccggaaatattgatgccccatcgtataggagtctttctaagggaacccccaccttcactgcccacacccatatgccccgcaactgctatcactctgccactctttgcatgcatgcaaatactcattattggacaggaaaaatgattaatcctagttgtcctggaggacttggagtcactgtctgttggacttacttcacccaaactggtatgtctgatgggggtggagttcaagatcaggcaagagaaaaacatgtaaaagaagtaatctcccaactcacccgggtacatggcacctctagcccctacaaaggactagatctctcaaaactacatgaaaccctccgtacccatactcgcctggtaagcctatttaataccaccctcactgggctccatgaggtctcggcccaaaaccctactaactgttggatatgcctccccctgaacttcaggccatatgtttcaatccctgtacctgaacaatggaacaacttcagcacagaaataaacaccacttccgttttagtaggacctcttgtttccaatctggaaataacccatacctcaaacctcacctgtgtaaaatttagcaatactacatacacaaccaactcccaatgcatcaggtgggtaactcctcccacacaaatagtctgcctaccctcaggaatattttttgtctgtggtacctcagcctatcgttgtttgaatggctcttcagaatctatgtgcttcctctcattcttagtgccccctatgaccatctacactgaacaagatttatacagttatgtcatatctaagccccgcaacaaaagagtacccattcttccttttgttataggagcaggagtgctaggtgcactaggtactggcattggcggtatcacaacctctactcagttctactacaaactatctcaagaactaaatggggacatggaacgggtcgccgactccctggtcaccttgcaagatcaacttaactccctagcagcagtagtccttcaaaatcgaagagctttagacttgctaaccgctgaaagagggggaacctgtttatttttaggggaagaatgctgttattatgttaatcaatccggaatcgtcactgagaaagttaaagaaattcgagatcgaatacaacgtagagcagaggagcttcgaaacactggaccctggggcctcctcagccaatggatgccctggattctccccttcttaggacctctagcagctataatattgctactcctctttggaccctgtatctttaacctccttgttaactttgtctcttccagaatcgaagctgtaaaactacaaatggagcccaagatgcagtccaagactaagatctaccgcagacccctggaccggcctgctagcccacgatctgatgttaatgacatcaaaggcacccctcctgaggaaatctcagctgcacaacctctactacgccccaattcagcaggaagcagttagagcggtcgtcggccaacctccccaacagcacttaggttttcctgttgagatgggggactgagagacaggactagctggatttcctaggctgactaagaatccctaagcctagctgggaaggtgaccacatccacctttaaacacggggcttgcaacttagctcacacctgaccaatcagagagctcactaaaatgctaattaggcaaagacaggaggtaaagaaatagccaatcatctattgcctgagagcacagcaggagggacaatgatcgggatataaacccaagtcttcgagccggcaacggcaaccccctttgggtcccctccctttgtatgggagctctgttttcatgctatttcactctattaaatcttgcaactgcactcttctggtccatgtttcttacggcttgagctgagctttcgctcgccatccaccactgctgtttgccgccaccgcagacccgccgctgactcccatccctctggatcatgcagggtgtccgctgtgctcctgatccagcgaggcacccattgccgctcccaatcgggctaaaggcttgccattgttcctgcatggctaagtgcctgggttcatcctaattgagctgaacactagtcactgggttccatggttctcttctgtgacccacagcttctaatagagctataacactcaccgcatggcccaaggttccattccttgaatccataaggccaagaaccccaggtcagagaacacgaggcttgccaccatcttgggagctctgtgagcaaggacccccaagtaacacaaccatgagggtgcaaatgcatgggccactaatggtagagcaagaaaacagaagggccctggttcctcgaaggcatcagtgagctgaaatgcctgccctggatgtcctattcctaggtgtttttctgcctgaagcagattaaaccctttgttcacttctccaagtagggcttctattacagcccaaatcaatccccaccccagatgacatcatcctattaatacttttcaaagtcttcctgtccttaaacttccagcttccccaaaaccccacagaagatcagcagtctgctctcctaagggagcctgggcctgactggcatagctctcccttacaatagtaagcaattaattcagctttgcgacttgatcagtccaaagtggctgccagtttgaaaatctcagaaaggtaccatatgtactaagagaagccctgacatgagggcctaagccaaaagttggcccacatccttcctcttccaaatttaggatgggcactgtaaagataaatatgaatttaataagtttaattccacctgttgaaaatgaggcaagaaattttcctcccctccatgtcaggttattacttgagaaaacttgtatgtgctttctcagtctctttgaaatatatatatgtatataattttttttttattttgagacggagttttgttcttgtttccaggctggagtgcaatggtgcaatctcggctcaacctccgcctccgggttcaagtgattctcctgcctcaacctccctggtagctaggattacaggcatgtgtcaccatgcctggctaatttttttgtatttttagtagaaatgggtttcatcatgttggccaggctggtttcgaactcctgacctcaggtgatccacctgccttggcctcccaaagtgctgggattaaaagcatgagccatcatgcccagcctgaaatacatatacagatatatatatttaaaaactgaatcagccttttgtcagctttatgacctaggaatgtctttctcaaggatctgggaaatgtaaacattaccagatagcatacctatcttccagtttctgtgggagggtaacagcctaatcttaatgagtaccttgcaccaagctataaaagtaactcctgtttccacactcccccacccccgaaaagttgatatcttagataacacaagtggtcacatcaattatcaggtaaagttagaatgaactgtgtgaccagtggtgctgtcaagttctcttagttgaggactatttatctcgaaaacatacatgtaatgggctgtacctgcttggctgtacaaaatggtgaaatttccttctgtctttgtgatctcttagcaaagtgcctgtgatgtgcatcacattctcatttaatttttattcaataataaagcttatctttctctactgccttcatggagaggatttctgggttgagagaagattttgttttttaaattatatttccccaacagcaccttcaccctttattctaaaactgctggctgggtgtggtggcttatgcctgtaatcacaaccctttgggaggccaaggtcggaggactgcttgaggccaggagtttg

SEQ ID NO: 17383 - DNA, 90150 bp, Human
gcccactgccaggcctttgtgcattcttggttctcctccttccagacagcctccttctccttcccgctggggacaccccaactactgtctcctggaaaccaaaaataaaactctaaccccccagccatctgaatggacccctcctctccaccaagggcattccaaacttaacctgaaaaactatttcaggccgtgataggaagtgggagtcaggcctcattatccctcctcccttcaggtttcaggcacagctaagcagtgtaacatcgacacagagacttgaagactgacaacagactctgtggcagtaagataccagcatgacagcaggcccggaaggaaacacatattttactgcaaaacaggtttctttcacatattttgaagtcgctctgcaaagctgttttttgtggggaaaatctacattctgtagagaatccctatccctttcaaggtcttttctcctgagagaattaactagagtctggcaccttttatttatttttccttttttttttccttttttttttttttttttttgagacagagtcttactctgttgcccaggctggagtgcagtggcatgatcttggctcactgcaacctctgcctccccggttcaagcgattctcctgccatcagcctcctgagtagctgggattacaggcgtgtgccaccacgcctgggtaacttttgtatttttagtagagatgtggtttcaccatgttggccaggctgatcttgaactcctgacctcaggtgatccgcccgccttggcctcccaaagtgctgggatgacaggcgtgagccaccacacccggcagagtctggcactttttaataagaaacattaacagtcttttctctgtgaagcctgatacctggaggcttcatttgcctaagaaacttggtctccacaaccccttaatgtagacagtcccttttattgattccaggtctttagataaactctttgaaccaactgccaatccgcatgacctagaagcccccctccaccccccactttcaagttgtcccgccttttccgactgaaccaatgtatatcttacatgtgctgattgatgtcttgtctccctaaaatgtataaaaccaagctgtggccctacccccttgggcacttgtcaggatctcctggggctgtgtcccaggctattggtcacatattggctcagaagaaatgtcttcaaatattttacagagttggactcttcgccgacactgccctccaaggttcaccctgttggtgatgacgggagaagtggcacttggagcactgttcgcaggggcgctgagcctcctctctgcctagctttctttcctgcacatgtggccttcccctagccattgtgtaggcaggtcctccagggagccggcttcgctgcagtctccaggacctggccttcccggtctctctttgcctgacactctcttaggccattcctgttcctctttccccaccctcagaaccggcaggccctccctcctccacagcggttcggccttaaaaagacccctttggggcgcacttttgggctgctcacgggacctgagcttgcaggtgtgaagacccttggagtcccagccaggttcccacttcgttctctccgctccccacccgcgcgacccctcggcgccccgccccatgccccgcgcctttcgatgtccatccttgccgtcccgcgcccgccgtccctaaccggcgtccagagaccctactcccttcggtggccccgccgctcaggccccggccccggccctgcctctctgcttaaccaatggcacgcctcactccgtatggtcccgcccttcccttagagcccgcccctcagtccccgcccttaggtccccgccctccgccgtcgcgaccttaggcctcaccctcttcggagggctttggctctggccccgccccccatcttgacggtcattggcccgcgcctgcgtcgcgggcgggaggcggggcggggcggcgcggcgcggagccgagcaggacggccgccatcttgcgcgcagctggagtcggtgcctgaggttgcagccgagagtgtgcgccagcccgcggcccagccgaagctctttcccgccgcctctccgcgcctcgcccaggttcagctccgcctgaccctccgcttggcacggtcccctgaccctcagtccggcctggtccggccttccagccgccccggggacgatgaacggaggataaatggtgcccaaggcagacagcggcgccttcctgctgctcttcctgctcgtgctcactgtcaccgagccgctgcggccaggtgcgccgcgcgatgggggcggtgtgggggctgggcggcgagcggggccggggtcgccccgggacctcctttcacccgcggcgccctcctgcaggggccgcgcctggggcaggggcgggcggggcctggctcgcgggccgcctggcactctctgcggacgcctgctggagcttacctgggctcgcggcgcctcggacttcgtgcagctctgctgtccaggatgttgcctctgggcccttcccgggagcggcggcggccaggagctacgccacgggcgcaccctctcgccagtccagcgtcggagtcgggctggggacagtggctctcaggggcacctggtttcacagacgtcctcccagcagtggcctagtgccagcctctcagtcctggaaactcctcgcctggacagcggtggttgtggctgtcattcagtgagacgttgcgctaaggaagtcctcaggtcccaccgggcctagaggaggcaccaggagtcagcctagcgttgtgtggccggcgcgagcgtcccgggagcagagacctcgccactgtgcggggcccttagccgtgctgcgtgtatgtgatgaatgagtccgtgctttggaactcccctcggagctagtgtgttcttaagtctgtggtggggaatcagaaccgtggcaaccaggagacccttttctacctatttcggtgtacctccccttgaactgcaccaaaaaatcaaactccctaaatgcagggccgatgtatccatcaggcacaggaatcctggtatcacttgcccacggtacttttagtagccttcgaatgttattttatttttttttaaagtcagcagaaaaaaaatgaacttttaggtcaaataaaatgttttcgtatgtatattaatacagtcatctttatactaatacagtgaaaaagcatgactcttaatatttcttaatggaggaaaggtcccatgaaggcagaagtgccagggccatcttctctgatgacctgggtgtgggagcacggggtgtgtggccctctcctgtgccctagccaggctcccagcccagatacaccgcacctcttggctctgcgcttgtgtcatctatgtggaatgtctgcctcctccctagtgcctgcctggtggccaaggccctgaccggtgctcaacctggacagattcagtgatgcttctctggtctccccatgtagagctagttgctcactgcttttggctgctctctgggcagcgggatgactagttgtggggtggccttggtaagaacagaagccaggaaaagggctacctgtggaggagggtatcatataggctcttggaggtcagaaccaatgggtttgtggattcttgtgattaacttctttagaaaacatatatgtacgtgtagagaggtagaaggtcaccgttttctgattcttgagtcccagttttgcagatgaggtcaccgggctcaggtgaggccatattatgcctggcttctttggggtgcctctggttccaggcccagcatctcctgcctgggtgatagaggtgactgacgtccccgactcctttttccttgccagccttttcacatagcctgccaactggccagcagcaactgagaaagtgcctgtgggtgcttgccccctgcccatccctagggaatccaagtgacaagaacaagcccctccttttaggagtgcctgatgtggaacagaggccaggtgtaagtcacttgtcacactcctgtgtgttgaataccctggagtgtggggtcccagaggtgggtggaggtggccatctttttgtacctgtgaagcagtgagggcgtcacaggagacctcacactgaggtcggagtagggcatgggtggggtggatctggtagagggagcaaacttattctttcgattccatgactctccagatgagaacattgcagctacccctggaggcgtcttgagttgccctgcagaacccgggagctgcagctggcttcctggctttggctgggcagggagggcaggcctctgggcctgatgtgttccttgtatgcccgtgtgtgcctcttcacacattcaccatgtgtccttcctgagagtgctgcagggatctgcctggctggtgcttgcaagaggctggggcttctctggtcttagtctgcgttctttctgtggggattccggccttaaaagcatacttgagtatgaggaaggtatcagtcagagcccacttctcaggagggtgttttctgactcctgcctggtggggtccctgaagatgatgccaagccacctgggcttcctctctggtacagggcagggtggaaggcctttcatggagttatggggcagcaagtgcttgctgtacttgacctttcaccaattttttttttttttttttttttgagacagagtcctgctctgttgctcaggctggagtgcagtagcgtgatcttggcccactgcaacctccacctccttggttcaagcgattctcctgcctcagcctcccgagtagctgggattacaggcatacgcctccacgctcggctaatttttgtatttttagtagagatggggttttgccatgttggccgggctggtctggaactcctgacctctggtgagccacctgccttggcctcccaaagtgctggaattacaggcctgaggtaccatgcccagcaatttttttttaagtgcacatttgaacttgatttaagatgtgtcatgtgccggacactgttctaagcactaacatatgttaactctcaagaggtccctgctagatgctgtttttagcctcatttaaagatggggaagctgaaatccagagcactcatgaagctaaggctgagatgagatttcatcgtaggagtctggccttccccccatcatgcacccgtgactggggtctgtgcactccaactgtgtgtctccagcccagccacaggagtacctcatattatgctctgaacagcttccttaaccccaggtggagccacagactgcctctgtcccctgttaggtcccagggtcctctaggtgagggtgcagaatctttttccatgtggatactccagtctgagggacagaaccactcaccctctgccaaatcccttctgtgtttggccatgtgaccactgatgatgtgtgttatgatcactgggggtgtgatgaggaagaacggttggagactactgctgaggtaactgacagcgagatggtggggggatttggggaccactgattgtgatactgtctcattggccctttctccatctgtgtagagaaggcagcatcgactgctgattctaaaactgtttttctttctagctttaattgtgaaacaaaattatatcatgagccacagctctatccaggttgaacccaccatacatagctgagaaaaaattgccttctgaatgctggtgcaccctggtcccttcctgctggttgttggtcctgtacagggcctgtgctcagctaggccccttggtaaggtagaggactagaaggtcgtcttccttctattgttggtacagctagctgggagaggcaagtgacttgtctaaggtcacacagctggtgagcagcagagcgtgggttcagacccaggtggagctggctgctagctcagggttctttctcttttgctttcagtaggcagctgtgctgagctgatcacatctcagggagctgagaagtgaacacagcaccttggctctggagtccagagttgttttttttttttttttttttttttgtttgcgatggagtttctgtctgtcacccaggctggagtgcagttgcgggatctcagctcactgtaacctccacctcctgggttcaagtaattctcctgtgtcagcctccagagtaactttgattacggcgcacgccaccatgctgggataattttgtatttttagtagagacggggtttcaccatgttggccatgtaggctggtctcaaactcctgggctcaagtgatccacctgctttggcctcccaaagttacgggattgcaggtgtgagccacctctccccggctggagtccagagttttctttcatgtgaagtagcacaggggtttggtgcatagggagagagtgcatattttcatcacaaggaaaagtgaccgaggttcagaagtagctggagaggtgagcttgcacctagccttgccaaatcctcctgagtttggagtgctttcctctgtagccagtactgtgacactttgtagagtttgtccactggtagatttggcttttgggttaacaggttcattttttttagttggaaagtgatgtaatatactttctaccttcactagctaatgaattttccttttttttcttgacaaaaagaaaacttttatttggaaataatttcaaactcccggaaaagttgcaagagtaaagtgagtgcagagaacacctgcatatcctttgctgaggcttccctactgttggcattttaccttatttgccttatccctcatcttccatgtgtatgtgcatatctgtgtactcacacacattgcttttttctgaaccatttgagaataagttgtatgcgccatggccgtttatccttgtacatgttaaccattgcagagagtagaggctgctcccacttaaccccaccccatcgttctcactaacacctgctatgtgccaagccctgtgtcacgtgggaaggtctcatgggtgcaggaagccctgtagttaaagcccaggttggcccaggtggaggcaagctggcatcactgcatgtcagggttattgttttagttggcggttctgggtttaggaatgaagactgctgttgtggaagatttgtgctgtgttaggctgcgccttcgctgctccacttcccaagctagcttgtgggcactttccccaccccttccttcccacttcccagagtactgagtgattatatcctcttagcagcggtggccggtgatttgtttgtgcaggtgtccttctagcagtgacggcaggtaatcttgttacgcacagatcctcttagcagtaatgggaggtgagtgatctgtgtgtgtcctcttagcagtaagggcaggtgatctagctgtgcacgtgtcctcttagccatggtgggaggtgatctggttgtgcaggtgtcctcttagcagtgatgggaggtgatgggaggtgatctcattatgcatgtttcctcttagcagtagtggcaggtgatccggttgtgtgcatgtcctctcagcagtgatgacaggtgatctagtagtgcatgcatcctctcaacactgatggcaggtgatctagttattgactctctcctgctggacctgagcctttgacaggcagggagttcctctgcctctcttggttgttggcataaggacgacccgattggcatttagtagtttcttgactctaagtggaatgcatcagtgacaacatttaaggaccccgtagatagctcttgactgattagatgtcttttccttggtatgctattagattttctcttatgtgctgttatgtttgggtgctgaggttttgatgaccgtcctctttcctttctttcactgccagtctgcagagtgggctcggtaatcccgagagaccagttttgggccaacagttcattgagcagagtgatgcatgggcttgggtatggttattatgtgatagctgtgtaacacctgtatttgtgtttctgacatgatttaccagttgtcctgggaagtttagtcaaagccagtccatctcatcctgccattccaagctgtgtgtcctgtcagtgtggacatggcgggcttggcagggcaagtctaggttggagggtgaatagcctgtggacccagatgccctggaccttctgggcatcctcctgggagatggggaagctcaggtctggttttgcctcaaatgagctgtctgtaaaagtagcagctgggattagatcaagccttctcatcctggcccatggcaggcagttgggtatggtggcttaagagcatgggctctagagccacactgcctaggctcaatctgttctactgctcactcttcagtttcctcatttggaacatggacatcgtaacagagctttatagagatgttgtgaggattaaaatgggtaagtataaaattctaaaaagtgtctgacataaagcaaactcttcatcaggcaaaatgttagtgttaatcacagatagagttcaggaaccctgaactgaaatgtgaaatgtgaggtggtttgtgcacagggcttattggtcgggagagagctccctcaggaggtggcagagtacagtggctctgaggagtgtctgccacacagagagtgctctttgctgttctgatgggatcagagggactgcgtatgacttgctgagagcccccgaaacagccatggtgctttggacagggctgggattgttcatacacgttttgctctttgtcacattcatgctctgtcacctgggcctggtcaggcacagactgggcactcagaaatcagttattgaacaaatgcacaaatgcctatttatattttgacataaagagcaacagctactttagccagcaggccttgcagctgcctctggtgggggtggcgaggaggatgagagccttgtggcagtcctgcaaaaatgccttgggaggatgggatccgggggtaggggacatggctgtggagccagctggcctgggccccaccctggtaggagcttgcttctgtgatgggagctgagctgagaggtgagagcaagtgtggcttctcattaatgtggatcctcactgaagctcaccagctgcccagcctggggtggagggttgaggggctcccagagggagggaccccagcaagccggtgctgagggagctgcctctctgatggacttgctggcacctggctttgagaactggactgccctgtgtgaggatgtggctggaccttccctgggttgtttgcacagtgcagggcttgtttctggtcaagagctggctgggtgcatgggctgcatgggctgcacatgcttgcctcttggccttctcctcctcctctgcctgcggtagctgttgcttcagtcactctgagctggtcattgttcttagtgcccttgtcccctacaggtccctccctgtaggctgacttctggctgacctctggcaaaatggcagacagctatcagtttggttagcttgtcttccttggttagtctgtcatccttcagctgttggctgctactgttggacaggacagtactgaggacagtattctggtgggtatggtggactaagggtcccccaggtagaccctgccctcttccttgcctgggaagtctcattttctgggaaaccttccttaggagttcatagttgtggagaggattgtttgtggctggccagggcactggatgaggggcaggagtcacagcagagggacccagaaggtcaacacagggatgatcagcaggagactgaccacaggaccgggccagatgctccattgaaactaggtctgctgatgcagaggtctctccggtgccactggctgcttcttagggcctccaggtagattagtttacctacagaactctgtctatggtcttagaataagaggacctggaagagttagaggcttgttgggggccatggcaggcctttgctgcagttcttggaggtttcttggccactcctgacagtgggagcagctcttcggatttccccatctaccctatttgcgaaggatgcctgctagaccagcatggtaagccatggggcatggagagagcccaagggtgtagaagatcttgtctggacaatctagaaaaaataaagttgatatttcttcacatttgctaacattcatacatagaatattttacataaatggaattatattttttatttaatttttgtatttaacttattttgagatctttgtagatcagtgcatatataacttcattcttttttttttttttcctttggtaacaaaagatggagaggaaaggtgggaatgggtcggggcaagattgtcttaactcgttctttttttttttttttttttttttcctcaaatggaatcttgcttttgttgcccaggctggagtgcagtggtgcaatctcagctcactgcaacctccacttcctgggttcaagtgattatgctgcctcaacctcccaagtagctgggatgacaggcgtctgccaccatgcccggctaatttttgtatttttagtagagatgggattttgccatgttggctgggctggtctcaaactcccaacctcaggtgatccgtctgccttggcctcccaaagtgctgagattacaggcatgagccactgtgcctggcctaactcattcttttttagaaatctttttactttggaaatatttcaaacctacataacagtaggttgacttggcaagtggaaaccccttcacctggccttttcaggatgggagcgtgtcgccttctgacatgtttccatcaacttgaaattcctttttaccaggcacatcttgtaccttacctgccccacactggaatggggcattttcccacagagcgctggttccttttggtgggagatggtatttagaaagcaggattttggtggtagatgtgtttattgctagctactagagtatgctgcgactccatcttttcagtctagcccaagaggtgtgtgcatacgtgcatgtgtctgtgcctgtgtaagttcatactgttatttttttttttttatttttatttttttgagacggagtctcgctctgttgccaggctggagtgcagtggggtgatctcggctcactgcaacctccgcctcccgggttcaagcgattcttctgcctcagcctcccaagtagctggaactacaggcatgcgccaccacacctggctaatttttgtatttttagtaaagatggggtttcaccatgttggccaggatggtctcgatctcttgacctcatgatctgcctacctccacctcccaaagtgctggtattacagccgtgagccactgtgcctggcccatactgtttctttagttctaatccagcgttccaggttcttgcttgctttctctgttgcatgtttgtttctctctttttctacagtgagaaccctggctcccaacagcatcagtaggtttactcatttgcttagtcttacactgcacccagaatagtttcagaagtactgcattcgcaccactagtaacagcagacctattaagtagaatttaatttaatttaattttttttagctctttgtgttttcagattgatggtgtatactcaaggttcttgggttcaaaagctacttggattaattctcttctctcttccatgtgattgttacacagttaggttcaaaactgtgttgaggcagggccgggtggttcacacctgaaattccagcactttgggaggctgaggtgggtggattgcttgagcccagaagttctaaaccagcctgggcaatatggcatctctgcaaaaactacaaaaattagctgggcatgatggcacacgcctgtagtcccagctacttggaggggactgaggtgggaggatcgtttgagcccagtgagcagaggttatggtgagctgagatcatgcctctgcactccagcctaggcaacagagcaagacctgcctcaaaaaccaaaaccaaaaaaaaaacctgttttgatttgaaaccatgtttattaaataatattgagagtggtatttactgtaacctcagtatttataacaagcccctctttcattacactaattggtaaggaagcatctcaattttgaacggttttattattttcctaggttttttttttttttttttaaaagatggagtcttgctgtgtcacctaggctggagtgcagtggtgcgacctcggctcactgtaacctctgcctcccgggttcaagcgattctcctgcctcagcctccccagtagctgggactacaggtgcgtgccaccacgcccagataatttttgtatttttagtggagatggggtttcgccatgatggccaggctggtcttgaactcctgacctcaggtgatccacccgcctgcatctctgaaagtgctgggattataggcatgagccatcatgctcagccaataaatagatattttaaaaataattatttttcatttctgacagtcctgagccttcgttgatgtacttttgtcaaaactcttggtaaatcactttttaagtttcagtttcttcctggagacaaaaaaaaataaataaataaaaaataaaaacaaaaaagagtttagatgttcaagggctatttgggcccaagtgctgacattgtgagcttgttggtttaacagggtctcattccaccagccatcaccctttgtgtttcctctccatccgatagcttgggttcgtgctctgatagtctttgggtatgcagtggtatgggggagctgtctgaagcaggggctgaggttggcctgggagtttgggtatagttctacacaccctttacctgacaagactcattgtggaggggtgatcagtgaggcaggtggtaggtctgttttggagattaggatgctaagacccagagaggttaattagcttgcttggtggcatcacttagcttttaagtagaagcaagaacaggaaactcaggactgctatcctgagccacatgctttgcctcctgcaccatgattccaaaagctgatgaaagagctgtatggcagagggagctaagtggagcgccaccacctggggcctcctgcctaagaaccgggcaccttttcactgagttgggcatcgctagtgttcacagttctgactgcaccagcatcttgtgtggacactgatgctgtgatgtctctttgggcttgggtgatcaattcaggccagctggtgaccaccctctgtgatctcaccacacagtgattgcaatcaaatctacctgtgtgtttccagaagcttgggaggcttattagagtgtcaccttcttttgtatggacggactttgtgggttttcaaccgtgtggatgtattacttcttaacaaacattcatgaaagtaaaagatgaggaaaaggtattttaaaaggaaaaaaatgtgtataactgaatataaaacatactacttaacagaaaaaatagatctaaaatgcttagaacccacaaaaaagttaaatgaaattttagcttaatgctgttgcatatttctgctttataattgcagcatgagatgtgatgtctttttataggaagtaggtttactcatattaacctcattttacagatagagaaacagagcttgggagactaagtgacttagccaaagtcacacagcttttaaagtcatggagtgggtatttgaaacatgggcagcatagagttcatgctgtgatattgcacagcttcaagagaagtctctggctctttttccatctactccttgtctttctccttctgccttttctttttttttttaatttaattttattttactttaagttccaggatgcatgtgcagaacatgcaggtttgttacataggcatacatgtgccatggtggtttgctgcacctaacaacctgtcatctaggttttaagccccgcatgcattaggtatttgtcctaatgctctcctcccgccttttcaatgtgaaccttcccacccaccctgcttttcttgtcttcttcccatagcttcagcaggctccaggtgccgcagccctgactcctcagggcccacccctgctgtgtccacacaaatgcccccaggaagctgacacttccccgcagcctgttcctgcagtccctgccttggttcttagctgatgctgtcttatcactgccaccccatccccatttctgagcatcaggcaccctcatcagcacttggcatgtaatagctccattaaccttaactgtaaccccgttttttggatagagtttttcgtgtgttaaatcttgtgttcaacttaggttttgaaataagagcaggaaatgaagctttcagactgcaaatgtttcctttgaatgttctttaaagaccccatatgataggacatgtgctttttgtgagtgtaactccctgtggtgatcacactaaagtttggacccactctgttagacaagggaggaactgggcagaactgcctgcccatggctgggctgtaggctcagtctccttttagatgcgtcagatttctagtcttgctttcttgcaggagttacttcattcagttgtaatattatccttaggactttaaatccctccgtattttatatgtgcttttcagggttaggcggctccactgctaccgcagtttttttttaataacgtaaaatatgccatcataaccactcaattcagtgttcagttcattcagtgttcagtagtgccagagtatgtaccttgttatgcaacagatctctagaatgttttcatcttgcaaaactgaaactcagtacctattgagtaactacccctcccttttatctctctctccagcctggcaaccaccgtcctacttcctgtttctaagagtttgactgctttagatactccatataagtagaatcatgcagtatttgtctttttatgtttggcttattttacctcaaggttcatccatgttgtagcatgtgtcagaacttctttttaaggctgagttgtattccactgtatgcatatactgcattttgtttatttagtgtacacctgggtcgcttccacctcttagttattgtgagtagtacttctgtgagcataggtatatgaatatatctttgagaccttgccttcaattaattttgggtatgtacccagaagtggaattggaattgctggatcatatggtaattctatttttaattttttaaggaaactccatgctgtcttccatagtgactgtaccattttacattcctaccaacgatgtacatgagttctgatttcttcacatcattgccaacacttgtttgtttgtttgtttttgacagtggctatcctaatgggtgaggtgatagcctattgtggttttggcttacatttccctgatgattaaggaggttttttttttcttttccttttgagacagtttcgctctgtcatccaggctgaggtgcagtggtgtaatcgtaactccctgaaaccttgacctcctgggttcaagtgatcctcctgcctcagcctcccatgtagttggcactacaaatgcatgccaccacacccagctaattttttgatttttttttttttttgtaaagatgagatctcactttgttgctcaggctggtcttgagctcctgggctcaagcaatcctcccacctccgcctcccaaagtgtgaggttcattttctgatatgtggagtccaactgtctagtaccatttgttgaaaggttataccttctccattgaattgtctttgtacctttgtcagaatccattgactacatttgtgtaggtctatttctgagatctgtattctattctgttctgttggcctgtgcatctttttttttttttttttttttttttttttttttttagataaattctctgttgcccaggctggagtacagtggtgggatcacagctcactgcagccttgacctccctggctcaagtgatcctgccacctcaccctcaccgagtagctgggaccacaggtgttcaccatcatatgtggctaatatttttattttaatttttgtagagactggatccctgtgttgcccaagctggtctccaactcctgggctcaagtgatcctcctgtctcagctttccaaagtgttgggattacaagtgagagctactgtgctcagtgtggtctgtgtatctttactaagcttttgatcaaagacttttttaattttaaagaagtctgatttatcattttttcttgttatggtcatgctttctgtttttgtctaataaatccttgcctaccccaaggttacgaagttcttctccttccctagtaaaatctgagcttcgtgggggcagacaccttatggttctcctcctgctcttctcacttgtgtcctgtacaacacctggcccctaggaggtacacggcggtgttcatggaaggagcaaatgagttgtcttaaggattcataataatgtattctaagcacttgatatactgcctggcacatgcaaaatgagcattcaggaatctgatttgactacagctgttctttctcttagagaaattggctgcgctatcctgtggctatgatcgaaatgtggtgcgagtgttggatgaaactgctggctgatgtttacatcagatgcgagatagctctcgctccagttctgtcccaccctcctgccctggtcttattcccaagtatgtagcccctcctgcccgaacccccatgaaataaggactgattgcaagttgctgttcttttcttgaaagtgtcactcatggaataggtatgcttggtggacctgcctttctcttctttcatcttatatgatcccttcctttttcttaggaccttcccttcttttctaggataacttattttaaacagggccttctttcccaaacatctgcctaaggagaagccacagggcagagcagctgagccagtgttttggttggacagcatctacagatagatggtagcaggtggtgatcacttcttctcctggaggtagaaaatgcttgttatttatgagaaataaatgctgaagcataggccttgtccctttgttcttgtgtggtgttccccagtgtcagtgttgtgaccccttgggctgtgggagaaagtggctggcactcccctagcgcttggcaaccctactccctctccactgttgcaggagagctggccacctgtctccagtggtggtgatggggagtcaggagctccagggtccaggggaggagtgactgagggtggagccttcactcagagattccacttgccccgggggctgtttggaaatgggtttggtggttatgtgtttggggagctactgccatttagggagccatatcaaagaagttgcaggcatatttcaaaaccacagcaggagtgtttgcaggtgtaaaatattttgttctagtaactggccactggtagggaaaaaaagtacaatatgttggtacatccttggctctgcaccagactggtggtggggctctggtatccctgggctttgtgcagtgagcccccagaggctctgctgactgctgtctcggtgaaggaaatggctcagaactggaaagtttggacctggtcctctagggagtcagaatgcagagccccacccaggggctctgctggcttcagggatggggatttgggtcaaagagcccacagcctgacctctgatgcccattctgctgctgccaacttgatgtgggacactgagtaggcgggtcagcccctctgagaagctagctggctggactagttgggggtttcaatacatagaacagcttcgggccttccttcacattttgctaatgaaacttccaatctcatcattttccatgagccacacatgtcttgttcccgtttgaactctgggccctcatgggtgaggagccggctggcctctgggctccttgtggcttgaggttcagatgctggcatcgttggtgctgtagcctggtggctgccagtacagaggatgctcaggcctccaggtatcagcagtcttcactgccccctgctgctgagacgcagtggcaggtcaaactgcacagaacccctggccatggttcctgcctcccatcctctctttgcccttgtgggtccctctcagagcatttatctctgcagaggacctcccaggattgttcctaagggtggcatatgtgaaacttcagcagctgagcattgttggagtaattttctcttttgggcctcatcacctccgtggaagtcaggagggataggcagggcaggatggtcacctccatgctttacagatggaggaagcagcctggcgaggctgagcagggttgcacgggccaggagctgaagcctgctgtttgtctcgcaacggatctctggggcgtctttccaagccagtctccctgcgtggttccaggaagctacaggggtggggaggttgtgtgctggcctgctggtgctacggggcagtggcagcgatggggaaggggctagacgggcttcaggggagagctgcagggactggtgagccgggacccccaagaacctggatgtggggctttgcgggaaggttagaggtggcccttggactccataaaagggcagatggcatttgagcactgtagagaaggcagggagtttgtgatgtgatcacagttggttctgggatggtctgtgcactgtttggaatgccaggtcctgcctttcctcacttcctagctctgccctcccaggtctgctctctgtgctgacgcaggttggtgttctgatgatgcactcctccatcgccagccgcgtccctttctggagttatagcacatcccatgaagctatctggtcccgaagtccctctggggccccggagtacagtgtgccttccagagcgtgcatcgctcccttccccactgggcagcacctgttcagaatgggtgcttgccagaggcctgcccatggcccctggtggctcagatgctggccatctctgaggccccattcaaggcccttattattcactcttgcctcaggacagaggtgacccctccatttagaaggtcaccgagcaatatgccctctgttttgtcttttagttgtgctatcaacagtggtctctgtcctccctatttttttagtttttgagatggagtctcatgctgtcacccaggctggagtgcagttgtatgatcttggctcactgcaacctctgcctcccaggttcaagcaattctccccacctcagcctcccaagtagctgagactacaggtgtgcgccaccacgcccagctaatttttgtatttttagtagagatggggctttgccatgctgtccaggctggtcttgaattcctggcctccggtgatccacccgccttagcctctcaaagtgctgggattacaggcatgagccaccgtgcccggccctctgtcccttcttgagggcatctggagaagagatggctggcccagggcagaacccagcatccacacctctggtctcctggagatgcgtggtcgcctgttacaatagcccagccagcccttggcttccaaaccttctcccctctgctgctgctgctgctttgaagtgtgctggacaaatctccctttcctagtagcaacttgtatggaaggtgaaatgacctgtgggaaagccccactgggaagcagctgccagctctttccaagacagaatgtgcagtaaggctttactgccaggtgtgagcaggcctgccagggatgctggaaccttctgttctgggcactccagcagggcatgggtgtcccctaccccgggtgtgggagtctgtgtctgatgggtctcagactgctctggtggagacctatcttagtgggctgtgagtagtgcgagcagatgggctggaatttctcctgcatttctttgctggaaatgttttgattttcttagtgatgtaactgtggacatgtgtgcttctgctagtactctgtctccctcttgttctttgtgggcaaatgttgaagagaaatcaattctaaacaatttatgcagcatactaaatttcacacagtaatttgagacagctcagtttgagacagccttgaaacaaggctaaggcttgctgacaaaggagaaattgaatctagagaaagaatttgtattgcagagactcgtgggtttctacagggcatgaatccactaattcctgggcgttgcatagcccaaagcagtagctctccaagtgtgcccaggggtctctgggggttccctgacccttctaggggctccgtgaggtcaaaactgttttcatgataatactgaggtgtcatttgcctttctctcatcctcacaagcataaggtagcatttccagacactatttgatatgtgatgacatcattgctctgacagctaatgggatgtatgcttgggattctctctttttttctctctctcttttgaaagaacagtgcctcactgtgttgcccaggatggattgcagtggctgggtcatagctcactgtaaccttgaactcctgggttcaagaggtactctcacctcataataaaataaaaaataaaatttttattttattttatttgtagagtcagggtctggctatgttgcccaggctggtcttgaattcttggactcaagtgaccctcccaccttggcttctcaaagtgctgggattataggcatgagccaccgcacctggccttttttttttttttttttttttttaagaatttttttggccgggcacggtggctcacgcctgtaatcccaacactttaggaggccgaggcaggtggatcacgaggtcaggagatcaagaccatcctggctaacacagtgaaaccctgtctccactaaaaatacaaaaaattagccgggcgtgatggtgcgcgcctaatctcagctactcgggaggctgaggcaggagaagggcatgaacccgggaggcggagcttgcagtaagccgagatcttgccactgcactccagcctgggtgacagagcgagactccggctcaaaaaaaaaaaaaaaaaaaaaaaaaaaaaaaagaactttttttattgtggtaaaatacacatacaatttaccagttttaagtacacaattcagtggcattaagaacattcagaatgttgtgcagccagcaccactacccatttccagaacttttttttttttttatcatcccaaacggtaactctatactttttaaacagtaactccccaattcccctgcccacagcctttggcaatttctgtctgtatagatttgcccattctagatatttcatactaatggaatcatacaatatgttgtcctttgtgtctggcttctttcacttagcattatgttttcgcagttcatccatgttatagcatgtgttagtatttcatttcttttttaaattgtggtaagatatatgtaacataaaatttaccatattatcttttttagagacagggtctcactctgttgtcaaggctagagtgcagtggtgcaatcaaatcataactcactgcagccctgacctcctgggctcaagtgatcctcctatctcagcctccggagtagctaggaccataggtgcatgccaccgtgtctggcaaatttttctattttttgtggagatgaggtctcactatgttgtctggggtggtctcaaactcctggcttcaagcgatcttcctgtctcagcctcccaaagttctgcgattacaggcattagccaccatgcccagccccattttaacctttttttttttgagacggagtctcgctctgtcacccaggctggagtacagtggtgcagtcttggctcactgcaagctccacctcccaggttcacgccattctcctgcctcagcctcctgagtagctgggactacaggtgcccgccaccatgcccggctaattttttgtatttttagtagagatgggatttcaccgtgttagccaggatggtcttgatcgcctgacctcatgatccacccacctcagcctcccaaagtgctgggattacaggcgtgagccaccacgcccggccccattttaaccatttttaagtgtacggttaattcagcagtgctaagaacatgcagaatgttatggaacgagcaccattacccacttccagaacttttttgtcaatccaaacagaaactatacccattagacaatactccctattctcctcacccctagtccttggcaaccaccattctactttccatccttattaaattgactactgtaggtacttcttatgagtgaaatcatatactatttgcctcttttgtgtctgtcttctttcacttagcataatgttgtccaggttcattcatgttgtagcatgtgtcagaattttcttcctttttatggctgatggctgatcacattcacttttgttttttattttttgtctcactctttcacccaggctggagtatagtgatgcgatctcggctcactgcaacctctgcttcccaggttcaaacaattcttgtgcctcagcctcccaagtagctgggattacaggcgtgtgccaccatacccagctaatttttgtatttttagtagacacggagtttcactatgttggctaggctgaccttgagctcctggcctcaagtaatccacctgcctcggcctcccaaagttctaggattactgacgagtgtggtgagccaccatgcctggcccacattcactttttttttttttttttttaacagttttgctcctgttgcccaggctggagtgcaatggcgtgaccttggctcactgcaacctccatctccctggttcaagtgattcttgtgcctcagcctcccaagtagttggaactacaggtgtgcgccaccacgcccagctaacttttgtacttttggtagagacggggtttcaccgtgttggccagggtggtcttgaactcttgacctcaggtgatccgcccacctcggcctcccaaagtgctgggattacaggcatgagccaccatgccaggccccacatttacttttgaagcgacacaatacaccattacttggttgcccatggggtactacatgcctcctgtttttatggtggaataatattcttttgtagagctataccacatttatttatcctcccatctgtcatggccacttgggttgtctctgcctcttggctagtatgaataatgctgttgggaacagtggtgtgccagcatctgtttgagtctctgcttttaattctcttgagtacatgcctatgagtggaatcgtgagcatttgataattctattaaaaggttaaaacctttgagcaggtgcttcagattcttgtgttcaaaaaattctcaagtgttttttttgagacagggtttcgctgtgatgcccaggctggagtacaatggcgcagtctcggctcactgcaaaggaccatccacctccgaggttcaagtggttctcccacttcagcctcccgagtagctgggactacaggagcgtgccaccacgcccggctgatttttgtattttttggtagatacagggtttcatcatgttggccaggctggtcttgaactcctgacctcaagtgttccgaccaccttggcctcccaaagtgctggggttacagacgtgaaccactatgtctggccaaatttctcagttttaatttctgatacagtaaatattgacagatataacccacataaataaaagctctttggggtcttcaataattttaagtgtattaaggtgtcttagaatgaagaagtctaggaactgctgatgtggcaggtttttttttttttttaaacggagtctcgctctgtcgcccaggctggagtgcagtggcacgatcttggctcactgcaacctccgtctcccggattcaagcgattctcctgcctcagcctcccgagtagctgggaccacaggcacccaccaccacgtccggctaatttttttgtgtttttagtagagacggggtttcaccatgttagccaggatggggctgtccttatgttggtactgtggctggtatgttgtgggcatggattgtttcataaagtgtcaacaatccattggctaagaggagctggcctgcctctgccatgctacagcaaggtgacagtcatcaccagaaggcctgggacaggaccttgtaaagccatcagtgaaaaggggtgactttctttttcttttttttgagacagagtcttgttctgttgtacaggctggagtgcagtagcgtgatcttggctcactgcaacctcgcctccccggttcaagcgattcttgtgtctcagccttccgagtagctgggattacaggtgtgtgccaccacgtccagctaatgtttgtattttagtagggacagggtttcgccttgtccaggctggtctcaaactcctagcctcaagtgatcctcctaccttggcctcccaaagtgctgggattataggcatgagccaccatactgggtcaagggtgacttttttttttttaaagacagaatcttgctctgtcgtccaggctggagtgcagtggtacaatctcggctcactgcaacctctgcctcctgggtttaagaaattctctgcctcagcctccagagtagctgggattacagacatgtgccaccatgcccagctaatttttttgtatttttagtagagtcaaggtttcaccatcttggccaggctggtcttgaactcctgaccttgtgatccacgtgccttggcctcccaaagtgctgggattacaggcgtgagccaccacgcctggccaagggtgactgtttttaagcaactttgtatgtggcagaagttgcacttactgctttacagagagactgtggaggatattgagaaaggacaggcaattttttgttggtggtggtgttttgtttttttgagacaggttggagtacagtggtgtgatcgtgactcactgcagtcttgacttctcaggctgaggtgattctcccacctcagcctcctgagtagctgggactacaggcatgcacaccaccacatctggcttatgttttgtatttttagtagagctgggatttcaccatgttggccaggctggtctcgaactcctgggcttaagtaatctacctgccttggcctcccaaagtgttggggtaacaggcgtgagtcaccacgcgtagtcagtggaaacgcagtgttgatgtccagctaaagcaatgccagtttgacctgttggagtcaccatctggtgtgctgtgctggatgcaagctctgtcatgtcctggaattgactttctttgttcattaccacagccctgtcacctggagaactgcctggcacagagtaggtgccagtgttaatgagtgatccacatcttcagttgcttccagaatagacccggcttgacagatggatcaagaagggagaaaaaccttccctattggagaacttctgacacttcattgtctgctagcagaatatgggaagattttgagctgtgcagttcattaggcatttagtgcatgcctccatgtgtggggtgttggtgacatggagtatggggcagcaataaagatgtgtccctcagccagacacagtggctcatgcctgtaatcccaaaactttgagagcataaggtgagaagattgcttgagctcaggagttcgagaccagcctgggcaacatagcaagaccttgtctttactaaaaataaaaaataaaaaattagctgagtatggtggtatgtgcctgtagtcccagctacttgggagtctggggcaagaggatcactggagcccagggtgtctacgctgcagtaatctgtggtcatgccgctgcattccagcctgggtgacagagcgagaccctgtctcaaaaaacaaaacatttacatgtatgtaaaatgtccctatatgtatactcgagaacagggtttggcaaactatacctgcaactggccactgtttttttttgtttttcgctaaagctttattggacatgcctatgcccacgcattcccatattatctgcagctgctttagctccacggcagcagggttgagcagctgtggcagagagagggtggcctgtgaagctggccacctggaaatacttatcatctggcccttgaaggaaaagtgtgctgaccctactcagggtgtgaagaaaagaacagagaagggctgcttaggaaaacagggctaggccaagaaggccgactcagttaggggagtttggggaggggttcctggagagtggtgtgtcttgagacctggggagaggggatgccatggactaaggcccagcagtggggagcccagctgtgttcaggatgtagcaagacagtcattctgctgatagcttatttttcctcttttgataactattttttttttaaaagtctggagaaagaaagaaaaggacagaaaatccgtgtgggggctattttagccagagctgtctggttgtaaggagtagctgtaggaggaacttttccctgagcccagggaggaagcacagccatccttggggtcatgggactgtgaagggtgttgctcccctttctcagcccttctggtcttagcccttacctctttctgcctcagggtgcacagaacttcaagtgactgtctcagtctggctagcctggatcttcccactcccatcaccttacagactcttctcattggcccagcctggggcagggcaggtggcactcatggagtggccagatgggcacttctcaaagaggaaggctgtttgggcctttggagcctttcccagacatgcatagagtatggagagaagaagtattcttcaagtgtgtttgagttatggacactaagtgtggtcggctatgccctgggaacacaggagtgaacagtgcagacatgacctgtgccctcaggaagctttactttttttttcgagacagagccttgctctgtcgcccaggctggagtgcagtggtgcaatctcagcttactgcagcttccgcctcccggattcgagcagttctctgcctcagcctccagagtagctgggattacaggcacccgcaccacacctggctaatttttgtgtttttagtagagacgaggtttcaacatcttggccaggctggtcttgaactcctgaccttgtgatccacccgcctcggcttcccaaagtgctgggattacaggcgtgagccactgcacctggctgtttcacttacatatctatatatgtatatatatatataggtttactatatactgatatataggaagccaggagtgacaagtactacttagaagcagccaaggcaaggcaaggtggatgtggtgcatgggggaaggggccttgtttgccagagaagacttggctgacgtttgcttttggaggatataggggtatggagaaagaaaacccccagtgttgttacttattacttcttactcaactatttccaaaaataatttaaggtagtgcattgaagtttttctgggcctagggtatgatatgttagggcgtagatttggagggctgtgacatgagctatgaatttactttgaacaacaccatagggtgttttttttttttgtttttttttttaatagaatggacactgttaaaatattctgctgggcggggtagctcaggcctgtagtctgaggtgggagagtcatttgactttgaggcaccatgattgtgcctgtgaatagccaccactgcactctggcctgggcaacatagtaagaccccatctctaaaaaataaaaaagaatgttctgttgctaaatctctattcagtgaatgaactctttctcagtatagtttgggaaattagaaggctttttttttcttttttctgcattagtctttaaaaaaattttttgttaactttatggacacagtagttacatgtgtggggtatatatgatattttgatacaagcatagaatgtgtaatgatcaaatcatggtaattggggtatctgtcacttcaagcatttgtaacttttcttgtgttaggaacattctgattctactcatttagttattttgaagtatagaataaaccattattaactatagttaactgtgtttttgtacctattaaccaacctctttttctcacctctgcctttcccagcctctggtaaccactactccactctctagctccatgagtttaactttttttaagctcccacatatgaatgagaacatgtgaagtttgtctttctgtgcctggcttatttcacttaacataatgtcctccagttccattcatgttccatttttatggcaaaataataagaagttagaaatttttaataaaactgaagacctagaatacactgaggaggaatggagggttccaggttcttggtctaatggttaattgtggctgaggaagacagacattaggccagaagagcatgtcccaattgctgatttactcatcaaatagtgcttcagtaccagtcatggggcaagccctggatttataattatgaaaaggacctagctcctgtatggatggcgggggtgagatctggtaggccaaggctgtcttttccagagaagcaagcacgttaggtgggccatgattcaatttagttcttcagttccaggcatatctagtcctagaacacagggtgcctggatttttagccttgtggtcagtatcttttgatctcaaaattgtttcctgattttttaaacagaaatctatttcatgatagttaaaaaaagccttattgaggtataattgacttataataaatgatacataaagtgtaaaatttgagttgtttttttttttttttttgagacggagtcttgcgctgttgcccaggctggagggcagtggcgcgatctgggctcactgccagctctgcttcctgggttcacgccattcttctgcctcagcctcccgagtagctgggactacaggcgcccgccaccacgcccggctaattttttgtattttcagtagagacggggtttcaccgtgttagccaggatggtcttcatctcctgacttcatgatttgcctgcctcggtctcccaaagtgctgggattacaggtgtgagccaccgcgcctggccaagttttttgtttttttgagacagaattttgctcttgttgcctaggctgaagagcagtggcgtgatttcgactcactgcaacctctgcctcccaagttcaagcgattctcctgcctcagcctcctgaatagctgggattataggcatgcaccaccacgcctggctaattttgtatttttagtagagatggggtttttccatgttggtcaggctggtctcgaactcccgacctcaggtgatccattcacctcagcctcccaaagtgctgggattataggcgtgagcctctgcacacggccaaatttgagttttcatatatgtataaatctgtgaaaccgtcaccacagtcaagataacaaacacagcgtatcgtcaccccaaacattttctcgtgctcctttgtaatccctcccacccccatccctttctgtcttgatagctgcaagtgcattttttagatttttatataaatgttgtcatacagtaggtattcttttgagtacatactggcttcttcactcaatataattattttgagattcatccatgctgcggaatgtgttaatagcttattcctttttattgctgagtagtattccattgtatggctgtacacaacttaccaatttgcttcttgatagacactgtttgtttccagcttttggatattacaaataaaagtactatgaacaagtctttgtgtggacatatgctttcatttctcttggttaaatacctaggaatggaatggtcagattatatggtaggtatacattcagtttttaaagaaactgtcaaattgttttccaaagaagttgtaccatttacattttcactgggagagttccagttgcttcacacacttgccaccacttggtatggtcattctttttcattttagccattctagtaagtggtttctcttcatggttttttgtttttgtttttgtttgttgagacggagtctcattctgtcgcccagactggagtgcagtggtgcaatcttggctcactgcaacctctgtctcctgggttcaagcaattctgcctcagcctcctgaatagctgggattacaggcgcccgccaccgcacccatctaatttttgcgtttttggtagagatggggtttcatcatgttggccaggctggtctcaaactcttaacctcaggtgatccacccacctcagcctcccaaagtgttgggatcacaggcatgggccgccgtgccccaccttttcatgctttaatttgcatttccttaatgactagacgttgagcatcttttcatgtgcttgctagccatctgtatatatcttccttggttaagtgaccattaagatcttttgcctattttatttattatttttttttagagttggggaggtcttgctgttgcctaagctggagtgcagcattgcaatcctagttcaccacagcctccaactcctaggcttaggcagtcctcttgcctcagcctcctgagtagctgggactacaggcatgtgtcaccaagcccagctaatttttttgttttttttttgtaatgtagagatgaggtcttgttatgttgcacaggctggttttgaactcctgggctcaagtgttgctcccaccttggcctcctaaagtgttgggattacaggtataagccattgcacttggcccatgcccatttaaaaaattgggttgttttcttattgaaatttgagcatgctttatatattctggttacaagcaagccctttatcagatacatgatttgcaaatgttttctctctgtgtgtggtttgtctatgcattatcttaacatgtcttttgaaaaacaaaagttctcaattttgatgaagtccaatttatcaattttttttatagattgtgtttttggtagatatattaaaggtatttgcttaaaccaagggtgcgaagattttcttcttgtgttttcttctcttgagttttatagttttaggcttcacctgtaggcctatgatcgattttgatttttttttttttttttcgaggtggagtttcactcttgttgcccaggctggagtgcaatggcactatctcggctcaccacaacctccgcctcccagattcaagcgattctcctgcctcagcctcccgagtagctgggattacaggcatgcaccaccatgcctggctaattttgtatttttagtagagacagggtttcaccttgttggtcaggctggttcggagctcccgacctcaggtgatctacccgcctcaggctccgaaagtgctgggattacaggcatgagccactgggcctggctattctgaattttttatgcggttcaaggaatggatcaaagtagttgttctttgttcctctttcttcctcctcctcctccttcttctcttctttcttcctcctcttcctcctcctttttttaacttcattttgtagatgaactccttccttccttcttcctttctttcctcctcctcctcctcttcatttttctttcttccgtgtttcgcagtaccattctgttgaaaggcctgttctttcttcagggagctgcctttgcacctaggtctttaaaaaatgttttttctcagcaatgttgaaaatttttcagtgtacaggacttcacatcttttgttagatttatacctaagtatttcttattttttgatactattgttaatggtaatttttaaatacctgaacttacagtagagtttgtatagaattgacatcaattcttccttaaatatttggaggaattttccattgaagctatttgtgcctggagtttcctttgaagatttttaactaaaaattcaattccttttagggctgttcagattgtttatttattttggagtgaactttgcatttcatctttcaaagaatttgtgtatttcatccaaattgtcagatttattgacataaagtttttcatactattaccttattcttcactcctctgttagcctttatactttctctggaatccacagtgatgacatctctcttctgatagtagtatttttttttttttaagatggagtctcgttctgtcgcccaggctgcagtgcagttgtgtaatcttggcttcctgtaacctctgcctcccaggttcaagcgattctcctgccttagcctcctgagtagctgggaccacaggcatgtgccaccacacctggctaatttttgtatttttagtagacagggtttcgccatgttggccaggctggtctcgaactcctgacctcagatgatctgctggatcatctcccaaagtgttgggattacaggtgtgagccaccatgcctggcctggtattttgtattctttatttttttttgctgatcagactgtctagaggtttattaatattactgatctcaaaaaaacaacttttgtttttcttattttctctatttttctgttttcaatttcagtaatgtccactctcatctttattatttcttactgctgggtttcatttgctcttcttttgtaatttccttttttttcaggttcaagcgattctcctgcctcagcctcccacgttgctgggattacaggcgtgcatcaccacacccaactaatttttgtattttagtattcaccatgttggccaggctggtctcgaactcctgtccattcaccatgttggccaggctggtctcgaactcctgacctcaagtgatctgcctgcctcagcctcccagaatgctgggattacaggcatgagccaccacgcccagcccttgctggttttctatctgcttgttctatcaagagggttattaaaagctctgactttaattgtggattcgtctattagcagttacagtagtttctgtttcatgaattttgaagtttcttttgtaaattttaatagatacataaacatttaggattatgtcctcttgaatcaatccctttatcattattaaatgaccttctttattcctggtaatatttgcactgaagtctactttgtgtgatattaatacactccagctagcctttttttgagacagagtctcactcctgttgcccaggctgtagtgcagtagcacgattatagctcactgcagccttaactttccaggctcaggtgatcctcccacctcagcctctcgagtagctgggactataggcgtttgtcccaatacccggctaattttttgtatttttagagagatggcattttgccatgttgctcaggctggtcctgaactcctgggctcaagtgatccttctgcatcagcctcccaaaatgctgggattatggagatgacaggaatgagccatgtacctgcccttccagctatcctttgattagtgttaacatggtatatctttttttattcttttattttctcttatttatgcctatataaagtgagtttgttttaggtaatatgtagttgtatcttgattttttccctacatgacaaattctgcctttcagttggagtgtttagatcgttctgcgtatttattgattaggcaagtttaattaaaatctaccatattaccctttgttttcatttgtaccatctgtttgtcttttttttttccttcttttggattattttttattctcttctatgttggcttacttgccacaactcttgtgttattttagtcgggttcatcattaacttatcatagactaccttcaagtgatggaccactttacctgtagtttgagagccttaaaacagtgtgcttctgtttctctcttcccacctttggtgctactattgtcaaaattttacttctgtgtatgttataaactgcacaatacagtatctgtgtgtttgctttaaataattgtaggtcaacagctttttctttcagaactttaacatgtcacatcactgtcttctaggctgtatcgtttctaatgagaaatctgctgtcatctagatctttgtttttctgtgcatgtcttctttttctgcctgcttttaggattttatcgctgattttaagcaattcaattccaatgtgacttggaattgtattgtttgtatttctggtgcttgtggttcattgagctacctggatttgtgggtttatagttttcatcaaattgggaaattttccccattgtttcttcagatgttgtgtctgttcccccatgtattagggtgtgtgaggttgttccacagcttactgatgatttgcacattttttcctggtattttttcattctgtgttttagttcagagtgtttctattattatatcttcaagtcactaatcttttctactacaaaatctaacctgttaatgttctgcagcgtacttttcatcttaagtgttacagtttttatctctaggtaataggttcgtaaagggccaggcattaaatgttttcagctttgcaggccatatagtcttttctgcagctactcagctcggctgctgtagcttgaaagcagccatagacaatacatatttgtggctgtgttctgataaaacctgattttaaaaacagatgggggccaggcacagtggtacatgcctgtaatcctggcacttcgggaggccgaggcaggcagatcacttgaggccaggagttcaagaccagcctggccaacatggcaaaaccccgtctctactaaaaatataaaaattagctaggcatgatgacacatgcttgtaattccagctactcaggaggctgagggacaagaattgcttgaacacggaaggtgaaggttgcagtgagctgagactgcaccactggcactccagcctgggtgacagaatgagactctgtctcaaaaacaaacaaacaaacaaatgggaagagattgatccagcccatgggctatggtttgctgacctactgccacttcctcaatggcctctcaccctttggtcccacagagctgcggtgcaaccctgggcagtttgcgtgtcgcagcggcaccatccagtgcatccccctcccctggcagtgtgacggctgggcgacttgcgaggatgagagcgacgaagccaactgtccaggtgagtgtgttgagtaggcggggtacacaccaccttgtctctttgttgtagctgggtgactgtgcctcttgtgaggggtggaggtgtgtgctgtcttaacacattggaaagttagtttgagccgaccccttcctctctctctgtctttctgtctttttaaaaaataagtgcccaacctaggcagatcccagaacttgcaagatggcagggctgtggggaggcccgtgagatgcccaggaggctccacttaaggaggcgctgcactccctggacttggatgatcttgagtgtgaacccctcctgaggggtggcaccttggccacctctctgaccttatccccatcctggctctggatgtgggtgcctcttgatcctgaatgtgctcttttagactggccttggcacgccctcccctcctgctcactcattcacctggaactttgcactcacaggttctctcctggccattatgtagtctcctaaagatgtatggaaaggccacaaaaaggctaaatcggagaaccaggttcttcacctggtttctgcctcagcaccctcaaggaatacagggcaccccatgaataacaatgttcactggatccgttgttctcaactttggttgggtgggaggtgtagtgagtacttgtgcatgtgtgtgtgaatgtgtgagacatacatatacatgtatccatgaattcgtttttaagactaggtggtgctgataaagccactaaggggaaagtgtgtcttaccccagcttgagaatcacaggcttaaatgctttggccagacatgcagactccttcacaagctggtttaggtctgctttgccaacctgatttatcactacttccccttcagtggctcagctgggctgtttcttgtgcccaccccattaataatcttgtagatgtgtgcttcctttatgttttcctggaattctcttgttctgtttctgcatagacaagccttaccatccttcaaggtgtagctcagatgttaccccagtgggagaatgtctgtggtccctcattttatagattggcttcttccagtcccccattcgtccctctcttatagcatcagaaccattggtaattctcaccattcctggtgcccaggcttgatttttccatccagaccatgagttcccagggggcagagacctttctccttccttagtgggacttggcctaggacatgaaaggtgtgctgtaattcctataggcttagtactgaaggaaaaccaattcattccaaccagggtattaggtaggggattaggtgacatttgaacttgtggtagttctttgagggggggttccaaaataagaagcagagatggtctggtcagattgtatttgcctgtaaagaatgctgtttaggcagggtgcgaaggctcacacctgtaacccaacactttgggaggctgaggtgggtggatcgctttaggccaggagtttgagatcagcttggccaacatagtgaaaccccgtttctaataaaaatacaaaaattggccaggtgtggtgctgcacacctataatcccagctactcaggaggctgaggcacaagaattgcttgaacctgggaggaggagattgcagtgagtcaagattgtgccactgcactttatcctgggctgcagaacaagactctgtctcaaaggcaaaaaaaaaaaaaaaaaagccaggtgcagtggctcatgccttataatcccaacacttttggaggccgaggcaggcaggatcacttaaggtcaggagtttcagaccagtctggctgacatcgtgaaatctcatctctactaaaaatacaaaaattagctgggcgtggtggcgagcacctgtaatcccagctgaggcaggagaatcacttgaatccaggaggtagaggttgcagtgagctgagatcatgccagtgcgctccagcctgggcgacagagtgagattctgtttcaaaaaaaaagaaaagaatgctgtttagagggggcccctcctgatcatctctggagcccattcttcatcagattatgcgtgtctctggtagaggtgtttgcctttccaaatgagggtttggatggtgttggcccggtcaggagcctctgggacagtcctttgtctgggagcctctctggtgggtctttggggtcaaagcccagagaaagtggattcccagtgggcttcccagtgcttgggctgctgaagttccctggttggtcagcctggggacgaccatgtggttatgagtgggagcctccccttgtctgactcatagagtgagaccttatatccagcctcttggagaattcctgaagagagaaccagatgattcttggtttgctttcaaatggaagcagagtttatttgttgttctcaaagtgccatttggctttgcttttgtagttgtttgtaataactgtcctgttacacacgctgaacatagtggtatccacactcatagttgccaccttgttcatctttccacgctctgaagacttgttgaaggcaaggagtaggttttatttctcttgaccacatggcctggcatggagcaggcatcaactttgcacttgagtattggcttgaagttacattggttgccatatgttttccctagacagaaaaataaaatctctcatagaagccgaaagttacgagtggtggcctgcaccagggctgagcagtgaaggcatgacaatgaggacccgtgtgtgcaagccccctgaggcttggtagggcctaggagtgttctgggtgggctgaggaggccactgccctgacaaggctcaccctgcttctccttgactcacggtcctatgattgtccttgtatagtgctgtgtcacagtctggagggtgagcagattgatttcttttttttttatttgagatggagtctcgctttgttgcccaggctggagtgcagtggcgccatctgggctcactgcaagctctgcctcccgggttcatgccattctcctgcctcagcctcctgagtagctgggattacaggcgcctgctaccacacccggctaattttttttgtatttttagtagagacagggtttcaccgtgctagtcaggatcgtctcgatctcctgaccttgtgatccgctctcctcggcctcccaaagtgctgggattacaggcgtgagtcactgtgcccggccaagcaggttgatttctaattgttcttaaagttgagattctgagcaaattaagtcataaaaatgtacaaagaatgtgtaatacgtattttcttacttccttgaattaatgactgctaaatcttgtgattttttttctagtttattttaaaagaaatttttaaaaaatcatagatatagagtcaagtcctcattgacactctcccttcccccaacctcctcccctctcaaaaaaggaaactctttgtgtttgtgggggaagtagagagttagctaataaccacccttgctcaaaagctgtgaccttcctttgtatgaggagagtttcagtaacccctagggaagccctgggccattctcagtcaagttgcttttgaactagacttcaggacttctggagttaccttatggggttacttcattgccctgctaaaagcctgctaaaaaggagtataaaaaatgtaaaaccaaagggacaaaaaaaggggaaagatgtaacagtagatcagtaatttctgcatgtttttgaaaagagggaaatgacatgctaggtacagcctgggcattcagtaccttcccactcactcccttctgggcttgtccgtgggtttcagaggctggaatgctggagcagtagcactcagaaccacctggcagcaggcttctgtgtgtcatttgccctatgacatgtgtcttgggaaatgtggcaagtggaagggaggtggaacctttcttcctcaggccatagtgtatgttgggggtgtgcatgggcttagatttttgaggtgactttttgcagtggcttctgccttcccccactggccagctgtctcagggctgcagagcagctgcagtattggcagcagatttttgcagtttcctaacctatagatggcagtagtagcttcctgactcttgacaatgactgtgggaattagatggggagttagcccactttacttttgctcacactatatagccttgccagttgttttgaaagcacctattttctgtattaaacccttcgtgttagaaatcccttagcatggtttctgttttcccagtggaaccatctttgtttttttttttttttccaaggcagaagaatttttcttagtacagaacaaaatgaaaagtctcccatgtctacttctttctgcacagacacagcaaccatccgatttctcaatcttttccccacgtttcccccttttctattccacaaaaccaccattgtcatcatggcccgttctcaatgagctgttgggtacacctcccagatggggtggtggccgggcagaggggctcctcacttcccagaaggggcggctgggcagaggcgccccccacctcccggacggggcggctggccgggcggaggcgcccccccacctccttcccggacggggcggctggccgggcgggggctgaccccccacctccctcccggacggggcggctggccgggcgggggctgaccccccacctccctcccggacggggcagctggccgggcgggggctgacccccacctccctcccggatggggtggctgccgggcgggagacgctcctcacttcccagacggggcggctgccgggcggaggggctcctcacttctcagacggggtggctgccgggcggaggggctcctcacttctcagacggggcggctgccgggcggaggggctcctcacttctcagacggggcggctcccgggcaaaggggcccctcacttctcagacggggcggctgccgggcggaggggctcctcacttctcagacggggtggcccggcggagacgctcctcacctcccagacggggtcgtggccgggcagaggtgctcttcacatcccagacggggcggcggggcagaggcgctccccatatctcagatgatgggcggccgggcagagacactcctcacttcctagatgggatggcgacagggaagaggcgctcctcacttcccagactgggcggccggtcagaggggctcctcacatcccagatgacgggcggccaggcagagacactcctcacttcccagacggggtggtggccgggcagaggctgcaatctcggcactttgggaggccaaggcaggcggctgggaggtggaggttgtagcgagccgagatcacgccactgcactccggcctgggcaacattgagcactgagtgaacgagactccgtctgcaatcccggcacctcgggaggccgaggctggcggatcactcaaggttaggagctggagactagcccggccaacacagcaaaaccccgtctccaccaaaaaaaatatgaaaaccagtcaggcatggcggcgcgcgcctgcaatcgcaggcactcggcaggctgaggcaggagaatcaggcagggaggttgcagtgagccgagatggcagcagtacagtccagcttcagctcggcatcagagggagaccgtggaaagagagggagagggagaccgtggggagagggagagggggagggggaggggggagagggagagggagaggggaaccatctttgatataaacgagaattaacaaaagatgtgtaaaatttttgagggagaaaaatttgcagttttattaagagacattaaagaagacaagtaaatagtggcagaatgttcttgcctaggaagaccgaatcttttaaaaactcatattgttctgtggattcagtgcatctttaaagctccgtgagttttatgtgaaatgcgataagtcgattctaaaatgttgagaagaattaagtcgtagtattgagaggtcgttgtgaagaagaggaatgaggagggagcacttgccttgcccgtatcaagatttacttcaaaattggctcagggaaatccaaattggccagtgagacagaagctgtcagaaacagacctaagaagcttgaattccagaggtggaattacatatcgctgtgcaaagggcagactcttcaaacacagtgctgtgacagtcggagaaggatgcagttggatccctaactcacaacatacaggaaattcagttttggataaattataggagactatctttaagaccttgatagggaagtgtgcctttttctttttctttttttttttttttgagacaaggtctggctctgtcacccaggctggagtgcagtgacacgttcttgtatcactgcaacctccgcctcctgggctcaagccatcctcctacctcagtctccggagtagctaggactacaagcgtgcaccaccatgcccggctaattgcatgttttcgtagaatcggtgtttcgccacgttgcccaggctggtctctaactcacgagtttaagcagtctgcctgcttcggcttcccagagtgcctggattacgggggcatgagccactgcgcccagccacctttttcttttctttctttctttctttttttttctgtttttttttggagatggagtttcgctctgtcacccaggctggaggctggagtgcagtggtgcgatctcagctcactgcaacctccacctcctgggttcaagtgattctcctgcctcagcctcccgagtagctgggattacaggcatctgccaccacgctcgtctaatttttgtatttttagtagagacggggttttgccatgttggccgggctgggctcgaacccctgatctcaggcgatctgcctgcctcggcttcccaaagtgctgggattacaggtgcatgagccaccatacctagcctctggccacctttttcttaatcacataaaatattcactctaaaataaaaatgactgaatttgctagattaaaattaagatctctcgtttattgaaagacaccaataggccaggtgcttatgccaggaatcccagcactttgggagaccaaggtgggcagattgccagagcccaagagttccagaccagccagggcaacgtggtgaaatcctgtctctatgaaaaaaaaaaaaaaaaaaaaaaagaaataattagccagatgtggtggtacacacttgtagtcccagcttctcagtaggctaaggtgggaagaatcacctgagtccctgaggtcaaggctgcagtgagccgagattacaccactggacatcagagtgagaccctgtttcaaaaaaaaaaaaacaaaaaaaaccccaaaaaacaccagtaaagactgtgaaaagacaagctagagtagagagaagatatttgcaacacttacagcctgtaaaggataaggattctaattcagtgtatataaagaactcctataaagcatttcgtagatggtgattaaacatagaaaaagacatttaaatttaacctcgttagtattctaagactacatacagtgagataccactttacagatgcttagactggcaaaaattaaaatgttggagaagatatggatagtgtggaaattttatgtgcttctttacacccactctggaatagagacattatcttgcaaagctgaacattcttattttctgtgatccaggatttctatttagggaaactctggaaaaatccttgcagaattgtttgtacagtttttccagagtgggtgtaaaggagcagataaaattccaagccatccacatcctctccaactcttggttttgtcagacatcttaatttttgccattgatacatgtcttggaaacaacccaaatgtctgtgctcacatgatggaatgttatacaccagcaacagtaagtgaatgttaggtttatgcagcaacatggatgaatcttgaaaacagaacgtcagctaaaagcaagttgctaaaaacgacatatggcacaatatagagaagcaaaacagatcgttatattacttatagatacatacacatgtggtaaactaaaagaaaaaaataagcgcagtgatacacaaaattctagttcctggtggagagacagagggatataagactgggagaagcaaaatgatgcttgagttcctaaatggggtgtggggaggtcgctcacaactatattattaggcttatgaatcttacatgtgtgctacatacattctttgaaatgtttcacatattatacagctttttttctttccaaagaaaagccaatgggagagttaaactgacctggtgtagcagagcagctgcaaccatgggcctgcttgagtgagaacaacaagaaataagcagtttgcccagcagcctcccagaaaggctcagcgcttgaaggctctgagtgccaagggtggcaggcatcaggcataggcatgggagtgggatagggattggtggaattctcttggcactcgcattcccttcttcactttccatcactgggtgactctttctgctaccataagatgtggggtttcatttcttttttttgagacagagtcttgctctgttgcccattggagtacagtggtgaaaccacagctgaatgcaacctcaaacccctggactcaagcgatcctcccacctcagcctcctgagtagctgagactacaggcgtgtaccaccatgcccagctaatttttaaattttttgtagagacgaggtctcgccctgttgctgaggctggtcttgaactccggggctctagcaatcctgcccccagcctcccaaagtgctgggattacaggcatgagccactgtgccccgcaggagttgattttctagaccaacactgtccagtgtagtagccatgagtcacatgtggctgttttgaaggaagatgtgcagcaggtgtaaaatacacaccaaataggaaagacctagtacaaaaaaagaatgtaaaacatcccatgaatacttctttatattgtttccatgttgcagtaatagtattttgaatatattgggttagataaagtattaaaattaatttcatgtttgtttctacttgttgaaatgtggtttgcattgtgtttctattagacagcacttaaagtctgcaaaataagtgacaccaggtacaacagaggggagtcgtggaggttgaaaatagaggaattaagagaaattctctgtagtgacaagtaggtaataagtaggatgctcaggcctgtcttctgccctgctctccagatgtcagcagccaggtgttttcccagacaggagattggaggagtcttttctagagacactggcacttcatacaagaggtagaaaagtgtcaacataatggaaggtttccaactgaaagactagctctcccaccgtggtccctgacaagcgtctagcccactaggctcactagagcctctggctagctgggtcaccttcctcttatgatgaaagacaaccagtgctgaccagatctagaagaaaacatccactgtggatattcgccagagtctgaacaaagcacaccagaccagaagggccacagcaaagtggcctgaggcagccagctctgctgtatgtcatatcgtggttaaatgtgggggcttgagccagggactggggctgctcccctgctttcaccacttactggctgtgatcctttgggcaaattgcatccataaaatggagaaaataatagtgcctgtcacttggggttgttgtgaggattacattacatgctacatataaagggattagacaagaatgtagcacacagtaatccctcaattagcagttactttattcatgtaataaaacttaaaaaaatgtattctgacattggtaaaatggcagtccaggaagctccaggttctcgttccaccatagaaaacattaataagcaactagggactagatggaataactttatagaagctctggaaaacagtcagaggtttcttagcccagctaagaaaatgcctaatcaagaaaaagccacattcaaaatacagattgagtatcccttaactgaaatgtttgggaccagaagtgttttggattttggatttttttctgattttggaatatttacattatacttaccagttgaacactccagtgagcatttcctttgagtacaacgttggcactcaagagttttggattttgggctgggctcatatctgtcatctcagtgctttgggagttcaaggtgggaggattacttgatgccaggattataagagaatactgttaagaattgtacattaacaaattgcttaacctaaatgaagcggacacattcctagaaacatacaacctgccaagactgaatcatgaggaaatagaaaatctgaataggactataattaataaggagattgaatcagtaatcaaaaacctctcaacaaagaaaagtcctgaaccacatggcttcactgatgaattctccaaacgtttaaagaagaattaacatcagtccttctcaagtgaattcattctgtgactctaacatgccctgataccaaagccagacagtaatactactagaaaattacagaccaatatcctttgtgaatattgatacaaaatcctcaacaaaatactagcaaaaccaagttaaccaagtttagcagtctgtcaaaaggcttggaccaaatgtaatgcaaggatgtctcagcaaactaaaatcagtcagtggtcaaagactgaaagcttttcctctaagatcagagacaagacaaggatgtctgctttcaccacttattcaccatagtattgaagttaattgcccacagtaattaatcaagaagagaaagccatcaaaattggaaagggagaagtaaagttatccctgtttgtatgtgtgacgacatgattttatatataaaaaccttaaagatttcacagaaacatggttagaactaataaatgaattcagcaaaattgcagggcacaaagtcaaaacacaaaatcagttgtatttatatttatgtacactaactcagctatctgaagaggaaattaagaaaataattccatttacagtaatagtacaaagaataaaatacagatattcctcaacttataacagatttatgtcttaaacctattgtaaagtcgaaaaattttttagtcaaactatcataagttgggggtctgtctgtactaaagaatattcttaagtacacatgaaagactgaaaacactgacaactacaaaatgttaaaagaaattaaagaagacactgggtgtggtagctcacacctgtaatcccagcattttgggaggccaaggcgggtggatcacttgaggtcaggagttcaggaccagcctggccaacatggcaaaaccttgtcttggtgaaaaatacaaaacttagctgggtgtggtgaggtgcacctgtagtcccagctactcaggaggctgaggcaggagaattgcttgaacccagaacgtgaagattgcagtaagctgagatcgcaccactgcactccagcctgggtgacagagtgagacactgtctcaaaaaaaaaaaaaagacaaaaataaattgagagatgttccatgctcatggactgtaaaacgtaagatgtgactattacctaaagcaatctacagattcaatccctattaaaatgccaacaagttttttttgctgaagtagaaaaatttatcctaatgttcatagaatctcagcagactccaaagagccagaacagtcttgaaaaagaagaagaaatatgaaatcctcataattcctgactttaaaccttattacaaagctgcagtaatccaaacattgtagtattggtataaagacagacatatagaccaatggaatagaatacagagccttagcaataagtccttgcatacagtggtcaaattattttccacaaggatgccattaccattcagtgagggaaaaagtgtcttttcagaatgaatggtgctaggaaaactggacatacaaatcaaaagaataaagttagacccttagctaatgatatacaaaacttaacccaaaatggatcaggcttaaatttaagaccttaaactataaaattcttagaaaaacataataaagtcttcgtgacactggatttggcaatgatttcttacataagacacttaaatcacaggcaacaaaagaaacaatagataaattaagctacgtcaaaatttaaaacttctattaattaaaagaagcactcaacagagtgaaaaggcagcctacagaatggaaaacatttgaaactcatatctggtaagggttaatatttaaaatataaaaagaattcccacagctcaataataataaatatcctggttaaaaaatgtgcaaaggactgggtgcggcggctcacgcctgtaatcacagcactttgggaggccggcggatcacaaggtcaggagatcgagaccatcctggctaacacggtgaaaccccgtctctactaaaaaacacaaaaaattagccaggtgtggtggcgggcgccttagttccagctactcgggaggctgaggcaggagaatggcatgaatcctggaggtggagcttgcagtgagccgagatcacaccactgcactccagactgggagagagagcgagactccatctcaaaaaaaaaaaaaaaaaaaaaaaatgtgcaaaggacttgagtagacatttctccaaagaagataaacaaatgactgataagcacattaatgattagagaaatgcaaatcaaaacagcagtgaaatagctcacagccattagatgtttgctgttgaacaggaaatgacaagtgttgacgaggatttagaaaaagtggaatccctctgcggtgttgttaggaatgggaactggtgcagctactaaaacagtatgacagtgccacccaaattaaaagtagaattacctgccgggcgcggtggctcacgcctgtaatcccagcactttgggaggccgaggcgggcggatcacttgaggtcaggagttctagagcagcctggccaacatggtgaaaccccgtctctaccaaaaatataaaaaaaaattagccgagtatggtgatgcatgcctgtaatcccagctacttgggaggctgaggcaggagaatcacttgaacccaggaggcgaaagttgcagtgagctgagatcatgccactgcactccagtctgggtgacaggacaagactccttcccccccaaaaaataaagtgaactttaaaaaataaataaaataaaaatacaaaaattagctgggcgtcatggcgcacgcctgttaatttcagctactggggagactgaggcaggagagttgcttgagcctgggagacggaggttgcagtgagctgagatcatgccactgcactccagcttgggcgacagagcaagactctgtctcaaaaaataaaagtagaattatcatacaacttagcagttcgactccaaagaattggaagcagagacttgaagagagatttgtacacccaagttcatagcagcattactcatagtagccaaaaggtggaagcaacccaagtgtccatcacagatgaatggatcaacaacaaggtagtctatccatccagtggaatatggtttaccttaaaaaggaaggaattctgacacatgctacagcatggatggactttgaggatatgctcagtgaaataagcctgtcacaaaataacaaatactgtatgtttccatttagatgtgctatcaagatactcaaatgcatagatacaggaagtagaattgtggttgccaggggctgggaggagagaaaaattgggaggtaatgtttaatggatacggagtttgtttggtaagatgaaaagttctggagatggatggtggtgatggttgttatggaactaatgtgaaggtacttaataatgccacttaactgtacactctttttttttttttgagacagagtcttgctctgtggcccaggctggagtgcagtggcacgatctcggctcactgcaagctctgcctcccgggttcacgccattgtcctgcctcagcctcccaagtagctgggactacaggcgtccaccaccacgcccggctaattttcaccatgcccgactaattttttgtatttttagtagagatggggtttcactgtgttagccaggatggtctcgatctcctgaccttgtgatctgcctgcctcagcctcccaaagtgctgggattacaggcgtgagccactgcacccagcccaactgtacactcttaagtggttaaaaatgagttcagaaaatccaatatctgattaatacaaattccttaaaagaaaatagaggagatgggggaggagggaattagcaaagaagttatataagaaaatttcccagaaatgaaagattgtatccttggattggaagggactggcacaataattttaaaaaggcctgtataaattacctccttgtgcagctgcagcacgttggtaatgcagaggacatcaacccctgtagcgggaaacctgggtcacaataaaaggatcaggaatcagagcagtagatgcctcagcggcagctccgatgtaaaaaaaaggtggggcggggcatcccagatctgtagaggaactgattttgattgtctacttcaaatttttagttttatctttattcaagttacttatgcatacaatttgaatattcaaatgattctgtaagtcttttttttaatagcaaaccctatgaacccctctaattttcaaggcaaacattgttttagctgtttcatttggtatttatctgtgtgtctttaaattccgtggttttaggcattctctgctgattcttccctaagcctggtgggtgagtctgggccctgtgctctgtgaggtcttgcctgctttcagtgctgctcctagctgggccatgcaggagcactccgtttcctttttgttggcacaacattgtgttttcactttttttttttttttttcatcttgctctgtggcccaggctggagtggagtggcgcgatctcggctcactgcaacctcctaggctcaatcgattcttctgcctcagcctcctgagtagccgggattacaggtgcatgccaccacacccagctaatttttgtattttttagtagagacagggtttcaccatgttggccaggctagtctcgaactcttgaccttaagcgatcgcctgcctcggtctcccaaagttctgggattacaggcgtgagccaccgtgccgagccatgtttaattttttaagaaattgccaagccgttttccaatttggtgtgaatcctgtagattcatatatatcttttctttttaagtacctagaagtctctttcctgatgtcccctcagttacagatctctatcagtcagagttctttggcccctcctttcccagacgcccctggtggtcctcacctgtcagtgctgctgggccagcttccccgttcaccatcagtgtgggagaatcagtcactctcacctgtgtctccttgcgttggaacctctggtgtttggtttttatatctttcctgttttgttttattccttcattttagtcgagtactgccccacttatgtggaaaaggaacataggagacaaaggtttgtgtttccttgtttgcatgtctgaagtgtccttattttacctttgcacataagtttggctggttttagaatcataagctagaaataagtttttcccataattttgaaggttaagcttactccatttttactccaacaccagtgttgctggtgacataatttttgattctttgaacataacttgttttcttcctggaaattttgcgtatcttttgaaccattgcactgcctcctcagtgggtcttttcatcttagactcatgccttacagcttagggaaaggggtcactttcctgttctctgttctattctgttttcttctctgttccctttttctggaactctttattattgggaattggagctcttggattgattcccagttttcgttttctcctctgcagttttccatctctttgattattttacttttagtaggtttctataacttctgccaaatcttttatgagttttcatgtttgctgtcatgtattcagtttttttttgtgtgtgtgacaggtctcactgtcactcaggctggagtgcactagtgtggtcatagctcattgtagcctcaaacagctaggctcaaacagtcctcttgtgtcatcctcctgagtagctgggactataggcatatgccactatgcccagctaattatttttatttttatttttcatagagacagggtcttgctgtgttgcccaggctggtctccaactcctggcctcaagcaatcctcctgcctcagcctcccaaagtgttgggattacaggtgtgagccactgcacctggcctcctgttcatttgtacaagatcattttcagaggcaagtaatgatggatagtgttgtctgcattttccttttttttaaaaaaaaattttatttatttattttttagacagagtcttgctctgttgccaggctggaatgcagtggtgcgatctccactcactgcaacctctgcctcccgggttcaagtgattctcctgcttcagcctcccgagtagttgggactacaggtgtgtgccaccacgcccagctaattttttgcatttttattagagacggggtttcaccatgttggccaggatggtcttgatctctttaccttgtgatctgcccacctcgggcctcccaaagtgctgggattacaggcgtgaggcaccgtgcccggtccatgctccttcttaatagcacccttttcttgtttcatgagtacagtagaacctctcactttgaggatgttaatggcctgtttttggttttaactttttgtctctgtacttgtttcttctgtgctattttcctctgtggtttgggtctctgcctcagaggtttggtggtccttccctatctgctgtatgtggctgagggacttgaagttctgtgcacgtgggcttccctggagggtgaaccagctggatatgtttcgttgggaatctcctcctgttggggactttcttcttgacctggtcagattttttccataaaggaccatttcctatctgcctggagcctggggttctgagagcttagtggaagaaaaatggcgatggggaatctgtcctctcttccctgagtaaagaaccctgattttcagctgaactggtgtcccctaacccagacaccacctgttttatcttcttaccagttaactcttgatttgtttactgcttgagttgtgggaggaatctgggtgtgtccacctgccttgtccctgcgcccaccttttaatatgaataatttcagatctatagaaaactcataatcatagtgcaataaacactcctgcagcctttacccgggttcaccagctgatagtgtcctgccgcacctttacccgggttcacctgccgcagttgctctttgtgtttttcttctgaaccctttgagaggttacagatattatgatattctacccctaaatactatgatcaaaaaataagaacaatcctctacagaagccttttcacatgcaagaaatttactgtagtactattctgtgtaatccatattcagattcttttcattatccccagaacatcctttacaggtttctttccccttttaattcaagatttattcaaggattaatgtaagtatgttattgccgtattgctttgttctttaatctagaagtattcccagccctcttttgcagggggctttgggcgtctttcatgacattgccatatttgaagagtccaggtcagttctgtagaatggcgttcaatttggacttgtctctttcttcaggattagcttcaggtgagactttttttttttaggtagcaatactatgtaagtcataaattatcaaatcacgaggcccaaggtcattttgtctcattattggtgatgttaagtttgatcactattgtgaatatttctttccctttttgtgacgaaaagtaatttgtgaataaatagtctgtggagtggtattctaggtattctccctgattctgtttccttgttgaacttgctctccagtgtgttcctgtgctggggaagcagcagcgtggcactctagtggtgctggaggcaggaggggcacatgtgctccgagctgcacaggtcatggagcccagagtcggagcagatgtggctctgggtgctacagtgacccctgcaccaggtccccagctgggctgtgaggcagggctgctcgggccccatggccctggtggaggtggaagaggccccccagcttaccaaaggctggccctccgcgggaagagggacattctctactgtcagaggcaggcctgagaggtctgtaagggttctgtcctgtgctatgcgcattccccagcctggcccccagactctcccccaggacactgtctgacatcagcatcatcttgacagccaagcccttccccttcttgctggcaaaggcctgtgtctgtgctggcaggtttccatggtgggcccagaatgggcattgaataaacgtgggggtgaggggatgaatgtgagcatttggatatggagatgcatgatggaaaaaagaaagggctcacaattgccacctaaacccagagaagcctgctcaacagagtggtgtcctttatcaccatttggctttctggttatgtttctgaaatatttcacctggtctcccaccccagggggcagatgacttcactcagtcaacatgtaacaacctggtctttggtgcccatgtgacctggcagcactgtccctctgttatctcttctttctcttccctttcctctgccctcagttcatcttgtctttctgtgagcaattttaccaggtactgtgcttggcttggggaagaggccaggatacaaagtggagccacaggtcttgcccatttgagcagagggagatgttgaatttaagttcagtgacattctccagccacactcaggcctggcctcaggtttatcccggatatgtctgcctttgccctttgccaaagctgctccatctgccagaaagcccctctgttctttctcagcttccagtctcaggcccagaagctcaggtggctcttcccttctccaccaagtgctgatgccccatcctagtggctgcatccctgcatcagagctaccagcgagtctgtgggtcgagtctcctacccagagtgtcgggtgctgcaggtagcatggcttaggacatgggaccagtcctaaagagctgatggtccccaagtactgcgtgtttacagcatcaggcctgtcgtggtgccagttactgtcccacactgaggtccttaggttgtattttggggtggtaaagtaccccaaagacacctctaccaaaaaacacaagccttgaagatgcttctccctttgaggtcttcactttctgttgaaagtgtctcggacacaggtagcatattttatattttagtgattcccagtcgaatagcaacccatccccatcacatgcctgacaggagctatggaactatgcttattgagtactgagtgagtatccagagtctcagaaatgagactacatacgcacttgtgtacaaggtgtttaaggcagccttttctagaataatgaaaaaaatgcaaacagcctaacctcaaaccatagagattatggggatgaaagaaatccatttgtggaatactatgcagccatcaaaagtcatgttcctaagcccatttaaaaatatagaaagctgtttatagtcttaagcttacaaagcaagtcgtgaaatggagtgtctgatgtgatcccagtattcttaaagatttgtgtagaaaagagacttggtgagggggcagatgctcgcatagttaaatatggcctttgttgtttattgtcttttcaaacttttgtatttttcaagcatttcacattgaatgtttgttactttatcatgagcaaaaaagcatgtggattttttattaaataaaaaccattgcaaagtctatgacactagcagaaccaacctgctggagaggggctcgtcaggtggcgctgactgccggttcaggttcagggaaggaggctttgcaggaggcctcctaaccctccctgtgacctcccttggggagccgaggccccactcgccatctgcagccagagtgcacttgctggcaggcgtctgtctgtgtgcagccttgcagaccaagtttgtttcccatctgacctgaccttgtacccgatgcccttcatgacacatcagggtacacctgtacagagtgggaggtgagcgggcccatgagggccctctcccctgcaccatggccttgggtaagtcactccccttctctgagtctgcccttcaccttgtgagatgggaggagtgtggttctcctttttcacaagggggttggaggacaaaagagagtgtgtgggtggaagcactggtgtgcaaattactattagatcatgctgtataaaactatagttatttcctcatcttcagctgcctgttgacaccttctagccatgcactgagacctgctgcacaccagggcctgtgccaagcaccaaagagccagacaggaacatactgaggtcctggcctggaggccttcacagccatgggggaccagcaggcagggggacagataggcagctcaggccccaggacaagggctgcagaggaaggttgcacacgtgggtctccttcatactgggagagaaggccctcaaggaaggggtaggggcagcctgggctctggagagaactctttcatgggccatccccatggggctggaactgctgagggattttaatttatgcaggaccctttgctgtgctagcaatgacctgttagaaaatgcaatgaagagggcctccatttcacaatagtaacttaaaaaacaaaaactgccacggcataattttaataagaagcacacgggacccatttgatgcgagcggcagtgtttcatagggctctaaagaaagcctgcattgccggactctgtgctacaggccccccctccggccttgcagccctgagtggtctgaaccatgctggccagggagactgcgactgcacaggcaggactcacagcacacatctccttttgctttcagaagtgaccggggaggtgcgtcctcatcatgggaaggaggctgtggatccgcggcaggggcgggccagaggaggcgacccttcgcacttccacgcggtgaacgtggcgcagcccgttcgcttcagcagtaagttgcagacctgccctgactgggacactggggagtgcaagcctgacatgacccctgcctttccagcactactgtgctgcgtgaggggtttctcaaagcagcccttggaggccagtgaggggaatgaatgaggctgcatgatgacccacccgcagtcacccagcgctggagtggtggtatgtgactcaaggccctaggaagtcaaccggctctgaggccaggctgcttgttctcacaaagtgactgcttttcagggccagaaggcactggcccttggaaattccaaagttgtattattcccttttataaatgaggaaaccagctctgagtttagatacagcaataaaatgggaaggctcgactccttatttatttatttatttatttatttatttatttatttagagacggagtctcacgcttgtcacccaggctggagtgcagtggcataatctcagcttactgaaacctctgccttccaggttaagtgattctcctgtcttagcctcccgagtagctgggattacaggcacgtgccatcacgcccggctaatttttgtatttttagtagagaccgggtttcaccaccttgaccaggctggtctcgaactcctgacctgaggtgatccacccacctcagcctcccaaagtgctaggattacaggcatgagccactgtgtccagccattttaagaaaaatttttaaggtgattagttatttaataaattacctatgacattgaaattttaaaggggcatgagatcatcaaggaaggttgaggggaggaaaagccaccactgaaatggccctgagcagaccctctcaggcgcgaggtacccaagtacgctgagcagcggctgtggaccaggcaggactgatactggatgggcctgctgccctgccttgggcctgtctgcttgtgttactcctcagcccccagactttcagcactggggagcacctcagaggtgaccaggtctgcttctggcagaacccccaccaaccctgggtggccagagtggggccaggtgtttccaggtggtcacgcatgttggtgcggctgaagcagggctggacatgtcctggtgatgcactttgtctccggcctgtgcccacagcccgaacgggtccccacagtgcaagtgtggtgcacaggcttggtgtgtgaagacactgaggctgagaggccacctgtagggaaggggcagttcacagtgcagccccagggggtcctgatgctcagctccatgttcttccttccccttgcctgtctgttcagttttgaacaggcagcacttctgcctgggtagtaagcaactccaccaagttcagaacataaagaagatgagtcagtgcacaggagtgcttcctccctccatgccccagccagctggctcccatcctgggatgtctccttccctccatgcctcagccagcttccctccctacagggcttcctctcaccttgcctgagataggggcctggcctctgcctgcctcagtgtcctcacctcttcatggagacggtgcagagccacctgcggggcatgtggtcaggctgcatgcattggtgtggcacccaggaaacacgcaatgaatgtgcaacacaccttctcgagagctgatgccttgacattttttattgttgttttgtttttttttgtttgtttgttttttgtttgttttttttcagacagggtctcactctgtcacccaggctggagtgcagtggcgcacttttggctcactgcaggcagtctctgcctttttgagctcaagtgatcctccaacctcagcctcccaggtagctgggactacaggtgtgccccaccacacctggctaattctttgtattttcggtagatagggggtttcgccatgttgcccaggctggtctcaagctcctgagctcaagcaatctgcccacctcggcctcccaaagtgctggaattacaggcgtgagccactgttgccagccctctgattccttgtctgcacctaaagagcttccttgcacactcaggtgtacccttcacggtgagcagatggtgctgtccagctgtggccatgcttaggggctaggggtgcccctctttttctgtaatctatgtgcctttatgaagaagtcacacacacacatgcttacataataaatacatggggatacgtgtctagaagttttactagtgccacaagacatagctgcactttaaaaatggcatttttaattttacaactggctttgctaaaaattgtcactcttctccagtgtactaatatgaggtacccaacatttgaaggttaaagattctataaaagaggtcactggtgttacctaaggtgagctgtaaattaccaggcattcccgtgtgtgggtgtaggagtcggaagtgatgggtggaggaagtgagaggacgctggccagactcattgatactcaagtgctggctggctccttagctttgccacctgtggcatcgcccacaccttatttttttcggctgtgggaggcaggggcgggtcacacagtgtcatggctctcccagctgttatcctttgagctgctgttttagtggagggttggccagcccctactgcaaatgctcatgtaagtagaaaagggagagaggggagtgagctagctggcagcggaggccaggagagctgggcattggaagcagggcccaaagtgaactgcatgggagttgtgctgtgttgttaacccagagaatgaaatccactttacaagacttaattcagcagccgttcttgactagtgaataaattaaaagatcttatagaaatgggaagagtcaccgaatgtacttgtatcattgaatctgtgttttagagaaacttgagcatttctgcaatgtggtttcagaagcagaccttgtcctcttgagcctcagtttccccacttctctagggtgatttacaaggtgtgcctgtccctgatggagtacatataatttccattttggagctggatcctaacttgggggacaactccccttctgtcctttatgtttcctagggaagtgcccgacagggtggcaccactacgaaggcacggccagctgctaccgggtctacctgagcggggagaactactgggatgccgcgcagacctgccagcgcctgaatggctctctcgccaccttctccactgaccaggagctgcgctttgtcctggcccaggaatgggaccagcccgagcggagctttggttggaaggaccagcgcaagtgagtcctggattggggacctgaggggctggagtcagagtctgatgactactgagcacatggcctctgaccactcagtaaactcctggagcacagctggcagacagcaggttgggaagaccagcctcgcccactggaagcccaggagatccatgggtaggagtgtgcatcgagataggtggagggtcctgggagcaggggcaggctggactctgctgctactttgtgggactgtggggcagcccctttcattggtacccctctccttgtacaagtgcagttgctgagcgcaggcagggggctgggggtgctggcttgtgtggggagaactgcttggtgtggggcttcgtgggccttgtgcaaggggtgtgcagtgtaggtgggggttccccccaagaaagcaagggggccttcgcttcaagacccaagctgggttttgactccacagttatgccctgtgagagtttggcaaatcacaagacggagttgtttttccttctgcagctacaaagggaggaaactaactcttagctcacaggttgttgtactaaccccatgaggacaggcctgtgagtccagtggagaagcaagagggtatagcccggagggcagggcagccccatctctgaggacagccttgtggttgcacagcatagggcagagtgtgccatccctgggctcctgccatgcggggagacctgctgatgggcatctctaggcttggggctggaaagctgggccaagggacatggactaggcaggagcttatggcggtcagccagatgccagtgcaaggtcctttcagtgctaggcctgcatgctcaggagcaggctgcaggcctgaggtgggctggctctgagtgggaagccgtgcaagtgttttcagcccccatggtagtggatatttgcagggacttatgtctttattgagatgcagttcacatgccatgaaaatctcccctgtggagtgccctgtcctatggttttagcatagtcaccgagttgtattcatggggtttcatgtctaccaagaataagattgttcttgcttaaattgtgaaagctttaccggtttagctcatagaaacagtcttggcaagagttccctgagataaaacttttcctgccctgtgaactttcttgttttgaattttaatgcattctaacatgagtgtctcatgttagaagctcagtgttgtggaggtcagtatagctattaaaaaacaatcccagcactttgggaagccgaggcgggtgggtcatgaggtcaggagatcgagaccatcctggccaatatggtgaaaccccgtctctactaaaaaaaaaaaaaaaaatacaaaaattagctgggcgtggtggcctgtgcctgtaatcccacctactcgggaggctgaggcaggagaattgcttgaaccaggaagtcaagttgcagtgagccgagatcgcaccactgcactccatcctggtgacagagcgagactctgtctcaaaaaacaaaaaacacacagtcattgatggttgcatccctcctgccgctgagatctctgtctctgtctctgtgccctgcaggttgtgggttggctatcagtatgttatcactggccggaaccgctccttggaaggtcgctgggaggtggcattcaaaggtgagcccttctggtgtgtgggagtgtttgaagctgggcagagtcaccctgattcggggcctcccctcctccctcttacccagtgctgcctggcccgtaggggtgctgtgcagggagtgggtgagccccagttgcagggagggctgcggtcatggggccagtgcagcctgcagatcaggccctgcattgggcggtggctgtctctggaaccctctgttgcatctcactttggccagctttctagattgtcccccgcctccttttgaagttaaagaccttggagtataaaaatgagcatgcagagtgtgcccctggcaggctggaggggaggacaagcttgccaggacaaaggtcagacgtagaatccagacctgaaggaaactatcaggcagatagagagagagagagagagagagagagagtgagcatgcatgtgtgtgtgtgcgcaaagattttatgcggagctgcttggaaataccaagacgacgtaaaggaaacatggctgctgtttcctttacattccctgggctcggacttggcttgcccttcctgtcccattgccctggcactggcgagctcctcctggacatactccagcagtgccttctccagctgccgccagggtcacactcccttgccctgccccttccctgtctgttgggctgtactttgtgcctgtggcttgagctaggatttgggttcttttcgtaaacacatcccagtcctgctgttgatgtcttaagtatctctaagaaggataaatgaggagtgatgggcctggggacagggttgaaaagggtcaaggcctgggtggccggcttccctggagaaaagagggccccacagaggcggggccatgcctggctgctgggacagggcaggagcagaggtgggggctgcagagcccagcagactggggccacacctgctgtcccgatcctgctcaggacagatgccaccctgttctcatgaccaccagtgccctcctgagagccccagccacatttgcattccctggctttatgagtgcattgtttagattgctattgactaatcaatggcttctgggtttccaggccccagagtcaaagtttgcctcatagagcataattatcctggtagcttgtcctcctgacactggtggttgaagagaagacatgattctgagtgggatgacagcacattcagagttggggactgggggcctcatgcttggtgtgagaatggcaagggtcctgggtgggctttaatggccaagtgcagctcagtgactccattggagcctcaggcaggagagtgaacctaaaatttagaaaaagattgaacacgtatgttggtgctggcagctgcagctggcatagagctccctatttgtgtggctcaacgtgcaaggggccccacagcatcccggagctccacggaggtgaccatgtgccactgcctgcttgtgcccagttaaatggattcgggaactctgttagcggatttaaatagtggtcacaaaacaaatagtaacaataacaataattcttctgctgcaggataactggcccttgatgcagctcagcatcatgagtggttctgggcttaaagagattaaagaaacataaaaccaaatgtggcacaagaacccttatggtgtcctaggttgggaggcttataaaatcttccacaggacaattcaagaaatgagtggggacttgtggaagattcattttcttaggtgcagcaataggactgtggttgtgtggttttaggagccagtatcctggagtctgcaggggaggggctcccagggtggtagggcagagaggagccaagcagcagggtgcggtcagcaccgaggtggctcgggtgcacgcactcctctctccatagtggaatcgttttaaaaattcctgtaccaaaagcaagctgcagagtgaagacagtactgagtataaaacaagctagcaagagcacgtctagcccagcccagcccaccccagcctttctcctgcctggggacatggtgcaaagcagaggggtcattggggtctgaggtgttggcccccccaaaaatacccaaaaaaccatgggaaatggatgtaagtcatttgttactcattctgaacccttccctaagaaaatattgtacctgagaatatcagctaatgatggtggaagggcctcacattaagatgttgaaaaatgtttctttcatctacatgttgtccatcttttctgtgttgtataatatgttccagattggggtgtgagtgataccatggtacatagacgcttactatgcccatgtgtcggtaccctgcacacacatttgaagttgggagctcgtttccgcagggttcctgtgcgccttggtggagcgctctccaggcgctcccccaggcccacaccagcctgtgagccccgcctgggggccaagaccctgcaggtttgacagcaccaggtcatgatgtgccctggagacagaactgccgctgctgctgccagaagacatgaggccaggatttctgtaacatttgtgcagaaaggttgaaaaagtacagatccttgtgtagggagaatcatccacaccgccccacgtgctgctcccagggccttcccgtcagcaccagcagtgtagcttctgtctggtgagtcatacttgatatttaccttaaaatataaaagtgaaaacagcgtgtgtttcatgtgtccacatgttgtgtcacttgctcatttaagattactcagtgcctggccctcatttgtcccccgtggtgtctcagcacgcacattgcaggttggctgaggtcaggaggtgtgtgacttagtagaagccttcttttctcccccaaaatcttgtgcccagtcctttatggtctccgtcttcttctttctctggtgctgtacctgagggattgtatggtgttgcccgctgaggccagcagtcagggctgtggtcctgggccagcctgtgggacctagcgtttagaagcctcagtcagcagtgagggaggggccaggctggcctagcagccactggaaggtgcattgtagagaccctgccctctgggtgagctgaccattggtctaggatggggtcagctggggtcaggccacagttcttggaggggagacagaccctgagtggggcagctgccaccgtggtggggcattcgggagcatctggacagcccctggtgggcccgagtggaggctcattctgtggctgtggaggtggcgagacaggaaggggaggttctttgagggctcagaaaagtgagtgaaggtctccccaccactcgaacaatgggggactcgggggccggggagggttctccaggctcggcgagcagcggtggacatggaggtggcagtggctgctcgcacatgtgggagaggatgtggtggcagaggtaatcaggttcagatgccctcgtgtatcagtctggggagcagggtgtcctccggtggctggtgacggcccagcccaaggctcccgtcagagtcctgcgcacacctcatgtgtggacatatgggaggggcacctggaaacttgccgccaccctgtcgaggtgaggactggatctgctggggtggcagggggtgaggagtagtgtcttggagggaggcttgagaggagggctctgcacgaggaactgctcccagtcactctggtagccagggcagctctgctcacagggcctttctctaggatgagggtccttcaggaagagcgggatgtttgaggtaagggggtgtccaggaggaagtgggaggccctggaggaaaatctgcaggagtcatccccagtgcagtatcgggaagcctccaggctcctctcacacctttggaatatgtccaggatctcatcacctggcaccagtcttgcagcccccaccgggatctaacacccaatcatccgtcacccgattgtgctcgtggcctctgtctggtctcctggccccagccccaccgctcctcacacagctgctgggggtccttttcacctctgctcccttgttcacagctctcgtttctcatagaaatcacagttccatcaaggccagcagccccttccttcactaccctcatcacctaccactccccagcctcttctccagccccacaggctgccttgttcatggctgccactgtgacctcttccagggatgctccaaagacgaacacctgcccgctctgcaaggctgcacctcgggtaggcatgcagtgcccgcatgaccagcccccattcagcacctggatgcagagccaccagcagctcccctgggcaggggcgctacacaggtgcccatgcagcttgctgccaggagggagcactgtgtggctctctgggccctggcctagagtgccacacgaaccctgttttgctggttgcctgactcactctgacttgctgtgccccggtccaggcagctttcgtgggcaaatgctgggtcccaggactctgcccggagaggtcatttgtgtccttggtctcagtctgctgtcatgtactgtagttgtgggcaggagctcttagctggcaactagcttcagcgctgaagattttttgtttgttaaagattggaaggaacctgtttggttttcttgccacgggacaagaaggcaaatagtgaagaaaacagtgtttaaaaggggaggggctctacttaggtgagaaggcatctgtgggagatgaggagggtgtgcaggggctcgggggcctggaggaaaggtggggtggtgcacagcgtgatggtggtggcacccactgtcagcagtggagaccagccctccaggtggtatggggaggtgactccagacagtgggcccctttcctgctctgctgtgggtctgatagatgcagatgaggcaggcgagatgctgggcctgtatgtccctgggaagggggcacagctgttgctgtggctgcctgctggcctggcacaggtcttgcaggtctcagagcttcctgagagctgtcctcctgcccatggcagggcaccatgtgtccacaggcccacagcataggcctgcctccagactcactggcttttttgaggcagagccccatgtttcgtgctgggtataaacagagctccaaaagacgcaggtgagaatgctggaggcttataaatggggtgagctgcactgctgctgtcttaggagggggagagcaccaggtgtgccttcattattctgcttcttggaaaggttgctttgtgtttccattgatcctggtcgggtaagcctcaaggaatcttggcagcccagactggaagggccgtgcaggggagagagtggggcctagggctggctgtgccatgccctgggcatggccagagcccacctggaaccttgcaaaagagaggcttggaggttagcagtccccaaccctcacgctctctgcggcaggggtacacggtttctgactgccttgtgcctggcttaggcaggagctgagtgggtgacagtttcccttgagctgagagaggtccccgggagccagtgcttcctaagtgttccctgcagccagctgctggcagtgccggccagtgccaatgctgcctgacggcgcctttctcctgggtgttgggtggactttgtaagtcttctgtttatctgagtgtgctgtcctaagggagagcttccctgcctgtttcccttgcccattcccctgtttgcattttaatccagtgtgccacaatccattactttgttattatgctgttgctctaactttaaatgccacccactaaccgtgatccagcaccctcttctggtgctcaggctggcacttactgctacccagggtttgtggcctgtgtgcttgcaggctccaaggagtggctcccgctaggcccagcacctggggtgactcccaggaggttggggagtcccgagtgaacacctggccacagtgaccaccagtacttggcggtccaggccctgtggttgatgatcctgtctgacgccatggtccccttgaggactgcacagcttgtcctctgatgtgatgttgtccagccccaccttttgtctccccaacaggctcttcagaggtgttcctgcccccagaccccatctttgcctcggccatgtctgagaacgacaacgtgttctgtgcccagcttcagtgcttccatttccccaccctgcggcaccacgacctccacagctggcacgccgagagctgctacgagaagtcttcatttctgtgtaaaagaagtaagcccccttgagctggcgttcttggggaatgtctgggcccttgtgtcactttgttggaccctgagttcaaggtttcggaggcagaacctgatttgcagtgttgcggtggacgccccttaccagctcacaccttgttcttggggcccatttgcagctctgtgaccagggcagctggtcagcatcttagagcccacggaagcatcttagagcccagcttcttttcccacggaagagacaatcatccctgtcctccctgttgcagtgttgttaagagagtaaatgggaatgaggacccaaggacttggcatctctggagcatctaaggctgtttgtcacctccccaccccccatttctgccatccttctctctgcttctctgcttctctgtttaccttgccagtctatggtgtgtgtgtttttttttttttattaaagccagctaactctattgcttttgggggacaggggtctcaggagctcttggtggggcaggtccccttcctcttcaccatcacaggcttctggcttcgcaggatggcgctggctctgggatggcagctgtgcgcaggttggggagaggctttgttcttgcggatcatgtgtgtgatgttgccgagcatggtgcaggcgttcttgttgacggtggtcctctttttctttttttttttgggacagagtctcgctctgttgcccaggctggagtgcagtggcgtgatctcggctcactgcaagctccgcctcccaggttgaagcgattctcctgcctcagcttcctgagtagctgggactacaggtgcctgccaccacgcccggctaattttttgtgtttttagtagaggcgggtttcacagtgttaggatggtgtcgatctcctgacctcgtgatccgcccacctcgccctcccaaagtggtgggattacaggtgtgagccaccgtgtccacccgacggtggtcccctcataggaggtggctggcttctgctggccggatctccactccatgaccaccaccacacctttgccatcagctgccgggtccacacccacagtcctgcagtgaatcagctcgttgtagtggaaggagctgcagcctttaagttctcaggctcagtgctgtgggtctgcttattccccttgatcaggccggatgattcctcgcgaccatccattgcagatgtgcggccggggcggcagctcctcccaggtggctggcaacagagagagcttcatgataaatcttgactgctggtgttacgacttcctctgccttgttcttgcctgttatgttgcctatttttgacccttttctatgtgaattttaggatatgttttctaaactcctttattggttctcttagtttgtggattttgttgattttctatttagatgggtttgtttcttctttcaaatctttgacatttatttatttatttacatttattagagatgtggtttcactatgttgcccagtcaactcttcttgctacagtctccaggacagtgatgattagaaatggtggtagtgagcattcttgtcttctcaacttagaatgctattttaatgtatcaatattctacagaatgccttctataggattttagaatgtacctgtatgaagtcaaagaagtacctattcctaggttgctgggaatatttgtgttacaaaagtgtactgatttttattaaatgcttttagtggattttattggggttatgtagtttttcttcagtctgttcagtcattatttcatataaatggattttcttatgttaaaccatcctcatggtttatatatatataatatattatattggtggatttggtttgctgatatttagaatttttgaaactctttgttgttttttgagacagagtcttgccccgtcacccaggctggagtgcagtgacgtgatttcagctcactgtaacctctgcctcccgggttcaggcagttctcttgtctcagcctcctgagtagctgggattacagacatgtgccaccacgcctggctaatttttgtatttttagtagagatggcgtttcaccatgttggtcaggctggtcttgaacgctggtcttgaactcctgacctcaagtgatccacctgcctcagcctcccaaagtgctgggattataggtgtgagccaccgtgcctggcctgaaactcttttaagaagtgaggttggcctgttacatttttttctatactctccttgactctctcttttttttttttttaaggtggggcatcactgtgttgcccaggcaagaatgcagtggctaatcacaggcacgatcatagcacagtacagtcttgaactcctaggctcaagtgagcctcctgcctcagcctcccaagtagctgggactacattgactcatttctgtattatactatattagttttctaaaatgagttggcaaacattttattttactgttctctaaatccatttgtccaagttggagataaacttgtctttgagtgtttgatagaaccaccttataggaccatctgggtcaggcgagggagacttctgtaacttgttaatttaggtataatttcaagcttatggaaaaggcagaataatacaaggaacttcctttcatacaccatttacacagactcaccagttacagtatttcagttttactgcatttgctttatcattcactttctctacatgtttcttctgaatcatttgggagtaaactgaagatactgtggaccttaattaagcgttttatacttcagtgtgtatttcctaagaacaaggacactttcttatgtacccacactatatggatcaaaatcagaacacttagcatggatacagtaccatacagtaatccacaatccattattccagttttatcagtcgttccaataatatcctttatagctatttttttcattgtccagaatcatgcattgcatctagtcatcatgtctcttggattcttttagtccttcagtttgagtaatttctgttgacctgtcctcaggtttactaattctttccttggctatgtcaagtctgcttatgagcccattgaaggtattcttcatctgtttcattgattttgtctgtttttttatttataggatttccatttgattcttatagattccatctctcatctgaatttcccatctaaccttgtatattgtccagcttttccactggagcctttaacaaattaatcgtagttattttaaattccctgtggggaagttccttcatctgtgtcatatttgagtctggttttttgattgttttgtctctggagcatggtacttttttctaggcttttcattggaactctgacatcttgtgtgggacaatagagactgagttcagtagttttgtgcttgcagtggctatgcctttacttccactaggcctttcttgtggggaggtctttagtacagtgcagggcgttgatctgggcgagagttgggctgggcttggggtttgttggcactgtagttgccctcagtgcacctcaggctttcgtatttagcagcattgttgttctgggtggaggctggtttgccagagggtttttcttaatgtctgctccaccctctacttgaggtcatccctttgggctacatctctagagtctgtcttttgcagcccgcctagcagtagtccactgtgtgactcaaggcttgttagcatgctgatagtagggtctgatgttctaactgtatctgagccttaagcaggcccagtgccctgaggatccagggtggagccttcacaagtgcttctgaccctcctgcagctggagttgggtccagcacagtggcttttcaccagggccctaaaggctccaggtatgctctgattagaggcagcctgactagaagcagggcagtggaggtgattggtttggggaacatatttgactttccctggtgggtttccagttggaagtatggactcaaaatagagaagctggtggccactggccagatcctgactgccctagactggttgctacagaagtggtaggtcagaggcctttggtcatatgtggtctggcctttgtcaggtatcatcatgaggcagaaatgttctataaatggaatcatatagttgcaaccttttggggttggcttttttcactcataattccctggagagtcatccaaattgttacttttattaatgatttgttccttttttttttctttttggcgacaaggtctctgtcaccctagagtacagtggtgtgatcactgctcactgcagcctcaacctcccaggctcaggtgaacctcccacctcagcctcccgagtaactgggaccacaggtgcatgccactgtgcccaacttatttttgtattttttttttttttgtagaggcgggatttcgctatgttgcccaagctggtctcaaactataggcctcaagtgttgaaggacatctgggctgtttccagtctttggctattacaatgaaaactgccgtgaacatccgcatacaggtttttgtgcaaacgtgttttctttttttcttttttcttttgtgtgtgtgtgtgtgtgtgtgtgtgagacagagtctttctctgttgcccaggctggagtgcagtggcacagtcttggctcactgcagcttccgcctcttgggttcaagcgattcgcatgtctcagcctcccgagtagctgggattacaggcatgtgccactacgcccagctaatttttgtctttttagtagagatgggtttcaccatgttgaccaggctggtcttgaactcccagtctcagatgatccacctgcatcggcctcccaaagtgctgggattacaggcatgagccaccacgcctggctgcaaatgtgttttcacttctgtgtgatagatgcccaggattacagttgcttgattgtatcgtagttgcaggtttagtttttaaagaaacaagcaaattgttttccagagtggctgtactattttatagtcccactatcaacgtaggagtgattcaacgtaggagtgatttaatttctccatatcctccccagcgcttactgttttcactatttttcatcttagcccttctgttaggtatgcagatatgtatgtagacctgtggctccttatggtttcaatttgcatttccctgaggctactgatgttaaaacctcttcatgtttcatgtgcttatttgccatctgtatattctctgttgttcacattattcttccgttttctctttgcatcgtttgttcgttttgttttgagaaagggtcttgctctgtcacccaggctcaaacgcagtggtgcaatcatagttcactgtaacctccagctcccgggctcaggcagtcctcccacttcagtctcctgagtagctggaactgtaggtgtgcaccgtcatgcctggctaagttttttattttctatagagataggatctcactatgttgcctaggctggcttcaaacgcaactcctaggctcaagtgatcctcctgtattgagattacaggtgtgaactaatgatctgttttgttcttttttaaactgtggagttttgagagttctttatgtattctagataccagtcctttgtcagatatgtggtttgcaaatattttttctagtctgtagcttgccttcatcctcttcaggtgagctttcaggaacaaaagttttgttgttgctgttttttcctggcagtataagtttacccaaagaacaaaagttcttaattttaatgaagtcctagttatttctctctcctttcgtggatttttttttttttttttttttttttgtgacagaatttcactctgttgcccaggctggagtgaagtggtgcaatcttggctcactgcaacctccacctcctgggttcaagtgattcttgtgcctcaccttcccaagtagctgggattaccaacatgagccaccacgcctggctaatttttctatttttagtagagacagggtttcacagtgttggccaggctggtctcaaactcctgacctcaggtgatccacctacctcggcctcacaaagtgctgggattacaggtgcgagccactgaaaccagcttccttttatggattattcttttggtgtcaagtccaagtactctttgcctagccttacatttcttctgtgtttttttcctaaaattttaatcattttccgttttacatttaagtctaggacatgtttcgaatgagtgttttaataagatgtgagacttaggtgaagttctttagtccagtatagctttgctcccacacaccacctttgtgccattcttggcaaatctaagtgtgttatatttttgtatgtcatagacccaatactacattccatacatattattttatacaattgctttttaaatcagctaagagaataaaggaggaaaactatgcatgtaggctataatttataatcacgattgcctttactgttgctcttcagtttcttatttgtattcaaattactatctggggattgcatacttttggcctgaaaaacttcctttagtgtttcttataaggtggatctgcaaacaacttctctcacttgttgtttgtctgggaaagtttattttactttcatttttcagaagatatctttgctggatatggatcttggttgatggttttctgtgagcagttatcccactgccccagcctctgttgtttctgctgagaagtcagttgtttgtcttattggggttcccttagaagtaacaagtcacgtcccatttgctgcttttcgtattttcgccttgtctttcactttcagcattttcactctgatgtgtcagtttgtggctcctttgcatttatcctaggaatgtggaatttgttgagcttcctggatgtataggttattgtttttcaatgaatttgagtagtttgcagctgttagttcttcgactaatttttttttgcctctttctctctctcctctccatttgttactcctgtttcacatatgttggtgtacttaatggtgtttcacatttctctgggagctctgttcatttctgttcattcttttttctctattttagccagggaataattgtatgtgagtatcttgccctgggagttcctgaccacatgggtgacctagatttgatcccaatctttttttttttttttttttgagacagagtctcatgctgtcgcccaggctggagtgcagtggcacaatctctgctcactgcaacctacacctctggggttcaagagattctcatgcctcagcctcctgagtagctgggattacaggcacatgccaccacgcttggctaatttttgtatttttagtggagacagggttttgccatgttggccaggctggtcttgaactcctgacctcaggcaatctgcctgcctcggcctcccaaagtgctgggattacaggtgtgagccaccgcgcccagctgactacaatcttaagtgaggcatagacctgtgattgtgaaatttcggaagagtcttttttctagacatccttaccccatttggagactgtaagaagctaccttctcatgtctctttgcctttcactgagggtggctctcttggaggctccttcattccttgtctctcctccaggcatttgcaacgtctgcctaccagttgaagactctgggtttttagccatggccattcctcttactctcatcctaggtcagctctgtgcagagtgtgcctcaggtccagtggactgccttcccaagcagaactggcagcttccttacacacattctgattttgaaatggttaatactcatagcagctgcatcttagaattgagaaaatctcataagtaatctacttcagcaacttccaggcaaacacttctgcagtgaccctggagtctggcattgtgctccatcctggctctccggcctccatttgccctggctagatgtactttgttctaacagtgttgtagtgactgctcttggacagccactccctgtgccatgggccagagatccatggcattccagccctgggaagactctcagcacaatctggccaagtcttcagttgccttgttcgttccccaggcccaggtggggaaggtcagctcatgtcaagtggtgcagcagtgatggcagtgtttgctcacagagctgtcttagaggctttgatgccattactctagtgggcatgtctcacatgccccctccagctgcctccttcccattctaaggtaacaggtagcattcacaggcccacacggggaggctaccttttttggcagtgtggcccacacggggaggctaccttttttggcattgtatacatctgtacacaatgtatgctcattgcaggtcaaacatgtgttgacatcaaggacaacgtggtggatgaagggttctacttcacccctaagggggacgacccatgcctgagctgcacctgccatggaggggagcctgagatgtgtgtggctgctctctgtgagaggccccagggctgccaacagtaccgcaaggaccccaaagagtgctgcaagttcatgtgtctggacccaggtgagactcttgataggacgtcccaagtcagcctccctatttggggctggaggctgggcgtccctttgcttcctcagtggtgaggactcaggagagtttatggagcatcgcgcagcagcaatggcagcgtttgtcacagagatgtctcagagactttgatgccactactctagtgggcgtgtctgacacgacccctccagctgcctccttcccattctggggtgacaggcagcattcacaaatgaacttgaactcaagtgtggctgtttgttcacaagtcaccactgacagcttcaaacttgtcttcaaacttacgcctccagggtttaagccgttctcctgcctcagcctcaccagtagctggaactacaggcgcatgccaccatgcctggctagtttttgtatttttagtagagacggggtttcgccatgttgtccagaccaggtcttcaactcctggcctcgagtgatccacccacctcagcttcccaaagtgctgggattacaggcatgagccaccgcgtccagcctagacttctaatttatgtccacattggagctcttcctgttctctagtatgatgatatggagggtagtgacagttgtcattgcttacagtcatccatttttaccttagaatcttcgagaaaaagatgaagtattattctcagtttcgagatcagactcctcaccaccaggcgggggctttaaggtagacactacagggaatctgatctcagggtgatcctctcccttccacttgcaaaaagagaggagcaggtgggccactgctctctgagatgttaacacccctcacactccacgggcatgctttgtcattctgcacaccggtgtagctgcagctctgtgtgaattcagatctcaagagaaatgtaaatcaaaagtatgagtttctttctttcttgggtgccacagtaggaatgaaatgatggggacttttggaagcccctggacttgtggcccctgtagaagagcagcttgggcagggtgtgatggccatctctgtctctaggggccctgtggaggagaggctgcagctagaggctgggccacaacagtgaaagctgcccctgagtggaatgttgtcagtgtccctccacactggggggctgctgggtgggaggacaaagctgtcctccagaggctgtgcctgaggctgggtgaaagtgggcactgtggcatgtaccatcagacatgtgcagttgactgtggtgagcacaaggctacatttgcagccaagcccaccagaggacccagagctagagggtgatgcttggaccccattctgcagggcagtttctcctcgtatagggtgcatgtctgtttagggccatgagaagcactggttgagtgcttatcaagttccctgtgcccggccacataactttaaacccccagcttagtgactggctacaagagtcaaactctgttcacaagccatgctacctggactcctggttccatttctcaggagtctaccagtgctgccttgccactctgtccaagctttgtaagaatgcccagatgtgtacaaggatgacccatttgtgggcatgtatggcctaaagagcctgcccagccccaaggacttcttagcagagcagggcccttagtgcatctgggtgggcccagagcagctgcagccctctctcctgcacggccagagcgacttagctgggccctgctctgcctgccctgtggccatgcttccatgggctcctgactctcctagggccttcttctggaaagtgctcaagaaccgagacactatcaccaaaactggagactctgggaataggatgtcatgtgttaagcatcagaatgtcccctccaacaagctaagagtgtctactcttgccaccctgtcatcattgtgcttgaggtcaaagccagtgccagaaggcaagaagaaatgaaaaaccatccaggccagaggggaagaaatgaaaccatctccctttgcagatcacatgattgcatagaaaatcctagggaatctacaggaaagttattagaactaataagtgtgtttaagcaaggtctccagatataaggtcaacgtaacaaaaattcatcatatttatataatctatctgtaacagttgaaaattgaaaattttgagaaaagtgccattaataatagcaccaaaaaaaatgaaatacccaattataaataatataaaatatgtgcacattctgtttgctgcaaactgtaaaaccatgatgacaaaaaggcttaaataaaaggaaagataccatgttcatggatcaggtgtctcaatatcattaggaggttagctcttcccaaattatagattcagtataatcccaaccaaaattctagcagacatttttgtaggtattgacaagctaattctaaaaatcaggtggagcgaggcatggtgtctcgcacctgtaatcccagcactttgggaggctggggagggtggatcacttgagatcaggagtttgtgaccagtatggccaacatggtgaagccccatctctacaaaaaatacaaaaaattagttgggtatggtggcttatgcctataataccagctactcaggaggctgaggcaggagaatcacttcaacctgggaggtaaaggttacagtgagctgagatcacgccactgtactccagcctgggtgacagagcgagactccatctcaaaaagtaaaaataaaatagggctgggttcagcggctcatgcctgtaattgtagtactttgggagtctgaggcaagaggattgcttgaggccaggagttcaagaccaacctggctaacatagcaagaccctgtctcttaaataaaaaggtagataaaagttggtggaaaggcaaaataattaaaatagccaaagtagtttttacaaagaacaaagttggaggatccatgccacctaatgtatgagttactgtacagccatagtaatcacaacagtgtggtatcgatgaaggggcagacacatagatcagtggaacacaacagtccagaaatagtcccacactacgtataatcaggtgatctctctgtttttgtttgtttaagacgagtcaagtgcagtcgtgagaacgggaaaagagtacaacaaggagtttgatctgttactgactgtgaacaatcaatcgagatgactcactaccttcagaccagcctaatctttgacaaaggtgcaagagcagttcagtggagaaaggatagtctttcaaccactggtgctgggacagcaggacatccatatgccaaaaaatacgaaccttacactgtccctcctactgtatgtaaaatttactcaaaatggtcatagacacaactgtaaaaccttgaattataaagcttctaggagaaaacataggagagaaatctttgtgaccatgggttaggcaacatttttagcatgatccttaaaaaaaacagacaaatttggcttcatcaaaattgaaaacttctgttctttggaacacactgttaaggaaatgaaaaaataagcccctgactgaatcaaaacaagtatttgcaaaacacagatcaaaggtctgtattcagaatacataaaaactcaataataagaaaacaaaacaatgctattgaaaaatggctttagaagaagatgtaaattattaaactttatcaaagaagatataggatgacagtcaggcagctgaaacgatgctcagtattggccattagggaaacaaactaaatccacgtggggtaccacccctgctcgaaaggctaaagtaatgaaactgatagcatcaagtgctggccaaggtgcagagcagctgaaactcatgccgccctctgcccctgcttgctctgctgctgtcgggcagccctgatacgatgaggttcccagaggcatggtgaggtgtttggctggtgcagctgccaggcacagagcccacattgggttcctggtctcagcttctgatccctgctgaccttctgctccccatggtgtctctgatggagattttgaaactgttaccacttaaccaagctcaatgaaatggtgagctccttgtcactggagctcttcttgcacaggctggatcctctctctgggagctgcaggatagctgagagacaaaagacaaccccaactgcacagcccagaactccatggagagatcagccctatcaaggggcctctggggcccctgggctggcctctggcttctggggcaggctctcttctttgtgcttgactacaagtggcttggttctgagagatgattatttccggtccccaccttggagggacagttgggaccttgaccgtgtccttgggtttattttagaacggattaagagttagtcattgcaaaggggctgctttcttaggagctcccctgggatctctgaactggcctccaatgaacaggcacgtcaccagtccctgggccactaggctttctcccactgatgacagtgcccttgagactggaggagggtcagaggcatcaggaaaagcagctaattggtgagaggatgtatccttctcacatattcacttcatgtgtcgtcagcaaaaaatgcagcttttggagatgcttcctggccccgtgggaggaggacaggagctggcgctgccatctgtgtgggcatggagtgtactgggctagcaggaatggcttgagggctctgggaacccagccactcacacgggggttgtgaagtgtctccttggggcaggcagtaggggtcctgcctgccgagattgttgcagaggtgggagtggccattcctagcttagcagggtccctgctggtgtggggtcctcctgcttccaggagctgatgggtcactcctcgttttgaagcctccctggccttcactcttggtctgtggaggaagctacttctgggaccacttcctggttccattattctgtgacttctgtgagttgccagtttacccaagtcaggagtgcatggaactgccagccatgttatagatgtgtggctggtagattctcctttcatgcctgctaccactcatgtcatctctgcctccccatgggcagctcatatcgagcccctgtccccagtgtgcactgcaccagggcagggtgtgtccctcttggcggtgttgacatttggaccagatactgtgtgttgggggctgtcctggaggatgttgaacagcaccccggcctccacctgctgaatactagtagcatcccagccaagtggtggtcacgaaaagcgtgaaatggttgaagaagagcagaggaaggcgcagcagcttagactcagtgctccttggcgtctagcctggctgggactcagcttcaagcttcatggcccctcctgcctactcacccagcaaagaggtggagtcgggtccacccagccctcctacacctgcgcttggtgcgtgtgtacccaatgtgtgggtgtggctgagccgggagagcatctcagtggggagcctgtgagacccagtgttgtgtccaggtgtcatctgcacgtgtatgccagggctgggtgcgtcaggggatgcgcattttctctgccatggcttgttaaggattggagtgacaggcttcacgcccaaccacagcagaggcacatttgtgaaatgatacctgagttgaccgtgcggctgcccacaggggctcactgttcccctacacagtccatcagggagttgtggcaatccgagtcccaagtgtaccttatactgtcacttctcccagtctgtcactacccggtccaggcctctgtcattcccttctctgctgcggcaggtcctcctcctggcttcctgatgccctatgctactcccttgcagcctgtcctccctacggcagccgcccgagccatgctccgcaggggcgtcacccccactccaaactgccagcaactgtcatccatgagacccctgcctacctggccaaccctggcctcctaccaggaaagggctgtccctcaccgccccctggctcattcttgctgggcaactgagcaccttcctcccaagagcccaggcctcagacaaaaggaaggctgctgttggacggacgtgggaggcctgtgtgcagccctggcccctggaaaaggatgtgcacctctgcaggagggccgctccccagccacacctggggtacacagcacatgagcgcagcctcctaggagtgctagtcctaggacaggaaatcctagtttgctccggtgatggtcagaggggtgttggcacacagcagcctggggccatggtgagatgctcctcctgacctgggattcgctcttctgcttctgtgctgtcaccatgttcttgattttgagcggccttatttcacatgtatcctaaagatggttgggtgcagggagacactgtgtgccttgtccacacagcccgcctgggcaggaggacgacagcatccccagcgtagcacgagggtggcccccttctcagagcggccatttcctcccctccccctcagatggcaacagtctgtttgactccatggccagcgggatgcgcctggtcgtcagctgcatctcctccttcctcatcctgtcactgctgctcttcatggtccaccggctgcgccagcggcgccgggagcgcatcgagtccctgattggagcaaactgtaagtgccctctgagggccacaaccctggtccccatccccaccccaggtcaccccatgtctccatgagctccccagccctggacagagaggggcagaggcaggtttgaaggccacatgttgtggggtctgtgtcctcacctgtgggccaggaaagttcttgccaagaccctccttattcccattgagccacagggtgggcagaactcggaggcctctgagggtcagaggcccggatcacccttccagctggaggggtgtggtcagccagaggctgggtctgacagaagtgtcagcccagagggacaggttggtgtggtgagggtgagacatgccacggagcacaccaggggtctcatggggatgccgaatgtggccgaggggtaggcagcggggcacaggtgtgtgcactcagggacggcaggcccagcctgggggtggggggctcaggagccaggcagcctgcccccagtgacttgtctctgttcccgttgcacacttttgatggcccagtgcaccacttcaacctcggccgcaggatccctggctttgattacggcccagacgggtttggcacgggcctcacgccgctgcatctttctgacgacggagagggtgggactttccatttccacgaccctccacctccctacacggcatacaagtacccggacatcggccagcccgacgaccctccgccgccctacgaggcctccatccacccggacagtgtgttctatgaccctgcaggtgcctgactccccagggagagggaacaccttgtcaagtaacctggcacgtggggctgagcccagcactcttgcccagctgcagaggcctagggacctcacttctttccggctttgtctttggtttttcctttaaggcttctcctggggctgcccgtgcagaaggggtcctgatctccctgcctggccgcccttggcaatctgtgcagagagctctgagaaggcctgggacccctccctcctacctccctgccttctgtgagcacctgtcatctgggcagccctcagggccctcagcccagctctagagacctggggagcccgacagtggtggttgtgaagacagggctggcccagacccaggagccaatcacttgtctgtagacacatgagctagagacaccatggtgacagcccctcctgtcgtgtcaggaggcagctctgtgaggtgggaggaaagcgtggcttctgtgctactggcccatagttggagcctaccacccatctgagagtgggcgccattcctcaaggctgtgtagctaaggagtggcaggcccctgacccctggcctgtctctgtctctgttgagcagtgcaggtgtcccatcccatctccctgtgcattaggccccctaacacacacaaacctgtagtatatttggtaggcagtgccaccccaaagtggctggctccttgcatgcctgcccatctcggcagaatgggcattgtgaggctggggctgctgtgcctaaaggtctcagtcctgttcgtttgtttagtcagctgccacagctcttgcatgatctgggggtgcagaaaagacttgcatttgacccctgccctcatgacacagattgtcacagtcttccagggtaggaccagcttcctgcaagggatggtggtgggtggcagcagatcccagacacctgtgtgggccaggctgcagagcagggtgggggctgtgaggggctggccgggagggaggtgcatcaccggggccttgtgctgttagctttcagagacagcctatggtaatgacaagcaggcagcccaggcgcagtggctcacacctgtaatccagcactctgggaggctgaggcgggaggaggggtctcactatgttgcccaggttggttcgagaccagcctgtgagacctccttctccacaaaaaattcagaactagccgtgcatagtgggcacagctgtagtcccagttactgggcaggctgagaatggaggatcacctgagcccagaattcaaggctgtcatgagccatggtcacgtcactgcacaccagtgtgcaatcttttaagatcctgtctcttaaaagaaaaaaaaagcaagtaataaagatcgggcaaaacaaagcgagtcgactgcctaccacacagcctgccttggatcagagcttcctgcaaacacctgtgtggttttccaggccgctcactgcagccctgttgcccacactccggttgccacattccagctgcagccctgaatgttcttccacccacctgggcccagtgcctccctgatgacaaatgcccctgccttcttgctgagccgggtcttcaccttactgagtctgagacggtttccctttgggcccctctgttctagtgactgctggtcagtgtgtctcccctacctcacaccgatggtgggacaggcccgtgtctgcctttgtgagatgggccctgcaccttgcatataccaggttcccagccacagggggcagtaggtacaacaggtgtcatgtggggcaggctcctccttcaaaatctgaggcccgggggagccacccaggtcctgctcaccacccagcttcaggggggccttcaggcaggaggagtgtctcctggttttgcctagctcccctgcatcccctgtgccaggcccgtacctgcctctgacacccctctgtctcttcctgcagacgatgatgcttttgagcctgtggaggtcagcctgccagcccctggggatggtgggagtgaaggtgcattactccggcgcctggagcagcctctgcccactgcgggggcctctctggcagacctggaagactctgccgacagcagcagcgccctgctcgtgccccctgaccctgcccagagcgggagcaccccagctgcagaggcactgccagggggtggccgccacagccgcagctccctcaatactgtggtgtagacggcctggcctgtaccccaacggtctgggagcacctgtctgttgtagaaaacaccggtccctggggagacttgaaaggcccctgtcccagcctggacgccacgcactgccgcacgtcactggcgggctcgcgtgtgtacatagagaccacagcccgccttctgccaaaagaagtgatggcctgcaccgagcttccttgagggcttcagaaacatgcatagctttggatcactgtcttctcctttataaatggcagaagagtgacaaaattcattcagaccgcacatgttagaggcagggaatgaagaaggtactgtgggccatggccacacctgatgcgtttttggtgggcttacttggtgcagtgtgctgtccagagagacctgctgacccagtctgggacaggcacagtgggagctgccacagtgccccttgctggccgccctcaggagggggcctctggaccgtcagtgtggcgtaggcagtgggtctgcttcagggaggcagcctcttgactttgtcacaacggttgcactgaagatggcccccacaagcccagttgtgaatatcaaggtgaccctgcccctggctgggagctcccctggggctctggaacctgaagccctgagaaggagagcttggaaggaggttgagctcttcactgtgtctttccatctgggctctgcagcccagctctgtggcaggaggcctgaccccaccccatcagtccctctcccagcattgctgtgcatggctccctcaggaagaagctctggagtggggccgaggccccagatgctctgctggggtctggggactgagctgcctcctgtctctccactctggagccctgggctcttgcctcctgttgaattgcccctgggcctgcccccggccccatttgtgccataaagggttgcttcattgcaggaggggtggctgaaaccaccatcctgggctgcatctatctccttaaagtccactccttacatcaccgccactactgcagctcagtgcccagcggccgcatgcacacctcccggcccctcctcagcagcgcaggggctgggggcccttcctggcacccttttgcctgacggaccctgttgcctgctcctgggcagtggttttgttgcctgacacagggcctttaacatttctgaggtttggagattaagcgggttctgtgcgatttttagcacatccatatcttttctacgttgaatgtctggatctttcctttgtatgtttgtgtctctgtgtgtgtatgtggccaagcgtctgcaggtgagggtggcacatggaacttcacgggtcactgggggcccactcttccagggtcatcgatgcatcctgggctgtgctgaggcagtgctgtctcgctcagtctttccagaccagcggggcagcacctgggaggcctgtctgaagcatgcagttctgtggtgctgctcggggatggactccatgcacagtccacttcttgacacattctcacactgtggctggagacccattttttccatcccatgtggaatgagaatcttgagttgcccacagacagacttgacctttgtgccagaactgtccagagctgtgagttttgttactgaattgcctgtccctgagcttggcctgctggagcatgatgctggaggctgtgtgcgggcaggcttgtgctccccttggagaagggctgctacttaacaaggaagtcctggccacaggagtcccctactggctgcagaggacgaagcaggaagcatgccgtggatcccacatgcactggggcagggcagccaggttccagagcagcaggcatgtgcattatgggtgccaggtggccagtgagggcccgaggaccacgcagcagagtcccccacgggcctgagcctgagagctcagaggattcctgccaggcctcagaactgtgtgtgcgggacagggtggctggcacgagatgtgtgggactgggacgcttcctttggggaccagaggaacattaggggccggtcagacacgtagggggcagtgaggaaacggggtaaagtggaccatgcaggctgcagagggtgggccttgggctggccggggttgctgggtggccccttccccatgggcctccacaagcactcaggccactggcacgttgggccaggcagaaggtccacatggcagggctgcctggaacaccgctgccactgtggctccaggaggcccttgggagcatgaggagagctggactcgctcatctgttcttgcaccaccatccagaatgccccctttgcaaggcctgctgcagtccccagtctgaccagcaagtcccggggtcacccttgctgaaccttgtgctccaggggtcctcctcctctaggaccagcttgccacggtttctcagagcccaggtgccctctgacctgccatgcggaggtgggatttgatactgtacattgtcttgatgcctgtttttttatgttttcattaagggtttttagtttttggttgggttgacactaacttttcttaagatgctgtgagaatcatttcatccaaatgccaaataaacttgtgttccggaagaggcatggttagtccttggtgtggcccccacggctgccacaggctaaggtggaagaggctgggtacccacctttcagcagaatgcacctagggtttgcagcccttgcaggcgtccatcaaaccccctgaggaccaggcagagctgagcctggagcccctaggtggagtgtgcagggagagcagcagccctgagctgcctacagctatcctgcagcacccagccctgcttggggcatcggctgctgccttggcaggtgttgctgacgtgcacaggatccacataaaggcaaggctgcttgacaccatctgggagctagcatgggacggggtggtagggcagggcttggaacctggccgtcagcgccatttcctctaagctcccctcatcatccgggtggctggaaacagcccctccctccagtccaagccacctaatgttacaaagtagcctaggtcctctggggcctcttcactcatgtccagcagtgccatctctaggtctcagagggtagtgggcccaggaagtgtgattgcatgccctgctctgggggcactccagatgtgtatactggggggacgtcctgcggccggacacgagaggagtcagggttaggaaaggaactggtaagtcccttggcagggatgggagcctcgaggatgtggcccctcattttttatcccatctgctggggcaggagtggagtggtggtgttgagtcccgagcacacaggtcactgtcagcactctggacagagccccgagccctgcctctgggtaggggctgtcttcccatccccaatgtgggtagggccctgccctctggcgattggaaagaggcgcagggtgcaaagaagtcccctcctctgacctcctgcagggctccgtcttggcctggatccgcaggggggcctgggtaggagggaggctgtggtcttgggatggggtggcagttccgggcccacagtggggcaagagacatcctacaccttcctcccatccttgccccgaaagtcatgggcactggggtccaaggtgccctcactatttgacctttcttgctggtggctttggtgtgtcattctggtccccagcctctgtttcctggactgtaagtggggataataataggtcacccctcccctgcaggattaacctcagcgattgttgctggcatcagtgcagccctgggaccagagcacacctgggtgagtttggagcgctcgcgctcttcctggtggccctgcctgggcaccgacccctcccatcctctcctcaatagccacgcccctagcccagctagctaatgaataaatatgtagtagccaggccagcatcctggctccgcggtctagccactttctagtccttcctagctgcggctgccactgagccacgcacgcccctggcatcatgctcgccttgcggtgcagctggtgtggtgcagactctgagagtgagcaccaggactcttcccgtctggtctccaatctaccctcttgccatgctccaccaccccttaggtcttgccactgggagtggggagggactggggagagaaaatactggggtaggggtgacaggagagaaggttcttcactggcctcccctggcctaagcccctggcctacttcattcttggaccccagctgatgggatggggcttggagaggacccagatgactggtctctcagctcagcctcctgcccactgtctctataggtgcctggtgctacgactcccaggaccccaagtgtggtgaggacagagtgtcatgtgaggctgagtgagatcagtctgtgtcctgggaccaccagagcatgtgccagtggtgcaagagtggccaagagacagtctgcaccctgcactctgtggcctttgcaggtttctgtctgtagtcgtctgccccagtagactgactgggcatcaggtgcaagtgcgtgactgtccccctgtgtgtgagtctgggcctgctgtgatcgccggtcccgagtcagtcaa

SEQ ID NO: 17384 - DNA, 14634 bp, Human
atccgccggcctaggccttccaaagtgctgggattataggcatgagccactgtgcctggcctgccccttcaattcagaatgaagacaaaccacctcaccataccctacaaggccctgtgcagcctggccctgcctctctggcatcatctcacacctcactgcactctgcatttccaaaggacttctttagaacttgccttgctccctcccaccactaggcctttgcacatgctctttccacctgactgttgccggtttgttcgtcttttgaatctgcaatcactttctgcctggggaagcttctctgacctcccgaactaggtcaagattccccaagtacaaactcttttcttgcacggacacagctgcaattttacacctgtttgtgtgatgatctaacaagtgtctctgtcttccccattgcactgtcacttctacaagggcagcagcagcacgctgcacttcagtgaatgaaggtatccctgtatgttgcaaaagcaaaattgtattaaattgttccagggcggaatttatttgtccaacacaattcacatctttcgtttgggaagaaattccttaaaaatgccgaggcaattttctggttcacttgaatattaatttttttttttcttgacagagtttcactctgtcacccaggctgtagtgcagtggcacaatctctgctcactgcagtttccacctcctgggtttgagtgattttcctgcctcagcctcccaagtagctgggactacaggcacctaccaccactttgtatttttttttttttttagtagagttggggtttcaccatgttggccaggctggtctcaatctcctgacttcaagtgatccacctgcctgggtctcccaaagtgctgaggttacaggcgtgagccaccgtgcctggtcttgaatgagaatgatccctcttctgggaagcccactctggcatttgggggcccaataatcttttttttttttttgacagagttttgctcttgttacccaggctggagtgcaatggtgcaatctcagctcactgcaacctccgcctcctgggttcaagcaattctccagcctcagccttccgagtagctgggattacaggcgtccaccaccatgcccagctaatttttttgtgtgtttttagtagagatggggtttcatcttgttggccaggctggtctagaactcctgacctcaggtgatccgcctgtcttggcctctcaaagttctgggattacagaataatctttagacatttcttaatcgaaccactgtcttgttctttcaccttttgttagataactataaaaaaaaaaaaaagattgttttggccgggtgcggtggctcacgcctgtaatccagagaccagcctgaccaacatagagaaaccctgtctctactaaaaatgcaaaattagccgggcgtggtggcccatgcctgtaatcccagctactcgggaggctgaggcaggagaatcccttgaacccgggaactccggtgagccgagatcatgccattgcactccagcctgggcaacaagaccgaaactccgtctcaaaaaaaaaattgttttaaggcccttttcttgcataaagcttgaaactcctatataagtaaatttcctggtttgtatttttgtagaataatctcgaagcatacatagttcttatttgtgggaaattagaattctaaggcctttggacgctgcaaagccagaatttctcgcgtgaagaacacgccctatagcatcctccccgccacctccacagcaccccctcgtgttcacagcattgacaagcatgaatagcgcggggcaggacaaggactacatttccaataaagtctagcatttatagtgacgtcagaacggagcgcgggctggctttctagagccacagcttttccattggccaactattggaggcgcctgcgcaaatggtgcagtcccgccccctccaccctgtgacgcgcctgctgggcccgagctttttcctgggatagcgatggagacgccgggcgcatcagcgtcgtccttgttgcttcccgccgcgtccaggcccccgaggaagcgcgaggcgggagaggctggggctgcgacgagcaagcagcgggtcctggacgaggaagagtatatcgaggtacgacctcggtgcggacgccggcgacttctgggcccatcctctgcttcaagctcctctcaggttccctctctcgggtgttgacactccgtctcctcgtggaagtggaggagccgggtgtggacggtcccacgagtcaagtaaacagggcagaggaagacgtctgtggtggaagaggctgtagtagtgttgtcagggaaaagagagagcggctctctttgtatgggacgggggtcagggaaagaagattttctgttaaagtgtgagtaggagtttgacaaactggaaggatggtggcaaagagggctttctaaagagcggtggcagcaagtgtgaatgctggggttcctggaaagagaccgcagttgtgacagcatctcgagtgagtggacctgcgtcgccccaccacacgcacacagaaggaggagctgaaacggggattggcggaagtcagtttggttttagacctgtttaattcgggacaccttttgggatatgtagatggatggctttaacggacggttgggtgcccagatatgcagctcgggagcaaggtctggctggaggtgcagacttgggaatctcaacttgtggtagtgactggctgaagttactcaggaaaaaggtttatttttattttattttttgagacggagtctcgctcgtcgtccaggctggagtgcagtggcgcgatctcggcttactgtaaccaacctctgcctcctgggttcaagccattctcctgcctcagcctgccgagtagctgtgactacaggtgcccgccaccacgcccggctaatttttgtatttttagtagtggtggggtttcaccatgttggccaggctggtctcgaactcctgacctcaggtgatccgcccgccttggcctctcaaagtgctgggattacaggcgtgagctaccatgccccgccaggagaaaggtttagattggaaatagaaagtcatgtgtggaatgaaagtgacaacacccacattggtctggcttgtggggagccagcaatggagaatgagaatgaccagttagcaagggcgagagagaagggtttcacggacttcagaagagtgtttagtaatgttagaggttgcagcatggctaccatatgggatgctcaaccccactagaaagtgccctcaagctccctcaatccagccccagtcattggggaagtagaatttgaaggaggttcagcaagttccttagcatgtacagcagtggacctgtgaggcaggagcacccagactgcagctccgactttcttttttctttttttttttttttttttgagacggtctcgctctgtcgcccaggctggagtgcaggggtgtgatcttggctcactgcaacctccgcctcccgagtttaagcgattcttctgcttcagcctcccacgtagctggaattacaggtgcctgccaccacgcccggctaatttttgtatttctagtagagactgggtttcaccatgttggccaggctggtcttgaacttctgacctcatgatccacctcccttggcctcccaaagtgttgggattacaggtgtgagccaccgcgcctggcctctgactttcattctgatctctccttgcagggcctccagacggtcatccaaagggatttctttcctgatgtggagaagctccaggcacagaaggagtacctggaagccgaggagaatggagacttggaacggatgcgccagattgccatcaagtttggctctgccttgggcaagatgtcccgggagcccccgccaccctgtatgaggaccctgtgggtggcggagaggggaaagcctgctgaactgtcgcttcaggctcactctaattcttatccccctctcttcccctagatgtgactccagccacatttgaaacccctgaggtgcatgcaggcactggagtggtgggcaacaagcccaggccccgcggccgaggcctggaggatggtgagtgagggtgccctctttaagtcacatggtcaggattgcctgggaatcttagcctgtgaggccctgagggggtggtccagagggctgcaggccacatcttgttcctgaggggtcttgcgtaaatagcagcctgtgaagtcaaaggacattggtctaggtggtagaacatctgggtccagctcccacacatggctcgcctctgtgaaatgggactctcaccagctcttgctggcttttctgctgtgttccagccctgccctgtgggcttcatggatgttggaaggccccttttgttactatcctgaagatgcctcagggcctctccatttgtttccttcatgttggtcacttcccagataactgcatggctcactgtgtttcttcctgtagatctctgcataggtgttacctgttcagagaaacttttcttgacctgccagtgtgaagtcacaacaccactggtgctctgtggcttccagcctggctttggtttttcatcacaagacattttattttattttatttcattttattttttattttttgacacagagtctcgctctgtcacccaggctggagtaaaatggtgtgatcccggctcactgcaacctccacctcccaggttcaagcaattctccctgccttagcctcccaaatagctgggattacaggcgcctgccaccactcctggctaatttttgtattttgtagtagagacgaggttttgccatgttgtcccggctagtcttgaactcctgacctcaggtgatctgtctgcctcggccccccaaagtgctggtattacaggtgtgagccaccgcgcctggccaagacataacgttttaaaggcatttctgtttatggtctctttccctaattggcatcccttgcacaagagcagaagctttgttttgctttcatctgtatgctccgtgttgggaacagcacatgtggtgttgtgggccttgcacagatacacatggaacagatgaaagagttgtcatcttcagcatgtttgctgggacacacagctctatatggtaacatcgtgacttgatgggggagtcggtttaggaaagggcactccgagtcctgttgaatgcaagtgttctgcacgccatgggacttctgcgttgtcaggccctcttttcatcagtagtagaatgtcagtgcatgtatagacaaacgagacactctttcttatcagtttgtagactccactgtgctggagtagcacagatgtgttgtgtgtttgcacaaacatgcaaacatgatactttttgctttacaatccagctttttcggccattaacacagtccttgttgtccttgaagcttgattatctgttgaaatgtagcttgtgcatcacagggcaatttgtagatttttttcttctccttttttttttttttcctatagagatgaggtttcattatgttgcccaggctggttttaaacttctgagctcaagtgatcctcccaccttggcctcccgaagtgctaggattacaagtgtgagccatcatgcctagccagtttgcagattttcaatacctgtacacctacatgccagtaaatataggaatccttttcagaacctaagtggtaggaaccatcatcatgtttacaggtgaggaaactgaggctcagaaaggcagtcacttctgcaggtctcagagatggtcagggtttcacttcttatctctctgagatgaatagagtttctgacccctgtcctcatcccgtgggtcttgagcttgtagccactgtgccttgtgcatagcctcacgtgtagcaggtggtcaggactgtcactagacttgaaggcagagctctccaggtggccccaccgaagtttgcaccaccacacgcagcaccagggcaccacctcagtgggagtaccactttccatggtggcagggttggtcggaggggggggtgtttggggttgtggcttagcacctgtgaggccccatccagaggactaagtcatatgagatccctggaattggggctcgctctcaggtcaggatgattaggcgatgaccacccacctgtagtacaggtaccaggaagagaagagtgggtaaggtaaggaaatcctagggagtgagggagagccccagggatttggaggcctggcacccacaggcctggcaccactttggtgggggaggagcctgcctgtgatcacgagctcttgctctaacacctgtattgctttctccagtctgaatcagaccacgtaattcccttggcatccagcacatgagcagagctggccctgaatctgtagggtaccacctgagggctctctgggcagtcagggtgggtggattctgcccccgtggggagtccttggcagtgtgggctttcatgggcagaagccaggaccaggggagaggattccagccctgcatgttgggggctatgattcctgggcctgggtgtcctcctctttcctgactgcaaagggtgctgtgttcctcctcccgcaacccctaagcaggagaggctggagaggaggaggagaaggagccgctgcccagcctagatgtcttcctgagccgctacacgagtgaggacaatgcctccttccaggagatcatggaggtggccaaggagagaagccgggcacgccacgcttggctctaccaggctgaggaagagtttgagaaggtgtctctggggtctggggtgtcacataggcgtaggcaccctctgtggtggttggggagccccagggccatgggtacaatgcccaggggcatctctgaccatcacttttccccatgtgattgcagaggcagaaagataatctcgaactcccgtcagcagagcaccaggccatcgagagcagccaggccagtgtggagacctggaagtacaaggccaagaattccctcatgtactatccagagggtaagtggcgggcctcgcagccaaatggggaggtgttgggtagagctgtgtgtgtctggctgtgtttggagcagccttccaggtgtgtatggccgtgcccccttgcagtttgggcttctgatgggtactggtctgtctaagggtggacaggtctgtgtgaggtcagcagtgagtgagaccctctccagcggcactggggcctgcgttctgctcaatgcttttgttcatctgggagtgacttggccgagaagcgagctcctcatgctccttaggctgctgcccttctgacacctgctgctacctttgcttcgtctgccaggtgtccctgacgaggagcagctgtttaagaagccccggcaggtggtacataagaacacgcgcttccttagggaccccttcagccaagccctgagcaggtgccagctccagcaggcagccgccctcaatgcccaggtgagcaggcgggtcagcagggccgcatgggccaggttggacagggctgcctgggggcaggcatgatctctcccatctctttgagcttggcagagctcagtgagtggaaccatctggggccctgtgcggcaggatcctgagtctttccttggccccagtgggcttccattgaacactgccttggtcacacacgttctgtaggtccagatctgtgccagctcccttgatggcaggggcaggagagaaaagggactgctgggagtgagcccaggctggcagctgcacgcccacacaccgggcagggaagccagagagccgcagagggagcccagccccagggggtggctggggtgggacaggccctgggttggcagagagcagaggctttctgagtctgggagcaagacgagtagatactctctgatggtgactgtggcagtcacagggttgaagtggggaaggcaggaagagactagagcataagcattgcctgtcatcagcattgcctgtcatcagcattgccccctgcaggggcctggcgtcagcatcctctggagttgctgggataggcgcagctcgagtggaggccctggcacctccctggatgggaggagggggctttccttgcttgggtacccactttgacaggccctcaaggtcttttggggggttggggcaggggccctccctctctttctccaagaaggctgccaaccccagagccccagccttgccctgaggagaggaagtgtttccagcatgttcccacgtgtttgcccaccggccagctgtcgagcgtgggctgcggtccccctgatgccagcctctctgcttgttccagcacaaacagggcaaggtgggccccgatggcaaggagctgatcccccaggagtcccctcgagtgggtggatttggatttgttgccactccttcccctgcccctggtgagaaaagtgcccactggcaagtgggtctactgctgggactccctgggggaggtgggcttctcagtcggccctggccactcctggcctctacctggcctgccccacaccttgtgtaactcagggacctggtctcctgtctgtacaaggccctagaggccaggtgtccaggctgcttggggccgtgggtgggctggactctcaggcagacctggcctgagacatcctgggatgacgtgtcctgtcctggtccttactgtgatgtcagtgggtgggggtgtgtgcacagtgcttatgagtctaagtctacctagcactgcagggagggaggcccagcacctcagtggaggtgaaactcaggtggtcttgtggcatgcgtgggtgtccctctgcactctggcctctgtgctcttgggtgctggtgctgtgtcacacgccagggcatgtgaaggcaccacaggtttgcctggggttctaggaggtttgggagccctggaaggcctgagtgtctcctcctgcgtggctgggggagacctcccagaggcttgtaggctaagcacatggctgtagggccttgagcctgcctcgggcctgctgggagcttggcatttccctttcggaggatggaggtgccagggttccagagtcctggggaaggagagagggctagctgcctgccttcgtattagctgggatgcacattgggtgaacaagctgtgactggaggggagggtggtggggagtcctctggcctgaggtggttttgggctctttgtctgcaggtgtgaacgagtccccgatgatgacctggggggaggttgagaacacacccttgagagttgaagggtcggaaacgccctacgtggacaggacacccggcccagcttttaaggtgggttgtggtgatgggggaactgtgtgcgaccggggtggacacctctggagccctgagtgcctgtggctcaggactgagcactgggatcggcccccagctgctgacgggcagagtgctggcttttctgaatgccagggtgctgaaggcaggtgtgggtgggtggacctgtcacagagggatttgggggtgtaagggctgagacaccaaggcagggagtggcttgggccctctggatcctggaggccgggtgctgttcatgaatgaggcaggatggtcacagacacgtgaggagctctgcaggcctgagggccataggacgaggctgtgtgcttgtagagaaggcccctggttacagaacacgattgggacacgctggattacacggctcaagcctggtgttgtaggagtggtcagggtggagtgtgtgaggcccggcacagaccaggggaggctcttcgtgggctgggtcagatacaacaggcctccccataccactgcgggcctttccccagaatacttagtacaggtaacccatgtccagacaaaacatggggagaggttctggttaccttggttctaaattgtctgggacacaaggataaccaaggcaaacgtgcgagagggataatgaagaggatgccgtgctgtccaatgtgagagcgcaaggcaagggctgaggtgcttctgaggtatgcctgccactgcttcccgagtctccaggccaacagtaaacagataaattctgaaacaaaccatgatccaagtcagaatttggggcccgataaagatggcaactcagattgcactgaatagcagagtatttagaaatgaagggagctgggtcctcaggatgtgtagcagcatacattgtggaaaggtgaaaaggttacatgtaaaaacaataaccataaaacaaccagaagaaaatagtggcgaatatttagtttgatttttgggttcaagtgattctcctgcctcaacctcccaagtaactgggactacaggcgcgtgccaccacgcccggcttatttttgtatttttagtagagatggggtttcaccatgttggccagactggtctcgaactccttggccagactggtttcgaactcctgacctcgtgatccacccacctcagcctcccaaagtgctgggattacaggcgtgagccactgtgcctcgcctcttttttttttttttttttttttttaacagatagggtttcactctgttgcccaggctggagaacagtggtgcaatcatagctgattgtaacattgagctcctgggctcaaatgaccttccagcctcagcctcctgtgtagctgggactaacagcatacaccaccatgcccagctaattttgtgtgtgtgtgtgtagaaatgaggtcttgtcattttgctcaggctggtctccaatgcctgagctcaagtgatcctcccaccttggcctcccaaagtgctgaggttccaggtgtgagccaccactcccagcctgtagtctaatcttaagttaggagggactttctaaacataaaagcaaaggaagaaatcacaaatgaaaataacaaatacagcagaaaatgttataaatgaaacaaatgtaaatgagtgaaaaaacatgtgcacagcgtagcacagttgacttgacacaaggtcttggcaagggtcttctgagtaacagcagcagaaaaggaaaatgagccccttgagagcaaaataggccacaggcacacggggaagcgcccgaaatacagagcgccgataaagacagagatgttcactctgataatcagggaaacactaaaacagactgctttttcctgagagattgtcagaggtcatggttttgggaggaacacgaagacaggtgaggagtgctgcgccttgggcaggtcaggtggggtttggggctttccaggggcttttagtgggaggtgatgggttgtgggggttttgtaggcaacaaagagaggctggcacccaccacagtggctttctgtgtgaggggctgcctggcgtgtggcaggcctggcgcagctacccacacacctgctaccttgtagatcctggagccaggccgcagggagcggctgggtctgaagatggccaacgaggccgctgccaagaaccgggccaagaagcaggaagccttgcggagagtgacggagaatctggccaggtgaggggccgcctggctggtggggaagtgcgagggtggctctggcctgctcctgttcggcccctgccctgaccgtgtggaggcatggcccacgcggcagagtccagggcaggtccgcggggttctgcagtgggtactgtggcagctcctctatccagagcatggccgcacatggacaggatgagaggccccctccatcttctctttcctccacgtcctctttgacccgtccctaagaggcatctttaggcgtgtggtcctgctgggagctttcatcagccctgtggagagagtcatcgttccccttggagaggggtggggactccaactctcagaggcctgggggtgcaccccagcccccacagccaagggcggtgctgctgtttgacctcaggtttgacctgagcgctgctgtttgacctcagggatcccccgcatttgctgccatgctggcagtaccatcctcctcagctcagagtgactgtgtctctgcccaggctcttcctgggagccaagggaggccctgctgccggcagctctcagcccacctaaccctgcctctctcacccattcctccaccccagcctcacccccaaaggcctgagcccagccatgtcgccagccctacagcgccttgtgagcaggacggccagcaagtacacagaccgggccctgcgggccagctacacaccatccccagcacgctccacccacctcaagaccccggccagtgggctgcagacccccacaagcacaccggcgcctggctctgccacacgcacccctctcacacaggacccggcctccatcacggacaacctgctgcagctccctgcccggcgcaaagcttcggacttcttttagagccaggcctgggctgggctcatagacgcttcacagagcctgcagggcagctgtacacccagcagaggactccagccttctcggggcccaggcctgggccagaagctgttgaccataccaggagtcactggagaaaggggctgtgctggggccagactggcacaaggcactcgtgcccacaccacaccccagggccttgccaagctgtttgctgtttaattggccccttgaactgtcattaaagaacacctaggtacagtctggggggttgcctctccatcttgctccccacacgagccctagccttgccctggggcctgcatcacgtctcaggactgcggggcttgaagcgaggggccccccaggtgaggaagctgcaggtggggcggctgtgggagcaccgggtgactggcgttgctttctgcggcactcggaacctgtgttctgagttgagctcacatcctgcagtgctttctgcttctctggggggatatgaaggagaaacggagcccttggaagttgtacccttaggttcccctgcggttctgggcccaggtctgcagcctccactctgggcttgccggctgtgaggtgcgctggttataggactgtgtgggggctgcatatcaggtgatctcagctatcaccttctcccagcacctggcttccagctcatggggtgggactatcccactcacccctctgctataggcactgcccatcttatgctgctggccctggcctcacctggtcacttccaccaacaggagctcccagataacagtgggttgctggacagatcaggctgggactcttaaggggtgggggacgtggggccttcagtgctttatcccctaggaaagggtgcacgttatcccaagggagcccccaggaagtggggagggaggggggaggagcatgtctaggtgctgaccacctggagcacttggccagcaagtgggccgcatgctttgggagcaatgggtgacccagcaggaagcacaaaagaccggccagtgtgccatcatcaagggctgctgagcagcttgaagagccactgggtggggagggcacacggggaggtctcagctggggctgcccctggaggacagggcagggaacttgagggctgaggacagaaatctcacatgactccaggaaatagaggaagaggaggatgctgagcgagggattgtgagggagtgggggtaggtcagagggggctgaactgcaggaagccagggggagtcgtggaccactggagctggccagccccagggcattggggacaaggccaggtcagagggagacagtgtgggcctggtgggtggaccctggcagaggccctcttgtcccccacaaggccaggccacactgtgattctgcctgtacctgagcatctgtcctgtgctcctaggccggagaccactgtgtgtcaggtggggcggttggctgagtcccagagaaaaacactcctcactgggcactcttgatgcttgcacacaccctgtggtttatttggtggtcagtaaggaacgtctttgctgctaagtggaagaaagctaatggaacgtaatcaaaatagtggtttaattgacgaattttacttgcacctgtgccttcttcagatcctacctgcctacttagtttacgtgaaggccgactgcaccatgccccccaaccccgacccccaccacacacaacggggccattgtcatgctaggtgcttgctttccccacctcagctccggagatgtgatggtctttggccctggaggtctcggccagcctgtcctccatcctgttctcgttctcgggcaccaccagcagccggtgctgggttttggctccaagcttgtggtcgggccggtggtcgggcctcaagcctgtcttggtgtccagtttgcactcagcgcggtacttgccctccccctccctcttgaaggaggcagaagacgtggctttgggcttggggggctgcagccacgagtggctgaggatctcatcgatgtggagccgctggctgacgtcgggctgcagcatgcggtagatgaggtccttgcactcgcaggtcaggttcttggagcgcgggaagtccacacggtgctccttctggatacgcagcatcttcctgatgtcggagtcgtcatagggcatggagccgcagaccatgatgtacaggatcacgcccaggctccagatgtcatacaccttgggctggtaggggatgctctgcagcacctcgggggctgcatat

SEQ ID NO: 17385 - DNA, 5293 bp, Human
gcaaaatagaaaataaactttttgaaaaagtgccacagtgggccatttaccaaggtggactggtaaagaggcagggcacacgcagaggcaaataggtagaagagaatgagcactagagatggacaggtgggcagtggcccatttgtaaaagtggagaacatagggtaagaaagggattttgagaagaccttgagttcctttctggcatggtgactgggagaactttattggtagtggagatggagatgtggagcaggctccagaaacaagagcgtggagcagagagagaggccaggctggaggtgcacttgtgagtcactgtcacaaagatggtgtctggagctccaaggctggaataggtattgagggtgagaatgggaaaggatgaaggaatggccagggctaggaggaagagggctcagcaaatgttgggctggctctcctgaccaatgaccctgcctcccccatcatagcagcactctgattttggaggatggtccagatgcagttctgtgagggaggtctgctgagggaggagggatccatggccatccaaagggccatgggaggagatgaaaagtgtggggctgtggcagccattctaccaccaagaggtgggtggaggaggggttgacagagccactcatggaggtggcagctcatcactgagcctccagactacccctgggaaacctatgtgggagctcttgtgacagaaattaaatcagcaggttcggtcacagtgatgtccacagcactttcactgatagcagagtggggatggcagagtcttgcagaggggctggcggcgggaggagcgcaggaatacgcattgccctggggaggcggccaggttctaaccgtctcacacctagtcactacactttacagattgggaaagccaagcccagaggctgaagacgcctatggaggtcacacggccagaaattgacaacggagtatgagccaggccgtctgtttctctgtgctatgagtcccatactgtattttcaaaggtcaagaggaaagggtcttaagctgaagtgacggtcccgctgccaggagccgcttcactgagggtgaaacaatgtagccaagtgcgggtcacctgcgctgtggcagaagggaccgaggacggtgtggccagaggactggcctgggcggagagcgaggagggggagcccacagcttctggggggcagtgacagtgcggggaagggcgaggtgcagtgttggatgttttcgcggggattctgggaccagtgggaaagctggaggacaggcggctctgaagcaccgaggaggggcctcggaaggggcggggaggtctccttgacacaggtgaggagacggagaactgggggcacccggcagcccaggcttcctgccgcgctctcacgccctccagggccatgagaccctggctccgaggtggcgggcaggttcgggacccgagcgcggcgggatcgtgcggttgccggtggtgctgggccccatggaggctgcggtccaggagtttcgggtgggcggctaggccgagcttctgcaggcgtgctgagccgccgcagtagggccccagaggggacgaggaattaggcccagccgaacgagggggagccaccagaggctgggccgggaggcaccgccgcgctctggggagctgccagggtcggggcgccctccgagcggctgccaggccccgcgggcggcggcgagccggccctccgccccttccccgcaggtaagccctgccagcttgagcggcgggcgcgggtggggcaggaggacgcggggcggggtggggggcacagggggccctctctgcagcgcccccggcccccgcgcgcggaggcagggccgccgcagtcgaggattagcgcgttcgcggccggcgctgcgggattaacccgcgtggactggacgcccggcccggggattactgcgcgctccctccccgacgtatatattcccgcggcggcggcgccccggccgggccgggcatgtcggcaccggctgggggcgcggcgagccgccggggtgccgggcggccctgccccttctccatcgagcacatcctctccagcctgcccgagcggagcctcccggcccgggccgcctgcccaccgcagcccgccggtcgccagagccccgcgaagccagaggagcccggggcgcccgaggctgcgccctgcgcctgctgctgctgctgcggcccccgcgcggcgccctgcgggcccccagaggcggccgccgggctgggtgagtgggcgcggagcggggcgcggggcccggcggagcccggggcgcggcgcagtgggtgccgagcttggccccagccccgcgcctcaccgcgccctcgctccgcaggcgctcgtctggcgtggccgctgaggctgggaccggcggtgcccttgtctctgggtgcgccagccggaggttccggggcgctcccgggcgcggtcggcccgggttcgcagcggcgcacgaggcgccaccgcaccatcttcagcgaagagcagctgcaggcgctcgaggcgcttttcgtgcagaaccagtatcctgacgtgagtacgcgcgagcgcctggccggccgcatccgccttcgcgaggagcgcgtggaggtgagtgccccgcccagcctttccccggagcgcgcgggccgcggctacactggactggggtcctggcgggcgggcgccctttgcaaagacggcctcggcccaagccccgccctggcgcgccggagggaggaggtccctggacggcgctgggcgtccgggggtatgaggagcgggtgagagcagggaggtgccgcgggaaaggaaccggagggctacttttcttttcttttgttttacactttcctctggtgacgaaagaggcccgcgttcacgtccagaatttgggaaattcagaagagcccgcaacccaagaaggggcgtcctggtcgccgccagctggaggctggggcgggtactaagggggttcccatctcgcgtccagacccaccgagtctgtccgcagcgaataagggcaggtggcgcgcagccgcggcccgggtgtcggctctacagcgccgtccgcccacatccctgttgcgaagctcccctctcggtccctgtgggaccctcgggagccggtgggacgcaggacctggggctagggctgagcattccccccatccccaggtctggttcaagaaccgccgggccaaatggcgacaccagaagcgcgcgtcggcttccgcgaggctcctgcccggcgtcaagaagtccccgaaggggagctgctgatgactctaggagctgcccctgggctcggccaccctttttgggatctttggagttggcgctgagagaagacaggtctacccgaaaaggagctgggagagtacaccggccgcctccacccgtctccacagcccttgcctcctgcagctcgtgctgccgtggcgctggggacgggcccccggtgcttggtgttccacggcagtgggagtggcgagtcccttgggggtgggctggggcatagagcagtttcctcagctccctaccccccgagagacactaactccaccgcaggaggggaaccaccccgtatcaacacgggacccagaatcctacgcagtggagcgtctctccgcaccctgggacatgctggccaccctcttctcaatgtggacattgacctaacttgacctggctcgtcctcccccagcgggagaggggatggggttcgtgtctgtgcagtcctggcgttgcaggcttcccaggccctgggctgggtcttggtatctggacctgtagaataagaaggtcgcaggagcgattccaggagcccctccacagtcccttcaccttcgagcctcgcgctgatactgagaaactagcaacttcaaataccacagaagccgcccagagtctcaagtccaccttggctccactcccacacccaacaaggagctgtcccttcttcttccttcccagcgagggggtatttagggtacagctgtctttgagaggagcacagctcagcgatcctcagtctctgcaccagggtgctccccagcagaggggactgctccacggatggtggccttggacccctggggtccagccctggcctctaggctactgtgaacctgcccatgggtgagggtcccctgcttcctcctggggttttcatgctgtgggctcggactccctcacagcaatctgtgccatcctagggtagggcaagaggaggttggactggggagaccccgcccctgctgcctgggaagatgcctgccctccccttctttatcctggcccatggcaaaaggcacagtggaaagaagccttagattccccaagtaggccctacagtgggtccaaagcatctcacatccccacccccagctggcttgagcacctcgttctgtctccttacaggccctgcagggaatggggccattctacctgcaagagatgaagtccatctctaaaagcaggactgcagaagccagggctgcagctccccagacaccccaaggctggccagcttggataacaccaagcaagcatggtgtccccagtcagaactgccctgacactgctgggtgtccctagcatccccgcctccacccctagcatgcacacaaagcccttctccctgaaccctggtcttgcccttggggactgaacagactacctgtggacatgcccgtgtcccagtcagctcccttgcagctggggacactcgcatctcacaggctccaggccccttgagttccttggttgaatggccatctgtcattgttttgggagccccgatcagagcttgtggagcgccaccttccagggctcagtggctgtgttgctctcctgaatttgcttcttgagctctagctgctccttggcaggctgaccccccacagcaggctattaacataggcatccttcacgctcacacccaggcgctcgcttctcatcttcaccctcttcccggtttatcttttaccctcagactccaattcccatctttctgccacatttacatctcaagccaggcacttcccctgagccaggtatttatctccagctgtccccttgaagcccacagactccttaaggtcaccttgtccacagtgagctcttctgtgcaaaccaggcacatgagccagagagctagccgcccacccgaaactggtccctggacccctccctctcctgatcatccactatacccaggctgacaggaagtcagttttactgtttatcaataaatcaataaatcccagaatctctccagc

SEQ ID NO: 17386 - DNA, 6992 bp, Human
gcctggagtatttcaatagcttcttttttttttttttttttttgagacagagtctcgctctgtcgcccaggctggagtgcagcggagcgatctcggctcactgcaagccccgccacccgggttcacgccagcctcctgcctcagcctcccaagtagctggactacaggcgcccgccaccacgcccagctaattttttgtatttttagtagagacagggtttcaccgtgttagccaggatggtctcgatctcctggcctcgtgatccgcccgcctcggcctcccaaagtggtgggattacaggagtgagccaccgcctccggccttcaatagcttaacaggtcaccaagcttccacactattcccacacagcctctcccctcttgccaccggctgtgacctcagactgaaatgctcttccctggcccctccttatccttcaaatcttggcttaaaagccttttctcagtttcattgaccaggctatctaacatttacgattcccccagcatatcatccattttattcttctttacggactcatttctggctcgtagtaaatgttcaataacggttaagtgaactgaatctctaatttctggtcgttaatttgtagagaccactttcccggatttaaaaagtgcaggtgctctggcagccttaagtcggtgaaaacaagaatattccgcaaaacaaaaataacttgtttattcatcaaaaacagttaacgttacacttctataccgtcaattcgtgtgtgaacagagttgtgtctgatccaagaccttacagttcaagcactggatcccaataacctgtaaacaacgttttgttatttgcaatgcaatcctgggctaacttttcaaaagtcgtttttctcaatttcccgttagttaaaggaataaaaaaatgctgtccaacgtggtcaatggaccaaacaaacaaggacaacaaacagaagcgtgagccattgctaacacaacagcgaccaaacaatcatgcactgtatcaggcgtgtaaaaatctggggggaaaggcttagtcttaaggcctaagtcatcggacactggtcctctcccggggaataaaacggcctcctcctctgagagggaaatgtcctgaattttccctgcagagggaaggtcacctgcaagcctacattcgtgacagcgttcccgaggaccccctgatcctcatcttcttttctgcttcatcagaccagagaccgtggctaaaagccccccatctgccggctctcaggggcttccgaggcggcggggcgggaggcggcgcccagtcaaggacaacagaagactacgtcgcgtgggccaaaggaaacagtcccgtcaataaataagcctctggccgacgcacctcacccttcccatccatacaagacctcaccttctccccggagccgcggaggctgttctgctaaactgtctggaccacgacgaccccctaggaggccgggtcgcttattcaatatggcggcctcggctaactctgtcagccgggcctggagaacggaaagcccggagggactagaatccttgcattcgacaagtttgtcggcaatttccgtcagccgaccagagggcggagctgaggtcggcccagcccggaggcgggaaggacaacttggacccgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtgagcggacgggctgagtcggggtggcggggaggtttctccgcccggggccggggccacgtggcgcagcgtgtcggctgccgcgggagggagggaggccgggccccggggccctttcgagagggaggggaaagcgccccgttgccgtctcccaaggccctcgtgtggggcgagcccggcctccggggagcggttcacgagcaaggaaaggttaaaatgtgctttatttacacttaattcagccaggtgtttccgcatcgctgcccagttaatacatgttaagctgtagatagagcaacgccagacattgcagtatttgaggtctacttagtggcagacatttctcaggatagcgcggtgacccaaacatatggtttgatttgaaggagctaataagaaaagaaaagcattaaagcaaccctgctggggttagtgcccactaattaatgtgatgcatacggtatttattatttattcgctggcgtttgtttttcaaaggtgtgtgtgaatgtttctgtgtccttggcaggtatgtgccatcacaagcagatgtggcagtatttgaagccgtgtccagcccaccgcctgccgacttgtgtcatgccctacgttggtataatcacatcaagtcttacgaaaaggaaaaggccaggtaaaatcatctttgtatagagctgaagaataagactgctctcgaagtttatcaggatgttcacatgacaaaactggacccaggctactttagttttgttgggatattgtaagctaaatttttctgtaaccttagaaggccaagagactgaagccctccattttttcacagaacaggtagaacatggacagcagcaattcaacttttccccacactgccctgccaatgtgcctcgaccttgacctggggggcccacctctggggtgagagggtggctcattcattcagtccttggccattcttctgaaactgccaacaagggtggaagtttggggaagtggactccagttcactaagaatggaactgagcatacttaatgaaatctcaaacagaaatgttcatactgaaagagtaaatcatagtgagtattgaaaataatgtctcacatggtactaatgcttgtcgggtgaggagttgaacatatgacagtgtttacctgggcgcatgtgaaagggtaaattatgattgcaaaagggatctagtgataagtagtgattaaaacaagttattttgtattttctggaaaaggatgttatactagctcaatagtggttgaatttaaatgtttttcaagcctgccaggagtgaagaaagctttgggcaaatatggtcctgccgatgtggaagacactacaggaagtggagctacagatagtaaagatgatgatgacattgacctctttggatctgatgatgaggaggtatggcgtcttctataaagaacatatcggccaggcgcagtggctcatgcctgtaatcccagcatgttgggaggctgaggcgggtggatcacgaggtcaggagttgaagaccagcctggccaagatggtgaaaccctgtctgtactaaaaatacaaaaaaatgtggcaggcatctgtaatcccagctactcaggcggctaaggcagagaattgcttgaacctaggaagcggaggttgcagtgagccaagatcgtgccactgcatccagcctgggcgacagagcgagactccgtcccaaaaaaaaaaaaaaagaatacatcgatcagcaattgtatcaatgtggttaagccaaattgcctggatttgaatcctggctttaatttatatgcctttttcaaattctgactggttgcatgatgaataaaatcaaatcaccatctttcggctgagttcgtgatggatttgcttttttctgattaagccagtcttttttgtgatgaccccactagctttaagcagaggaacaaccagctttctgaagtggattaattttttttctttacaggaaagtgaagaagcaaagaggctaagggaagaacgtcttgcacaatatgaatcaaagaaagccaaaagtaggtcatttgtttttaacttcatttcatgttaatgtaagtaatctttttcaaagcttgaccttgaagtaatttcctccacattccttgaataggtcaatattttaaaacctgtacaggttcttccacagctactggtctgcagctgttcttatggtagcagttgtggcattcctctgtgggaaagaaactgttaacacaaacacctctttcttagcaaaacagaaagtgggtatatatgtgtgacagacacaagatgtatctgtagttttgtttggctaaggagatagtctcaaaacaaattgagatggatttgtttgtgtcttggagtagggtgaaaaaaatacaattcattatttgaataatgctgtttattgtttttagaacctgcacttgttgccaagtcttccatcttactagatgtgaaaccttgggatgatgagacagatatggcgaaattagaggagtgcgtcagaagcattcaagcagacggcttagtctggggctcatgtgagtttaggctttgcctttttttttttgaaactaacatctggaatttgcctacagtttcaacctttcctacaagacttttctaactaggatttttcttaatgctctttttagctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagattacctttggctcttgagtatgttacataggagggtggtgtatatattcctttcattttgggggaaggaattaaatgaatatgtgattcctaaataccccaaatttggtttggcattgttgttagaaaattgcagtgcaggccaggtgtggtggttcatgcctgtaatcccagcagtttgggaggctgaagtggctggatcgagaccaggaggctgataccagcctgggcaatggggagagatcctgtctctacaaaaaatataaaaattagctggacatggtagtgcacccctgtattcccagctatttgggagactgaggtgggaggatttcttgaacccaggaggttgaaactgcagtgagccaaggttgtgcgactgcactccagcctgggtgccagagcaaggtcctgtcaaaagaaaaaaaattgtagtgcaactttacccacttgtgatgtccttagcagtgcctgatgatgtgatttgttgtaacctagcatctttgcactgggaacttgatgtgagatgtgtgacactgctagaagacacctaacccagaggagggagggcttcccagaatttggcatgacttacaactacttaacaggttacaaatttaaaataatgactcatgatgtaaagaaaccatcttttaagtgttgggaatgtgatttggagtagcactgtgtcctgggagggggattatataggtaactggttcccaggcttcccagaaaaacttgactttgctgtgaagattcataggtgctgggttgtagaggcggaatattttacttggatttggaaatctgattggttctcatgctgcaggtaaatactgggatgagggtagtatgttgagtgaagagatggtcaagtattggaaaccgtttaatcttaacagggaatttggggtctggctaacatttgatacatttttttaaatagtagttttacaaaagcagtgcttgggaattgctgatctcaaatgatcaaaaaattttaggtcaattttttttttttttttttttttgagatggagtctcactctgttgcctgggctagagtgcagtggtgtgatctcagctcactgcaacctcggcctcccaggttcaagcaattctcctgcctcagccccctgagtagctgggattacaggcatgcgccaccatgcctggctaatttttctatttttagtacatacggggcttcaccattttggtcaggctggtctcgagctcctgacctcaggtgatccacccaccttggcctcccaaagtgctgggattataggcataagccacaatgcccagcccctaggtcaattttttaatagaactatacagtgctatttcttctccatctgattttatgttgtgactgccttgactgtgggaaactatattataaggaagatttatttaacagatagatacattgaataatatctctaagcaatgtttataatccaacagcctaaaagtcatgggagacattttcaggttgtcattatcataagagccagcagagggcagcactacattttctggaaaaccagagagtttgggaataatgaaaatgccaaaagaaacacaaaaaacaaaaaaccaaaaccatgaataaacttcggtgaatggtaataaaaattcgcaattattgacatggtgaaggggttgagttccaaatagcttggccaaaatgttaactatcagcagaagtttatgatgaaaaaactaatgattaataattagtttaaaggtggtcaaaaatttagaatggtcaattcaaaccacagatgtcttcagaatcctacagtgatgaatgatgaggcataccattttgaaatcttgattctacacccttgaataaaaaatattttgatggtatcttttaacttcatattttaaaaaacacatggccggatgtggtgtctcacacctgtattcccagcactttgggaggccgaggcagctggatcatgaggtcaggcgatctagaccatcc

SEQ ID NO: 17387 - DNA, 6992 bp, Human; identical to SEQ ID NO: 17386

SEQ ID NO: 17388 - DNA, 74177 bp, Human; identical to SEQ ID NO: 11988
  misc_feature (1)...(74177): n = A,T,C or G

SEQ ID NO: 17389 - DNA, 55031 bp, Human
  misc_feature (1)...(55031): n = A,T,C or G
agttggtgacctcaggtcaatttttaaaaaaatctattctctaaccaaacttgctggaatgaactatttgccaaaccaataagttattgcatattttgaaagcaaataagcttttaggagttaccatgtgactatataatacaatacagtactattccattattattactagtgatgttgcaaaaaatggtgaaaagcattatgtagtgtgtattaaagattccatttccagatttttacagtaataaagatgatcatttattatagtatatacatttgaggtactttcttgtattatactagaaatctgtagtaatagtcaactgttatttagaactttctttttgcctgttaggacagttttataaaaatctgttataagtgttttacaaatattaatttataatcctcactcctaagcttcacgatgactctacaaaataagtacctttaatatctgcattttgcagatgaggaaactaaggcacagagaggctaagtaatttgtctaaaggtgtttattccgtaagtctcagagcctggattcatatatagttaacattcttgtaaatctactattgaaataaaaaagaaaactttgtcgggagtagttgcctcttcttaaagagagaaatggagtgtggtggacagcttcaagcccctggagccctactgatcccattcccttcccccaccccttctgattgtactttgatcttagacaagtttcaaaactttccagtgctccagttccctcttgtaaaatgaggagagacacctgtacttagtagagttgtagagaaaaggacctggaggtaattcagacagcaggtaattcaaaaagtggagctcttattttatcagaaaaattgcctgataataacaaaacgcaggatgctgggaagtatataatcaagttccacaaactgctctttccccaagcacccaccttggtgttatgattctgcttatgggtggatttattattctatatgaagaacccattcagtgaattagaatggtccagtgggttattctgtagagcggcattgtacattcttctcacttttctggttctgatatacaatttgcaaaacgtctaaattgtaactatttgcaagaaacctgtaacttgtccgatttgacgtccacatggttagtgtatggatgagggtttcagaaccctcttcaggaggcttagcagacaccgttgttcacttataaacatttggactctacttctggttttttttttttttaattacaaacaaaactttgttaggttgttgttttgtgtaaagtttgtccttgtccccccaaggacaatctaaagttctttctaggccagtctccccatctttcttggggagagatggggaacagaggagatgagagatttcttgggtcccaggcactctgcattaacgccaaacttttggacttacaaaaatatgcttgcagaataaggtaacattaaagtccttcctgacaagcaatacaaaaatcattgaccaagatcacaaccaataactgcacaccaaagacccgggaagcccctggtccctggggcgcctctccccaggcttgcctgggccgcctgacccaacgcctggacaaaacaaaggcccctgcttcccggcaccgcgcggcctccggagctgcacccccaaatccccgtggcgacttcatttgaagcgtggaagaagcaaccacgcaagtggagagtgggttctgaaagctctgggatgaaccaccctctctctttctgtcgttcctcttttaggaccccggctgcggcgaggaggaaggagccagcctagcagcttctgcgcctgtggccgcgggtgtcctggaggcctctcggtgtgacgagtgggggacccgaaggctcgtgcgccacctccaggcctggacgctgccctccgtcttctgcccccaataggtgcgccggaccttcaggccctggggtgaattcagctgctcctacatcagcttccggaaccaccaaaaattcaaattgggattttccggagtaaacaagagcctagagccctttgctcaatgctggatttaatacgtatatatttttaagcgagttggttttttcccctttgatttttgatcttcgcgacagttcctcccacgcatattatcgttgttgccgtcgttttctctccccgcgtggctccttgacctgcgagggagagagaggacaccgaagccgggagctcgcagggaccatgtatcagagcttggccatggccgccaaccacgggccgccccccggtgcctacgaggcgggcggccccggcgccttcatgcacggcgcgggcgccgcgtcctcgccagtctacgtgcccacaccgcgggtgccctcctccgtgctgggcctgtcctacctccagggcggaggcgcgggctctgcgtccggaggcgcctcgggcggcagctccggtggggccgcgtctggtgcggggcccgggacccagcagggcagcccgggatggagccaggcgggagccgacggagccgcttacaccccgccgccggtgtcgccgcgcttctccttcccggggaccaccgggtccctggcggccgccgccgccgctgccgcggcccgggaagctgcggcctacagcagtggcggcggagcggcgggtgcgggcctggcgggccgcgagcagtacgggcgcgccggcttcgcgggctcctactccagcccctacccggcttacatggccgacgtgggcgcgtcctgggccgcagccgccgccgcctccgccggccccttcgacagcccggtcctgcacagcctgcccggccgggccaacccggccgcccgacaccccaatctcggtgagtaggagcgcgagggctggggcgcgtgagggccggggcaggggccgtcttgagccctgtcgagggcctcttgtttttccaccaacgccttcgttgggctggggatggtgcttcactacctcgagtttctagggaaggcagaagccagtgcggggctggcgacatcacagccccagaagaccggcttctgtggaaggggccgggcctgcccgccggggcctcttctgagatggtgtcagggtcggagtgcggcctccccgccatcccagacatcgaccgtggccgcgctgcgctgtgggtgacgcgggaggacagcgggctccctggagagccgggggcagcggcctgggatttcctcgtggaaggtgctggagattgctgagtttctgcgcccctttcctccccgcccgccctcgggcctccgcagggaactgattacaatggtttggaccgcagaccttctgggccatttggcggcccagctggaggatccctcggggtagctgatgattttcccgtcgggggtctcacaccgagaacaaaggagggatggacaaaggagacgccggggagatgcgcggaacaggagccggcactgtgcgggtgccacccggccgagcgcgtgggcgcatcatgcgggcagcgggggggggggcgcacacgcccggtcagtgtccgggaacatagggacctcaaacgggcttgttcatgacacccgagttaaatggagactttgcagtcgcttgcacgcgtggagcctcctcttctcgcgtgggccagggttggaaataaccgttgtggtaggttccatgcagtgtttccatcggatgtcagacggggagggacggcaaacctgtctcaacctccactgattcacaaataaacgcagcgggatctgagaaggggcctgagtacacgggccgggggagaaagggaagtggcaacccctagttcaaaatgcaaacgacctctggaatttcgggaagagacggaggagtgagtttggattgagcccaccctgtgggggaggggaagcccaggcttgagaagcaaagctcgcgtttattgaccacctactaagtgctaaatccttctgcatttgttctcactttgaagagtaaaggctacccctgccaggtttccagtcttgggctggctccgagaagggcctaggctttgaagcgcttttaaattgtcctctggccctgggtggccagggaaggttcccgggggtgcagccaaatacacatcgccggcaaactgattaaccctgaaagtggcgccgaggcccggtctgtggctcttggtgttcccctccccctcacccctcttgggggagccagacggccacccccaggggaggaggggcccggccgagcctcgccgcgacttttgcgagatagcgcggcgacatggccacacaatggagcccgcaggcgggagtgcggggcggggcgcggcgccctggccttgcgcgcttacggggtcctctccagggccctctggggcctctgacttaaaatagggaggactgggccaggagatcgagaccatcctggccaacctgttgaaaccccgcctctactaaaatacaaaaaaaaaaaaaaaaattagcggtcgtggtggcgcgcgcctgtagtctcagctactggggaagctgaggcaggagaatcgcttgaacccgggaggcagaagttgcagtgagccgagatcgcgccactgcactccagcctggtaacagaacaagactacgtctcaaaaaaaaaaaaaaaaaaaaaaaaaggactggtccnnnnnnnnnnnnnnnnnnnntgtttggttaaggaaaagagagaagttaaaagtcatgagttacatccagcagtgtaaaaacgaaatacccgccgggcgcggtgtctcacgcctgtaatcccagcactttgggaggccgaggcaggcggatcacaaggtcaggagttcctggccaacatggtgaaaccgcatctctactaaaaatacaaaaattagctgggtttggtggtgtgtgcttatagtcccagttacttgggaggctgaggcaggagaatcggttgaacccgggaggcggaggttgagtgagattgctccactgcactccaggcctggcgacagagggagtatgtctcaaaacaaacaaacaaaaaaccgaaataccatgtgaatgcacacagtattcagattttgaaatgtcagccatgccatgtagaggttgctgatgaagtgatgtttcccaaattcccatgtcagcaaatggcaagctgacctccctgtgcgtctctctgccaagaactgccacctgccttctctgggctcttcccggatagcttatgaagtccacagcctttgaatctggcctagagggtggtttttctcttctgcacccagccaagtgttttaggagaggtgcggctctctgtgagggaacacagggcatgttgaacttgttggcattcatagcttcagcgtgttatgcaggtggcacttacataaaagcaactgaaattaaaagcagtgcatgtggccaggcgcagaggctcatgcctgtaatcccagcactttgggaggctgaggcaggaggatcatttgaggccaggagttcgaggtcagcctgggcaacatagtgagaccccatccctacaaatcattttaaaaaattagccaggcttggggtggcatgcctgtagtcccagctttggaagctgaggtaggaggctcacatgagcccgaggccactgcactccagcctgggtgacagagtgagaccctctctcaaaaaaaaaaaaaaaaaaaaaaaaccagtgcatgtgaatgtgctttttatatgttcttcccattacttgggctctcctacctgcctggcagctttagtgaggaccagcatcacatagtagctgaccctgagtcatggagggaagatgagaactgaccccagctttctgaggagttgccactgagccctaagatggccagacagtgtggtgggaggagcacagggttttaaagttgggcaaacctagattcagttccaggagcctcgtgtcatcttgggcaagttacttacctctctcggtctcacctctttttctgtaaaatgggatcatcataacaatttttagtgttgccttaaattagaaaagtaaggtaatacttttgaagaatttggctttagcccttcataaatgatggttattttattgaatagccactcactgtcatgtagagttaccaattttgctggtgtgcccaggactgagggttttcccagaatgtgggattgttcgtggtaaacctgggacagtccccagtgaacgcagattgttggacactcaatgtgaaaatgggtgcattacccatcgttgtggtttggtaatgagctgagaacaaagaagaaacagcagaggagaagcagctgagagcaaaggagaagcagcatcattcttccctctgctgagattctggaagtagtcatttaagtgctgccagcttcatttggtcttgaagggtgagtaggagtttgtcaggaaaagaaccagcaattttttaaaaaaagaaatattgaccattttataggaaaaaaaagaaagacaaagaaaaagaggccaggtgcagtggctcacacctgtaatcccaccctttgggaggctgaggtgggaggattgcttgagctcgggagtttgagaccaacctggacaacatagtgagaccacatctctaaaaaaaaaaaaaaaaaaaaattaactgggcatggtaatgcatgcctataactccagcaactcaggaggctgaggtgggaggatcgcttgagtcagggaggttgaggctgcagtgagccgtgattgcaccactgtactcctacctggagaacagagcaaagaccctgtctcaaaaaaagaaaaagaaaaagaaaggatatactctgctttactaatatgttgtgtagtaccatgaaataatacaatgcaacctggcctttgatttaaataatatatttgtcacaataggtaaaactatacagactaattaaccttaactcagaaactgtttttaatttcaatgaggagaaacaagagaacacttttttttttctatgtaactgctgtagttttaacaatatcttgccatagttcttatgttggttatgtgaatagggcaaaaatcaaaacaataataaataataaaagttaacaggggcctctgtaaagccctgaacttaggttggaagaaataagtgtggcctgactgcaatgtatgtgaactttaattcactccaagttccatatgagctacgaccctaagacaaatgttaaaatcattaattaggctgcatgaatggaattatgtgaccttactgagggcaggtacagagtcttactcatttttaagtgcctggcacatgttgggcacttagcaaatatttgcgtagggatcttggtggtaattgccccaggactctgccctgcctgggtccaaccacacagaatggctgcgtgtgtcctttaagaagcaaactggagagccctaggggaacggtgggcaggatggaagagggttctggaaacttcagggaaccactggaggaaagcagggcttttaggctggagaagtcactgagtggatgaaagcaagatggagtatgactgtgtccaaatttctgaaaagcaaaaaaaaaaaagaaaaaaaagaccatgaccttttaactctgtgttagtgaaggtgagcagatattagatgtgagaagaacactcctagacaattgtggttgtgtggaaatgcagtatagaatatggcttgtcttcatcataaactcctgggcgctggaagcacttgtggtggagctctgcggatagttcttgccttgcagggctaggataggatctgcatgtgcctgtgaaacggacgtagccggagaacgtagctgtttccttttaaagaacccagtcacggtggttacacgtgtatctccatatggcaaaattgtggagctgtgctcttaaaatgggagtcttttattgcatgtacattacacctcagtgaagctgatttttataccagttaatgcttgtgagtacttaaggctgaaaaggagaccgaaatggaaatagattgtaaatatgccttgacggatatatggtggtaggtgttactggaaaggctaggaaaatatatttaagtatggaataacaattattttgtgtaatggagacataagcaattatgatattctccaaggatttcaaaaagtttgaatcatttttagagtcgataaaaataacaacacaatgaaatacatgtacagtatatcactgtgttattcaaacaatttatttaaaagaagttttgccccattagggatggagtgggggcattcaaggtgttctcagagtttttttatggtgcaggtcagtgaaaaaccccgaagtgttttctggatcttttgggacctgcttatcaagtacgctagtggctttcaaagccggttcatttgtgcagggaactttgtgagactggagaatgatttgtcgatcttcaggaaaaccaaagttgtttaactttccggttaccaccctgagcaggtcagtcagagttggggttggtctgtggtgctaagctgagaacgaattaaataagaaaggtgtgttggggtggccaggggtgtgtcactacctctagtgagccctgtcacttgcccagttgtgtcccatcaaaaggtcaggccacatttgctaggcactttctaagcactcaggtggaatgatgcccgggagacagttctagataacgctttattctgtatccctccccatttcttttctaacttaaatgcactaagaaaacaaacacactgaggtgtggggaaacaggaactctgatacctgtgggtgggagtgtaaatcgctctgacctttatggagagtcttaggtgtagtagccataaaattgcaaagtagacagcctggactccggaattttcacttctagggatttgttccacaagcacaccggcacatattaatttcagcattgctcgtaataacaaaattggaaataatctaaatgtgcatccttaggggaatgtttttatgcacgtggcacatacaaaccataagctatgtaggcaagaaataatgaagttcattatctaatgtatggaatcctcacaaagacatttataaatgcaggaagtgtatatagcactttactgtttgtgttaaaaaaaagaaagaaaaagattatattcacttgaaaatacaaaatctcacaaaaaatttgtaacacagatttgcctgtggggaggaaagcgggtaggtgagggataatggtagaaaagggactttcactatgcatgccttggaactttttgaattttttaaccaccttaatcatttttatactcatttctgtgccttattaatccatttaataacaagaaaatacatttaacatacagggaagttaaagttaagtttaatgtaaaaatttcaaatcatcggctgggtgcagtggctcacacctgtaatcctagcactttgggaggctgaggcgggcggatcgtgagatcaggagaccagcctggccaatgtggtgaaaccctgtctctactaaaaatacaaaaattagctgggcatggtggcacgtgcctgtaatcccagctattcaggaggctgaggcaggagaattgcttgaacccgggagttggaggttgcagtgagccgagatcacaccactgcattccagcctgggcgacagagcaagactccatctcagaaaaaaaaaacaactcaaatcatcttagccacttttaagtatacagttcagtagtgttaaatacctttgcattgctgtgtatcagatctttagaacttaaactctgcccattaaaataccactcccattcctctccacaccagcccctggtaacccccattctattttctttttcttatgaatttgaccactctagggacctcacacaagtagaatcgtacagtgtttgtcgttttgtttctggctaatttcatttaacataatgtcttcatgattcatccatgttgtagcatgtgccagaatttccttcctttttaaagctgaataatgttccattgtatgtgtagaccacgttttgtttatccattcatccatggatggacacctgagttgcttctccgtcttggctactgtgaataatgctgctatgaacatgggtatgcaaatgaaaccttttgaatttggagaatgtgactatattacctaattttaaaaacatattaaactaattaagttttaaaaaacagatacatgatattcatgaatcaacctgaaagtagcatctttttcttttttttttaaagaagattctctatttagtgtttatggatgcacaggaaaactgctttaaggcataagttgttttttattaaatttgtcttttacctattcttttacaattttgggggttttcctttatgctcaagcttcctcaagattcttcaaggcagatcaaaaccatcctcagtggcaatcctgtatttggcttttgattttgcttatttcacaggaggttgctttactgagagggggaaatctctactcctggtctcagtgctggtagtggatctaaatcagcaatgggcggacaccccagccccacactactgtggcttccccacttgtgggcacaaacagtcacgtactaggcaatggtgacctctccaggtaggcagttttccctcaggttatattggagttagaacctgcctgaaaaccactaaccggctgcagcggtgggattgtgtgaagaacaagttaccttcctccagggcaaggtgattcttttaaacaaattttaagacaatttagttgtactgaatttagagctgaagccagttgcaaatgtagctgcttgtgtctgcataagaaagaggaagtatgctagttttcctttccttgttccagaagagggcagttcttgccaacgcgagctgctgctttaagaacttgaagcaacttttctgacatctgaaactatttgtcttttgggaacttatttgtcctagcctgcctgcagaaccagctgttaaggctctgttgggaaggagtatcgctctgctatattgacctctggtagaccatgacatggccccatatgccatacaacataaactggttactaagagtaatttaatggctatctctagagctactcttttgttaccttctaaagaaggcagggaagaaaatataaatggggttataataggaataatcttgaatctgttttaatttatacaaaatacatttataagttttggcacattgacgtttggatactggctaacaactttttagcgagagtagcctgtatcttgcatgtcattccattgaacagtaaggtggatccctgtcaatgaagaaatcatctgatgccagggactttgaagtctttctccaagaggtagatacgatgatctctgttttgctggaaagaaagctgatacccagaaagagcctgtaatctcaggtccccgtgggtagtaaacagccctggtttggaacccaggtaagtccaacctgcaggattgtactttccccctttccccacactttgtatttgccaaatctgatatgagggcacttggctcttcagaaccagaagctatgtgtgattgaagggctctattaaaccttaggattttccatgacttgtcgctcccatccgcttcctctccccagggtagcttcttgtctgagtttccgtttgcttcccaccaatcactgtctctctaggagcaatgtcgtcctacggaatcttccgtatcattcctcaactgtaagctctgcagttcaggaatgcaatgttaggaatcccagtgttgcacaaacttcctttctagccgttggattctggtgtgcagagaactaaagagacttcccaggattcagacccttccaatgggaggattctcctaactctaggggaactgttggctgcttaagagcaaaaccatatggctcactcaaaaatccctttcctgagagaaatctataactgaccctctgtgttcccttttctctgaagatttcaaatatatttgtggtaaaagcagagaaagaagaggagaaaatcataataaaagcacaataatgatgattttagtaaagataagaatggggcatggatcaagacaatgactaaaaccccaggcaggaaaagccccgtggaattggtctgaactgaatgtagcagcccatcagtggaagttttcttgtttctggcaggtggcctatgcttttatctattactgctctgtaatcagaattgagccacgatattcaagtttcttatctgaatgatgggaatttggttttctggccttctgcattttgcaggagcccaagaattgacctgatgttttaaaatatattttccctccaaaggaggagtaaaatccagacaggtgggccattctgtgtgtttaaagtcattgaaaagcctctgcaagtaaaatttgaggctgtctgtaacccacattgaatagttacagatatattttattttggaggataaaaaatcaagaagttactaccacaatttggtgggaattttgaattttggagttttcctttgtactcaagcttcctcacgattcttccaggcagatcaaagccatgggttttgggatcccctaatcgcaaatccagttttgcttcttaaaatctaatcagtccttaagttattttttaaatcttcctttctactccccagttgaaatctccatttctacttctagaaatccagtcaaaccttatcgcctccatttagaactgatcgatagcaactggtgagcaggttaattataatcgcagaataaacgctgaagtctcaaagttcaccacttttgcaatgtttccaaacccctcgggaccatgccaggaggcgctcattgacccattccgagcaggtgtgggagtttgaaccaggggcagacaatcagatctgattcaaacaactcaatttggttgcttatctagaggttttcctatcttatgatatctgtcattttagataaaaaagagttcatcaattgagctgggaaatggcaaagttacattttattctgataaaagtttgctagttgttgttttatcagcttgggttgaaattgtgtctccgtcaaggtctgcaatgaccttttcagatattttatcaggtattaggtgggggagtcctttttttttttttccttctttgacctagaaaagaatgacctgacttccaagatcataaatcaaaccaggtaaagacaggcaataatacaggttgcccctcaaaattgagtaggcggggaaaacaaacaacaaataaaacctttccctagcatttggggagaacttaacttgacccgaaataaagaatgtagttcccacggagtgcacagatgtaggaaaatactgcttattttaaaaaagaaaatgctttccaggcaaaaatggcttcagagaaacacgtagtaattttttttcaagtagtataagggaaacttctttattttatgaaactcaatgtatatttattatagaaaaatggaaaactcacataaaccaatgtaaaaataattggtaatcttaccatccaaagataaccactgttaggcattaatccttgacttccagttatcctacatacacaggtatgtgtataactacattattaagtagtcgtgcaagttactgtttaaagtcatttcagcactgatggcaatttctgtaaaattagtgacccagattggatccttaaacactgatgccatttttaaataaagcagaaatgagaaattgaccagcactgtcaataacagctgaatggaagagttgggtgtaaaaacatattttttaatcttatggtatataatttatagccactttaaaactaaagcatatttgtaagttttaaattagggtccttgaagcgaggtgcccccaggacgtgtgatttactaggcctcactggggaatgggagttgcagcgctgaaatctgctatttgaaaaggggtgacccaagatcccagcagccgcagggaggtgaaagcacattggtctggcgcggagaaaccctgggctcctctcccagacccttctcttcctgcggtgtgactcactgcctctctctgcttgtgtggccatttgtaaggtgaagaattcaggtcaggtacagcaatggtgagaaggactgctctaccgccctttggagatgtttaaaatcgagtgtcttccggcatgccccgtgatagtcattcaggctgactttgtctttcccggtaccacagaggccacattaacattaagccttcctgtgcctgcgtggacatcaaactcgaattcatgcttgcctgtgtcaggtaggtttccacggctgcctgcctcgttttaagcaactctgtgaaatcttgggtttgatggactcatcttttctttttaccttttattttagatttgggggtgcatgtgaaggtttgttacataggtaaactcgtgtcacggggatttgttttacagattatttcatcacccaggtattaagccccagtacccaatgcttatcttttctactcgtctccctcctgccaccctccactctcaattagataccagcatctgctgtttccttctttgtgttcataagttctcatcattcagctcccacttatatgtgagaacatgcggttagtttcctttcctgcattattttgctaaggataatagcctacagctccatgtatgttccctcaagagacctgatctggttttttttttatacggctgcattgtttttcttatgcaaagtgacctcaggtgctctgagtttcctgctgcttgggctttgcttttcagttaataaacccactgagtgttgtctgcaggtctaggcagtggtggagatttcatagaagttcagctcccttcacaccccagctccacatgcgtgatttgtttcatccatccaccagccaataaatacttctccccattccctgtgagcctggcgctggtcaggctgtaaagatacaaaatgaacagaagtgtctccgaatcccagcaacttagagcttgctaggggagggaacacgtggatgtgcactcttaggggcaggggatctgaagcgcaagggggcgaaagtgggttctacggagcccttaggataccgaaactggcctgggcgcctgaagtcaaggccaggcttcctgggcaaggcagacttgtggcatcctaaaggatgagtaggcgtttgctgcctataggaaggccattctgagcccaggacttagcttgaatcaggctgttctgcagtcccgagtggagggcgcgaggcaggaatgcaagcagaagcacggcgttgagggatgttagaatgctggaaaggtgagcaggattcgagcagcacttcagatatagcgctttggttatggtataagaaggcgcaagctcctggctgttggttttgttttgcacccaagcagggtgatgagcgcctcccgctgagtcacccatttcccatcggagaaggaactctggttaaaatgaagccgcacgctacaggccagttttggaggatttatgtggtgtgcttcggcagcagggcacggcggctgtgtggtttgagttcaaattgagggccaagaggggagaaaactcaagccaattttagtccccaaatctggagccctgccctgggaaggaagaggagtgttcgtctgacccagaaggtcaagcatcttgtaattctgccctcttcttgtactttctctaaaggtggtgggatgacataggattacaatatagataattacaggggacaatactatgatgcaaggatggattgccagaccctgtagggtggattcacctacctcccaggaggtgtagaggtgaagaggaagggctcagatcaaccgatctttctttctcatttgaacctctctcactttgatccatcacccttcctttaattttaagttcaatttctaccttttaaataggttaaaaaacatttttttgagacagactctcactttgttgcccacactggtctctaactcctgggcttaagcgatcctcctgcctcagcctcccaaagtgccaggattactggtgtgaaccaccacaccccacctaaataagttttttaatgtgaaaaatttcaaacataataaaaatagagagtagaatattcatccctcagctttgacaaatatcatttcatgaccagctgtttaatctatacattactcactttcccccacacagtgttattttgaggcatattccaaacagcatgtcattttacccacaaatacttttgtatatatgtctgaaaagtacgaggactcttttattttaaaaaatacagccccagtgccatgttatcaccctgaaacaaattgtcactctttaatatcattcaatatccggtcactgttcaatttcccagtttgtctaattgtctttaatgccttgttccaatcaggatctaaatgaggtctaagcattgcctgtgttatgcctgttaagtttcttttaatctatgggtttctctttcatctccttttcttctccttgcattctgtttgctaaagaaatgaggcttttcccagaggacttctgcagactggattttgttgactgccttctcttcatgacattgaacatattcctctgtcccctgttgctcatgtaagtctgtgatgggaaagataggcacactcagattcaagtttgtgatggcagcagccctggatgctcattgcctagaccctttactttgttaggcattgctaatggtaatattctactgccaccattccttcttcatttgttagctggaattcttctatagcaacaagcacatttttagcttattgaatatttggttacttggaggtacagtttgtctaggaaaggcaggatacatgcctgctacagtcgctttacttttcattgttcaaaagaacaaattagttctctagcatccttcaacaattaccaatgaaatgaaattgttttcagcatgattaagaactcatggacttcagctgagtatagaggctcatgcttgtaatcccagcactttgggaggctgaggttggaggatcatttgaacctaggagtttgaagccagcatgagcaacatagtgagagcctgtctctacaaaataaataaataaataaataaattaggcaggggtggtggcatgtgcctgtagtcccagatacttgggaggctgaagagggaggattgcttgacctgggagttcgaggctgcagtgactcatggtccaaccactgcaatcagcaagaccctgtgttaaaaaaaaaaaacaaaaaaacctcatgggtttaaacaagcatgatgtgtttctatccgtatatcctgattgatgttcagattgtcctatctttgctagagggaacttgcttaaactgagctcttttgacaaaatcttagtttaatagtttcttgctttccatcctataaaatgtcctaatctctttttatgagttttctcttgccaggcctggatttggccatttgccccaagaaacctggctcctgttagtgaggaatggcgtttggagatcaatctcagagctagctctgccagctgggcttattgctattgggttagtcattcaacatgcagagtcaggaaatacgtacccctcctaccccaaagataagataaaatacagcatgtcttcatactgatgctttcaattcaaatttagggctaaaaggcttttacttgcttcattcatctttttaaaaaaattatcttaaactatacataagataaaatgtaccgttttagccattattaagtgtacagttgggtggcattaagtacatccacagtattgtacaaccatcacccccagcagtctccggaactcttgcatcttcccaggtgaaactctgtacccattaaataacgtctccgtatccccttccctccagcctcaggcagcccccattgtgctttctgtctctctgaatgtaactactttagttacatggaaggacacagtattctcttgtgacgggctcgtttcctttggcatagtgtcttcaaggtttctccattttgtagcatgtcagaatgcagcatgtcttttttttttaaggctgaataatattccattgtatggatcgatactgtattttgtttatccattcatccctccatagacaattgggttgcgtctgcccattgaccattgtgaataatgccgccatttttacatgggtgaacaaatatctattcacctccctgcttttacttctttatggtatatgcccaaaagcggcattgctggatcctagggtaatgctatgtggtttttagggaccatcatcccattttccagagactgcaccattttatatccttcatggcatctttacatctgtcagtctttccaaaaatcccattctcaacatctccaacgtaattcttcattttctgtatgtcataacatcctcatctctgagtaacaataggaacacttcaccagcagtacgagtcctgaaacccgccctgtgttgcttgccttgtcttgccttttgacattgggctcacctccagtgtttctagctgttggctgtgggctcctcatcaccttcgtgagctggtggcacatgggcaggcatgaataaataagtgccttagggacacatgcacaaagaagtgtgtgtgtgtgtatcaaatgcattgcccacatggaggctgaaggcagagtcttgagagaggaggcgatcagaggcctaacccagccttgggagtgagtgggtgatgacagaggacatggagggaaggaaagtcacaggccaaatagggaaggaaggccatgggggagccagtggccatcgtctttctcttgagctcctgtagccacagtgtgaagggaagagctgtatgtgtaagacgccttccatgtgcccctcatgcccgcagtgtacacgggctgggggtgggtcatcctgacgttgcccgctcaggggtggccttcacgtttgcttcaccgcctttcattctctgctgtccttctgtgttgtcatggaaggagtcacgctctgtccttggagcctcgtgcgcagcccatgcagtccctgtggggctggggtagagatgagggaggagggataccctgtagcaaatgggatccggtcatgtggcccaggccaatgtcatcatcctccccagcagggacttagatccatgttttcccaatagctttatttgctgggtggagaaagtctggaggaacttttgaatagggagttgagtacattttgagtaggttgtgaaagttaggaaagactgtctcacccccagtcctgttgaagccccgtgcatcacgcaagggctggggaatctgattccgtactggcccccaccttcagaagcctccggctccgggcacacgctgggaagtggatgccactgccagggagggaacttgcagaaccgaaggcctctttttgcctggtttcctgttgggagaagagcaagttctacagtatttctggagagtgcttgggttttactgcgcaggctggggtgagtcttggtcttagtggggatggccaaggttcgtgaaactcctgcccctcgctcttcactctggaggtcagacttgctgctgcctgcctgtcgtggcagggaagagcgtggacccagcagccttggctcacagcgagtgctgaccctaagccattattactcggcaccttggcaatccatctggtactgatggcctcaaagagggaagcagaaggtgcatcttgcaagtgcatgaaagccagtggcgggaaaggggcctgggcccggggggtggggtggcttctggcctctgcatctctgtgtggcttgtctctgcatgcagcttttgactcatctccagccacaattcctgagcgtcagcctgtggcctctgttctcattctaccttctggtgctgtccttttatttggattatagttccactagcctggaagtattttcagggcaagaattatgccacatttccttctggggtccggaataccatcacctggtacatacaggacacatgcacgtattccttcacagaaaagatgcagcccggaatccatcctgaagcatttggcagctttggctcacatattcagacctctgtgaaaggctctgctgagacatcttcggcgggagcggagccatccttgtaaaaggaacctgagaaacagaagcccagggatgagcccatgtggatccctggccagttttacagggagaaggaccctgagagacgccagggagattgaggtagcaaaggcgcccaaaacctagaaggccaggaagcgagagaagagcgcagaaagttctaacattatgttctcaaaggtagtaacacgggaacagggcagtgaggtgtggccaacaccggggacctcttgggtctgaggcagggagaaaggtgcaggtggagatgtcccagggacagggggacaggtggcagtggctggactctgagggctaagggctggtgcacatgtgggatactccagtctctgtttgaacccttgagagcaggagagagcccccaggggagtgggggcggtgcagaggggtggaggaggagctctgcagagctgccttctgatgcagttggaggccttgggaggcccagagccaggcaagggagatgaggaagtggataggcgtgtgcccccgtgtttgcctgtagacaccccttgcatcctcacttgatcccttgatgctctgctgggccctgatggtgccctcctggcttccaaaggccccctgccatctttacattccatcagtgttctggacctggagcagatgactcacaatctttccctgccagcttgcagagacttccggagttttcactcatctagtttgtcctttcccatcttgggtgcctcagcccactgtttttccctccaactcactttgtgtagattctccatgatccttcctggagagccccttgaggcaccaggagagctgtgcgtgccagccatgcctctcagcctcatcataacaaacgtcacagggaaacaagctcccttcagaccctgtttaaaggcgtttaaaggcggtaagtgcctgtcagtcttggaggatagtgactcactgcctgaaaaccttcacagaagtgacaagacacttttcttcggggaatgttgatattgagtttcctcccctgtgtaaacacatctccaggagtggcattaataatggggaccctttccccaggacaaagcagaggatggggggagaaggaagaggagaatggacccgcctgctgggaaggggggagagctggccatataagcagctgttcctggtgaagggggagcccattagccagacccttttttcatttgttttcagggattttgcttataatctttatggggaccgccaactttttatttgacagttgataaggagaggcactagagtctagtaagtggttaaagaagctggagtcaggcacctgatttaaaattcctgctagcctgggtgcggtggctcacacctgtaatcccagcgctttgggaggctgaggcaggcagatcgcttgagctcaggagttcgagaccagactgggcaacatgatgaaaccctgtctctactaaaaatacaaaaaattcgcccagtatggtagtgtctgtctgtggccccagctagggaggctgaggtgggacgatcacttgagcctgggaggtggagactgcggtgagccgtgatctagcctgggtgacagagtgagactctgtctcaaaaaaaaaaagtaaaaaaaatccagctttaccccgtataatgtcacccagttttcatgcccataaaattggaatggaaactactccatagaggctaagaaatattattcataaagcatagtactcggcatgtagtaagtgtctataaatgttagtctgcatttacttatttatttatttagagatggagtttcacgcttgttgcccaggctggagtgcagtggtgcaatctcagctcactgcaacctctacctcccaggttcaagcgattctcctgcctcagcctcccgagcagctgggattacaggcgcctaccaccacaccagctaatcttgtattttcagtagagatggggtttcatcatgttggccaagctggtctcaaattccttatgtcaggtgatccaccgcccttgacctcccaaagtgctgggattacaggcgtgagcctctgcacccagccaaatattagtcattaagccaaccattaataaatgctattatcattaaaggaaatattgaaaatagtatcttttttgttttatttttggttttgtttttgaaacagggttttgctctgatgctcaggctggagtgcggtgctgtgatcatagctcactgcagccttgaacttctgggctcaagcactccgccttcctcagccttctaagtagctgggactacaggtgtgcaccaccatacccagcttttttttttttaattatcattttactttctgtaggggcagggtcttgctctgttgcccaggctggagtacagtggcatggtcatggctcactgtagccttcaactcttgggctcaagcaatcctccttcctcagcctccaaaaatggtgagattatgggtttgagccactgtgcccagccctggattcaataccataaagggttagattgcacaggaggctgccaagttgaattaagtggggttttatattagtgagaatttgccttccttctcagtattaatctacatttaggtcatagaccccatatccaacttactgtctataatttctcttacataggggggcacatttagataagcacagactaattggggttatagtcatagctttagaatagtttaaagacctagctgacggccaggcgtggtggctcacgcctgtaatcccagtacttcgggaggtcgaggtgggaggatcacttgaggtcaggaattcgagaccagccgggccaacatggtgaaaccccttctctactaaaaatagaaaaattagccatgtgtggtgacaggtgcctataatcccaactactcaggaggctgaagcaggagaatcacttgaacctggttgcagtgagccatgatcgtgccactgcactccagcctgggtgacagagcaagaaaaaaaagatctagctgagggagttgggaccagatgattttctccagtgatgtttgaacaaaaagaaaaaatgcagctgggcgcggtggctcatgcctgtaatcccagcactttgggaggccagggtgaacggatcacgaggtcaggagttcaagactagcctggccaacatagtgaaaccccatctctattaaaaatacaaaaaattagccaggcgtggtggcatgcacctataatcccagctacttgggaggctgaggcaggagaatcatttgaacccaggacacagaggttgctgtgccactgcactccagcctgggcaacagtgcgagactgtgtctcaaaaaaaaaaaaaatgcagaagctacttaggttgaacacagaaaggaagaaggactgtgtagttcagtagtgtgtgttctgagaaagccctcacagcgttggtctctagtaatctctggaaataagtgaatcattccagcttgaattatcatgatgcaaaattgtgttcgctgaaaagcaggggttaagtccgctgccttgtgaatttccgcctggaaatgcatctgacccatggtggttgctcaattctgagtgagtttggagaaggaaggaaaatgaggagttacttattagttagtcgttatacatttttggtttttaaacccaatatataattcctggatattcctaccacttactatttgttgtcgttgtttctattgtttttgagagaaggtcttgctccattgcccaggctggagtgcagtggcgtgatcatggctcactgcagtctttacctccagggttcaaggaatcctcacacctcagcctcctgagtagctggaattactaccatgcccagctaacgtctatattttttggaggtagggttttgccatgttgcccaggctggtcttgaactcatgagctcaagtgatactcctgcctcagcctcccaatgtgctgggattacaggcataagccatcgtgcctggcctcagtgagtggttttgtgggctggagtaaggatccagctgtcttcgctgcaggagtgacagggacgtggtgtccatctcagaggagccaagtgggcttgcctaggctttcgattcttgtgaagatgagtgaactgaaaccagacacctcttagatctatgggcccttctacctctgatgatctgtgagattcagtgaaggtgaacagtcactgtcggggatgttttaatgattttactaaaaatcggaatagaatgtgaaacagggggatctgaagagtgattatttgtactgttctggtcaggagctgggagctttgtctggcctccacgtaggggcctgaggacaagaactaggcagaggtgcagacagcgaagaggaggatggctcctgggtgttcaggccatggccagcctggtcagcagagcagctgtgggaaaagggatgatatttggtggtagcactgaggcccagccaacactgagcgcttaggatgtttcctgctgccctggcattgttttgttatttattccagcgactgtcctgtgggcaggaactgtaatgtccatgggcaggagaagaaacccaggtcacagggacctgcccaaggccacagaaggcccgaggctggcgggacctaggtcagcctgacttccccggccagtgccctctctgtttgtctcgtgtcatctgccttgggagctcacatttcagggcatgtggcccagtgcccactgaggtgcagcccgcgtgcctggacggctctgtcagggcgagcttctcgggcagtcttccttccctctccatttgttgctgcaggattctcctttggtcctgacttttctggtttttcatttccttacctgtaatctgttcactcttggtcagcaagagaataatattgcagctaccactgcctctgagtttcctcctggaagactgagtcttatgaagacccggttttgaggagtttcctggctggatcagcaaaaccacagtgatccacatttgattgatgtattttgagtttacatttattcccaatgtttattttcttgtaaaaatgagcgcattattgattaaaagagagagacacaatatccaaaaggtggaagtagcctaggtgtccatccgtggatgaatgaatgaacaaatgtggtctgtgtgctcagtggagtattactcagccttaaaaaggaagtcttgcactgctacaacagatgaatcctgaagacattacgctaagtgaaacaagccagtcaccaaaggacaaacactctatgatcccacttctgtggggcccccagagccgtcaaattcatgacgacagaaagcagaagaggggttgccaggtggtggggccaggatcggggtgcgggaggatggggagttagagtttaatgggtgcagagtttcagttttgcacgatgaaaacagttgtagagattagtttcacaacagtgtgaacacatttactatcactgaactgtacacttaaaaatggttaagatggctaattttatatgtattttatcacaatttaaagaagagaaaaatggagaggcagtgtacaagcttagtaagtagaaagtaaattgtgaaaacctttttcctaacacttcattctatttgcttctttggccaaaggtgtaagtagcattgatggacgattaggtagaactagccatccagaattggttctacaagattgcctttctggctcttcagtgtttctctttgcccaagcctcagtgttatcctgctatcacagcagggctgatcactaaggagaaggttatccttggtgaggaggtggaaaatggtgatttttaaatgttgtactacaagcaaccgagttttgatctgcaaatctatcatatttataatctgcattaaaattttaagtcacattcataaaatataggagtggatgcacttttaaaatttctttggaatgcaaatcagattggattaaagctattaaccatgtgtaataaaagactgtagattttgtagcagcttcatgctctacctaagatgtctgccaagtaagtgaaatgtatttgtaaaaaggcagatggaactactagacgtattgtcatcgaactattctccaggggcactgatttcagtgcaggtgctttagatgggaggaaggctgagagcagggtctgtggggcccctattgcagagaagctccgtttcatctactttatatttgatttgtaaatgtttgatttgcttggctaaagaattctgaggctagagcaacaaaacaaaacagaaggagagaggttgggaagaaaacgtgaagtaacaccaaaaaactaactgctattgcaaaacaaggataaaatagataattcaagatagatgtgattgattgccataaagattcatgaacacgtcaggtgaacccgagtctggaggctagaggaagaggagccgacggaatttgaggaggatgtgtgtctggtctgaagaggaggtagagacttcctgcgaaggctagcagagtaaaggtttgctttctccctttcctccccgaagaccagcacatcagatgaaaagaaccccccaaatcaagtaaaacttttatctgcagtgaaattaagagataactcatatccccaactatagaaaactgccgaatataatataaatccagaccacatggagggaaagacttcgagagctggtccatacctctcagctctcctgcctgttcgcctcccaaatgcccaacctccaaataccatcacatgtgggttagggttgccaggagtaaatttccttgttaataaaatgaatgagataggaaagaaagcggcaatgttttcattatttgcagataaaatactggtcaacttcactaaacaaatgtaaattccctgtggagggagctataaagctttactgaagggcataaaagaagacatgaataaatggagaaagatactagatccttggattggaaaagttggcagcattctttattccaaactccctcaaacaaatctataaatttaacacagtctcaggaaacatcccagcaagatttcttaaatacaacgtgtccagctgattataaaatttatatgaaagagttattgtacaagaatagccaagataattttttaaaaggagacttaagaaaggggaacttgccttatcagaaatcaaaacaaactagagacacactggcacggaagctaaagcagtgatgttcattgcagccctgttgtgtgtagcagtgaaaaattacttgctgaaatgcagccaaggtattaggaatggggaggctgtggcataaaaagattggcattagcattgaatcctttcaaatatcatgtacagctaaacagctgtgagaattatggagtagaatgtaagtgttatgtgccttaacaatgccaaactaataaatcctcttcgaagagagaagtagatctgtgctgatatggaaaaatgtctaaacagatatgcgtccctgcagaaacagctgcagaggagtatccatggtatgatcccacgtgtgttcagcacactgctctgttctttcctgtactgagggagcccatttctggtgaggattatttccaccaccccgatgacacaggcttggctatgagacttgctttgatcaagaatatgtgactcgaagtcactatgcaacttccacacagaggcattaagagccattacgtggttctgtcattactttttgccccctgccacgaggctggcatgaaccacatagaggttttgccttcggcctgcatgtccaattgaagcatacatatagaatttcggccaacttgcagctgacatgtaatgtgaacagcaaacaaataactatttgtttgttacagcataacagcttaaacagcaccaaaccaagcataagtgttttatacatatacatttgaacatggctaaaatatatctcctatatcctagatacacttttctcatgtgtataaacagacatgtacaaggatgcctgatgaagcattgctattacagcaaaaaactgaaaacaatctgaatatatatcagtaagtgtcttagccagtttaggttgctgtaacagaataccatagaatgtgtggctttaacaacgcttatttctcaaagttctggaagccaggaagcccaagatcacggcactggcagattggtgtctggtgagagacccaagcctgctttgcagaagaccatcatctcactgcatccactcatggggtgggtgtagggagatatctattctgtcttttcttttcttttttttgaggcagagttttgctcttgttgcccaggctggaatgcaatggcgcaacctcggctcactgcaacctccgcctcctgggttcaggcaattctcctgcctcagcctcctgagttgctgggattacaggcatgcaccaccatgctcggctaatttttgtatctttagtagagatgggggggtttcaccatgttggtcagtctggtctcgaactcttgacctcaggtgatccccctgcctcggcctccgaaagggctgggattacaagagtgagccaccgtgcccagcctctgtctcttcttataagggtactaatcccattcatgagggctccgtccgatggcctgttcacctcccaaatgcccaacctccaaataccatcacatgtgggttaggattgcaagatctaaatttgggttattcacagacgtttagtccataaccataaagaaatgaacaagtaaaatgtgatttattaatataatggaaaactgtaaatcaactcaaataaagcagatccacatgtataattaaaactgggaaacataataggcaaaaaagagactggaattgtgggttacacagaggcatctactgtatctgcaatgttgtatttctttaaaaacatctgaaggaaatatggtaaaacaaagatttgaaaaagctggtggtgggtttaagagtgtttgctatatatttttttctcaatgactgaaatatttcatattttttaaagaaagcattcatgtaaatctttaaaattgcaaagcaatgcttatgttcttcagaggaacatttatccctgtgtgtagaagtatatagattaattggaaggatatacactaaattcaatatagtgattggatagcagatggtgggggaataaacagaattgttacagtgtcctttgtgtttttatgtaattttaaaatttctaaaaataaaaatgttaattaatgcagtggaagatatctggaaaaacaggaaaattgttagccacctctgcccctggagatgggatcatggtgatggtggagactttttgtttgtttgtttgtttctttctttctttcttttttgagacggagttttgctcttattgcccaggctggagtgcaatggtgcaatctcggctcactgcaacctcctccttccgggttcaagcgattcttctgcttcagcctccccagtagctgggattacaggcatgtgccaccacgctggctaattttgtatttttagtagagatggggtttctccatgttggtcaggctggtctcgaactcccgacctaaggtcatccgcccgcctcggcctcccaaaatgctgggattacaggcgtgagccaccgcgcctagctgagaccttttgtttctacgtgacattcttctgtaccgtttgcctgtttgaaaaaaaaaatttttttttgagatagggttttgctttgtcacccaggttggagtgtggtggtgcgatcataactcgcttgcaggcctgaagtcccaggctcaagtgatcctcctacctcagcctctggagtagctgagactacaggcgagggccaccaagcccagctaattattattttatttaagagatgtggtgttactatgttgcccaggctggtattgaactcctgagctcaagccatactccgacctcacaaagggctgggattacaggccagagccaccatgcctggcctgtttgaatttttgtagcaattaaaaattgcgtaatttaaacacaaattgaaggggacagggactaaaaacataaatgagagttagaatgcagtgccacgttgaatgctttcacaggtaggagcctagaaatcatctgttccaactactgcacttttgagttgtggagaccagaccaagagaggtgaaatgactgttggctaaggcgtccacctctacttgcgtctggaattgcccctgcctctgcctttaagtctggtctgcgtggcttctgatagcgaagccaggggcggaccccgttcactgcatcaggagagccctgagcagcgcttggcaggaactctgcagcccagggcgccctctagaggctggaggaccttcgtcaagaccccggggggtgtggatgtggacctggaggagtggtgggcagaaggcggagccaccctttcacccagtcaattgcattcctctgtctttaatgttgggcttcctcagattagattttctttgaagaaagagttctgcagcttaaaaaaaaagtgacagaagaatcactggtgcagagtaaggtatagcgttagcatttgatctgatattatctagattcttttcacactaggaagcacctaagtcatctggtctaacaccttccttttacaaagaagatctgaggcctatataggcaaaatgtgtgctgcccaggtccacgactgcagggcattgtctcctggccctggtaatgtggtcttcattcttattttttgttttgttttgtgttaactgaacttagaactaaacagatcccttgcaacttggcttagactccatatttcatgcaaaaagctttcagggtagcagggtgactcggtggattagcaggagaagaagatgtaaagtgatggcgattggagcttaacctcggtttgattaagtaatcccccagacacccccgagaggggaaaacagtccccacgtataaatttctacacccttgctcgcctcctcttctgaaaggcgtaaatctcccctgaaatgcctccctagcattcagggcaataaagaggtcacattatatctccataaatctcccagctggctgctgctgctgccattccagaggcgaaggggaagttgtttcctcctgacggcaggccatgggcctggaaggaaaagcctctccctgcagacccattgtctcggtccctgagggagctgccctggcaatttattcaatattccctttccgtcctgccagctcctaactggggttgcagagtcaaatggcccagactagcccagcttaagtctcctctggccaaagctccattgcaatcttcctaataaataaaagaaaccaggaccatatcacagcattagaagccaggccagggttccctggggctgaggctggggctcgctgggacaggagctagggtgctgtgaaagatgacagcgggtcaacagcttcaggagtgcagcaaagctgaggacccacttgggaaatgggttccattttcccattagggaattaagatgcttttgtaggaaaggaaggtgggagaaaagatgcttttatggaaaaatctgaaaatggaacctgcccagctttaaattaaaaatgttactgcatgaaagagtgatgatgctagcccctgacatatttatgtattttatttaacatgcaaaataatcataggacagctatggtggcgcacgcctgtaatcccagtgctttgggagcccgagcctggcggatcacctaggctcaggagttcaagaccaccctgaccaacatggtgaaaccctgtctctgctaaaaatacaaaaattagccaggcgtgatggtatatacctgtaatcccagcttttggggaggctgaggcaggagaattgcttgagcctgggaggtggaggttgcagtgagccaagatcatgccattgcactctagcctgggtgacagagcaagactctgtctcaaaaaaaaaaaaaaaaaatcactatcacaaataagaaatacattaacataaacatagttgagtatttaaaaggtacacaacagcaaacaatgagaagtccttccgtgagccaccaagacacctccctggaaacaaccagcatgatcagtttcttgtctgtcctcctaaaaatgttcattctgtatataaacaaatccatgtatagattcttctccccttctttttgtaagagaatatcaatgtaatgtccatgccttctaatatttcatagcatatactgcaagaattccatatcagtacatcaagatcattgtttatggctacatagtgtgccttaattgaattaaccagtccggtattgatgaacgtaagagttgtttttccagtcctctgctatggaaggacatgccatagtgaatatccttgtatataaaccattttacacagaagtacatctggaggataaattcctggaagtggagtttctggatcaagtgacacatgcatttatacttttgataagatattgccaaattgctttccccactggctgcggggctgtagcatgtcacacttcccatcaatgcccagggtgtctgctttcccacatcccccaaccccagggcacagtactatgactgaggcaagctgggaggagcctggagaggggcatcatcacaacacagtgacttggaggatccaggaccagtgccagactttgtccacagcgtgactggaaagctcttcatgtacattctaccctggctgggactgtaccccgaagggagggcctctccctttctttctgtagagtgggaggaacagttggtgccacagcgatgcctgagcccagatggggctgccactgtggtgggaggcagctgggaccgaggtggaaaaagtactttgtactttttctttccggccaggaggatcccaggaaattgaagaaaataaacatctccaatcctgcagtgcctaggcagagatgcttgcttaattaactgcatatttaactaatttaaaccatgttacaggaagagaaaatctgaagaacatagtctatccaattgtcatgtaataaaccaactccaatttccgtatggctttggtgaaactttgtttttgtactcattcctctaccattgggcgttttggttgtttccagtatttggcaggaatacctgaaaaatagatattttccctttaaaaaagtttattccagtgaattattagagcagttttattgctagcaagagtgggctggcttttagtgcaacgtggtgtgattttccatatacatccatcatatatgattttatatacacacatgtatgtgtacacacacacacacggaaacttctggccctgcatagataattctcacagctgaattatattgtgtgtccaggaacatggcatctcagtggccgggcagcccagctggccggaagccgagccctgggagtgacgctgtcccatcgtcatttcggccgcctcatgggactctctaggcactgggtttgttgaaactcgatggctctgtgtgcagagcttctgtcgtgtgcggagcttctgtcgtgtgcggaggagtttctgtcgtgtgcggaaggcgaggactgggagctcagatgaggcacttgcccggcctgctctgcaccttggttttctcttatggatattcacgaaatagcccagacccagcttgcaggttttaagactgtaccactgtgccacctgccccttgctcctggaccctcgcagcctctcccacagaaggactggggatgtgcagagagagccgactcaacaaggcagtggacagggaagcagcggcgggggcacccttcgcatgcagtccccagaggccaggaaggagcaaatattttcaagtgctgatccccagccagggctcccctggttgtatctgagcctgaagccggaagccccaggagctgcaggacccagtgcccaatgcgttgtcctggcctctttcctggcatgctgcgtgtggcttttctggaagggggcaagtcagccgtactacctgtcagccgggacactagggagacacagagaggagggatcagcatgtcacggatgcaggtctcacagtgaggtctgcagagggtggccacacaccctggtgtgaagactgtgctttcagaataattagtaatatgccccctcccctcagaagtgtcccattttgtatggtaggtcacagggctcccatattaatccggggaggcggacggcacaaagaggagaaccttgtcccaggtttcggggtggggactgctgggcagggtccctgcaaacacagcagctgggaggcccaggcccctccactctgggactgatcgtagcttcccacatggaggcccccatgaaaactccatagttctttcacctgagggtgacagctggcaagacagtctttgtaaaaaatgtattggtataggggcaaaatgctgccattcgggagagttttcaaatagaaatgtagagctcactgcagtctttcagtattgccttcttttctttgttccttttccgtttttttttttggagacacggtctcactctgtcgcccagactgtagtacagtggcatgatcacggctcactgcaacctctgcctcctgggttcgagcaattctcctgcctcagcctcccgagtagctggaattacaggcgtgcaccaacatgcccacctactttttatatttttagtagagacaggctttcaccatgttggccaggctggccttgaactcctgacctcaagtgttccatccgcttcggcctcccaaagtgctgcgattacaggcatgagccaccacacctgaccctttgcctgtttttaaaatggtatcccagcctgcggttctctggtgggaaggggccatggtgaccattttctgggagtctgcatgtttagtgtcgagatgcagcaaatgaagtcttattcaccaccatacttttgtttcacttgtttcaagaaagtgcttgtggccagaagtggtggctcatgcctgtaataccaatactttgggaggctgaggcgggaggattgcttgaactcaggagttcaagatcagcctgggcaacatagtgagaccccatctctacaaaatgctagaaaaattagctgagcgtggtggtgtgcaactgtagtcccagctactcaggaggttcaggcaggaggatcgcctggggccgcgaagtcaaggctgcaattagctatgactgagctgctggactccagcctgggtgacagagcaagaccccattgaaaaaaacaaacaaacaaaaaaagtccctgtgagagcaatgcaacagtccacaagttcgcggacttagctctatggcattgtgattgcagaggctcagatttgaattcagaagcatcctacatttctcctggagccagcaactgatcctgcattttatggggaaatctttatgctgtaattataggcccacatggaggggttctcgaaggtctcaaaatctaatcttgacaatgatgaaggccaggaagcgtttcccaagtgggtgagctgagaagcattgagacagagatgttgggaagtttctgagatcagacaagatgggaaaacagcatgcttgcgctctgaactcctgcagcccttgctgctctcaggccaaattgagactgattttccatctgctgccagcttttgccgctggggaaggggtcagggatggccaaggcatctgtgggcagcgctggtgggacgctggcctgcggttaagagactgactgcccagcctgggttcgatcccactttgctgttgattagctctgtggccctgggcaggatctgttctctaaagctcatgaactttcctccattgccatcctctcctggaccagcctcccacgctcaccctactatgagcacagaccaggcaggtgtggaggtgctgggagttcttagacctccagggaggagccgctggggcccagggtgtcaggggcttgagtctttccacagttcctccagtgacaggtgtggttgcctgttacagccttcacgctcatctttctctttgtcatttgtaaaacctctttgcatatgagcgggtgtattttcccctatcatttgttcttcaacctcttcctcctctatctctctacgttcccccctccctccgttcttgtttttggtgttttgttttttttttttcctttccctttccctttcacaatgtccttgcctgtttgtgatttaggaaaaacaaaacaaaacaaaactgagtcacattctgtcactccagccagctgacgtcctgggttcttgtcctttataagggtcagaagcagaggccttggactctgtggggtgactgcaaggtgggcggtaactggtaaccgcctctgttcagcagctgcaggagcttccaaaataggtgatttcatccccggccggagcgccgctggagctgtgtgggcctccccgtgacagcctcctgtcacaggcatctgccgagcctgacgaagcccagaagacccagggctcaagagctgccaggaaaacctcaggctttgtttgggcctcgtgccccacacccaggcgccagccgcagggacagatccgggcctgtcgggaaatccaggctccatctctggtgaactctggatgggacatgggcctggggttcagcaagggacatttgggtggggctgagactttgctctgaagcccctttggttcccagggaacggtttctgggcaggtccctcccctcctgcccagtctgggctggggtctggccctttccaagaaagccttctgtgttgtatctccttggccccctctggcccctcttgtgtagcactgcccagctgccccgggcacgggccctttccactgttgacgtgtctctccctgaacgtccaggatgctgaagatctgaagctggaggtggtgggctgggcaccactgtgaggcccaggcccactgccgtttgtcatcacaaaggtagtgattatttttgagttgtgcatccccagctagaccaaaacaactttgggcaaggagttagcatggattttgccaacatgttcgttacgtctagcacttggacaggggcgcgtatacagacgcatggcagatatttgagtttcaggcattgctgtgaaggggctgagacccatcaactctgcctccaggcatgagggtgagggtcttccaacacaggctggggctcaacaccagctctccccagcaggtggaagtctgaggggagcatctgcaggagagcagaccaggctctgtggcgccgatggggcggcagcagtggcctgagctgtctccccagcggccagcagtgcccaggggagggagtggagagcggaaccgtgaccctggcctctgattcctctccctttcttcctcccgtgccttccctctccccgccctgactggcctccccttgttggggtgggtgggttccccaagatggatggagcaggtcagaggagaggagaggtcggtgtctttgcctctggctgcgtcagttctttgtagggaagtcaggggtgggatgtttcaacctcctggcctgcattcttctttcaggcactagggtgggagcagcttgtttaattgataggaatatccatactgcaccggctcgctgagaaatcagactatcagactttgtttcctctttaaaaaaaactttttttagcaaggtatgggaggaagtgaagagtgagatccccatccttggagttaggacaaaatttattttgtgcttttcattgctaaactaatcattaattaatacttcccatgagaagcaacttggagactgagtacaagtgaacgcggtcagccttgctgtcagttggttcctggcttgcagtctcaaacctgaccgctgagagcacagacaattctgagtatagccccagtggtttaagaaaggtcagattccccagtctcctagctcttttatctgtcctcccctcctccaataaccagcgccaaagtttgtcctggtctttcccactccctcctgacccctccaacttcagcctcctaacaataatccatcattgttatctcatttgatgtttgcaaagcactttacagccattgttgtaagtttttcctctcatttgcaaagtactttacaactattattacaagtctttcctccaaacgtgggtgatgccttccaagtggctggaggagttcccgggatgccagcactgggtgggaggggctgcatccgaggccacagctgtgccccctggcttcggaatcactcttgcccccagggaagttcctctcagtgcctttcgtaggaaggaatgagaagtggtgcttaccgaggttcataccagatgtcagtgctagtttgggacttagttagtgctgtgtttgtgatttaacattgtagggccaacgttttcctctatggttaccttgttttggtaataattgtttaaaaatatgtgtaacatttcatggagcaggttggatggcaggattttgtggttggaaatatggaaacttctgccgatttggaggtgtaggaggttgactattggatgtctttaggaagcatagcctttactttggctgttttggtaacccctgacccttctatcgcaatgggacttctatgctggtgggaattccacactttctgccctagacaattagggtctgccatgagtcccccactctgctgagggtgtgttctaaaaatgaactaatattattagtcattattgatattcaaatccaatttgtccaaatagatcattagcactctgagacctgggttccctcctagctcctgtgacatctatcagagtgattaaatagcagatgctcagtaaatatttgttggtggcaaatacatacttggcaacctccagtgactttacctggacagtaaaataattgcttgaatgcataacccaactttgaggtgagcctgcaggagctgctgaggcacacctgtgtgttgggctctcaaggcagccagaggtgagtcggcagctgagatcacgctccagggattcctgcgtcctttaataagattctggggtgggcacagttctggggtggacatggtggctcacgcccataatcccagaactttggaaggctgaggtgggaggatcgcttgagcttaggagttcaagaccagtctgtacaacacagtgagagcttgtctctaccaaaaaaaaaaaaaaaaaaaaaaaaattagcaaggcatggcagcatgcacctgtagtcccagatacttgggaggctgaggtgggaggattgcttgagcctaggaggttgaggctgcagtgagccgagatcgcagcactgtactccagcctgggggacagagtgagaccctgtctcacaaaaagtttttctttacatcagtgtagtgtgggaaaaagaaaaaaaagactccattcctgcatataaaacaataattgtgaggagaaaagagaatctcccctccgaacaagaggaacacattatgagatgtttttcacttaaatgaaccagaatgtaggagagaggccagtttgcttatttttaggagtgtgactctatctgttagaggaacatactgagatatttatgaataaaataatagaagtctgggattttcttcagtaacacaatgtgggggaaagtgaatggaggtacaggtaagacaagattgaccacaaatgattggaagctggatgatagttaagagttcgttttcatattctgtccccttctgaatatgtttaaattttttcataataaagaaaaatagggctgggtgcagtggcttatgcctgtaatcccagcattttgggaggccgaggcaggaggatcacttgaacccaggaatttgagaccagcctgggcaacacagtgaaaccttgtctctacaaaaattagctggggatggtagcgtgtgcctgtggtcccaggttctaaggaagctagaggttgcaatgcccactgcactgcagcctgggtgacagagtgagactctgtctcaaaaaaaaaaggaaaaaaaaagatagaaaaagtaaaatagactgaggcaggagtatctcttgaggccaggagttggtggctgcagtgagctgtgattgcaccactacactccggcttgggtgagagtgaacccggtctctaaagagcaaaataaaataaaaaaggaaaccagaatgggagggttgcactaggtttggaatggaaaggtgatcttacaaggcctctatgtccaagtgcgattcaggctagaccgcgtgtcttggttcaattttgagatggtagcgccacctagtgtttattgcgaacacccaacaaaacgacgacgttgcccgcgcccgcctcttgctgtggagtgggcttggtctaatgtccttctgtaaattcctggcctctttaatcccctcatgggcaggcctggatgaaagaagcggggctgacagcccataggcacggactgtagaggtggcaacagtagtgttgattgtggtggtccagctgggagcaagctatgggcgggagtggccgcatctcatgggcggctctgagggcaggcgaccttggtggaggctgtcagtgtgacccaggtgtaaaaatagcctctgctgtgacgcctgtgctccgctccctggcctgagcaaatagccccttacacctgcacactgtttacttggtgtggacacacagctacctgtttgcaggtgcaaatgactgtttgtgtacccagagttgtggggagggccccccaccatcctcttctctggcccacattcccctagagcaagtagctgggccacataactagcaaaatgcgcaacctcaacccactcccgagctgggtcctgttggaaagagagctctttaccacctgtcctcccaactcaataaaagcacccctcttcactagagaaaaatctgcccttgcctctggcagcagcataggaagaatctggagaccaaggtagatgtgttttgggacagcaaattaggataacatgaagtcagagagacttctggagatggtgagccaggctttatagagactacggggagcaagaaaactggcccagcctgtctcacgagggtgaggagaatggacacaggtggaatctgtcaattgtaacattctgtagacatggatgataaaggtgatggcggggaggggtgagcgagtgaagggagcggcagaccccggcagccttgtggtagctggggagatgctacgcttatgtgagcagctctaaagtgccattgcttataatatgcacctttattttatataccaataagcaagaaaaatgtccaactatgatatggcagcccatacaggtatattaaaacagaaaaaatgaatgaatgaagctttttttgcaggacagttagcaaattccaagaactgaaaaagaaatttagtgcctttgactcagaaattctacttctcagagagtatcttaaggaataactagaaatgcacagacttaagtaaggagcagtgtttatgaaacaagaatccaaaactggatgaagattaatagctgaatgatactagttaaatgatggcacctttatatgatggaacaatggtatatgagtgtataaagaattttataaaatgagtttataaagaatttgtcattgggaaaatgttttggtattaagcaaacgacccacacagactcagaattatatagcttggcaaaaatatggatcaacatatgaaagtctcacaaggccgggtgtggtgtactcacccagtactttgggaggctgaggcgggtggaccatttgaggtcaggagtttgagaccagcctgatgaaaccccgtctctactaaaagcacaaaattagccgtgtgtggtggcgcatgcctgtaatcctagctacttcggaggctgaggcaggagaatcgcgtgaacgtgggaggcagaggttgcagtgagctgagatcgcaccattgcactctagcctgggcaacaagagtgaaactccgtctcaaaaagagaaaagaagtctcacaaagggctgggcacagtggctcatgcatgtagtctcagcactttgggaggctgaggctggagtatcgcttgagcccaggggttcaaggctggactgagttatgactgcaccactgtactccagcctgggtgacagagtgaccctgtctctaataaaaagaataaaataaatacagtcttacaaaggatacaatagaaccaaatgctcaaaacattagtgacaatctggattttctttatatattttggcactaattttcctaaggtaaatatttattatatctttatgcaaaaggaaaagtaatcttactaactttgaaagggaaaaagagagagcaaggtttgcgtggacctcagtgtgaggtgagaggcctagggctggaggctctgaatgtgatacctggactgaaatccaggtgtcccgcctcccagcccaggacgtgggtgatcactgcaactttttcctcttctcgtgctcaggggaactctcagtgtctgggattagggagcaggggctgaagtcagagtgaggaagagcaagagcagcccgaggtggtcttctccttccaaggaaagggcattgtttctgtgcgctctagattctcagatgtgagagctgggcataaacaaagaattaatcctctgtgtcttttcttgtctgttccccccaactcagtagatatgtttgacgacttctcagaaggcagagagtgtgtcaactgtggggctatgtccaccccgctctggaggcgagatgggacgggtcactatctgtgcaacgcctgcggcctctaccacaagatgaacggcatcaaccggccgctcatcaagcctcagcgccggctggtaagcacgtgcctcgcagcctcctctgggcacctggctgcggagctctcgccttggtgggacatcctctggttttgaattttggaacttgagggtgtgcatcggggattacgtgggtgagagccccataataattctcacaactttagagttagctggagccaccagaatgatccaggctgtctagttcaacctcttcggcacacagaaactgaaagtgaggctcagaaaagctagtggccttgcccacagccactcaggtactgagtctcccatctagaactctggaaccagaatccaggtttcctggttcccagtccagtgttgactggagtgtctcctccacccacaccaaccctgcaaggaaggtcacctcagaggctggtctctaccctgacctcagttgatcagttgataaatcccaaagcccagaagtgcaagcagcttgtgttgggccccgtggctagggaagagtttgggcctggggcttggctcctggcttcctgctcctttttaatataatttgattctggtcaacaccaaccagcttgcactatattaaggagggaagaacagaggggataaacctggtgcctccctttcttgaggtcccagggccattcagactttgataccatttggacaccgtgattcctcactctctgcctgcccccggcacctgcagccccggtcagttctcctctcaggagaagctttcctgccggcagtgcccggcgctcactggttattcgcctgatggtgaatgatggttaggaccggaaaccaggtctcgatgcccacattcgctctcctcgggcagcagaaaccttgttctgatttattcctcgcagtggcgcaggtgacaggagagttaggtgccgtcacaggtcagagatctcatgcagggtcgttagggcccagccctgcctcccgttagggaggcccagctccgcagccacacgcgaggtggaagggcagtgcacaccttttacttggacatgaagcatttgtttcctgtcttgcagtccgcctcccgccgagtgggcctctcctgtgccaactgccagaccaccaccaccacgctgtggcgccgcaatgcggagggcgagcctgtgtgcaatgcctgcggcctctacatgaagctccacggggtacgtgggtcctgcgcccatgcggcatccttgccttctgatgcccatctctcagtcctcccttgtcttcttcctttgtactagcattcatttttccttcttaacaaagagacttagatttggaaggggctttcaactactttgctggcctcttccgtcctttacattgtataagtgaattttccgttttacagatgagcaggctacatttatatgtagcagtttgatgtgtaacaaaggtgacgtttcgattcagtggataagaagcttaaggatagttgtattgacaaaattggctgttcatttggaaaacagaaggaaagcatgacctctacctcctaccttaaacaaaaataaacttgggtgaattaaggatattacatgtaaaacatctttgaaataaactaaaagtaaggccaggcatcatgactcatgcctgtaattgcagcactttgggaggctgaggcagaaggattgcatgagctcaggatttcaaaaccaacctggacaacatggtgaaactttgtctctactaaaaaaaaaaaaaaaaaaaaaaaaaatctagctgggcatggtggtgcatgcctctagtcccagctactcaggagtctgaggtaggaggatggcttgagctcaggagtttgaggctgcagtgagctctgattgtcccactgcactccagcctgagtgacaaagtgagaccctgtctccaaaaaaataaaaatattagataataaaatactgcaaagaaaatcagacaataaaaacactggaagaaaatgtaagggaaagtatttatataactttggggatgggagaacttcttaaacaagattttaaaactttttagccatataagaatagttagatatatttgattttgtaaatatttactgtttgtgcctggaaatgatacctagggaaagtaaagaccaatacacacagtatcagaaaaagggttaatatttccagaattacaaggagcttctacaaagctctttaatttttattggaacattctccattatacaatattaacaaaaaggcaaggtgcccaacactacctactatggcactatttttataaatatgaggaagaatataatttataggtggttgcttccacatatacagaacacctctggtaggatatgtagaggttggtcacatggtcacatgtatgcatatatacgtacatggggtgcctccaggagaaaaactggggtcccggggagaagggattggaaggacactctttttgctgtgtacccccttggtaccttagacgggacatatgcaagtcttaattgttcaaatacaagttaaattaaaaccaaaccaaaccagaaacagataggtcttgtagcctaataagaaaagaacaattgatctttccccacttcccccaaatgggcaaaagatacggactgacatctcacagaagctgcccagatagccatgaaacatgtgcacatatgctgaatctcactaaaaatcagagaaatgtacctgaaaatgaccatgaaagtccctagtttgcccatatacttggcaaaaattaaagtgtttgctgctatggatttggggaattagatactctcatatattattgatctgtatttgaattactgcatctattaacttagtggtattttttaaggttgaaaccatgaacaccattatatctggcaggtctactgttgggaaactagcctataaaaaataaccagtacatgatgacctttgaaccatttattgctgcattgtttgtggtggcaaaaactagaaacaaccttaaaaccccataaaggaatggttgaaaaaattctgctatatcccaaaatgtggaatattgagaagaaacttaaaaataataatctagggccatgtatcttgatctagaaaatgaaaaagcacattgcaaagaaatatatgtagcatgaccccatactatgagtgtcgaaggtgcattaaacagacatacatatggatgggtggacagaccagtggatgggtgaacacacacacacaaatatacacgtataggtgtattagtctgttttcacactgctgataaagacatacccaaaattaaaaagtggcttaatggactcacagttccacatcgctggggaggcctcacaatcatggcggaaggtgaaaggcacgtcttacatggcagcaggcaagagagaatgagagccaagcaaaaggggtttccccttataaaaccatcagctctcatgagacttactcactatagtgagaacagtatgggagaaaccgcccctgtgactcagttatctcccatcaggtcggtcccacaacatgtgggaattatgggagctacaattcaagatgagattttggtggggacacagccaaaccaagtcaatagatatatatgtgtacagatgtttgagaatttttttaaatgtaagaatatataacaggctgttaaatccatttgcctcactgggataggattgacggtagtagagtgagagggctgttgttaacttagtctcatgtatcttttcatgatttcttgttataatgaacaagcaaatggctaaagttatgaacattcataagaaaatatttctacaaagcatgtatacaaggatgtttgttaatcactgtaatagcaaaaatggaggaaagaaaacctttggaaggaaaatggttaaactattgttcttcaatatgggaatggtacaagaaacttattgggaaatattatataggtattaaaaagattatattctcagaaaataaaaaaatagaattaccacatgatccagcgtaccatttctggatatatacccaaaataattaaaggcagggcctcaaagagctatttgtacactgctgtttatagcagcatgattcacaattgcagaaagatgtaaacaacccaagtgtccacggagaaatgaacggataaacacagtgtgatatacatacacgtaggatattactcagcctttaaaaggaagggaattctggcccctgacaccacatgtcaaatccatagagacagaaagtagaatggaggctgtcgggggctagggaaagggggaatgaggagtgatgtttaatgggtatggagtttgagttttgcaagacgagaagagttctggggatggtggtcaggcttgcagaacggtgtgaatgcgcttaacactacagagcaatatacttcagaatggttcagatggtaaattttaagttaggtgtgtttcattttactgcaactgaaaaaaaaaaagcatacctaagtgaatggagattaacgtgagggggagattcttctgaggccagaatgggtttgaacatttgaggcatagctagggggatggggtgggggaggacacccttccacaaggtgggaaataggggtctgggtgtagagtcacagagagatgtgcagatggtggggtcggggggtgcaagtgccaccccatctacccacagttaaataggaggccagttcaagttcacatatgctggtgcatttctcgcttaaccattgcgtgttcatgtctctgaagcagtaattgcttttctttctgtatttgcaggtgtggcctttatcaatcccacatggtagacaagcacagcatagaaaaggggctaaaagatttggctcagcctaagagaaaccagatgtggggaaggcaccctgcagtcctgctccccaggactggcttaggcatctgtgaatggctctggggcctgcctcccaacagaactgtggtcaaagtgttgtccagggacattttatctcagaacctggtcacagggcagtctctagcatagtctcttactgctccccaccattcacagaagcaccaatggctccagccagacccaatgcagtacagagctgcaataagtagagtgatgttacatctcaactcactgggactgttgctgttgaggccaattttcccagcacaataattgatagcaccgctgcaccctcacaccttttgaagatagggccttgctccaccacccaggctggagtgcagtggcacgatcacggcttgctggagcctcgacttcctgggttcaagggatcctcctatctcagccttctgagtagctgggactacaggcatgcagcaccgtgcccagctaattttaaaacttttttgtagagatggggtctcactatgttgccaaggatggtctcgaactcctgggctcaagcagtcctcccacctcggccacccaaagtgctgggattacaggcatgagccactgtgcctggcctagcacccactttttgttttcagggtccttgtgtggatgataaaggcttttgaacagtctgtctctgctgcctgaaatgcctgcctctgtctactcaaaaccttttacaaactcaggtgtcacctccacactgaagccttccttgatatcctcacgtgcccctccttcccactcctcaccccaggacagagtttagtgtttctctgtctttttacatcaccgaccagagtctggttatttctccttgtctgtgaatttctgagggtaggagctgtgtgtctttagttccctattctccaggctctagtaaagtagccatcacatcacacaggtgctcgataagttttttaaaaatggaattgatttctttctcgctgagttccaggggcctgtgcagcccgtctgggccccaggctttgtggagagattgcttaggtgttgccttctcgcagcaggtgtgtgtctttcaatgctgtagcagactacgcagaaatggaaaaccctatatatttacttgtgaccctccaggtccccaggcctcttgcaatgcggaaagaggggatccaaaccagaaaacggaagcccaagaacctgaataaatctaagacaccagcaggtgaggaaaagatctgtgagtgattatatgagtacatcaggagccctcagagtgcataagaatcatatcttccgggttaggcaggccagcccgggccgccagggggtggtgacagcatcggacatccctggcctttcaggacaggatgaagagcccagcaaaaaagtaacaattgccatggaacgtgttgggagctttcgaagcaggctcaactcaagctggggcctgatcattgccgactgcaaagacccagtgctcaggctggaccagccgaggtcctgcaggaaagaggaactttactcggtcctttcatctttggcgctgcagccacccaaaagctcagttcctttcaattctctttgggctaacggggatccaggagggcagggtccaattaatcatgtccctaacagattgatctctaagccaatgtataattaacatcatgcagtgctttgtgctttagaaagccccttcagaaatattatctccatgaaagtaagactccatgagaaccagtttatgaccccattttactaacaagcaaactgaggctcatagaggacaatgatttaacgagggtcatacagctgttaatgggtagagaattaaaacccaagtttttctgcttctgggtcaatgttctcttcaatataccactctgccttcttaatttctagattaagaataagggctgctcaaaagtttgaggctgcagtgacctatgatcgtgccactgcacttcagcctggagagcagagcaagaccctgtctttaaaaaaaaaaaaaagaaatacatttaaaaagaacgagggctgttcttttttaaatttatttttaataaatatattaactatttattaaatttaaattagatttatttataaaattatatataaatttctgacagaacaacggctgttctttaatacgtttatgttccctaccaaaacattcctcactcagtactgctacccagttaaagatttgactggtcggtgctgcagtcacagagaaaatgaattggctgatctgacgaaaaatttatcttctaacctaaggcatgacagagtcagataaatgggccctttccactaccaagaacatgatcaaagttctgcttttgtacattcaaccatggcttatcccttctggcaggcatatttcctactggaattttcagtgtctcacacctgtggtcttccacctctcctcctgcttccctactgctgacgagtcccctatgtcccctgggtaaccttatttcctctcacgtagcaatcacagatagagaagacatacggttcaggcgcacgattcccagtccaaaattccaaatccaggaagcaagattcggcagcaaaacctattttgaacagacactaggctgttgatagtctctgtttactccattcagtatgatattcacgtgttttgctgtggggatattattgtatttcattacagaggattatctcaggccctgctggaggtattctgtaataatacacagtatttggatttttaaaaatgtgaatcttcaagttgaatgaggaagaatctttttttaaaaagttttgaagcctgaaacacacgtggcctcaagggtttgagatgagatagggggaagaagccatccctgtgagaactgtagccctccgcagataaggacctctgctgctgtccccggcaaatgtagataaagccattagcttgcacccatcccggctgtctcgcaggctgccggctgttcgtttgtccctgccgctgatttgggtgtgctgactctgcttcattccagctccttcaggcagtgagagccttcctcccgccagcggtgcttccagcaactccagcaacgccaccaccagcagcagcgaggagatgcgtcccatcaagacggagcctggcctgtcatctcactacgggcacagcagctccgtgtcccaggtacgcgccatggctggggcgccagggctgtttgtggggaggccgactgcagagtcccagaggccagcctagtactgggtgggacttgcagccaggcctcacaggtgcaagcagtgagctaccctctgcgctaggaagacccagccattgagctgtgtggtgccctcagggccgcacgaggctaggggcatctgcatcgggctgtatttcaggacatcttatcaagatggtgatgtggacatgactgtgactcacaattttttaacagctcctctatgccatcatctttggaaacaaagagaggggagtccagggctggcatacagcatgggtggcaggggcggaaaacaacacagaagtacaacctgaatgagactgcgtgctggggcgaggggaggcgtggttgcgctgtcggaggccgagcggaggttctctaggcaagtctgcctcctacgtgcagggaggttagacttcaacagggagggtggggaaggaggaggaagctggcatggggaaaggcctggatcctgcagagggcaggcagggcaggctggtggggaggtcacaggcaggatgccactttcatgagacccagctctgcacgtgtgtcaggggacgccctggggcagcccatgttccctctggcggaggacgatggcgtctcggcctccctgcctcctcccctctgcagttccctctcttgggaccaggatgcaccaagcttgatcacggtctcctttgaccagccctggctgttatctcgtctctgctcttaactgaaggaggccgtgtcttagtgagcttcttattgtctgggagaacctgatcccacagaaccaggggcaccaggagccccttctgggccgggtggacggcttctttgttggaaagtggatgtggtggtgataggatggtagaaagtgtctcctgtaaccatcagagccttctgggcaaccacagtatccacagggccaccgggtcatagccctggttgtatactgtgctcagaagcagctgatgcatcacccagacccttcatgcctagatcaccgggatcaggagaaacagagagaagtgctccttggtcccttcctgagggctgaagccatcctggggacatctgcatagcagggcaccctccccagcctagacctcccaagccctcaggagcgtctccatgggcctcatcgtgtgctttctgcttttcagacgttctcagtcagtgcgatgtctggccatgggccctccatccaccctgtcctctcggccctgaagctctccccacaaggctatgcgtctcccgtcagccagtctccacagaccagctccaagcaggactcttggaacagcctggtcttggccgacagtcacggggacataatcactgcgtaatcttccctcttccctcctcaaattcctgcacggacctgggacttggaggatagcaaagaaggaggccctgggctcccaggggccggcctcctctgcctggtaatgactccagaacaacaactgggaagaaacttgaagtcgacaatctggttaggggaagcgggtgttggattttctcagatgcctttacacgctgatgggactggagggagcccacccttcagcacgagcacactgcatctctcctgtgagttggagacttctttcccaagatgtccttgtcccctgcgttccccactgtggcctagaccgtgggttttgcattgtgtttctagcaccgaggatctgagaacaagcggagggccgggccctgggacccctgctccagcccgaatgacggcatctgtttgccatgtacctggatgcgacgggcccctggggacaggcccttgccccatccatccgcttgaggcatggcaccgccctgcatccctaataccaaatctgactccaaaattgtggggtgtgacatacaagtgactgaacacttcctggggagctacaggggcacttaacccaccacagcgcagcctcatcaaaatgcagctggcaacttctcccccaggtgccttccccctgctgccggcctttgctccttcacttccaacatctctcaaaataaaaatccctcttcccgctctgagcgattcagctctgcccgcagcttgtacatgtctctcccctggcaaaacaagagctgggtagtttagccaaacggcaccccctcgagttcactgcagacccttcgttcaccgtgtcacacatagaggggttctgagtaagaacaaaacgttctgctgctcaagccagtctggcaagcactcagcccagcctcgaggtccttctggggagagtgtaagtggacagagtcctggtcagggggcaggagtgtcccaagggctggcccacctgctgtctgtctgctcctcctagcccttggtcagatggcagccagagtccctcaggacctgcagcctcgccccggcagaagtcttttgtccaggaggcaaaaagccagagattctgcaacacgaattcgaagcaaacaaacacaacacaacagaattcctggaaagaagacgactgctaagacacggcaggggggcctggagggagcctccgactctgagctgctccgggatctgccgcgttctcctctgcacattgctgtttctgcccctgatgctggagctcaaggagactccttcctctttctcagcagagctgtagctgactgtggcattactacgcctccccacacgcccagacccctcactccaaaatcctactggctgtagcagagaatacctttgaaccaagattctgttttaatcatcatttacattgttttcttccaaaggccccctcgtataccctccctaacccacaaacctgttaacattgtcttaaggtgaaatggctggaaaatcagtatttaactaataaatttatctgtattcctctttccctcgtcccttagtggtcttcactgggaggttcagcgttgctgttctctcccggggaatcttgaggccgtgtaggcactgacccactcacagctgcttactttatttttggccattggccaatgctccctctttaggtagcagtgggtcccgaaaagcacactcatcccagccctgctaacatgagacattagatgggggtcaccgctgggctttaatttcctgggagagggttgtacctatccataaacagagttccttgtggtccaacaaaagttgctcaatgtatttattgatttattgagacagggtcttgctctgttgctcaggctggagtgctgtgtgccatcatggacctacctggctcaagcgatccacctgcctgtgtcttgagtagctgggaccacaggtgcacaccaccatgcccagctaattttttattttgtagagatggaatcttgctttgttgctgaggctggtgttaaactcctgggctcaagcaattctcccaccttggcctcccaaagtgctgggattataggcatggatcaccgctcccaaccatctgagggcatttttagagctctcctccagacctcagggtctggagcaagagactccatctacctggaagaaaatgttctgtctagccctgtctgacttaaaagtgtgtccctccagggcaaggagctcttgccattttatggtttgatccaaacaggctaaggggcaaattatgtcccacaagaatgagagagaaggctggcagttcctctcctttatccatttgtcttcacctccttaggccacaggggtgcttaaccacttcatcttaaaagtatgtggagtggggctgggcacggtggctcacccctgtaatcccagcattttgggaggccaaggcaggaggattgcttgagcctgggaggtgaggacaagcctgggcaacagagggggactctctacaaaaaagtagaaaattagctgggtatggtggcgtgcccctgtgatcccagctccttagaaggttgtgggaggatcgcttgagcccaggaggtcaagactgcagtgagctgagctcatgccacttacacttcagcttgggtaacagagcgagactctgtctcaaa

SEQ ID NO: 17390 - DNA, 152583 bp, Human
  misc_feature (1)...(152583): n = A,T,C or G
cccatcgcctgtgttaccacctgagctctgcctcctgtcagatcaccagcaccgttagatccattagattcttttttttaaattgctgctgcacaaattaaggcattagattctcataggaacatgaaccctatcatgaactgcacactccttatgagaatctaatgcctgatgacctgtcactgtctcccgtcactcccagatgagaacatctagttgcaggaaaacaagctcagggctcccactgattcctacattatgttgagctgtataattatttcattatatattgcaatgtaataataatagaaataaagtgcacaataaatgtaatgcacttgaatcatcccaaaaccacccccacagctgggtctgtggaaaaattgtcttccacaatattggtccctgatgccaaaaagattggggaccactgagctagtgggttctggaacttcacctcttatgagcgatgtaaccttgggcaagttacttctctgagatactctataaattaaatcacttaatacgttgaaggcacttggcccagtgcctggcacataggagatgctgaataaacattcactatttttaatataatcttaatgcatagtaaaattatattaaaaagagtgagctagttcaatacagcaagtgtgaaaaactggactctgaaggttgacaggcccaggtccattcccaggtcaatttctggaagcaatttgctgaacaaacagttcgctgaaatagtgaggtttttttttaagttttgaaacatggtccctgccccacccctgccctgtccctgcctctgacaaagaaagaactatggcatttcatgacttgatttctggggattttcctttcagttttctactaatcaatgcattggaaaattgacctgctagtcctgggtttgaatttgttttacctttttttttttttgagatagggtctcgtgctgtcacccaggctggagtgtagtggtgcagtctctgctcactgcagtcctgggttcaagtgattcttgtgcctcggcctcctaagtagctaggactgcaggcacgagccaccacacctggctaatttttgtatttttagtagagattgggtttcgctgtgttggccaggctggtctcaaactcttggcctcaagtgatgtgcccaccttggcctcccaaagtggtgggattacaggtgtgagtcaccacacctggacttttttaactttttaaataaatttaaattttttttttgtagaaacgaggccttgctgtgtggaccaggctggtttcaaacttctggcatcaagcaatccttctatctaggcctcctaaagcactaggattgcagacatgagccatggcacctagacttgaccctgggtttgaattctggctctgacacttgctaactgtgtgtgaccttgggcaggccactgacccttcctgagccttatgggaatgtgggaataatattaggtaatggagcaagttaatataggtaaagaatttagaatagggcctggcacatggcctcagtctagtaccagagtccaagcccataaccactgtgccaacactcttgtaataaatgtatgtgggagacagggaggctgggaggctggatatgtgatgctactttatgtcaactacacatgaattttatatgtataatttatataaactaattgatgccatctactattattagactgaacaaatattgttacttggaactctcagatatgtaatagcttttttttattcaaatccaaaatgtaaaatgtgactatgagtaattgataatgaacttaactgataagaaacttcaggatagatttttctcaagttttccattcagtcttacagtgattaaagtgatgaaaaattccaactatgcatgccctgctcggagcgtccaagaagagcctaccaacgggggctacttaagctctcaaaggccaaacacacaaacggcattttgagtgcaagtggtctgtttgaactctgaaaaggcggggcagcgggcctgcagctcctggagttcagggagacccggaaatctcaccctgccctcttcttgtgttgtgtttgtcacagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctgggtgagtggtggtgctcacccccaaaagtgggcaggtgggggtggtttggggagggctcagggacagggattggtgactgtttgagaagctttcctttccctgggtccttgttggatgtgctgggcctggggtcctcactggtggtgaatgcatccggagttgagcacgtggttgcacacgagttttcaaaataaacttttctttgaagcctttaattgaatctgaggcttatggcttttctccaatattcagggcaagatttctcatctgaaaatgtccttgttgttggacctatctgggcaaaggtgttatgaaaattttttattgggtttgcccagctagatctgttaataatgcttccctgcatggcagcagggaagtaagagctgggccagaagagaggtggggacattgtgagctgaatcgaggtattaggaatggaaaatgccaggggtctattcatctgatccagtgaacatttttcctagaaaaaggaaatgtcatgaaaacacacggaaaacatgtaaatcagctgattctaaacaagggcattggtaagcctggcatgtggaggttataggaaggttgggcagtgccaagagaatgagttttggcattgacctgggttcaagtcctgcctctgctactttccagatgtgatataacctccctgaggctatagatgtgatataacgtaggtgatataacttccctgaggctcagttttatcatctgtaaaatggaagtgtgaatgccaaccttggaacatttctgagaaataaatgaggtaatatacatacattctaggtactcagtaagtaaaagctttaccacaactgtcattctattaagttctttgaaactgtatttgacatttataccttgttggccagccactcgaatctgaccccctgcaaaggctactaagagaactgcccagtgacctggtagcctcagtggcatccgaaattacaatcagggaccacagggacctaaagagccctgttttcagaggtcagaatctttattgatgttaactaagtgaggaccccagtgataggtcttccaggttcctgaaagtccttgtttccatagtgatgggggacaacacttttgcaaatgtgaaaaggagtgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgaccaacatggtgaaaccctgtctctactaaaaatacaaaaattagctgggcatggtggcgggtgcctgtaatcccagctactcgggaggctgaggcaggagaatcgcttgaacccaggaagtggaggttgcagtgagctaagatcgtgccactgcactctagcctgggtgacagagtgagactctgtctcaaaaaaaaaaaaaaaagaaaatagtggagtgacaatcgtgaaaccagaaagcaaacactatagctgtggcctggattctcaagtgcaatctgcttttttttttctcattttgatggggaacaaaaatggaaaagcatgctcattggtagtccttgccccgagggtatgaccttctcttcattcttagaataatgtagtgttttgtattttatgcatgtttgcttctcttggctcttggactatttgttcagaatatggcccaggccacatttcactttttaatggcaaatcattttggctgaagttatggcatccactggcatgatggattttactggttatttgcttgcaagtatgttcctgaaagtttaacagagtagaaacagcagaattgtttcttaggttaattttttttgaactttctgggttttaaaaatgtttatcttttatgtttaaattcaggtcagagtctcagtaacaacttgagtcagtttgaaaaaataacgcatgtatatatccaccatcctgtgaacatctgtgggctgttcactcggcagcctgtgatgtctgtccacatgggcttatctcttacctcattcatttatctggaatttctactctgtgccagatgccggttgggggtgtgggggtagtgtttaagatgaatagacaccatcaggaggtgcacagagtagtggaagagacaggcatgtgaaaagatcattaatttggtagaatcggtgtgcaaaagtagaggcatagctacattatagctcaactctgcctgctgagcaggcttagtgtaaggcagtggttctcaagctttggtctcaggatccttccttttacgctaaaaattatttttattttattattttattttattttattttgagatagggtctcactgtctcccaggctggagtgcagtggcatgatcatggctcgctgcagccttgacctcttgtgcttaagcaatcctccaacctcagcatctcaagtagctgagactacaggcacatgacactacgcctggctaatttttgtattttttgtagagacagggtttcgccatgttgtccaggctgatcttgaactcctgggctcaagcgatcctcccccctcagtctcccaaagtgctgggattctaggcgtgagccactgtgcccagccaaaaattattaaggatcccaaataacttttgtttgttttttaagaatcctgaggacaatcaagggagctttgtttatgtgggttagatctattggtatctacctgatcagaaatttaaaaataacaataataaaatcagaatgtgttaacaaactatatatgtataaaaaactatattttctggccaggtgcagtggctcatgcctgtaattccagtactttgggaggctgaggtggaaggatcacttgagcccaggagtttgagaccagtctgggcaacatagggataccttgtctctacaaaaataaaaaaatgaggccgtgcacagtggctcacacctgtaatcccagcactttgggaggctgaggtgggcagatcacttgaggtcaggagtttgagaccagcctggccaacatggtgaaaaactgtctctactaaaaatacaaaaattagcctggtttggtggtgtgcacctgtaatcccagctactccggaggctgaggcaggagaatcacttgaacccgggaggcggaggttgcagtgagccgagatcacaccactgcacttcagcctgggtgacaagagtgaaactgtctcaaaaaaaaaaaagaaagaaaaaaaaaaattagccgggtgtggtggtacacacctatagtcccagctaattgaaatgcttaggctgcaggatcacttgagccccagaggtcgaggctgcatgagtgagccgtgatggtgccactgcactccagcctgggtgacagagtgagaccctgtctcaaaaaaaaaaaaaaaaaaaaaaaagaagagtagcaccgttttacagttttgcaaatcttgtaacggtctggcttcgtagaagacagctagattgtcatttcttgaccattcaatctgtcatgaaatgttttcgttagattatatgaaaatgcatggatatgtagttggaaaagggaagagcatttaaatagccttttcatataattgtgaatgttctttgatactacaccaaaacttgacaaagagtagtttcttaaagtttagttgcaatgtgaaatctaaaatcagatcaataaactttttgttctctatatacccacaagagaatgagagtatgaaaggcaaacattcatgttattatggaaatagttctgacctcatggatcctctgaaaaggcctcagggacccctagaattccccaaactacacttgagaatggctggtttaagagaattgttcccagtgaaggtcctgcccacggagagccctgtgggacagcaggtggcagaggcatgaggatggagtgtggcagtggggctccgatgtggcgctgggtctgccagacaggtggtctgagctggagataaggcagcaataatttaggacctcgagggctccaaggaaggagttttgagcttcattttgcaggggtaggagctgtggagggctttaagcagtcaacagtgggtgtcgctttgtctttgcacccactgtactctccggacagacttgaccttcctgggttgtggcaaagagcagggatctaaatagcaggctgcaacaggagaaggaacgagcacctgctctagcccaaagacccctccaggccacaacgctggcaggtagagtcggagaatctgactgtgctgtacccagaaccctttggacttggattcttccccttgaccagccttatcagtggcacccatccccttccacactcctcgctaggccctcctcaagggggcgctaactggaaggcatgctgccccactgctaatggccgcctgcttcgtttgtgcacactttttctctttgttaccccactttcctatgaggaggtggacctgtctccagaacaaccagtggggtatatcagcctttttggaaaccttaaccctccttgcccaaactcccagagtattcttatttatttatttatttatttatttatttatttatttatgatagagtcttgctgtgtcaccaggctggagtgcagtggtgggatctcggctcactgcaacctccgcctcccaggttcaagtgattctcctgcctcagcctccagagtagctgggattacaggtgcctgccaccacgcccggttaatttttgtatttttagtagagacagggtttcaccatgttggccgcctgcctcggcctcccaaagtgctgggattactggcgtgagccgccgcacccggcccccagtgtattcttgattccctccactccacaaactactctacagtcagccagcttgtggtctctggtggtggtctgtcttatgaggtcttgttgacatatgcattcttttctaaatttaccaaactggctcattttatttctgctaactaaacttgaaagccttttcttttcctattatagactctcctttggatcaatactacacactcagaagttatgtttgtgttttaagagagcattttgtggcaatatggcatcaattctagaagtgggagacaaagatttaaaaggaagttggccctgcagtctggtcaggggatggtagggcctgagctccctcccaccccacaccccaccacacacactgctggaagaattccagaggtgttccagggtagacaccacagcatttagtaaaatttactcataacagttaatttactacttaaaaactaatgaagaaaatctaagaattcaccttttttttttttttttttttttttagacaggatcttattctgttgcccaggctggagtgcagtggcactatcatagctcactgcagcctgagctcaagcgatcctcccaagtcagcttcccaactaactgggactacagtcatgtactaccacgcccaactaattgtttaatttttttgcagagacagggtcttactatgttgcacagactggtttcaaattcttggccttatgcaatcctcctgccttggcctcccaaagtgttgggattacaagtgtgaaccattcctcctggcagaattcaccttacacagccccaaattctgctcttggggaatcacagtgtattaagagacacttattttcatttttgcatgtatctctaaacctgacatcaaaatattcataaaattgcaatacgtttcatataatgagctgaaacctcctaagtgagcaatgtgaagttgttggctgcctggagaattaaatgtaagcatggcctgctctgtgttgctaatggaaatttttacctaggttgatatttattaacccccccttttttttttgagacagagtcttgctctgtcacccaggctggagtgcagtggcgtgatcttggctcactgcaacctccgcctcccgggttcaagcaattcttctgccttggcctcctgagtagctgagattgcaggcgcccgccaccatgcccggctaatttttgtatttttagtagagacggggtttcatcatgttggccaggttggtctcaaattcctgacctcatgtgatctgcccacctaggcctcacaaaatgctggaattacaggcgtgagccaccgtgtctggctccaacctacatttttaaggcttagctgccactcaatggatttctacatcccaaaacaatacctttaattgacttttattggcctcctctgtgaaggacggaaagcagatgccagaagccatgagaggctctggctctccgaccaacccgtggaagccactagtcttaaatttcctgaagccattttgccatgattaaaacttttgtctccttccctgagctttccagagctttgtccattctcttccttctacctggaatatccttccccagacaagacccattctcatccagggccaggtcaaatgccacctcctccctctccaggcaagacctccattgagggaccacacacattgcaggccctctgccaaagtgccaaccctctctgccttacattccaaggggtaatagtgatacttacctcagagggattcacattttagctatttttgcacttgtctcattttactactagactgtctcttcaagatagggactgaatatttttcatttctcatagcacctatgaaaggcaactctcatttactgagcccctgctgtgggttgggacgtgttatctcacctaatccatagcaggagcaaacactgtaaggtaattcttgttatattctattttcagacaaggaagctgaggctcagataggttaagcagttttggcaaatttgtcaagacttctgcaaacctagacagaaaaggtgctcaacccccagcccctttatggaaaggatgcatggcttaggggcagatatgcgttggagcaaagagaaagacacacgtactcttgaatgtactattttagcccctgcttgctccttgacccagagtttttgtgtagaccatagaatgccctgcccatctgtatttggaggtgctgctgcagccggtcacacctgggttctactgacctccagccctggctgtggtcctgcccagggctcagtgtgtattgaacaagtaagtgaatgagacatgcagaaggctgatttcattcttatttgaatgatttcaatcttgattaaccttcttagcaagaggttattttcttctcctggacctcagttcattcatctctaaaagaaggaagttgaagtcaatgatctctcaggtctcatctcagatgtggtgatgtcaccaattcccctgacatcccttctatgtgggaaccctgatgaaatccgcagctttccctcactgtgtccaggtaggaaagccaaggaggaaccatattctggaagccaaggaaggagaagttttgagacacagggtggtcagtaggatcaggcaggacaacagggatggggcagtgggatcaggtaacacagcagggctgggcagtgggttcaggcagaacagtgggctgggcaggggatcaggcaacacagcaaggttaggcagtgggatcagataatgcagggctaggcaatgggatcaggcaacacaacagggctaggcagtgggatcaggtaacacagcagggctgggcagtgggatcaggcaacataacagggctgggcagagggatcaggtaacacagcaaggctgggcagtgggatcaggcaacacagtagggctgggcagtgggatcaggcaacatagtagggctggacagtgggatcaggcaacacaacagggctgggcagtgggatcaggtaacacagcaaggctgggcagtgggatcaggcaacacagtagggctgggcagtgggatctggcaacacgacagggctgggcagtgggatcaggcaacacagtagggctgggcattgggatatggcaacatgacagggctgggcagtgggatcaggcaacacaacagggctaggcagtgggatcaggcaatatggccgggctgggcagtgggattaggcagtgaagcaggggttgttaaacttcattgtgcatcaaaagctcctggaaggcttgttagaacacagattactgggccctgtgctcaaagtgtctgattcagtaggtctgggttggagcctgataagtggtattcctggaaacctcagtttgagaactattactgtagagaaacctacaaggttgggtgggaatgggcaggaggaaaagatactagaagaagatgctgtggggcatgagccggaaagacaatacaagatgagtaacatctgcagagaattgcagctgcagagtataaactaactgtaatctaggtccagcccttctgaagctttacaaataagctgctagcattgtccagccttatagggaattggcaaaaggtgagtttcaggcctacatgggagccagcctcttacagcacagcagttagcaatacacatctaaagaactaagtagctggcatgtgtctttatcatcagaatagattatacaaatgaaggtcgatgcattgagcttatcaaattgttttaaatatagcaacgtttgttttaaaatttttttttaaacctttgaagtaaaactgcctctttttcagtgctcagctgcagtgcatcacgggcagtacaatgacagctggaaacatggaccccatggaggcgctgtcatggccgccctcagcacagacctgctgttccctatcaaattcatcctctgtgcctatgctctgtttaatatagatttttataaactgtatgaagtaaaattcttcattcctatcttgtgattaacgctggaagaatccaaaaagcacagcgtctgacctccaataagccataaagttaaaagcttttctaggcaatgaatatataacctgatttttttctcctacagatcctctctctccccttctttctccctttctcctttgtgtgaaactctttctttatccctttccttttctataaacttccttgatctttccctctccagtactccccttcctcattcccttcttcagttccaggatgttctctcctcagcttgcccatatattttgcacctgcaactcatgtgtgtgtcagggagtagaggtgagggattatcccttccgtgagtgacagtcacctttcttttctttgctggctggtgcttttaggagacaaggtgtacaaccttacccctaaggagccagtcctgtccttcgtctctctatctaatgctaataatgataacaatagtagtgatgacggccgggtgcggtggctcatgcctgtaatcccagcacttggggaggccaaggtgggtgaatcacctgagatgaggagtttgagaccagcctggccaacatggtgaaaccttgtgtctactaaaaatacaaaaaattagccaggtgtggtggtgggcacctgtaatcccagctactcgggaggccgaggcaggaaaattacttgaacctcggaggcggaggttgcagtgagctgagatcacaccactacactccagcctgggcaacaagagtgaaactccttctcaaaaaaaaaaaaaaaaaatagtagtgatgacaagccaccatgtgccaggcactgtggtaggcagctcacacttcactctgcatgtactattatcccttaaatgtctcatacaaggtcattcaactactgagcagccagaggtagaattcaagaagcgaacttgctgttttctctacttaaactcttttatcacccaggctgcagtgcagtggtgcgatcatggctcactgcagcctcgacctccaggcccaggtgatcctcctatctcaacctcccaagtagctgggattacaagcacgcaccaccatatccagcaattttttttttcatatttttttgtaaagacagggtttcaccatgttggccaggctgttctcgaactcctgagctcaagcgatcctcctgctgtggcctcccaaagtgttaggattacaggcataaaccaccacaccccgccttcttgaactcttttctataaccccacccaccctgttttatccagttgaattggactcatctttcaggtctcagtggaagcgcttctaatcttctaggttgggatttaataccccaactattgcattcccatggagtgctgtatgtccccaaaactgcacttagcctgtacagcaattgcctgcttaattgtctgtgtagttcgtcactgtaccagcatagctgagcaaggtgcctggtacacagcaggtattccataaatgcctataggaaaagtaaattaacggactcttcctcaataaatatatatatgttctagaaatttgagttgtatattagtttcctagggctgctataacaatataccacaaagtgggtggttaaacaacagaaatgtattgtctcacagttctggagctagaagtctgagctcaaggtgtcggctgtgttggtttcttctgagccctctctccttggctcataggtggctgtcttctccctgtgtctccacgtggtcttttccctctgtacctgtgagtgtccagacttcctcttcttataaggacaccagtcacattgaattaggctcgccctaataacctcattttaacttaatcacatctttgaagaccctaactccaaatccggttacctcctgaaggcctgggggtgaggacttcaacatatgaatcgcgggcagggagagggacagaagtcagcccatgacaagctgctttgcttttcactttcccagtttgtggaggacagtgtgtcatctttcaacatgtttctaaatagcctctttttcctttctgattcactttatgttcccacttcagggtgatatgagaaacgctggggaagcatgttcaaagacttgagcagtgggtcacttattactttaccatggcatatttcagagtcattaaagcagctccagcaagcgcagtgggctgtgcagccggaatcccagggctgaagatgggacaggagtgcaatctaaccaggatgtgaaaccaagtccaagtaaggtttttcaaaagccaagaattagaacgactaactcagtcctgtttcagtatatccaggggaggctgatttatagggaaagatgaaaggaggacaatgtgtatattttggctgctcagaagaccatggggctagacatgggggaggaggaagttattataagcctacagccagccaatgagtaagaacatcaaagaggaaggctggttggccagatggaccaagagctggggcacaggcaggatctttgggagaaacaagatgaatggatgcttcggacaacctaagttcagagcccggaggggcctttagaaaggcatgatggattatgtgtactgtgggtcattgcgccatgagaagtcccatgggggatgagccccagaggcccttaaagtcagggtggaccattaagtaaactgcggaggaatttcttccaggagggctcagacttggcaaaggctgggaagggctgctttccatctccggctcttaatcccccagccctgacactggggctcgcttgttccagcctacttgatccatttattgaataaagatatactgagaaccagccgggcgtggtgactcacgcctgtaatcccagcactttgggaggccgaggtgggcggatcacgaggtcaggagattgaggccgtcctggctaacacggtgaaactccgtctctgctaaaaatacaaaaaattagacgggtgtggtggcgggcacctgtagtcccacctactctggaggctgaggcaggagaatggcgtgaacccagaaggcggagcttgcagtgagccgagatagcgccactgcactccagcctgggcaacagagcgagactctgtccccgcccccccaaaaaaagatatactgagaacccttttattccaaggtctgcattaggcccagtgaaagatgaggaatccttaaatctttgggacttggtggggtcaccggggatacatcctcctctcctaggtaccgttcatctgtttgcacccagatgtggcctgtcccatgtgattgtcccaccactgaccgaagcaggcctctccattctcctcttccagttaaagctgaatttgtctccaaagtgaagaagaataggaaaaccatcaattttatggagctttttaactatgccaaaatggtttcattctgatacactttttttttttctttttgagatggagtcttgctctgttgcctgggctggagtgcagtggtgtgttctgggttcactgtaacctccgccttttgggttccagcgattctgctgcctcagcctgctgaatagctgggattacaggcacgcaccaccacaccaggctactttttgtatgtttagtagagatggggtttcgccatgttggccaggctggtcttgaactcctgacctcaggtgatccacccaccttgacctcccaaagtgctgtgattacaggcgtgagccactgcacccggccctgatatactattttgtttcataatttgcttgggtaatcattgattcatccattcaacaaatacgtatgaagaagctacagtgtacaaggctttgctttgggtgccaaggatactgcagggtcaggccagggtcacatctggctcaccaccagtcaggctttagggtttggtacaaattccacggcctcaggcaccatgggtgcataggatcagcaaaataagtccttaaagagatggaaaactcactcataaaaccatctgggcttgatgccttttgtagaggggatatatttgacaacaaattaaatatcttcaaaatccatttgtgcattcaggtttttcatttcttcttaagtctattttggtcattgatatctttctgaaaagttttctcatttgtctacattttcaaatctgttgttataaattatagctcataatactgagttacgttttaatagggaacatgtattttataaatacatgtttataaaaaatagggtcccactatgttgcccaggctggtctcgaactcctgggctcaagcaatcctcctgcctcagcctcccaaagtgctgggattagagatatgagccactgtgcctggccaggggacatgtatttgttttttttttttttaacaaaaagtacccagtgttaggccgggtgtggtggctcacacctgtaatcccagcactttgggaggccgtggtgggcagatcacttgaggtcaggagtctgagaccagtctggccaacatggtgaaaccccgtctctactaaaaatacaaaaaattagctgggtgtggtggcgggcacctgtaatcccagctacttgggaggctgaggcaggagaactgcttgaacccaggaggtggaggttgcagtgagccgagatcgcaccattgcactccagcccaggcaacaagaacgaaactccgtctcaaaaaaaaaaaaaagaataaaaaaaaagacaaagaaaaaaagcaaaaagtgcccagtgttttattctcatagatcacaaagctcttagcaaaaattctgaagaaacactgagacctgggggatgggtgtgtgttgccgggagaggagtcgctattgcctcttgggtttctccgataacacctggcttttgtagaagatcttcacagtttttcaaagcacccatcccttgccttacctctcctgtctcccttgtctgcctgatgcctccaacttctcagaagtgccagggccagggcactgctgggcccatggtgtgggtctacattgcagtaaaaggctcgttacccactcccctcaacacaggagtctcctgtttttaggcagcttaagaaagcagtcttgtctgtggaggaatgcccagccttcttggtgcagatgctgggtttggggacccagctgtttgcaggagttgtctaggaacgtcagtacccagggactgtgagactcctgggatgttatagtccccatgctagcagagggaagacactgggcccatgagaagttgagtttaggtagccagtcctgctgggagaaaggaaagcctcagatgccagcaagcttgctgtccagccattttctgacaaccctgcttattgcaccatgtacagtaatcaacacagacttgcatctgctctgaggggtgcaggtggtgctccatggaacacacacatgcacgccttcacccaccctttcctgtacctttggaattcgtggcataggaacactatatctattgcacttgggtgtggttataatgccagggtaaagataagtttctctgtggagtacctgaatgacaagatcatattttgtgtcagttccacatggaagggctcttcctcacagacattggaagggtaacagtagaatctaagctctaggaaggcagggtttttttgttttttgttttgtttttgtctgcacatgatagacacttagcaaatatttgctggatgggtggacaaatggaaactggaatgaaatggagatgcctaggtgagtgtgggaaggactctgcctctcctggtctttgccctgtagatgccaaatatcctaggcgggaactgggaagttggcagatgctgctgtgtagagagtcagtggagcaaagactggaaaaacatccagcctgtgtcagctagcaaaagaggggttttgggtctattttggggtcagaatattagaggaggtaacctgtaccctcaggcttcagagtgtggttgactaggaggctccaaagagtaagtgaaacccaaggggacggagataggaccacttgatccatccttgtaggttcagagctatgtcttatcaaatgttttcccttcatgtagtagcatgataatgaactcttcctactttggtttgataatgcaatggattatatggatagattttctagtgttgaaccaatccttgcattattgaggtaaactttacttgatcataatgtactttttaataccttactagaattattttgctaatctgtttttgtatttagattcataaattaaactggcagatattccctctaattttcattttttgcactctctggttttggtatcaaagttaagttagcttcatgaaaataagttgtttttgtaaagtaggtattagctattccttaaagagctggcaaatttgttcataaaaccatctgggttgaatcccttctgtaggggaaatatgtttgaaactaatttaatttctttaaaagccattagtctatttgacttttctatttcttttgagtctattttagtaattgatattttccttgaatgttagccatttgtctacattttcaaatctgttggcataaatgacagttcataatactgagctgtgttttaataggggacatgtgattctttaaccaaaggtgcccagtgctttgtttctgtaggtcacaaagttcttaggaaaaattctaaagaaacattgagacctgggggatgggtgtgtgtgctgcagggaggggagtctggattgactcttgagtttctctgataatatctcgcatatgtgaaaaagccgtacagtttttcaacacacgtattgcttgccttatctcttttgtcttctcaaagtccttgaaatgtagattttataatcagtctcaatttgtagataaggaaaggccaatcagacataccagtttatctataatatagatgagatcagaagccactcctagatcacaccattttaattagaagagagtttagagatcatctcattgagaaactcttaacctgggatccatgtccctcaaagtgctcttgggtagacttcagtggctccataatttggatgagaacaaaattacattatttttcactaaactctaagtgcagtttagcattcccttctattatgattgcaagcaacaaacaccagagtagtagcagtactgtgtctccagtagcaatcacagatattttcatggcacattgtagccatcagagataactcaaaatactgtttacactcatcactacttcaaaattacactagttagtagacccgcctcttgatcttgacatgttgtttttaaaagtacatgttactctataccaaatttttaaaaatattttgataactgcagttcaaataattggcctcctttctaatcctttgcattcatttacttgtttattgtgataaaatatacataagataaaattgactattttaaccgtttatagtacatgtttgatggtattgagaaaatttacaatgttgtgtaaccatcaccactatttccagagcttttcatcatcccaaatagaaactctgtaaataatgaagcaataactcctcattcttcccttccccaccccccagtaacttctattctacttttttctctatgaatttgcctaaatacctcatacaaatgaaattctatcatatttatcctttggttgttagcttttttcatttagcttagtgttttcaaggttcatccatgttgtagcatgtatcagaacttcattctttttgtggttcaaaaatacgctacattttactccattcacctgtcaacggccacaggttgttttcacctttggactactgtgggtttttttgttttgttttgttttttgtttttttgagacagggtcttattcctatcacccaggctgcagagcagtggcgtgatccgggctcactgcaaccttgacttccctggctcaggtgatctttccacctcagcctcccaagtagttgggactacaggcacacaccatgcctggctaattttttgtattttaagtagagacagggtttcatcatgttgcccaggctggtcttgaactcctgggctcaagcaatccacctgccatggcctctcaaaatgctgggattataggtgtgaaccactgtgcctggccacctttgagctattgtgaataaggctgctatgaacattagcacacaagtatcttcttgagttcctgctttcaattcttttggatatatactaaggagtagaattgctgggaaatatggtaattctatgtttaactttctaggaactgctaaactgtgttcaacagtggctgcagcatgttacattcccaccagcagtacacgagggttccaatttctccacatcctcaccaatacttgttattttcattaaaaaatattaattaccatcctagtgggtgttgcattttattttaggcatgtaaaaactttattctgagaaggagtcatgggcttctccagactgccatgggggtccctgatacaaataaaggttaggaagctaggatgagggaactcaagagctcagagatattgtcacatgtccaaggtgaggtgatggactagcagcagcccaggcattagaactaagtttcctgggtctcaaaggagcccttttccctcctaccagatggtctgttctcatgtacatgatccaccccagccagtggtcagaactgagtcagagctggagctaagccattgaccaaccagctactgaagctgaggccagcaccagacacagactagatagacataattaatccctgtttgcaaatcactgcaatgtagaactaccatgcaccaccacagctgctaaatccttatccagcctacaaacatccactgaatgcctgtgtgcagatcaaactccatattcagttggagtgtttgggggacacttacggggacatcaacggacaatttggtttataggtataaagttcaggagggagaaataaccctgtgtatgtttcatttaattacagaataggtgtcttgatctctcgtttctttgtggggaccctctatttccgcagaggcaggttcagatggcctcttgagtctcatcgcccattttcttactgagctctgtcagccttggctcctgaacctttccacacttgtcagctcagtttttaaaataaccatagctgactttttttttttttttttttttgagacagagtcttgctctgtcgcccaggctggagtgcagtggtgcaatctcggctcactgcaacctccatctcctgggttcaagtgattctcttgcctcagcctcccaagtagctgggataataggagcctgccaccacacccaactaatttttgtatttttggtagagacggggtttcaccatgttggccaggctgatctcgatctcctgaccttaggtgatctgcctgcctcggccccttaaactgctgggattacagaagtgagccaccatgcccagtcatcatagctcacttttttttttttttttgagatggagtctcgctctttcctccaggctggagtgcagtggcgcaatcttggctcactgcaagctccacttcccaggttcatgccattctcctgcctcagcctcccaagtagctgggactacaggcgcccgccaccacagctggctaatttttttttttttttttgtatttttagtagagatggggtttcactgtgttagccaggatggcctcgatctcctgacctcgtgatccacccgcctcggcctcccaaagtgctgggattacaggcgtgagccatggtgcccagcccatagctgacttttaatgagttttaattctagctctccactgtgcaaccatgaataagtaacttaaccaccctgaagttcagttgtcttgtttgtaaaatgaggataataatgatacctccctcatagagtggttatgaggatggaataagacaatacacatagagggcttggcacagagcctggcacagaggaagcatttcattagcgctgttattgttgattttaaaatttattattaaaagtcactttgacgcctataatcccagcactttgggaggctgaggcaggtggataacctgaggcgaggagtttgagaccagcctgaccaatctggtgaaaccttgtctctactaaaaatacaaaaaattagctgggcgtggtggcagacgcctgtaaccccagctactcgggaggtgccttgtggtaaaagatgggccaaggagtttttggttttaaagcgaaagcctgtaatcactgtgcctgctcacagggggattgctatggctaagttcatagataattgggtagttggctgaggcaggagaatcgcttgaacccgggaggtggaggttgcagtgagccaagattgtgccgttgcattccagcctgggcaacaagagtgaaactctatctcaaaaaaaaaaaagtcactttgtaagttgcaaagtatgactctactatgagatctttacaactaggaattaagccagttacgatggcccatgcctataatcccagaactttgggaggctgaagtgggaggattgcttgagcccaggagttccagaccagcctgggcaacatggtgagagcccatctcaaagaaaacctaggaatcagagcttctcatctctgggcctaaaacatctggtggagtagcttctcaggaactgtatactgaatgaatgagtgagatgacatttactaacagttttattaacttttatcttttatttacctatttgaccatctactgtactgacttaaatataaaatagcagtttttctctttcaacctttttttttgaggcagagtctcactttgccacccagactggagtgtggtgatgcaatctcggctcactgcaacctccgcctcctggtttcaagtgattttcctgcctcagtctcccaagtagctgggactataggtgcgccaccgtgcctggctaattttgtgtttttagtagagacagggttttgccatgttggccaggccagtcttgaactcctgacctcaggtgatccaccggccttggcctcccaaagtgttgggattataggtgtaagccaccatgcctgcaccagcccctccccgcccccttttttttttgagacagggtctcactctgttgcccaggctggagggcagtgccctgatcttggcttacttcagcctctgcctcccatgctcaagtgatcctcccatctcagcctcccaagtagctggggccacaggtgtgcaccaccatgcccagataattttttgtatttcttgtggtagagatggggttgcccaggctggtctcaaactcctcaactcaagcgatccacctaccttggcctcccaaattgctgggattataggtgtgagacaccatgcccagcctctttcaactttaaatcaagtatcagtcttagaatcaattctctgtagaatttgtcatatgagtcagtctgctctctatttctatgagtttggcttttttaaattccacatataagtgaggtcatgcagtatttgtcattctgtgcctggtttctttcatttagcataccatggggccaaggacattttttcttttgttttctttttcttttctttttccctgctccagctcaaaggatggggctggggaatctttagatgagtcgggggaaggcctcagtgagaaggtgactcttcttcacatacctgaaggcagtgacaggatgaggcaccagaataatgttgcaggcagagagaacagcaggcaggagtatgcttgaattgttcagtacagcagggaggccagtgtggctcttgccgagtgagtgaggggcccacggtaggagatgagatcagagaagtaacaagggggcctttagtggggccattgaaacagcttaggattttctctgagagagatgggagccattggtaagggaattacatgatttcactttttttttttttttgagacggagtctcgctctgtcgccccggctggagtacagtggcgtgatcttggctcactgcaagctccgcctcccgggttcaggccattctcctgcctcagcctcctgagtagctgggactacaggtgcctgcaaccatgcctggctaattttttgtatttttagtagagacggggtttcaccgtgttagccaggacggtcttgatctcctgacctcgtgatccgctcacctcggcctcccaaagtgctgggattacaggcgacttttttttttttttgagatggggtcttgctctgttgcccaggctggagtgcagtggtgcaatctcagctcactgcaacctccgcctcccaggttcaagcgattttcccacctcagcctccccagtagctgggactacaggggcgtgccaccacacctggctaatttttgtattttttggtagagacggggttttgccatgttggctggtctcgaactcctgacctcaggtgatccacctgccttggcctcccaaagtgctgggattacaggtatgagccaccatgcctggccgatttggtttttaaagaatcacttcttctgctggattgggaatagtctgcagagaggcgaaggcaagcagtgcttaggaggctaatgccatcatccaggggagggatgatggtagggttgagtaatccctggagtgtaacaaacactaaggattattttattttgtggcaaatgtcctaaagctttcttgaacagtaccaggttgctgggaatgtatagagacagcttacagagcaccctacagttttagcaagggaactttcacgtaatataaaggcatgcaggttgtactcttgtatagttgtgtgtacattggttgtttcctgtagcaaaatcatgaagagtatgaattctagagttagagtccctacattcaaatcatggctccaccagttactaactgtgtgaccttgggcaaataaattaccctaacttctctgagccttcagttttccctctagtaaaatggggacagtgggttgctatgaggagtaatgagttagtgcgtgtacaacatttagcattatactgatatataaccatggctcaataacatagtagctatcattatggatatgaatataaccatttgtaaaggtcaaggaacatctctatttaacttagtttatttatttattttttattttttgagacgtagtctagctctcttgcccatgctggagtgcaagggagtgaccttggctcactgcaacctccacctcccgccttcaagcgtttctcctgcctcagcctccagagtagctggcattacaggcatgcgccaccaggcccagctaatttttttttgtattttcggtagagacggggtctcaccatattggccaggctgctctcgaactcctgacctccagtgatccgcccgcctcagcctccaaagtgctgggattacatgtgtgaactaattaacttagtttatttagagccatagcatatggggctgaaaaagaactaagacacttcatttagtctaaccctctcattttacaggggagaataaaaactagagatagaaaattccatagccaaaataaaataaaataaagttatggtccgggtgccgtggctcacacctgtaatcccagcactttgggaggccaaggcaggcggatcacgaggtcaagatatcgagaccatcctggccaacatggtgacgccccgtctctactaaaaatgcaaaaaatagctgggcatggtggcgtgtgcctgtagtcccagctactcgggaggctgaggaaggagaatctcttgaacttgggaggcagaggttgtagtgagccgagatcacaccactgtactccagcctggtgacagagtgagactctgtctcaaaaaaaaaataaaataaaaaataaagttatgcggccagtgtcacctagctggtagcagagtggggactggaacacaggtctctggactcccagtctggtgctttctctgctatgccacattgcttccatagaaccctcagtgcagcaccaggtgggaataataataacaacaataaaggcttatttgactcttactttgcgccaggcactattctaagtacacatatttgctcattttatcctcatgacaaccctatgaggcaggtacaattattgtccccatcttgcggaagaggaaactgaaggagagagggataaagccacttgcccagggtggagaatgagtgtggtgtgggagacatgggcaggaggctgctgccccgttacactgcacgacctgcttctccctttatgtaacagggaaattgaatccagtcgttcaagtcctttttcagccttcaaatttgcagaccctaaatgcttttctattatcgggtcttgaataaataccattccacttcattaaaactgctgtctttttaacttgtcttcatcttaatgatcatctacaagaaagactatttgcagaagagcctagaaaccaagtcaccaagcctgtgagagattcctgaaatgttatttctggcttccatagcaaccctaacatagggcgttaagcttaacggagtcagcgagagcagctggagccgggcattgaagcgctgagagcgctgaggaaacaaatcgttggctcaatagttttccttttgtgtaatatactgtcccagtgtgtttagggagttacgacttctgccaagtaagaatggaggaaatgaagcattgtatcaaagtgtacagagtttccaagcaaattggaggatgagtacaagtctgtgtctaggggagtctctgcagaagatgagggtgggcctgcagagacgtaggggtggggaggaggggcagctctgctttccccaaccttgggtgactaggccttcaggtcagctttgtgaagaggactgagcatgcctggttgccttttctgttccaccccgtttgccgacctcagtagagagtgggggtgatacgtgagtgaggcatcaaagaggccaagatgctgaggatgacagaggcagatatgctgaggctgacggagccaccagggccagtgcaggaaacagagctctctaggtatttcaggaagaaaaagatttaacacggggaattcggttatatagttgttggaagggctggaggagtgggagcccagggaccaccacgcaagagcacctcactgggatcaggatggtgctgccaccagaactgacgtctgtgcagctgctgagcagacaccagaacacgaagtctggctgccgcaactaactggctttctaaaaccttgcttgctggcagagccaccatccaccccacttcatcctttgtgaatatattgaattggggttccccaattcttacccagaaccctagctgcctgaaagatagtctgggaaatatttgttttgtccttttagcttctgcaacgctggaagactcatggggagagttgggagttcatgccaagtgccaatggacatggacagcaatcgattttttttttttttttttgagatggagtcttgctttgttgcctaggttggagtgcagtggcacgatcttggctcactgcagcctctgcctcccgggttcaagtgattctcttgcctcagcctcccaagtagctgggattacaggtgcacaccaccacacccagctaaattttgtatttttagtagagacggggtttcgccatgttggccaggctggtcttgaactcctgacctcaggtgatctgccttcctcggcctctcagagtgctaggattacaggtatatgccactgcaccctgccatttttttttttttttttgagatggagtctcactgtgtcgcccaggctggattgcagtggtacaatctcggctcactgcaacctctgcctcccgggttcaagcaattctcctgccttagtctaccaagtagctgggactacaggcacgtgccaccacgcccagctaatgtttgtattcttagtacagatggggttttgccatgttggccaggctggcctcgaactcctgacctcagccgatccgcccgccttggccttctaaagtgctgggattacaggcatgggccaccttgctcagcctgatatttatttcatttgaaatttggattaaataggtagaggagttgaacaccaaatagagatgagttgaaagggcccatcgttgacctaaactatttgctccaccatctgaaagtcctttgggattaagtccagggttagataacagaggggcagaaactcaactcccagagacaaaggagtggccttaacattctctctggtgccttctctattagtatatacataaggaaacattaatttacacccaagagtaggctgggagcttggatgggaggggaagcagggttgggggtcaggcctggagagattggctttgggctgggccatagatggagaagactgaagtctgggctgtcaggaacccttagaataagcctaaaataggaagggcacatctaaaacccttcagtgctcctcgtttgtcctaataaaatccagaccttttttttttttttttttttttttttggaacagggtcttgctctgtggcccaagctggagagcagtggcacaataatggcttactgcatcctcaccctccagggctcaagccatcctcctgcttcagcctcccatgtagcgaggactacaggcctgcaccattacacccggctacttttttttttttaatctattgtagagagggggtctcaaactcctgagctcaagtgatcctcttgcctcagcctcccaaagtgctgagattacatgtgtgagccactgtgccctgcctgaagtccagacttcttatgcaggaggcacatgccatccacccacatggccctgtcttccccaacttgtcctttaggacccagccttgccacatcacctgtggttacctgggtgcgtgtgcatcccactctgttctggcctccagcttttgcatacgctgcccttttacctaaatgcacaccccagcttgttgcctggtcaacacctgctcaccttataataacatcatcctattataatactcatcaccttgtccagggatcttcccccaccccctatcttgggactggtgatctactccaggctctagtcactcgtccttttttgttgttgctttgttttttgtttttagagacagagtctctctctgttgcccaggataaagtgcagtggtgtaatcatagctcacggcaaccttgacctcttgggctcaagcgatcctcccgcctcagcctcccaagtaactgggactacaggcgcacgccatcatgcttggcttgtgaaaaaacttttttttttgtagtgatgtggtatcaccatgttgcccaggctggtctctaactgctgggctcaggcagtcctcctgccttagccacccaaagtgctgggactataggtgtgagccatcgtgcctggcctgctcatattttttatgaatcttaatgaatctgtcttctctacagggttgtaagctcctcccaggctgagactggttctcatactctatccctagcacccagcacaaagaggggattcctgcaatgtttgtacaactcaaccaaaccaaaatgatgatagaattgtctccgaagacaaattttgcctttgctggcacagggctgtggaaccttgtgccctgttatctaactggccccttcctccttgtgtacctacacctcctcccctcctccttccagggaaaggccctgaggcgctgtgttttggggcctccacctccttcctctcctctcttgcagcccagccctgtgttgctatttattcacaggtctctgctctgctctggctttcacttgctgaattctcagaaagcagatgaagcaatttattcagttaaagtgcccctgtgggtcaaatgccagcttgctttttaaaaccttcctatgctgctttttactttgcagagagcagaaattacctgttttgtttcctggtgctttctgcactctcttgtattgagggatggttgtgtgtctgtgtgtgtgtgtgtgtctgtgtgtgtattacaattttaacgtacatgtcatttctcaatttgagaaaggaagaaagatagtgagggggtttgatagagaatatcaaaattattttgtatgtattcagtcagctcattttttaaaagaaaatgttttaatatcactggctatggtttttattttattttattttattttattttattttattttttgagacagagtctcactcagttacccaggctggagtgtagtggcgcaatctcggctcactgcaacctccacctcctgggtttaagcaattctcatgcctcagcgtcccaagtagctggaattgcaggcacgcgctacaacacctggctaatttttgtatttttagtagagacggggtttcgccatgttggccaggctggtctcgaactcctggcctcacgtgatctgcccaccttggtctcccaaagtgctgagattacaggcatgagccactgtgcctgacctgactattgtttttaattttaactttaattttaagttcaggggtacatgtgcaggtttgttatgtaggtaaactcaggtgtcacaggggctggttgtacagattatttcatcatccaggtattaaatctattacccattagttatttttcctgatcctctccctcctcccaccctctgatgggccccagtgtgtgttgttcccctctatgtgtccgtgtgttcccatcatttagctcccacttataaaaaccactgtttcacagcttatttgtacttctctttatcaattaagaaaaagactgtttgtatagcaaactccgagagaggacgtgaggggtattttttggtgagacttgagcaaactgctttacgttgcaaggaaattcaattcattggaaactttttcctccaggactaaactggggcagctttcattttggctctctcacaaagaaaattgtccagggtctggaaaccacagttgttgaacctcatatgacgtctcttttctttcagctcatgcaacatttactagaggagactggtgtgatgtggcgtgtttttcctttccttttttttcctttccattttgctggctcgttggtgcacacttcctgagggcctgagagggctgtcttcctggaggaatttatgacagtcagcagggacaactgaaatttgagctggtgtgaacccataatccctcagggccctactggctggagtctctttagggagcatccttgctacccaaagatgcacacccattccccagcaccttcataaaacaacaacaaaatcttaccatggcattgccaagcatattttgcatacaaacttcccaggatggattctatctccatgggcagatggaatccatcccgaaagcatctttctctgccagcacactcacctgtctctgctctgcaaatgcccttcttggtagtagcttgttcaagggtacgcagagcaaatttggcaattctgaaatttcagcttttgtttgtgaacttcggctctgctcaggaagaacttgtcagaatgaaggttgacattcagcctgtatgtcgagcattcttgagagaagcacacggtgcctggcatcttgaatggcatcagctgcttgctacccagttctttgggacaagtgggtccatgagagaaaatatacagagcagggataagactgcacccgctctggcaggacagggagcctggctaccccaacttccttttcccaagccatctgctacttttcttcttctgcaaccaggcattcaaagcagggtgtatgtgggggaagaccctggaaatcacctccatctgggtgtacattgttacttttatcctcagtagttggtcaagaagtagagtgtattctctatatatctttattgggttcatccccacttattcagaagtagaatctctaggccgggcatggtggctcacacctgtaatcccagcactttgggagactgaagctggtggattgtctgagctcaggagtttgagaccagcctgggcaacatggcgaaaccctgtctctttcaaaaatacaaaaaattagtcgggtgtggtgggtgtgcctgtagtctcagctactctggaggctacgttgggaggatcacttgagcctgggaggcggaggttgtagtgagctgagactgcaccactgcactctagcctgggtgaggctttgtttgagacccagtctcaaaaaaaggaaaaagtttttagaaagttttagaaatactaatttttaaaaaagaagaatctctagcgaccgttcagtgtgatctggagttaggctgttctggttaaacgtagattgtgcctatcgaataataatttctcttaccctgcctagctctacagtcgcctctatacttgtctcaatgacccctgcactgtgagcttcttgaggccaggacctgacgatacagcactaaccattgtattttgcctgtggtgccttcagtacagtgccttctatgtgccggccctgagccaggcatcgatgaaagatgaataagtccaagtcatgacctcaaaggtggcttatagattgatgggacttgcaggccagtaaataccataagtatttgtggggtgacatcactgcacattaagttactcattgggcttactgtcatcacgacctggtgctgagaaggcacatttgaactccggtaggtgcagcagatgaatcactggggcctgagcgatgcctcccagggcactggcctgggcagagggtgaagtggggagatttgcacttaggcgactgtgtcttgagttgagctttatctcctgggtcacattccaggctcagctgccagtcaatgtgttatctggtgatggggagggtaacagggctcttcactcttggccacctactgggagcagtgggtaaaaatgcaggtatgagagtcagaccaacttggggtttaaatccctgttctgccaccactcattaatcccctgactgtgcacttgtcacttaacctccctgagcctcagcttcctcatctacaagtggagggtaacagtgcctatcttctttattttctgaacctaattgaatgccagatatatctgtcatgcatatgatctgacaatggaacagaatatttgcatcaggagacaaaagagactccaggctgtatgattgccatattttcaaggccactcctggtttgggggaagaagatggcaggacatcagaatggggtgccctgccactatcttcttttctagacccttggcagatggtctctcaggctcacataaccctagagacagagttctcaaatttgttgtgcttaagaatcacttgtagcaattacaaatgcagattcctgggccttaatcccagagattctgattccctgggtctagggtacagctggagtgcagtggtgcgaccacagctcgctgcagcctctgcctctcaagttcaagcgattctcctgcctcagcctcccgagtagctgggattacaggtgcccgccaccatgcctgctaatttttgtgtttttagtagaggcagggtttcactatgttggccaggctggtctcgaactcttgacctcaagtgatccacccacctcggcctcccaaagtgctgggattacaggcatgagccacggtgcccagccgtccccacctctttctgatgttatcgagctgtcgagtatcccagctgcaacctgttctttattgtgtctctgctgaccagcgttcccagcccattccagctcatggcagggtatctgcaatctttctcttccctgccctcccaaccccccacccacaagctttacctggaagctcatgtacacaccaaagggaataagcaaggacccagacaggcagccaggtgcctggcactaggccgggtactagggattcatagaagatactgcttgtggccaggtagctgcatgtgtgagatactggtggaagacactcagacagaggtaagcagggagtgttggggctcagaggaaggccactgaggccagtggagaatggcccattaaggaaaggttttcaaaataggtgaccacagggctgagtcttaagctgaacagggagcagagggcatgcctagcagagagggcgctgtgtagggactacagacaggcagtgtgacattgtataaggtatagggcagggagtggtggctggtggagaaggctgagttcatgagttcattctcccctgaacatcagcaaccttgccattagtgacccttgggatggtggcttttgaagaaattgctttgatggaatagctccccaagactcatggatactgggagtttatgtatgtatgtatgtatttatttatgagacagagttttgctctgttgcccaggctgtagtgtaggggcgtgatctcgactcactgcaacctctgctttccatgttcaagtgattctcctgcctcagcctcctgagtagctgggattagaggggcacgccaccatgcctggctaatttttgcatttttagtagagatggggttttgccatattggccaggctggtcttgaactcctgacctcagatgatctgcccacctcagcctcccaaagtgctgagattataggcgtgagccactgcacccagcccgatactaggagtttaaagctgtcatttctggttcttgggactcagatcaatgaaactcactaaaatattcattcatgggaaagttctggtagaaaggggaagattaaagtccatttttgtcaggagagtctctctctgggaaagtcattgatgagatgactggggcataaggtggtgtggtggtgtgtgcctgtagtcccagctactctggaggctaacttgggaggatcacttgagcctgggaggcggagtgattgggagtaattggaaagtgacatctggaagacaaatcggtttattttcataagctccctccagtctatgggtgatgggaaattggggtgctgtgtcaagaggaatcctgtggttggactttgattctgagaccaggactgattaggggtgtcggtcacagatgccagggctggggacatgggggtgacatgcaaggcttggacttgccatcctggctccatattttatcatgggaccagctgtctcccttcctttggtttatgcagttgatttcgaaccctacgtgcagggcttgacatttttaccaattacacttcatcttactagtttctactcattattccatccctcagaaaccctttctgggcctgtctgtgttactcagcttattaacagttcctcccagcatcgtatgcagtggtgtagggagaaccataaatgcctccagaatttgcaaaaatgtttggaaaatgttaccaagtgggaaatgatttgctaatgagttcacaatatgtcttagacccattaagtaatccagggtgtctccctaatatagtagaagcaagttttcagaatattccccagcggttttttcagaaaatgtgaatagagcacgactgagtcaaagaaagccctagctcatcaactgcattctacagtgtcaggcctcatgtgatgccgcagctggcgactgactaataagggaattggagaggggaaaattgattatttcctggacaaggaccatggtgccttaatcaagtgccctaaatgcaggggactgcaggggaagtcgcactgtggtaaaaaaaaacaaatatagtctaaattacatctgaagtagcctttcaattacccttaagcactgagagctggtcacagtctggaggcacacagggacagaagcacctgaggaggctcaggggccgcatctcaggtgtctgtggacatgcccctgagggagcacagtggtgggtgggatcccactgctgtgtcgcacggtcgtctttgctctcagtccatctgtctctctgtctctctttgacaagcccatgtagttcaagtctcataaataaaatgcgtacagccggggttcccaagccccatgctgtggaccgatctcagtccgtggcctgttaggaaccaggccgcacagcaggaaatgaatggcaggtgagcattaccacctgagctccacctcctgtgagatcagtggcgacattccgttctcacacaagcgcaaaccctattgtgaattgtgcatgcaagggatctaggttgcacactccttatgaaaatctaactaatgcctgatgatctgaggtgaaacagtccccctcttccccactctgtccctggaacatttgtcttccattaaaccagtgcctggtaccaaaaaggttggggactgctggcttatcggatgcaatttccttgtattctgatgtgctagttttatattcttatagtggaggatccataccgctttcacggttttatgagaaatatctcttacaatctttctatttgttttgctctgaccccatgcccacctggcagccctccgtcatgagtgcagttttacctggaagctcatgtgctgacccttcacatagccagccttgtctgcctgcccttatttctcactgaaaaagaatgttagcctttatagtcagacggtgtctcatatgattagctagtttacctttattcattttttcagacgtgggtaaaattgagtacttcaatctttgtcgcagagcaccaggctctaagaccaggttggtagaaggattctatttcatgtgccagttctgacaaattgtttattggtactcaaagtgccatgttgaaaggatccaggctgagggggacagggccagaattgattaacaatgtctgccagggactgaaaaaaatggcattgttaagcttgccttagagcctgagacagtcaaccattccctctctcctctaccaaaaggtagtcaaccactccctcactgtccttctctctctcagcatgtatcattagagacctccttccagactggcttgatctgtttatatttatcaacaacagcacactgtatctttttggtctgcctgcttcattgtatcccgttattgtgtccttttcacagtcaggagtcttttccttcctctgtatccccaggccctggcatacaataggtatgttgaatgactggctcacaacctaagagttctacctaattgttctgcatgcagggaatctgccttattagggtcagtcgtttgccttgctgagatccatactacagagttccgtggatcctcttggtctgttccatctaggaataaaacgtacattttgcatgcccttttttttttctttcttaaactcctgctagctcattacgatcatggcttgctgtctctctctctctgttcttctctcatcataaaacagcttcaacttttctccccagtgtccctttgaaactgttggtgagctagttttttctctgtccctttaggaaattttaatcatgtttttaatcatgcttcatagtgttttgggtcacccttcggtaatttttaaaatcctctggttattcctagttctaagaacaattttagctcttggcttactgctactctgtccagcattacccttgtcataattgttggtgatttcaagatccacatgaatcatgaatcatcctttaatagctttgagattcttttctccaatattcttgtcttccaccagatctcagccactcacttctctctctctctctctctctgtctctctttttttttgagacggagccttgctttgttgcccagattggagtatagtggcacaatctcggctcactgctatgtctagcctcccaggttcaagcgattctcctgcctcagcctcccaagtagctgggataacaggcacctgccaccacggccggctaatatttgtatttttagtagagacggggtttcaccatattggccaggctgatctcaaactcctaacctcaggtgatccaaccgccttggcctcccaaagtgcggggattacaggcatgagctactgttcccagctagatttcagccaccttcttctcttatcttgaccctataattacagtaactttaatcctgccataatctcagtttaaacctcctatcttcccagcttacctgtactagtattccaactccaacaattctgtgaccttatctggacttccagttaattgatcctgctattttttcactgtctttcacctcaattcctctatttcctgcttccccagctttaattctatagggaatcactatagtcactgtcaactacctttgcccctttcctgattcatcgttctcgtttggccacatgataacccttgttaaattcaacttttaccagccttccccccatatctgtgtagctgaatgtggctgtagcaaaacatgcaaccacctggattggtctcatgtaaatttcataattgcagcctttaagtaggcctttaatgtggcctggaaatcatactctagttccctaatcccttcactcttccactgtcctagaaactgttacagttttttttcacttgtgttattacatttttcatggttctcttgttaagtgcccacaaaccatctgctcgtgggaactttgctgggaattgatatggaacatcacattttctgaaatcaattttcctgggtatttgactactgtccagactgtagtccttctattccccacagcccctcaaagatcggtgacctctctctttccgtcacacctgtcccgtccttcattctccccctggcccttgaccgtactgaactctccgtaagcgcttgtcgaggagtaagaatgggaaccatcagtggcttgacttactgggctgctgctatccaggcaggcaacatctgttttcatcatattattaagtgtttttttttttttcagcacttggcaggaggtaggcaagtttgggccatagctttcaggccctgagtccaggcaaggaaagaactgaccccagagagccaatccagccctggtgcatcttgagtattctggaaatggcagatctaaaaggacaaaatcatttcatattcatcatgagtatagcttggtggttaagagtgcagactacggagccatcacgatgggttcagatcccagctcctctacttcctagtgataaaagaaaaaactcaaccaaattaaatttaaaggagtttaactgagcaatgaacaatttgtgaatcgggcagcacccagaatcacagcagattcacagagactccagtacagccacgtggtggaagatttatagacaaaaaaagggaaatgatgtacagaaatcaaaagtgaggtacacagcgggtggattggctacaggctggcatttgtcttatttgaacacagtttgaacactcagtagtgtatgaatggttgaagtacggccgctgggattggccaagactcagctattgttacaggtgcatactcctaagttaggttttcaatcttgtgtacttataagcttggttgcagtttttccacaaagactgaaatatagaagcatggagtcattctcaggccatatatacttcacttttatactagataggagaactcaagcaagttatctaacctctctagactcactgtcctcatctattaaagaacagtaacaacacctactttctaaggtgtgttctttcctactttctaaggtgtgtgtgaagaataaacaagccaacacctgtaaaccattcagaacaaggcctggcactaattaagtgctcagtaaatattagctataaattacgattattttctcttttgagtctcacaacagtattgtaaggtattattatccctattttgcagaggaagagactgagggtcacacaggttaaggagaggctcaagatcatttggacagaaagtggcagaggctgggcttgcatgggatcataggactctaatactgtttcacttaggatttcagagccccctttggtctccagatgaaatgattttacccttgtcatggagattcatattcattccttctccaaatgtgtcctaacttccccatgcagatggcaccaaatatttacagtatgattacacggccatgattgaatttagccagaacgggagagaggctgattagtgacaaggctgcaatcttgagaggaggaaatagttctgacgttgcacattgtcattctgctggagtaggaatgttgcttaaaattgtcctggctcagttccctttctctggaagagtaaaagacacgcatttgcccaatacatggactttggagtcaagctgacagtactggaagagctgttaacagagtccagattatcactttatggttagagggatgatgttttattatgggcccacaaactgtcctccaactgtggctgaaaaccctgtcatgagaggccagaaggaagatcattgtatgttcttctcccaggccaaggagacaggatgtccttcatcagaaccagttgtcagcataagaagaacacacaccaaggaaatccatttcctggaaacatctctcaacagttcccatgtggagaaactgtgaagcttttcacagcaaatgttttagagtgttcccaggtatttgcaaagctcctatcataatgctggctgtactgataatttcctaagggtgcctgccatgagacgatggaaagggcatcaggtctgaccatggtgagccatgagggccttgcagagatagagtcaactctctgggcctcagttttcctttctataaaatgagtgacttggactctgttgggacccctctgcctctaagattctactagtctgtgattccatgagtcaaacttcagaagtggttatggtccctcataaaatggcaaagatttgggtcctagaatctatgactccattagcaggaccacatctcctctagaacattttggcttcgtgcttgtcatcatctttttgtactaactgctctgattcaatctctttccctgaagacttgcttccaccagaattccatttaattccacagatgttgaatgaagactttctgtgtttccaactgcatgcctacaaagataaatgagactagtttcctaaccttggggaattcccagtgagatagcaaggtcaagactttatagaacttcttttctccagagagctctctatttctttgacctgtgtgtgtccctagaccagtaatattgacttcaccagggagcttgttagaaatggaaacctacagaatcagaagctctggggttgtggtgcactggtcttagttttgttctgttttgttttgtttttgtttttgtttttgttttcgtttttgagatggagttccactcttgttgcccaggctgcagtgcaatggcatgatcttggctcacagcaacctccagctcccaggttcaagcgattctcctgcctcagcctcctgaatagctgagattatgggcatgcaccaccacacccagctaattttgtattattattattatttttttttttagtagagatggggtttctccatgttgatcaggctggtcttgaactcccaacctcaggtgatctgcctgcctcggcctcccaaagtgctgggattacaggcatgagccactgtgcatttggcctggtcttagtttttaacaagtcctctagagagttgagatgcacacttgagtttgagaaccattgaactagccctttcagggacaagctatgagactgtggttctgagccctcaagggacccaaggacacattttgaagaaaattcagttacttgggctgccaggacttggtgttttcaactcagaattacagctttcttggaacctccaacaacattttgaacctttgtggcgtttttgtacatgtgcaggtgttgtggaaactacccatttgttttgaagggaaagaatccagtttagcacacaattctccatggaacttccaggcttccctttaaattgattgtgatgcttggatagatattgacaccatgactaagacccataataaaggcccaatccaaggaggctctgctacttccaaagatctccaaaggaagagagttctcagagtgcgagtcttgtgtgaatttccctcccttcaaaggtgccttaattaatatcctcctccatggcagggtctaagcctggcccctcttctcagcaggtaaagattattgggtcacactctccctgcagtaagttcagacatgaagggtcgggcaggtgtggctcttggagagggcctgcctgggtcttgggaatgctcccccttgtcctccttcctgggatctgcagatccatcatctactgccccaacccagggctatatgctaaaccacaggagccttcatgaaaattagaaaagcactcctgcctttttttttttttttttttttctgagatggagtcttgcactgtcacctgggctggagtgcagtggcgccatctcagctcactgcaacctccgcctcctgggttcaagtgattctcccgcctcagcctcccaagtagctgggactacaggtgcgtgccaccatgcctgactaattttttgtatttttagtagatttggcgcttcaccatgttagccaagatggtctcaatctcctgaccttgtgatcctcccgcctcggcctcccaaagtgctgggattacaggcgtgagccactgcacctggctgaaaagcaccccccttaaggtgcctcttagggtggctcagcccctggggctcagggcttggctggattccagttcctctcacctccttgagcaggtgcctgtgtgcagcaccaaccacatagccatagctgtaaccctgcccctacccagcctggggctggacatgagtgagggctgatggaggggtggggagagcctgtacatgcagccagcacacgtcgggagttcccaagtgctggatccttcattacatcatttccttaaattcttacagctgcccaacgaggtggatattggttgcacctctgtatatttttttctttttctaaattatgaaagatttcaaactctcagtgctcccatgttctcatctatgcaatgggtatgatgcttcttgatcctttctcaaaaacttgttctgaaaatcaaatcacaccaagtgacaaagtgctctggaaatgttaggtttcatatagatcttatcgctgaaccctcaaaggctcactttctggggcctctgttttgagacactcaccctggactcacccagccctcagcgttatgcatgggtatgtcagaacgttggtttcttgccaggctactggtatttgtgggtgcctcctcccctaaaatcattagacttgtgaggcggcaaggatgagttgtgtgtgcaggcactcagggacgagtcacagcctggcaagctggcctggacaggatgacttcacgggcctttcccacttctcatttttatgactagctttactgtttcattttggctttctctctctttcttgcagctgtggtgattaggatttagggcaagcatttgggatcccttttctaatccctttcaaatcctgattcagctgcaaagtccgggaagggagtagagaatgggggaggagggactcaccctggtgaaaggcagtagctcagaatatccgagaaactcccaacaggaatgcccagcctccacccactaaagctggagacctctcatctcatccaatatcaccctcgtactagaaacgcaaaagggatgagtttgtctatggactcaaacctttacagtcttcttgcttagaagcttaaggcataattatggtagtcatggtggtaagggacttaacatttgcctttttccaatttaactgtgtcctttgttgaaatatttcttagtcaggtccccttttctctatttccactactgtcctaggattagatctgagtccccctctcaatgagattagtccagaaattatgtataccatccatcttgcaaaccactgccagactctgttgacttttcattatgtaacttccctatgggagaggtgagttacataatatgatgctaagatgcccctcactggtggcatcatgtacatatttctcagtctgaaaggaaaggtctttttaaactggcttcaggccatctgtccaactaattcctgcctgcaactcctagtataccctctactacaaggtctcatcacttattctgttacccaccacattcattccgtcttgggctttggttcatgtgatccactccatgtgctccttctctctaatccaaacaccatgcatctataaggtcagctcacgtcccatttccttgaccccagcccattcatatccctattctcttagcagctattgtcaggatgacacagttttcatgccagttattctttcatggttttattagttaattctccccaggtagattagaagctccttaactttggaccctgtcctaagcttctgttatattctctgcagtgcccagccaagcttatgtgtcatgcagtaaagaataaaataattttgaccctgatcaggtgtttggttacataaaaactgcattggcaactttctagaaactaatatattcatttatcttgcaaaaaggattgctatctgattatagccagtagtcatgatcttccagccatgcacaaatatacccttataactttcatgagtggggaggaaaattgatgaaggaggtttcaaaggtgatcatcagccccaggatttccaacaatagccagtctgccctgggtccttaactctcttttaatgtttttattcttatttttatttttttaatgcagtctcactcttgttgcccaggctggagttcaatggcactctcttggctcactgcaacctgtgcttgctggattcaagtgattctcctacctcagcctctcaagtagctgggaatacaggtgccgccaccacacccggctaatttttgtatttttagtagagacagggttttacagtgttgaccaggctggtcttgaattcctgacctcaggtgatccacccgccttccaaagtgctgggattacaggtgtgagccaccacacctggcctctcttctaatgtatttgacctctcctctttccccagagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgaccgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcagtaagtcctgctcctttgtcactcttctagaggaaccactagaattcattcattcatcttcaagtgttcattctgtgttactatgtcccaggtactgtgctggcaataggttttcaacaaaggccaagataaacacaacgtgctccaggggcttacactttggccaagagacacatgtttttatttatttatcttttagagacagggtcatgctctgtcacccaggctgtagtgcagtggcatgatcacagctcactgtaacctcaaactcctgggcttaggtgatcctcttgccttagcctcatgagtagctgggactacaggtgtgcaccaccatgcctggcttattttttaactatttgtagagacaacgtttcgccatgttgcccaggctgatctgaaactcctggcttcaagcgatcctcctgcctcaacctcccaaagtgctgggattataggcatgagcacccagctaagacagacattaaatatataattatacaaataagtaactatagttgtcacagtgtaatggaggaagaattcaggacatgaaggagtgtgcaaccccaggaccttatctaggcctggatgctcagggagattgccctggggaagggacacgtaagcccaaaccacagaatgaggaagagtagatagacagagtttttcttcagcacatggagctgccctggaattccctaagttggaattcatgagttggagtacggataggaatggaagggcagaaaaagtaacataatctctccttggatggtgtggaataccaaggcatttttgccccatggtggtgctggcaggggatgttttctcagctgacaaagaggtccagcgtatacagaggaccaaggtgtggtcctggcagctccccacctgttaagattgtaggggccactcctcacctgccaactctttctgcaggaagatgcctctcggagcccctgagctgcattcttctatgttggaagctttctttcctcttttgctttctaaccctcttttcacagggcttctctctcccttccttcccacgcactttccagttatctctacccctgctgctgcccccactcttctcagcaggtcagcctgcattctccccagtttcctgcctctgcggctgcctttttgttccttcctcctccgggagggcagggggccagccgcccaatccaggaaactcgcatcctgatttggtaaacaatgtcccaccctgacttgtccattcccagtggtccctgtcccctccagctaccatgaatctttggtggggaaataaagggaaataatctatttttaaatatctatttgtaaattatctatatgtaaatatctatttgtaaaatgtaaaatatcttcctagagcagagtggagaatgagctttagagccagactcagcaccaactccccaggagagggcacccaggagggggttctcagaatgtgacatattctagacctctaagatatagcccccagcgaagaacaatgtgcttttgatgtgtattaaacaaaatcccctgctgagaactaacttcaaaaagcacagagatctcatttgttcttgactccagaatcaaaagatttacttaagaaatcaatgccatgaagaaaaaaagaacctttttccttgccatgccacttggaaagtgttcagaagtgccatttccctggcactgcagaggctgtgttgttgtggtgtgttgtggcctaagtcagctggaacacttcaatcagcagaacacactgcaaacattttcaaggtttatgactttaaatgacttctgcagaatttatgtttcccctttcctgaaaatattaaaagggaaattggttctgtaaccattttgacagcttattcatttgtgttggaaaattttaatggaggggttctttttataagccttctgtatttatcagaaaatggaaagataacatgataaggctgaggagctacacaatgggactgaccgcccccctccccccacccccgcaatcctggtgtcgaataggatataccaatgtggacttgtctgtggaaaaaccatctctgtgtgctttctggcaaggcagcaaaatgaaaaggcagtttggacttttcctcccttcatcttctttgttataatctggaagctctaagaaaacattagcgttatcccgcttgttcctgtgcctgagaaatgaatcccctgtgagtccccccatccactctgcaggagacagggctgctgtctctcactgcactgcactgcccggctttgctcagcagactcagcagccgtcttgaaaggctgaagaggccccagggcctctttatcaacttcatggtaaagactgtagtaactaacatttataaagcactttcccttatgttatcgcagaaagccccaggaggcaggcagcacactcttgccactctctttttacaggttaaggaacttgctaagtgaatcacctgaaaaacaaatagccaagagatagttggatgctaattccaaacctcttgctcatttcactcctctgcatgttgggaattacaaattcctcttttaaggtaaaccattttctggtggccacctccacagtccagcctggccaggtaaacctactttgcaattggcattcacctaaaataggtgaaactctgaaggcagccttcgtaggaggaagaggagctgactctagttgtacaatcttgagcaaatcctttgtgctctctgagcctcagttgcctcatctgtaaaatggggattttatatgcagaaagtagatgagtgaacaggtgttgtaaatggtagagccctattcagtgtgcactgtgttatgtattattacaatcaaatacactgaggaccgatgggctaggcagatggcctcagttttgatctgcactcaaatgatcagacaaaaatggtgagcattttccaagttgcagatgacatctctgaggtttgggaagtctcatttgttccttaaacattcattgaacctgtaaaccaaaaagtatctgagacaagtcccaatcaatgtaaaagtttattttgccaaggttaaggacatgcctggagaaaaggaacacaaaatcacaggaacaatctgtggtctgtgcctttttccaaagatgattttgagagcttcagtatttaaaagggagagagggagggcatggtcacattactgaatccacatgttgcaagagaaaaggagcaggtaggggaacagtcaattatgtattcctctagtgctcagtaaatcaacactttacataagataaggtgaacatagagtagctacttatgcagatatttaaccttttatctgtagctatctgcttaggaacaaaagcaaaggcagtttcttgcattactcagcttttagcttaatttttttccttttggcatagtgatttgggatcctgagattttattttcctttcacaaactgtaccccaataatagctaatcttgtcctgtgctaggtactttcaaatacagtattccacttaatacttaaaatagccgtttgagataggtactatcattatcttttttttttctttctaagagataaggtctcactatgttgtccaggctggcctcgaactcctgggctcaagcaaccctctcacatcagcctcccaagtagctgggactacatgtcactatacctggctctattatccctattttacacaactggaaattgtcagggtctgcctgggggctccaggagagctttaaagatgaggtgatactaataatcactaacatttcttgatattaatgtatgcatgtgttgtttcaggctattagtgtatgttaactcactttattcacacaacaaacctgtcaagtagatgctcttatagttcccattttatggaagaggaaattgagaaccaaagaggttaaataacttgtccaaggtcacaaacctgtaagtgctggagcttgtttttttgtttttatttgtttgttttattttgttttttgagatagggtctcactctgtcacccaggctagagtgcagtggcatgatcatagctcactaccgcctcaaagttccatctcagcttggactacaggtgtgcgccgccatgactgaataatttttactttttaaaaaagaaacaatgtcttactatgttgcctaggctggtcttgaactcctgggctcaagcagctctcctgcctctgcctcccaaagtgctgggactacagacatgagccactgtgcctggcctgtaagtggtagagttgagacgtgagcctaggcattctgcaggcagaactgaaaatcaatgctacatctgcagattgggacaggttctgtctgggtgtgatcaaggcaggacctttatcatacagtgaggaattgattagactctgcagccagacctcgctgggtgagagtcctggcttttttctctttggctgtctggctgtacaatcttgagcacagtggaggctttatacttgcaggcagggacttcccataccagccacagcaaggggaatcctgaggttgcattctcaggccacccttgagaccaccagggagaggccaggtgccctgtgaattgaggtcctgtctacaagatgaccaaaccccacacatcctggagtctgccatttttgccacccagtaagagaaaacatggaatctatgggctgaaaacgctgtccccagtgttctggtgattcttgccacctgggcgagattgcttttaattaacctctaggtgctgactttatcagcctcatctggtattttggagcagggagccaggctgttcctaccctaatagccccaccccacccaggccaggcacaatttaaggccctaatagtattcctaggacacacccttcatgaactggcctgggcagtctacactgatggcacccctttgaggtcctgatgtgaagtggggaggctggactgacttcacaaacgttgagtctactgtgcccagtaatacaagacctccagcccacctccctacactgaccactcctttagtcattcatacaatcattaaaaaaaggactgttcttatttcctagtcaacaaatccaatcccaccaatgacttaggctgctgattagttattcctccccgctgaacacaaggccttggctgagtgtaaacccagagggccttctgagaaatgaggctcataggactgtttccagcaggccggtggaggaggcaaggctgtggtctccccttggctctcaccgcaaaggcccatcccacagagggcaaggcatgaggcctggatgctctgaaagtcactcagcactcacccacagcattctacagatgggaaagttttattctagtttagtgaaggtgtttgagattcttttggttgaaagtgtcaggaattccatttttttctaaaaggaggggggagtgcattatattatctatggaaataaggatggcagttgtgagagtcctgctttcactgcatctcccctccactcctctccttctccagtccacagtcaggaagcatggccccaccagcccctgaggctcacttgttctcagtttgagcctccttttattcagttctggttcctaaatgccagtaaaggactctgattgtcaaaccctgtaccaaccaacagtggccaggagtgagactacctcagaccaccacggcagctccccgatgcaaggtgtctggagtgagaaggaagggcagtttctagaaaaaccaggtaccagattaaataataggtgtctgtactgaggtccctagaggctgtccatgcctttactctacaggtaaagaaatagcctacaagagctacctgatttcccagaacttccctcacttgttcgaggtagaggggaactagagcacagtcttctagctcccaatccagtgccttttccattacaccaagttataatcttttttagttccagtttctcttatggcacatggccaaaataagccttagtaacaagctgtcattctgaaacccaatgcaatagttcttttaattccccctccccactaacttttttttttttttttttttttttgagatggagtcactctctgtcacccaggctggagtgcagtggcacgacctcagctcactgcaacctctgcctcccggtttcaagcaattctcctgcctcagcctcccaagtagctgagcccaccaccatgcctagcttatctttatgtttttagtagagatgggattttgccatgttggccaggctggtttcaaactcctggactcaagtgatctgctcacctcagcctcccaaagtgctggtattacaggcatgagccaccatgcctggcctaatttccgcaattgataggtgaagaaagtggagttcagagaaaccaagtcatttgcacaaggtcatagggagtggcgaagctgagccttcaggtggtctatttccggtagccatcctctccccacgatgctgcctgctgcccgccagatattttctctgcctcacatctcctgtcttcttattttgtctgttagggtctcaccaagaagacaggcaccaggtacatcacttgggcctcccactcatgacagtgggtgactgccgtgtagttggttgcctacacactacacttccttaattatggagagagacagtgacatgctgtgagtgccttagaaatgtcctctgcccgtgggtaatttgactccagcagtccaggaaaagaagagagtctttcaggatgcaaagcaaatgcaaattaaaagtgggataatgattacccctcaccatacgattgtcaaaacttgaagtttgataacaccaagtactgaagttttgaggggatgggaatcgttaggaccatcgttgctgacatgagctgtcttggaaggcaatcaggccatatctgtttaaagtgagacccagtcctagagaaaacatcgtacatgaattcaaggggacgtgttcaggaatgttcatcacaacactgtgaaagtgaaaacttggaaaccacccaaatgcttaccaatggggaaatggccaaataaaatgaggaaagtcatatgaccaatggataaaacaattgggagggataaactagatctaaggttttgattaaatctttaaatctaaaatacagctagttttcattattcacaataattatgttttataaagtcactgcaaacactgagttagagaatactaaaccattgctccatatattcctgatggaatatagggttaggttcctgcaatcctctggtgacaatattttttgtcaactaatcaatacatagccttgttttatgtgtgtttctgtttaaaaacatcttattttttgtttgtttgtttattttttgagacagagtctcgctgtgtctgcagtggcacaatctcagctcactgcaacctctgcctcccggtttcaagcaattctcccgcctcagcctcccgagtagctgggattacaggcacctgccaccattcctgactactttttgtattttttttttttagtagagacagggtttcaccatgttggccaggctggtcttaaactcctgacctcaactgatccacccaccttggcctcccaaagtgctgagattacaggtgtgagccaccatgcctggccgaaaacatcgtatttgatatataccattgattcattaacatcagacccacagccaacggtaactcctgactgaatgaaacttacctaacacatgttttccctgtaaggcacatcgcagcctttctgcactgaggaacactagacggcgcatcaccattttaaaccgcaaaatcacttacagaaagcacagaaatgaaaaaacaaacaaacaaacaaaaaaaccacggtgctaagtagactgtgaaaaggatgcttgttcacagaatgaaagctgaaaaagaaggcagagtggctccttgttcaacctcagctgagaacatctgcaccaggcaacacatttttttgtagtctcagctacttgggaggctgaggctgaggcaggaggatcactggagccccggagattgaggctgcagcaagctgtgactgtgccactgtactccagcctaggtgacagagcaagagcctgtctcacaaaataaactaaatttagagatattttaaattgagtgctcatgcactctgagcatgtccactagtgaccgtgaaaacgctgtgagtattggtttgggcttacaaatacattttagtgagtaggcaaattcacaaatatggaatctgtgaagaatgaggatcaactgaacatgtcttcacagtttgatatctctgaaactggggtgcattttagattccatgaaatacagtacatgtatcaacattgatagaatctgtgattaacgttgagtgaaaactgaggtgaaggtcaatgtatataggatgaacctacagatgtaaaataagacaaaatgccaccataattctcctttgctataaaatggttagcaggtatcttcagcattccccaggcactattctcaacactctaccatctccattaatttaacctttttgaggttcttatgaggtaggtgctatttttattctcatgtcttataaagaagttaagaaaattgcacaaagggctgggtgtggtggctcatgtctgtgatcctaacactttgggaggctgatgtaggagaatcgcttcagctcaggagtttgagaccagcctgggcaacatagtaagacatcatctctatttttaaaaatgagaaaacttctattttatttaaaaataatgataacaataaaagaaacttgtacaaggtcacaaaaaaagctgtttgtttcaccctgaagtaaaaatgactgattggatctacaaactttcctagtgatatttgtatcctaacaggaaccaaaacacagacaatcaaactcagaacagtacattctaaattgtattgttgtgaaatgaaacagctttacttccctagttcatttattgcccaccatatttcttactccaatgtaaagagacataaacttcagatggatttaatcacagctgagttttcacaagtgctggattaatggaattgttctaagcttttgagagctccttttattttagcttcataaaaatatatttctacatatagacatcttttttgtttatgagaacacttgcataacttgttatgtttgtactgttgcttgttaattttaaatacaatcaagttacattgagtaaagtcataaattaggacattaaaaaaagagaatttttatgagctacagacagacttatgcaggaaccaatgtaccagaaagctgaggtacttcaagaactaaatgcagagggcaggcgtggtggcttatgcctgtaatcccagcactttgggaggccaaactgggaggattgcttgagcccaggagtttgagaccagcctgggcaacatagtgaaaccctgtctctacaaaaaaaattttaaaaattagccgggcatggtggcacacgcccatagtcccagctactcaggaagctgaggtgggaggatggctttagcccaggagtttgaggctgcagtgagccatgattgtgccactgctctccagcctggaagacagagcaagaccttgtctcaaaaaaaaaaaaaaaaaaaaagaaagaaagaaaagatgctaaataggtatcttaaattgagacataaagattacagaaacatgaaacgtgtgagtgcattttttactccaaaattgtgtgtatacttttgcatattaaaaatttacgttactcttgaaacatgattttgagaaactgttggttctttaacacattcttgcttatttaatagcttttcctccagccccattgctgcttcctaaaaatccacacttaagtcaaagtcccctctgatgctggcaaacttttctgattccccagcccaccacatgggtattattaagttgaattggaaatttcttgcttttttttgtagatcaaaaccaatcaagtatcagcaatttcatatagttcagcctaacactgtttctctttgattttccatggccctttatctggccctgtcttgtccaccttggactgtgagcccccttgagggtagggactgcagcttatttctctgagtcctgcccagaggagagagtaggcactgaataaatgcttgctggctggaatggagtgagaaagggcatcactgttgacttaccttcctgtgtcttccctttcagcggcccacatgtgcagcaccctggagcataactgtgcccacttctgcatcaacatccctggctcatacgtctgcaggtgcaaacaaggctacattctcaactcggatcagacgacttgcagaagtaagattgctttgctgatgtatttgtggtttcttcctattccctcatcctctcccttcttttatctgggctcattttattcatctgtgatgcctcacccaccccagttatcatcccttggggacagaaataaagtttggtattttctgttgaccccatcacagtgcctagtccagagctgggcacatagtaggccatcaggaagagttggagagataggtagaagcaccatctcagaaatagcctctttggatgtgtgaactggtctcctttacttccaagcttgttctttagcagggactactgaagagccttttcatccactgtctttattaactgtaccctaaggaactgtttccatattttattatcttctataaagtgtggatttaggaagagttgttaacctcggctgggagtgattattcaagttctgttttagaggggtgcagggacccagttgctttggtgtgggacactttataggtgtcctagattttaaaaagggggtaaacagatgtaagatattagaactcgcattctcttttttggctaagtgccaaagactagacagtatactgatatttgagccagcacgaggtagtctaccccttaaaggacagaattactcatacactgagtaccgtgtccttactttttaaagttatggataaagccactgagttaacctacagatgaccaggctaccaaaaacaagtcatgaggaagaccagcccacatggaagcaaataaaactcagctaatctgacacttagttcgtgcagtgcataactgttgccatgtgtaattgttgcagtgtgtcattgttgcaatgtataattgttgttatacctcatggcaagcaattaagcattaatggaaagcagtttgcacaaatggctgtaattagtgtcacatttatagaggccaaccacctttttcatgtttcttctcactgtttttcagttttggggttgagtggttggctggagttctccctgcccctcaagattaggtaacatctacttgaccctccgcttctgtgtggcctgtggaaacccaaagccctctggactctgaatcgcaggggtggggtgggcggtatgtgttcttaggctcctctaagaccccaggatcccaagttgagtgcagcctgaatcatcctcatcttccggttgaagatctgacgcttcctcaaaatccataacaaaaactcactcccaccgaatactcatgggtttcatagagtttcctaaagaactgggggagcctgggaaaggtcatctcacacactgctcagcaaacaacctagagatctctttagacacccccctctagacacctccacctcttcaggtgttctacctccccacaaccatcctctggaggcacccttcctcctcttcaggcatcctcccctctgcccggatgcttctctgtcccatctcagcttcccaccatcttgcccactcccttcctgccctttctccttctccttctctgtctccttctccttctccttctccttctcctcctcctccacctcctcctcctcctccttcttcttcttttcctttgtttttttaagacagggtcttgctctgtcgtccaggctgtagtgcagtggcacaattatggctcactgtaccctcaaccttccgggttcaagcagtcctcccacctcagcctcctgagtatcagggaccacagctgcatgccaccatgcctggctaatttttgtagagatgaggttgctcaggctgctctcgaactcctgagctcaagtgctccatctgcctcaacccccaaagtgctgagatttacaggattgagccgctgtgcctggtgcccttctcttcttaggagcacaaggaattcctctccttgtctcatgtcccactgagtgactgggatctgggaatctgctgatatttattttccgtgggctggcctagccaagccagaggaattctgacaccagcaaataaaaaataaagtgttctttccctaattttatgagcaaggccttcccccacacagcagagtttgccagacccctgcctggtcctgccacaggccctgatgtcccccagatctcaagtactgctctggccttggattcctcctgcctagggatgtgccacaggagaatatgaagcagaccctgcctggacttcagacagactgaccagggggaggggcagggaggtccaggcggaggagggctaggagctcagggcaggctttctcaaacttcagtgactaagaatgagccaggaaactgacttctgggctcacccgcagagatgcagagtcaacaggtctggattttcaatgaaccgacgaatgactgccacactttgagattcactggcctcaggcagtgaggggtcccagggaagggcttagcagagctctgctgtcccgtctgacccagctctccagtcaccctgaagcagttaaaccatcttaaccttcagccagacttagcttaataaatgtgcagtgataaagaacagctctctctctttcagaaggggataatactaataactcttttgctttcccaaaattggtgtaccaggggccttggtggaagaacaaggccttcactgtctgcagatctgggcttgaacccgaccttatcacttaccaactatggctgtctcactctgagctggttatttaaacttcttgactctcagtttcctcgcccataagaggggacgggtggtaacaaatcaatacctgtctcactgattatgtccttgttaggccctgtttttggtctaggggacagttaaaagctgtgccaagtgaaggctgtgccatctactgacccctgctgatgagcagggacctgtgcctgccaacactgagagaaactcacagtgggcctggagaggaggcatgtactccacttctggaagctgtttccacttaatttccatgtcctgggcgtagctggataatctcccagatgaaaagccatgtgggtgacacctcctccccaaagcacctcttactctctaagaagtgcttgccattcattcttccatacaatcattgattggttcatttattttttcatttaacaattgtttttgagcataaaaatgtgccaggcagcatgcaaagtactggaaataaaatagtgaataacacagcaatattctttcttttttggagctcacatttttgcatgggagtgaatcaaataaacaaccagggtaattgcaaccaaaagtgactgcaatccacgtccacctcagtgtgcaacacatgaggtcaagcctaactatagccacttgttaggtgtttaccatgtgccaggagctttcctgagtgttttatatctgctgtctcatttaattctcacaatgagctcttaaagtgggttttatcactctcattttacagataagcaaaataaggaacaaaaagtttagacgatttacccaagctcacatggctagcaatgtgatcaaaccagaatccaaatcctgttatgtcctcgctcttggccatcatttgagactgtcccatgaccctagaggaccccgacatggcagcaggacaacccttcaatcagaaaaccttctccaagccgggaagacagataggttcctcagcccactaatccaggggagacttagaactaattcaggactaacattcaacagattgttacttccccaagtccactgctaattgctgtggtactgtcatcacacaaaataatagtgggagggcctcttcagcaactgccttcaaatacacacacacatacacactatagaaaaaaaaaaaaaatatatatatatatatataatctccccaccattgtatatttgtaatttgtgtggagagggaaagcagacacagttgatccacacattctttgaatggtgatggaccttggctattagacttctggcttcctctcttatggaacttcagaattctgtcccctcccagtgtcccagaggggtgatggttcttacagaatcaggttattacaaaacacctgaatcccatattcagacagcttggatcagcggttgagctgaaatcctacttgtctataatttccacttttatcctatttctgctatctgaagccatataccaaaaagttatttccttatccaaataaatagagaaagcccttcaattattatacagtgttattcccacacactgaccccattcctatcaattttctcttcttcaggggagaaacacatcttttgatgacctagttttgggtctcttcactgtccaggtaaccctcttctgggtggatattagttgtctaaaaagggcctttccattcgaagactagatcaaatgcattaaagaattttagcttccatcacttcttggccttttggctaagatcaaggtgtagaattttatcttccaagttgtgtctatatgggcaattttgaacatactggacctcaacattgtggattccttctgcctttcaaaaagtcttccctgtcaaataccattatatgagatatatgcaagagcatcagcataatactagaacaatggaattttatgttccttccttttcccatttaaaaaaaatggggggaaagaaaacctcatgaagtgtgcccgtcttcacatgctatttccccttatccttccccttcccagaattcctgtcctactaagaaagaactttatcttgtttctttttcttgatatattttcaaaataaggaattttccctttcttctggaacatttaatctatctggaagctgatgataatgcagcatttagaaaactccatttggcagaaaatgtagactttcttatccagcttaaattttttttcttctctcaagaacgataccaaatgcattttactgctttcattctttggaaatgttcccaacattatttttcccaagctacataagtgatttaatagatttatgttagagtttaaacaaggagcatgacccagaaaaaccactgaattattagagagagataactataaccaacattctttgtgaatttagatgtgaaaattcttaaaaatttagcaaatagaattcaacaatatatagaaagaacaatacatcaagaccaaatggagtttattccaagaatgcaagtttggtttaacattcaaaaatcaatcaatataattaatcatagtggcgaggtgtggtggctcatgcctgcaatcctagcactttgggagactgagttgggcgtatcacctgaggtcaggagtttgagaccaacctagctaacatggcaaaaccctgtctctactaaaaatacaaaaattaccctggtgtggtggtgcatgcctgtaatcccaattactcaggaggctgaggcaggagaatcacttgaacctgggaggtgtaggttgtgagccaagattgcaccactgcactccagcaacagagcgagactccgtctcaaaacaacaacaacaacaaaaagccactaaaactaataaatgagtttagcaatgttgcaagataaaaagtcaatatacttaaaaaattacttcattgtatttctgtacactggcaacaaaagtcagaaattgagattttaaaataccaggtataatggcatcaaaaatatgtaaattagggataaattttaaagatgtgtatgatttacacattgaaaaatataaaagatttctgagattaatttaaaaaaaacctaaataaatggagagatataccctatcatggattggaagacttaatatggccaagatgtcaattctttccaaattgatccatagattcaaagcaatccccttcaaaatcctagcagacctatttttttagaaatcgacaactgattttaaaatatacatgaacatgcaaaaaaactagaatagtcaaacccagtcagttctcattattcccagtagttatcatccataaaatatccataaacactaaattgcaaattctgaatcattgctcctagatgaaatacagagttgggttcctgagagcttccaatcacaacattcatcaatcaatacataaacttgtttgatgttctgtttaaacacacgtttttgagtatatactgttaattcattaacattgaaagctatcgttcatattttgaatgaagtacttaggaacaatagacagcagatcagcattactcttgggggccattttcaacagcaaaatctccaacaagaagtacaaaaaggcaaaaaatgtggcactgcatagaccacagaaaggatgcttgttcatgggatgagagctgaaataagaagacagaacgttgccttgtttgaccttacctgggaatatgtgtcctgggtgactcaaattttttgccactctgtgtatgtccatgaatggctgagaaagtgtcatgggtattgacttggggttacaagcaaattttagcaagtaggcagattcacaaatatggaatctgtgaatcatgcacattaaacaaagctttgaaaaagataaagttcatctttaaattttgtttaaactacctgatttcaagactaagtataaaacaacagtaatcaagacagtgtggcattggtataaagatgaacatatagagcaatggaacagaacagaatcgagaaataacccatatgtatgtggtgaaatgattttttgacggagtgggaaggcaattcaatgaggaaacaataatgtcttcaacaaatggtgttgcagcaattgaactgccatgtgcaaaaaagcaagcaaacaaacaaaaggaacataaatcttgtctttacctcataacatgtataaaaattaattgaaaatgtattctaagcctaaatgcaagagcagacactattaaataccatgatgaaatggtagaagaaaaatcttgatgacctcaggttggcaaagatttcttaaatagtacacaaaaagctacaaaacataaaagaaaaaaatcaatatatttaatcacaatgaaaacatttgctcttcagtactctgctactaaaatgaaagggcaagccacagattggaataaaacatttgcaaaacatatgtccaacaaaggactttagaatataaggaattcttagctcagtaccaagtaccaagtattcagtaccaagaagacaaacaccaccataaaaatgggcaaaatatttgaacagacactaaaccatggaagacatatgggtagtgaagaagcacatgaagagatgctcaatgttatcagacaggagatatcactatacctccactagaatggatttttttttttttttttgagacagagtcttgctctgtcgcccaggctggagtgcagtggcgtgatctcagctcactgcaacctctgcctcctgggccaagcaattcccctgcctcaacctccaagtagctggatctacaggcacgcaccaccaagcctggctaattttttttttgtatttactagtagagatggggtttcaccatgttggccaggctggtcttgaacttctgaactcagatcatctgtccacctcagcctcccaaagtgctgggattacagtcttgagccactgtgcctgaccagagtggataaattttaaaagattgactataccatgtgttcgcaaaattgggaactggaatgctcatacatcaccagtggtcatgtaaaatggttcagccactctggaaaacagcttagcggtttcttacaaagttagatatttacctatcatgtgacccagccattccacttttaagtatttactcaaaagaaataaaagtttatgtctaaaaaaagatttgaacacaaatgttcacatcagctttacttgtaatagccccaaactgaaaacaactcacatgttgattaacagatgaatgggtgatacactgcaatacacgcatcctgtataatactcctctgcagtgaaaagaatgcactattgaaacatgcagtagcctggatgcatctccaaatcactatgctgaatgaaagaaaccagacccaaaaaaaccagaacataccatgtggttccatttgtataaaatttttggaaatggtgcctactcagtaatgacagagagcagattagtgggtgcttggggccaaggagtggggagcagcagggagagggattacaaagcagcatcaggaaacttgggggggtgatgactatgctcattatcttgattgtggtgatgatatattgataagcccgatttatcaaactgtacacttgaagtatgtacagtttattgtatgccagttgtcactcaataaagctgacattcattaatcagaacaaggtttcggaagtaagtagtggcgctggaccagactgcctttctggaatagtttgtttgtggcatcagtggaggatgagagaaggaatgtaagcagggataaagtatggagcaatttgattctcaagctaagttccaacagtgtcctttgttgagtaggggaattgaacacagggtgtcaagggcaaaaccaggtcattttagtaaattggggctggcaataatgtatgtgctgtattagaggtagagagtggggcagggatgccttcactcatccgctcattcattcaatacctgtggattcccctctatgggcctgatactcttatggggtatttttcttacatattagggacccaagaaacattcagatcttggcttcccttttaccccccacacagagagcagaatataaaagatggaatcagagaacaattctaatcagtccagtcaattcagtgtatgtttcttacgcccgcagaattaagtaggagaccacggcaaccatcccagccccagggaggagtttatgacatcagataggtgatggctggtgggttcagagtaattaagactgatggataactgcagagaggaaatctagttttcagggcaaacagatgcgtccaagagagagcccacacacgtggttggatgcagctggagatggagaattccagttcaaggaaaaggcctgggcagtatgtgtttggtggtggtcgttgaccctgaaaatagatggaatcttggagggagaaagcgagtgtggaaagtgaaggtcaggttgtgagctctggggcagcccacagtcagaggatgggtcaaagctagaagggcgagcaggccgcacgcacacacacgcaaagcagctgccttcactgacaatcaatggcagccacctgagctgtggctgagctgctgtgagccgaagcagtgggcttgctaaatgccgtcatccagcttccccttgaccctggctgtcaggcctgggtctgggagcttagggatcattttgtgcagtctgctcaccctctggctgtgccagggcacaggattttctacaaaagaaggaatctggggtgagtagagccccatgggagaactgagctgactaaatgtgagtggagaaatgccaattatgaaaaaaatgtacatatcaggggaacatgagcttgaaccttgcacagcttttcctccgcttggctgtttttatgaggacccaggcaagtggttctcaaagtgtggtccccccggaaaacaatatcagctttgcccggaacttactagaaatgcaggttcccaggcttaccctagacccactgaatcaggacctctggaactggggcccaggaatgtgggttttcccaagccctccaggggatgtcgatgtatgctgcagtttaaggactactgacttagatgttttaaataagatctctccctggcagcatccactcaaaagggggtttatattaagaacataatgtgacaacggtttggaaattgaaaagcactctacaggagtaggacattatttttgtttgtttattatttttgtcaacctcattcactcagatttcactgtattttagaacttgtttcagagattccccccttcctccttttcccttccccgaggaaaaccaaaatcttgttagtgaacaggagaattgattgaaaaaaaattcaactgctgcgggaaaggaggagactaggcacagctggagtttgcctgaaaggataattttctcagtgacattgggtttgttttgtttctttcagtgtagaagcacgaggctgatgactcatttaccattggaagacttcaaatccaaactgcagttgtcaaaataagattagtgctttcagacatgatgaaagagagggcatggtctcgaaaaggcaagcttgggttttgcctgcatttgtggagccctaactcatagcaagctttcctgtgggagtgggcagagaccccatcgtttacccagttgagtgaaatggcagccctaataacccacttctccttctctcttgctgtgataaacaatttctgatttctacatctcagattaaataacagcaagagctataaaaagtagagggtgtctcctaaaggtgttcatttgctttaactccaaagatgagattaaactgtcattggtgtcaacagcgtgcagtgcagcttgtctaaaattctgaaacgttggtgaaaccctttgatttagccctggatgatggccatagcctttgccccatgctccgtgctcccccctcagttctgcctccttccggtgtaagcagatgaaagtttccaagttctctggactgagatgcaggcaccagggtttctaaaggaaggcacttacatctagggtgcatgggagtctctggggaaactgtggttgggtttgagcacagctttggggctcttggcagcaaatcttcactaattagtttcacctgggaagactgagttatccctcttaaaattctccaggcactgaaacaagcgagcagattttgctgactgtcagatacatgctaatggtagctccctggcaaggtgtatctcaaatttggccaggtctttttgttatgaaattccaaattacctactttgctgtatcacttcaatttagcatagaactcaaaaaccaaacttggccagagataaattttagaacgttaggatctaatattcatgtttgtagggatttttttttttttttttttttttttgagacaggatctcgctctgtctcccaggctggagtgcagtggcgcaatcatagcttactgcgacctggaactccctggctgaaatgatcttcctacctcagcctccctagtagctgggactacaggtgtgtgccactgtgcctggctaattttttaattttctgtagagacaagatgtcgttctgttgcccaggctggtcttgatcctcctgcgttggcctcccaaagtgctgggattataggtgtgacccatcgtgccggcccatgtttgcagcttttataggtacccaataaagtgaaactattagaattgggatgtgagcaaaatttggttgaagttcaactctctgccatgcttaaataggtatgtgccactgacacttttcttttcccccttgatttaggaaaggagaaggatgctaacatttgttgaatacttactgtcagccctgcacttcgggaggccagggcgggtagatcgcttgagctcatgagttcaagaccagcctgtccaacatggtgaaaccctgtctctacaaataatacaaaagttagctggtattttgctgagcgtggtggctcacgcctgtaatcccagcactttgggaggccaaggcgggcagatcacctgaggtcaggagttcgagatcagcctgggcaacacggtgaaaccctgtctctacttaaaatacaaaattaggtgggcatggtggcacatgcctgtaatcccagctactcagcatgagtactgaggcatgagaatcgcttgaacctaggaggcggagaatgcggtgagccaagatagcgccattgcactccagcctgggcaacaagagtaaatctccatctcaccaaaaaaaaaaaaaaaaaaagttagctgggtatggtggtgcgtacctttagtcccagctactcgggaggctgaggtggaaggattgcttgagctcgggaagcagaggttgcagtgagcctagattgtgccattgcactctagcctgggtgacagagccagaccttgtctcaaaaaaattaaaaataaaaaaataaaataaaaatatcttctgtgagacagatgctttgcccatctagattatctcactcaaccctacaaataagatatttaacctttttatgaaaactgaatctctcaaaagtcccttacttgaagtcgttacccagctggggccaagtctggctccaaagtcgatattcttttcacctgcctgcctcacccctaccctttctgaggagacgtaactgacatcctgccctcccccagtggtggctctcttcatcatttttcatgtcacctctttcaggtccaaataaaaatttggagaaggtcaaaatcatcttttcagttcacactgttaaaaatggaagcctgctctctcaccacgctcaactcccctttcctgcttataacgtatcacagatttttacctatttgctttgtttactatcaatcttctatcaggtatgtgctgctaaatgtttaacaatcaggtctccaggagacaaaagctctgatttgtagatttgccaatttccatggtgtaaatactcccaccgtggacatttcaagctaccaacgtggcctctttgaatgcagctgtgggaagagatgcacatcattgtgtgagtcagtacgagctgcctctagcacatgactggcccctcactggaccatcagctctataagggtaggaatttttctgttgttgtccactgattcactgttgttttcccagcactccgaaccattccatcgttgaatagatttattaattcagtcatccacaaatcagccacatggcagatgctagatatttgaactagcatgctgagcaagacaagcactgtggctgccctatgtggcaggtgaaatagacatgaaataattagttgcaaattaagcattaaattataattgtgttgaggattacaaatggaaactctgagggaggacttcacccctagtggcaggtcagagcttcctgagaaagcagactttcaggtgagtactaaaggaggtatgagagttaggtaggggaaaaggaggtcaggaagaggcttgagcattctaggcagaaggaatgacctttgcaaaggtcccaagacatgaagaagcttgatttgaaaatggagagggccatgtaaatggagcagagaaaataagaggaggcttgagataagactggagaggtgaaggggtgggtcttgtagcccccttgaccatcacattagagtttttggactccatcctaaagcagtgataagccattaagggttttaagcagaagagaggcaggagcagattactctggctacaggaggatgctaggctgggatgaatacaggaaaaccagttaagaggttgccatggctgttcagccaacagatgatagtggctccatggtggcaggggagatgaagagaagtaaatccaggattgactgggtctgaggggtacaggagagggaggaatcccatgactttcaagtttctgttcccatcttcgaccccagggtaaaagttagctattctaaaaattcatctttgctaaagagaaattaaagaatacttcagaatcatccccagctgtcccatttctgcccagtgacatttattaattgagacagagctctaggctgcccagcaagggaggctgtcaagtcaacaatagatggctactaagcaccaactgtgtgaagtgcatggcattatacaggcaccgtaaggaacaccaagacttagagacatggctctgtccttcacagagcttacaagagtaggtaagagagatgagttaggaacacctgacaaccctgtgcttgtgtcacatgagcatgagttcattcatccattcaacaagtacttgttgagcaaggacaaagtgccaggcactgtgctagataccgggatgcagtggatagcagggcacacaggttccctaactgtcatgacagcttttctggtgtccatagctgggggctggctctgagatgtcattgtgttcttgatgcaggacaagtgagccccaaagtggggcttagcccatgagggttcttggctttatccaggagagaattcaagggcaagcagaggtagatgtaaacagctttattgaagagacggtgttacagccctggcagtgttacgcctccgtgactgctcctgcagagcagggctatccttataggcagagagtaggtagtagctcagggcagttttacagtcatatttatacccacttttttttttttgagatggagtttcccaggctggagtgcagtggcgcgatctcagctcactgcaacatctgcctcctaggttcaagtgattctcctgcctcagcctcccaagtaactgggattacaggcacctgccaccacatctggctaattttgtatttttaatagagatggggtttcaccatgttggccaggctgctcttgaactcttgacctcacatgatccacctgcctcggtctccgaaaatgctgggattatgggtgtgatcccagtggcctatacccacttttaactgcatgcagattaagaggcagtttatgcaggaatttctagggaagggatagtagctcttggtttgtcaggtcattgacacggagggggtggttactcccaggtgttgccatggcaatggtaaactgacatgtcacactggtgggtgtgtcttatggaaagctgcttctgccccagccctcaatttgatcctgtgtccaagccctgcctctggagttaagctctgcctctggagttgagtcctgcctcctacctcactctgagccctcttctggtgtgtgaatacctcttgctgaggatgaggagaggcagagagacttggagagaattttgttcccatctcagtcatcttctgaggaccccacatctaatggaggagggtattcttaggactttagggccattcctcctgggaggcagggcatctgggcctttttcattgttcattcagcaaatgaactcttatggagaccaaatacatgtgctaggacactgtgctagactctggagagtcaaaactgacccgcttataatggggcagatagccgtgatcaagtccttccaataccatgggatcagtgccgaaatgctagagcggagccatgtctatagtgctgtgggggcccaggggaagaagccttaactccagccaacttgaaggaggcttcccacaggaggtgacatttgactggggttgtgagccattcatgggggtcaccaggtggagaaggtggaaggctgtgccggggcagggggagctctggacacagtgcttcttatccttcagtgaaatcctcctggcctcagagagaaagaagggctgtttttcaaaagcataaggaatcatccaaaaaacatctgtatttgtttcaaaaggaaatggccactgccagaaaaacagcaaagttgttttgtcagaacccagtctgtatttattcctttgtctttgtttaattagattaatccctgaatggtttcccttgggtcggtacaaatcgctcgtggccataaatccccaacaattctaaaaacagtaagaaaggacaatccgcatgaagccaactggcaagcttgctgtttgtgggacagttctgggatgcgagcagtaatcttgcacccgcacataggtgtttggggttcttttagcctcttggagaggggagcaaggacaacaatcactcagatttgtttagaagaggaaagctgaaccgtagggtctcatcattaaagggggagactgactcctggatctgggcaccttccccagggaggattgtggggactttttatctgttaggttcaatgacattcagcctggctgcacactggggctacctgggagctttgacaaacaccactgcccaaatcccaccccctgccagtctgatttaattgtggtggggagtaccttggcatcaagattttcaaaggtccctgctgcttctgtagatgggagcttgcagttactcacagactcttctgcggatatcccagtctgtcctgaaaggaacaagcatatccttgcctttctctacctaccctgtgcagggaagccttttagaaaaaaagattgttccttcaaggtcctggttccttgcttttgaaatggtactttcaaaagggttcttttgtaacaggttgatttttttgtcttcctccattattataaaagttcctgttagaaaatttgaaatcagacaattataaataaaagaatgaaaaatcacctgtattcacaccactacttggtaaccatggtaggtagagttcctgccagacccctgatggggcaaggcagcatctgcagtagagattgggaggacccaggtggagaagctgctgccacccttccagagctggttccagcatgctggagcgtcacctcccagccatcaggacttcatgcagggacactgcccacccacttagggagcttagagtctagtaagagagacacagtacatccatcgctctataaatacatacgtagttaacattatgattcatgccaggagggaaaagtgcaggggtgggctgacagctgatgggtgaggccaaaagtgtaaagaatgtttaaaggtcctcatagcaagaggttaattttctcatcaccattcaggcaacccaaagctacttcagcccggaactcagaaacctactgctgttcccaagaaagcaatgcttttcattgaactttgctagaggtgcttaaattttcccaggcctgagaggatctgtggtgctgccagacttatccttccgaagcacaacttgggtgaaattgctggtctccctttttaaagtttttcccttgagtggtccccattgcccgctgattggagttcagcctatgcagcctgtgtgcagagatccctctgcctctggtgtcaatggtctttcccatcctctcttctgctacttcccctggaatttccagagcagaattcagctgccacgcctctcctgcttccctcttctgtttactcacgcgtcccaagcctggagtgctgtttctctttctccatacctgccagcctttcccagtccttgctagacttgcagtaatctgtcccaattctgaactcccatagttttcttggcacttctcttagggattcttatcatgtcctacctcgcatgttagttatttaggtggcatctaacaaccactctggcctttctgttcctcaaataggatcagtttgttcttcaggacctttgcattcactgttcttttggccgaaaatactcttcctaaaggttcatgttattaactcctagtaggatacaagctgcgtgacagcagaaaccccttgtctgttttgttcaccatgatatccccaatgcttgggacatagtatgcgctcaaaccgtatttattgactaaatgaatgaatatcgtatgattcagacatttcttatatctggcctagctcatttaggttttgtatttctttgattactcactacgatttttgtattagctgaagttttcttccggttatgggtgttttccttacatctgaatccactgaaaatctacattggactttctggttggagttctcaattggaaatgtgagatataaacttactggtgagaggtaaaagaatctgtgtctataaggcttttttttccatctactttattgatttgggagtgaaacttcttttaggagtttaaaaccagaattcttatttgtagactcttagacctaagcgtttttaaaatgtgatgatgtaagttttaatgtttaaaattgtttaatgcatttaatagagatgttgaatcaaatcagcttttatctttttaaaaatcaatttggatattttatatttatgtaaaagcataataaactatgaaactcaaagatctagaagatgatatgaaaatgtagccattggattcaggaattaatcaagctttctaggtaattaagtttttttaaatcatacctgttgtagtgatagcttttttttgtttgagacagtcttgttctgtcgcccaggctggagtgcaatggtgtgatctcggctcactgcaacctccatctcccgggttcaagccattctcctgcctcagcctcccatcttctgagtagctgggattacaggcgcgtgccaccacgccaagctaatttttgtatttttagtagagacggggtttcaccatgttggtcaggctgatctcgaacttctgacctcagatgatcctcccgccttggcctcccaaagtgttgggattacaggtgtgagctaccacgcccggccagtgatagcttttaaccagagaaaattctctttaatatattcaacccctttaatgctctctgattatctccagttttaatggcaaaatcaatggtacagctagctgtttcatggtatccaagctgttctccttgctgggaaatagtgttagagactgagtcagtgatggatggaagatgcctttaatcttttcatccaccaacatattcttagttctgttgcagtagatgcatactgcaagtccattcctacgttgcatgtgaataaacaggcagagcttagcacttagtggacatgtaataaatatttgaccaaaataagaccacgaatagacatgtatctatttctccctggcaatgtttgttacctctacctaacctcttttggcttctccattttcctcgtttgttattagaatgaatacatagagcacaaagagggttttcaaagagctttgtctcattccttcttataccagcaacagagtgagattctgtctcaaaaaaattatttaatgtatttcaaagtaattccaactttgaaaaatgtggtttttttatgttatttatttattttgagacagagactcgctctgtcgtccaggctggagtgcaatggcacgatcttggctcactgcaacctccgcctcctgagttcaagcgattctcctgcctcggcctcctgagtagctgggattacaagcacacaccaccacactcagctaatttttatatttttagtagagatgaggtttcaccatgttggccaggctggtctccaactcctgacctcaagtgatcggcccacctcggcctcccatagtgctggaattacaggcgtgagccaccgcatggctgaaaaatgtgtttttatatacatgcagaaactcacctggaaagaaaactcaccaaaatgttaacagtggttgcctctgggtagtaggattacagatggggggattacaggtgaattttcttttatctatttttttatgttttccaaattttctactatgatcacgtatcaaaccttacaatgtttttaaaagttactttggtgagggctctggagttccctgttgcctcaccctgggctgggagcattctcaggtgtgcctgacgttgtgttctaacatcgtgactttgcctcagtccaggatctgtgtgccatggaggaccacaactgtgagcagctctgtgtgaatgtgccgggctccttcgtctgccagtgctacagtggctacgccctggctgaggatgggaagaggtgtgtgggtgagtatccctccagctgggcttggtagggaaggacaagttaagcatggtgaggaggaggggagactcacgtgtacctcccacatatttgtttcctcacctttgggtttccacaaagtgctcagttgtttggtgtagttgttaggcagaatttgaactttaaaggcttcatttatggctgaggtcagcgttttcttattctgggtctccagtaaaaggaacacttatgataatccatgcaaatataactgtgtgttactgcatctcttgaaaaggatcgggtggattttcttcaactttggaggatatgtttggaatggcctgacttatatatagctcaggtgttatacatgaaatttacttgggtgggttgctgagtgacacctcaaagacaacgggcagccttcctccctaatgtcacctatagctcagtgacaggccaaagtgactgccaggtgaaagagcccagccatatgggctcagcgtaattagacggcgtggtcagaggaaactagcagtagcctcaaaccctcaaacacaagcccaggtaatgaggctcaagggcagtgcttgatgctgcagacatcccccctgtttatctacaaagcctttgcaacttaacatggtctcattcctccttataccaacaaacagtgcctggtggatagtaggtgtttcataaactgaactgaatacttatgaggcagaaaatctagaaggaaaagaacttgactgacatcaaaactggaatgtaaattttctgctaaatcctgcattttgtcttccgtgttctattgttttcaggaccctattttattttgcttcgcacaaacagggtatgcttatatttttgcacatagaatttgcattttccagcacaccttaattcttagctagggatgtggaaggcaaaacaaaacaacaacaaaacaaaagttaggtggtagcctgcaattggcaggtgagtgatgagagtatcgtgggtttgtttttacacactgataggaatgaaagcaacctctgcctctgactctcatcaaagggccacaaatgcagctggtctcctgggccttagggttgtttttcttcttaatctgctggtggtggccatgatagagtggcagggttccacacccactaccactagcaaaaaagaagccaacatatatacccatggttatttttgcttcattaatttttattatgcaagtaatacccgttcatagagaaacttaaacagatgagaaaaatcactattaataggttattgtattttctaccagactttctccatataaatatctactttaaaacattttgttggacaggtgcgatggctcacgtctgtaatcccagcactatgggaggccgaggcgggcagatcacttgaggtcaggagtttgagaccaacctggccaatatggcgaaacccggtctctactaaaaatacaaaaattagctgggtctggtagtgtgcccctgtattttcagctagttgggagggtgaggaagaagaatcacttgaccctgggaggcggattttgcagtgagctgagattgtgccactgcactccagcctgggtgacagagcgagactcatctcaaacaaacaaacaaataaacaaaaaacattttgtaaagatttaacaaaatgaggtcacactgtctattttgttttacaacctgctttttcccctctactatttgttaaatgggtagaaactctgagtgctgtttggtcaggaggaaatcaagccattgtgagttaggctggtggaggagcttcaggaaacaggatgagggtaatgggttgattaggacaaggggagggacagtagaacacagggcttgcattggtcacagggagtagatggggcaggaagcccaccttggcccatgggaaactggaggcccctgaaaaacccatttctctgagtgtttccaaataattacctgcttgtccgtgtgtagtagagaacctttgtatctctgaggattttgctgtaacttttgggatttgacatttattgaagagctacaagcgtgggagggtagatgctgtcattgccagagagctttggcgtgctgtttatcggagatgggcgtttctctgcggctgcttgactgcatataagaatgtctgcattttctcagtggggatccaatccaaagagtgggaaaatgggagagactgcatcccattgcaacccaggtctcctccgtcagatgatcctagcatcaccagccttaccaccttttccccaatgccctttacagcggttcactaagcactcgatctgttagaggctgggagtgagatgattaagcaggcagtacttttgttgccagtagcctttcttagggactccagacaaaatcctacaaggttagttgctgctcaatagggctatggtgagtacaacgcaaatgatagagaaaatattggccacggaaggtcagagagagacatcctaatggctaggctggaagatctgagtgtggaaggaagggtggcaattggacaaatgtccaaggcagggggagagatgaagggcagtgactgtggaggtggcaatgctcttcaagcattagggctaagtctggcctaggagtggcagggccagctcctgggagctggtaggtcagagagagactgttacagtgaaaaggccaaactgaaagttaaccaggtggcctaacctgagggccagaaggcgcttatcaaagatggagactccaggtaccagacttagagcaggaaatttagaggagaggctggtgagaactctggacatactccattagtagctgatctggggtgccctgtgtgtagatggccagggaacattaagaacagagtgattatgcctcccagttaatacaggacaatcccagtttatgccctgttggcccaattcttttttttttttttcttttttttgagattgagtcttgctctgttgcccaggccatgatcacagctttgcagcctcgacctcctgggctcaagcgatactcccacctcagcctcctgagtagctgggaccacgtgtgtgcaccactgtgcccagctaatttattttttgtagagacagggtctccatacattgtctaggctggtctcaatctcctgggctcaagtgatcctcctgccttggcctcccaaagtgttgggattacaggtgtgagccacctcgcctgatgccatttctttttatttttagacagggtctcactctgtcacccagactggagtacagtggcgcgacctcggctcactgcaacctctgtcccccaggctcacatgatcctcccacctcagactcccaagttgctgggaccacaggtgcataccacacgtctggctaattttttgtatttttggtagagatggggtcttgctatgttgcccaggcaggtattgaactcctgagctcaagtagtctacctgcctcggcctcctaaagtgcagggattatagacatgagccactgcgcccgactgaccccatttcttacccagctggcctcatttcttgatggcacatcttttcactttgaaaggggttccagtttggatgataaattacataatcaccctagttaaggctgtccaatttgacttaaactgttaagttcagcagagaattcctgtatacatgaagtaggagatgaagttgaagacagcagaaggaactggattgttcagggctttgaaaatcagacgtaaagcctagattttatctctgaaaaagagccaccgaagggtttatatttgggtgacaaatgcaaagcttcatttttaggaaactcaacctcatggggaactgcagggtgtattccaggagaaggatggcaagaagtgggaagaccagataggagattgtagcagttatcgggtgagagaggataggaaccagccaggatttgaggtgcaactgtaggaaaggagagggagacagtaaggaatgaaagaaggtgctgtacataaagggaacaaggagaagtcaaaagtgactctaggccaggtaccgtggcacatgtctataatcctagtactttgggaggccaaagtaggaggattgcttgagcccaggtgttcaagactaacctgggcaacatagtgagacccccatctctaccaaaaaataaaaaaattagttggacatggctggatgtggtggctcatgcctgtaatcccagcactttgggaggctgaggcaggcagatcacctgaggtcaggagtttgtgaccagcctggccaacatgatgaaactccatctctactaaaaaaaaatacaaaattagtcaggcgtggtggcagtcacctgtagtcccagctactccagaggctgaggcaggagaatcgcttgaacctgggaggcagaggttgcagtgagccgagatcgcaccattgcactccagcctgggcaacaagagcaaaactctgtctcaaaaacaaaacaaaaatattagccaagcatgttggtgcacatgctggtggtcacagctacttgggaggctgaggtaggaggattgcttgagcccaggagatcattcaaggctgcagaaagtcatgttcacaccactgtactccagcctgggcgacacagcaagaccttgtctcaaaaaaaaaataaatgaataaaattgaaaaagactccatgatcttgagcttccatggctgtgagagtgatggcaacagtgatggaagagtgatggaatcgattttcaaaaagataaggccaagcgtggtggctcatgcctgtaaacctaggactttgtgaggccaaggtgggaggattgcttgagaccaggagttctagacaggcctgggcaacaaagcaagaccctatatctacaaaaaaattaagaaattagctgggtatggtggtgcacacctgaagtcccagctactccagaggctgaggtgggaggggtgggaggattgcttgagcccaggatgttgagactatagtgagccatgatagtgccgctgcactctagcctgggcaacagagtaagaccttgtctcaaaaaaaaaaaaaatgttggggtgataattagtagtcattgacaaggtgaattttgaattcaggttagacaccacaaggacacgtcaagaggaagcagaaaactcggcattaacatgacagagagagtagaatcaatgctgtagtcaggaagcagcatagtttatttcttaacttccagttattttctattttaaatatttatgtgtcagttggtttgttttgagggcatctagacctttaaaacagtgctacctgagctgaaatcccaactctgctacttgctaggtgtgttaggccatttgcgttgctataaaggaatacctgagattagctaaaagaaaaggtttaattggctcatgattctgcaggctgtataggaagcatgacaccagcatctgcttctggtgagggcctcaggaaacttccaatcatggtagaaggtgaaggcggagcaggcatgtcacatggtgagagcaggagcaagaggtagggggaggtgacacactcttttaagaccaaccaaatctcacatgaactaactgagcgagaaatcacttatcaccaagatgataacactaagccattaatgagagatccacagctatgatccaatacctcccactaagccccacctccaacattgggaatcacgtttcaacatcagatttggaggcaataagcatccaaaccatattattccactcctggccccccatatttcatgtccttctcacatttcaaaatacaatcgtgcctttgcaatagttccccaaagtcttaacttgttccaggcttaactcaaaagtctcaaactccaaagtctgaagtgtcatctggagatgagttccttccacctatgagcctgtgagatttaaaaaaaaaaaaagaaaaagtttttacttccaaggtacaaggtgttataggcactgggtaaatattctcatttcaaaagggagaaattggccaaaacaaagggcaataggaccatacaactttgaaacccagcagggcagctattacattttaaaactccaaaacaatctcctttgactccatgtcctgcatccaaggcacacaggtgcaaggggtgggcccccaaggccttggttggctccgcccctgtggttgcagggtatagcccccaaggctgccctcacaggttgttgggtgcccatggctcttgcatgctaaggttgcaaactgccagtggctctaccattctcaggtctggagggtggtggcccccttctcacagctccactaggcagtgccccagtagggactctgtatgagagttccaaccctacatttccctttggcactgacctagtagagtctctctatgaggcttcacccctgcagcaggcttctgcctggacatccaggctttccaagacatactctgaagtctagggagaagctgccaagcctctttcatgcctgcattctgtgtgcctgcagacttaacaccacatcgtagccactaaggtttatggtggcttgtactctctggagcagcagcccaagctgtacctgtggccctgtgagccatggctggagctggagcagcctggatgtgaggagcagtgtgctgaggctacacagggcagtagtgccctggacctggccccccaaatcatttttttcccctaggcctctgggcctttgatggggagtgggtgctgcctagaagatctctgaaatgcctttgaggcctttttcccatgtcttggatatttgcacttggctcccttttagttacactaatctctctagcaagtggttgctccacagcctgcttgtattcctgtcctgaaaatgccttttctttctctgccacatggctaggctgcaaattttccaaacttgtacattctgcttcccttttacatataagttccaactttatttctttgctccagtatctgatcataggcttgaatgctttgctgtttagaaattttttccatcagatagctaccttaggtcatccctcttaaattcaaacttccacagatccctagggcatgaacacaacccagctaagatctttgctaaggcatagaattggtgacctttactccagttcccaataaattcttcatttctatctgagatctcatcagcctggcctttactgtccatatctattagcattttggtcacaaccacttaacaagtctctaaggagttccaaactttccctcatcttcctgtcttcttctaagccctccaaactcatctgacctctgcccattgcccagttccaaagctgcttccatactttcaagtgtgttaatagcaacaccccactctcagtaccggttttctgtgttaggctgcttgcattgctctaaaggagtacctgagactgggtaatttatttgaaaaagaaagagtttaattggctcacagttctgcaggctgtacaagaagcatggcattggcctctgcttctggtgagggcctcagaaagtttacaatcaaggcaaaagccaaagggggagcaagtatgtcacatgacaaggacaagagtgagagttgggaggtggggagatgccacacttttaaacaaccaggtctcatgtgaactaactgagcaagaactcactcatcacctaggggtggtgctaagccatttatgggggatctgtccctgtgatccaatacttcccaccagggtccacctgtaacacgggggatcacatttcagtgtgagatttggagggcacaaacatccagaccgtatcactaagcacatatctttaagtctaatttctgagcttattttcctcacccataatgtagaatagtaatatatacattgtaaggttttatgggattaaataagatagtgagtgacattcccaatatactctaagaacttagcattattattacaacacctactattatcgtaatttcctgtatatagtgaagtatggagtgagaagagagtgaaggactgagccttggattgcagtcacatgtagggagcaggaagtaggggcaggaaaaatattcatgaagaagtagcttaaggctgggggagagagagaagaatcatggaacatgataggaagataatttcttggccaggtcaatattaatgtcatgcttcagcatggccaaaggtaacaggacttagagaaaaagccatcaacttgagtcacagattcaccgctgcaaacatttcagaactctgccagggactttgctaggcttgaggagcacaaaggtgaccaggaggccattgagaatggcaaagggggcatgggtaaagggcagatttcaagaggcagggagtgggtgacaagaaagtgtgggcagcaggttcaaactatttatttaaagaaatttggtagaagttaagcatgtccagctgatgcagggcaggcaagtcccaaagtggagcttagcctacctgggttcttggctttgcccagggaagaattcaagggcaagccagaggtagaagaaaacagctttattgaagaggcagtgttatagctccatgactgctcttgcagagcagggctaccctgtaggcagagaatagcagcttaggcagttttgcagtcatatttatacccactttcaattgcaggcacgttaaggggaggtttatgcagaaatttctagggaaggggtagtaatcgttgggtcattgcccaatgatagtaagggatggtaactcccaggtgttgccatagcaacagtaaattgacatggtatactgattgaagtctgattgaaggctgctttcaccccagccctgttttagctagttctcaatcaggtccgatgtctcagccccacctctggagtcaagtcctgcctcctacctcacagctactagtgaatttatgcagtagattttcagtttcaacactttcatagctactgctatgaaaagcacttcttttgttaccaaaacattaggggttcagtctaggtcctgttgcttgttgcacagaaagccaatcactgagacaacaagtattaccaggaaagaaggcttcagtcaggtgccatagccaagaagatgggagatcagtctcaaatccatctccctgactgactaaaattagggatttaggctggatgtggtggcttatgcatgtaatcccagcactttgagaggccaaggtgggaggatcacttgagaccaggagtttgagaccagcctagacaacatagtaagactcctgtctctacaaagaataaaaaaaaatcagctgggtgtggtggccaacacctgtagtcccagctactcaggagggaagattgcttgagtctgggaggttgaggctgcagtgagccatgattgcactactgcattccagcctgggtgacagagtgagaccctgcctcagaataaaataaaataaataaaataaaaattaggggtttatatagcagggaataaatgtaaacatatgggggaaaacaggaattagggaggagtatggaagaggagttggtcaacacgcagcaggtggttggttaggcagtcataaatggggaggggtctggcatgtcattgtgcagatgcagtgatctggtaagtttcagccccttgatactgtcagagagtcctgacggtttggttcttgagaagggttctcagataaaacaaatgtaactttctcaagtttcaagactggaaaggtaaatttctatgtttattcaaaataaaccataaacatcagttctgtgggacaattgggccggtttcactttgattcatccctgaattattactgtgacctgcatgaaagttcagttcttagtcatggactcagcatttttttatagatttccacacatttgagtaagtggaacgttcaattccagcaccagagttccaactccctgacagctcatttcaccattgagagtcctgaatttattccgtattcaatggtggattgctgactaagaacctcctctgctttagtggagtccctgaatttataattcatcagctgccactaaagtcatgttcattgccatccaaaactatttttcaaagaccatttatctagatttctgaacatgaattttctgctgtacttactcacctggtgtttacaaactgtcttttattttggggtaactttggtcctgtttgcatcttatctacccaggcagattgtaaacccttgagggcaaaaccacttgtacttttcatctttcacagagtggacttgaaatacattttcttgaagcactgactgaggttgattgcaatctcatgcattcatgttttgtaaaaaatatttcccccattgactggtttttaaattataaagtcatttttgcttattaaaaaaaaaaagtcaggccaggcatggtggctcaagcctgtaatcccagcacttcgggaggccaaggcgggcggatctcttgagctcaggagttcgagaccagcctggtcaacatggtgaaaacctgtcactacaaaaataacaaaaattagctgggggtggtagcacacacctgtagtcccagctattcaggaggctgaggtgggagaattgattgagcccaaggagatatgtgccaccacccccagctaatggaccaacaccgtctctaccaaaaatatataaagaaattagccaggcatggtggcacgtgcatgtagtcccagctacttgggaggctgaggtgggaggatggcttgagtctgggagggctgaggttgcagtgagccgtgatcatgccactgcattagagcctgggcgacagaatgagaccctgtctcaaaaaaaaaaaaaaagaaaagaaaagaaaagaaattttctctgggttttaaatcctgcatttggaattccagttatgccttggagaagagaggttttgtgagtctgactctgtgtgtgtgtgtctaatgtatgctcagcaagtaaattggttctaccatttctctaaatgacaaatttggtttttcttactttgttatcagcaaactttaaactccaaatgctcctctttaaaatatactatttctgctaatgccattcccttgcagacggagtcctgctgagaaaacgttagaattggaccaggttataaaacagaaatcattgattttagggttttattacctgcagcaaggtatcatttattcttagagacagtggagtgatttctcacatgttgggcagagaatgaatgtggcaagactgacttctgactctgggatcttagcacttgtgatctggagggctaaagagctacagctggagaattactctttccatttgtaaacaagaatgtagacattttaggcataaatgactgagaacagattttgttgaagtagatgagaacttggaacaatagagccatcattgagttatacaagaggtcacctccatacatctgcctccctaatcttgacctctctttttatgagtacaattttgcaaccaagaaagttatgcaaacaacccaaaccacttggcaaataacattagagctgaatgccctagaactctcttggccttaaaaaactgttagattcacatgcctggcagtgggttcttccatgtttaaccactgcactgatggcctcatctgccgtctccagaagcctagcagtgtgtcagtgggtggatttcaaattgagatgggatttgacaccttggagttttacagactggagacttgggacccaggaatgcgtgaatcctgccttgccaatcacatcctcccccttagttccccagagagctgtgtacacaaagaacaaaaacattatgagagtcaagatccagagaagctctcttatctcatgaattgggcctgtggttagctgataaatggaaaacatcattcagagaggggaatcctaaaaaactatatatgcaaacccaccttagtcattttatttttatttaaaacacataaatgtatacttagtaaaaatcacttttatgcttttaaaaaatgctaattttaagttgaagaaaaaagtatgatatttacaaatctttttttttttttttttgagatggtataattctgttgcccagattggagtgcagtggcatgatcttggttccccgcagcctcaatctcccaaactcaagcaatcctcccacctcagcctcctgagtagcttggaccacaggtgcatgccaccatgcccagctaatttttgtattttttgtagagatggggtctcgctatgtatcccaggctggtctcgaacccctgggctcaagcagtctgcctgcctcggcctcccaaagtgctgggattatataaaaatcttttttgcataaaccatacccataatgtgttgtctatgattttttagttttggtttctttaaattggaacaaggatttcaagacatctgtaaagcagtctaacagcagaactcttgtaaattttaatgggaaatttcccaatgttttacatttgtttcatccatgcctggttctatagcaattttggttagcaaattgctttaattttttccaaagctttcaacaaaatttttatttttaaaaactcagtttcttttagtgcttatattttattggtttttattttatttatttatttattttgagacagaatttcgcttgttgcccaggctggagtgcagtggcacaatctcagctcactgcaacctccacctcctgggctcaagcaatcctcccacctcagcctccagagtaaatgcgacaacaggtgcccaccatcatacctggctaatttttgtatttttagtagagatggggtttcaccatgttggccaggctggtcttgagctcttagactcaagtgatccacccaccttggcctcccaaagcgctgggattacagatgtgagcctttttgttttgttttgtttttttgttttgttttgtttttgagatgtagtctcacactgtcgcccaggctggaatgcagtggcacgatcttggctcactgcaacctccacctcccagattcaaatgattctgctgcttcagtctcctgagtaactgggattacaggcgcctgccaccacgcccagctactttttatatttttagtacagatggggtttcaccatgttggccaggctggtcttgaactcctgaccttgtgatccacctgccttggcctcccaaagtgctgggattacaggcttgagccaccgcgtccagccccagcccagtttttataatatttaaattacttacaataacatgtacaaatgacacatacaggtttggaaacaaaagcaaccttgactctaacaatggctcttaagttttagcgtgcctcagaatcacctggagggcttgctcaaacacatattcctgggtcccactcccagaacttctgatcagtaggtctgggatggagcctgagaatgggcattactgacaagttctcaagcgatggttgatgcagttggttcacagaccacactttgagaaccaatgtttataagaatacatctcagtcaatggaaaaagtacacaggtgtcctagagcccatgtgttccaccaaggctgctttatcagcatacaacccagccaatgtgaggcgtgtacaggtgttttaaaacacaggtgttctaactgccttgagtgtgtagcatgccctgggttatcaggattcatatggtcagagggaatgaaagcgttgcttgatcaggagttgcttaaggagtgatcagttaaaagagcatcttagtacaacttttttcttgaaacacccgagccaatttggatactctattctataacattctggaaaaggggaaagtttggagtatgtggcttagattcaaagcctaagccaagccttcaacacctctctaaattattacattagtctaaattacggggccagcataattatgggatatccctctgagagacagaaatggccgggctcagattataccccatggtgtaagagaggacattcaagagaaaaggtagagtgtgagtttctgacttttaggtatagagacctgaccactcattgttgcagcaccatcaatgtcctacaatttggaagtcagatcagcagctcctctctttgtaggggatactaagaagtgggtggccatagataggactggctgactgatggcaggcacccatatccaggattgggagattttcatcatggtgaatcaagcccagcatgaggaagttgaagctggggattgttgactgctaacacgggcccaagcaggctctggcatggccaactcctgtgacaaacagactggaccgtgtgccagggtttagccttcctcgatctcagtgttcccagtgtcaccattgattcttttgatgatcccttggttcttgagaaatgagaaatgaactattagaaggatgtggtgctagctcagtctttatgttatgactcaactctagcaaccagctgatatccaatgacgttgagatcctgagatgacatgaatgccctatccccaacataatggcttgtgaattaaacctgcaaatactaggttctactagaactctttagggagctgaagttacaaaaacaatatttagactgaaacttttttttttttttgagacagagtcttgctctgttgcctgggctggaatgtagtggtgcaatctcggctcccgggttcaagcagttctccctgcctcagccttccgagtagctgggattacaggcacctgccaccatgcccagctattttttgtatttttagtagagacagggtttcgccatattggcaaggctggtctcaaactcctgacctccggtgatccaccctcctcagcctcccaaagtgctgggattacaggcgtgagccaccatgcctggcctagactgaaacttaatgaaactttgaagcaaaagaataaacgtaacacaggttattaccctttacaaatcttcagtgtccctttgcatctttttattgctatgctaaatatgtcattatcttctccatgcatggttttgctttttaaaattttacatatgtattacttttgtagattctatttccttgttattatttacacacttttgatattaatataatcctaaaacattgtagggagtacttttttttgaaaagggactggtcttaagctcctgagctcaaatgattgccctgcctcagtctcccaagtagctgggatttccaaaaacttttttttttttgagacagggtcttgctctgtcaaccccagagttgaccctaggtgcactctctttttctcatttcacctctaatccaacaggaatcctgttagccccaccttcagtatttaccaggtgtattagtttgctagagctatgctgtggtttggatatggtttgtttggcttcaccaagtctcgtgttgaaatttgacctctgtggccaggcacggtggctcatgcctgtaatcccagcactttgggaggaggctgaggccagtggatctcttgagctcagaaggttgaggccagcctggcccacatggtgaaaccccgttcctactaaaaatataaaaattagccagatgtggtggcgcacacctgtagtcccagctacttggatggctgaggcaggaggatcacttgaacccaggaggttgaggctgcagtgagcagaggtggtgccactgcactccagcctgggagacaaagtgagaccctgtctcaaaaaaaaaaaaaaaaaaaaaaaaaaaaaaggacaagaaatttgattcccaatgttggaggtgggacctgctggaaagtgtttgggtcgtagggacagatctcttcttataagaacaccagtcatattgaattagagcacgccaccctaataagcacattttaacttggttacttctgcaaagaccctatttccaaataaggccacattcgtaggtaccagggtttaggactccaacatgtctttttaggggacataattcaacccataacttccagaacaccactccccctcatcccctgcaacatcctggtttaagcctccacccttcctccctgggattactggagtcactttcttactggttttctactctcagatttgccctgtcagtctattcttgactcatgggtccagaaccctgcagtgactcccaactcattcagactaaaagctgaggtccttgcatggcccatgggtccctcctgactgcccccttctcatctcccacctctctccctcctccagccaccctggcctctttgctgatcctccagcccaccaggcagagtcccacctcctggccttcgcacttgctgtttgttttgcccaagataccctctcccagatatcctcacggctcgtattttagtcaacactcttcctaaccacccaccttctcagagaggcctctcctgaccacctctattacatcccacctgctacccactcccccactgaccctactcctattcattgttttgcttttctccagaattttctttatctcctaatagactatgctatttacttattttacttcttatctgctccccactcccagcatcattatccaaatatacgctccttgggggctggaattttggattattttcttacttgttctatccctagcacctaaaacaggacctggcccatagtaggtactcaggaactaatgaatacatttttgttcattacacatatttgtgtaatgaacacatatttgtggaactaatgaaacaaatgaaatatttgtggaacacaggaacacatttgtggaactaatgaaaaatcagccagtgtattttctcatacattgttaaatcatttacccttattcaatgttcatcttattttctaggattttttgttgttgttgtaaacaatgctattaatagtttattgtatataatttcacccttttcctggctatttctttgggtttcacgtccagggtgaacattgtcaaattgccttccaaaaggatctttctcaatttataatgcccctaccattaataacgctgctgcctttctaccactgggttttatctcatcttatttttgccagtttactaggtgtaagtgcaccttgtgatgattttgatttgcaattctttaacttttaaatacaattgttcacatgttctttagtttacttcctatatcttcctatatgaattgcctgatatagactcctgattttttttgaggggggcagagaccttgggttcataactgtttatcctactcttttggggggcaataatattaatcctaattaatatctgttatcattttgccctcatcctaccattcccttttcctctgtttgcatttctaattctgaatgtgttttattctctccagctgtggactactgtgcctcagaaaaccacggatgtgaacatgagtgtgtaaatgctgatggctcctacctttgccagtgccatgaaggatttgctcttaacccagataagaaaacgtgcacaagtaagttacacacacatgcacacacagagaaatatttgctgttactgctgtggtgactgtgaccatggaactctctcaagtatagattagcaatataattatgtcatgggggtctaataccttttgccccattcctcctctgtcaggactttcatgacttggcttaagaccatagaccactgtatctcaacatcactattcaaggaatatgatgaaggcaccatgtgtaggactgttccttcagcatctgctgagcatgctgacaatccgagcaacttacttcctgctaactcagcctgactgtgcccatcagtactaacagggcttgagatgttttcattgaagctttgtggcttgtgggctttagctctgactccacgcgagaaaatcgctgagccaaaaagaatcataagtgatttcttctggtggaccgcagtttgcaaagaactgctcatgttttgtttgagctatttagttcaattggattttaactgtatacataaaaatcagaattaatttcagctcccaaaatttgaacataaaattcgataaactaaagatgatcattagttttgcaaaaaagataataactagttacaaaaagattccaaaagtgttctattaaatataaaggtacatcaggagacttaagggattgtgtatggattattatccttctatagggaggatcacttgagaaaagcttgcttgttaagtattagggccaagcatttataaaaagtggactttaataacaatctagaatagggtaaggcacctcagagacatgcatcagtgagaaaacaggattttaattcataaaaagttcatgtacctacaacctttctaaaatgtattcactatgtaaaacaggatacatctgcacaaaacctttttcaacataaacttacttcctactcttcaatacctaaatatcagcagcttacaaacaccagagctggaggtttgggtgatgtatggaactataagggacacattaggtcaaaagcatacatttctggagccccaaccatgtgccaatagaaatgagtacggcaaggtccttaagggagaagataactgtggctgagtcttggaggtggagctgtcattcactaggcagaaaagggtgaggtgggggttccaggagaaggaaagaagttgaagatgtgaaccaagcagagaactgtagtctccatgccccgtgcatgactggcatatacagtggtttatttgttttgtttattgaaagagtaagtaaatgaatgagtgggctgctgtgtttgtggtctcccttcccttctgaatattctgaactgtaaaatagcagcctgtgctgtcgtcgtggttggggagttgtggttgttgggctgatgagtcagtgttcctcatcaaagaggaggccgtgggctgccagcagcgggccttggttctaatcccagcttctctgctttttctcttggtgatcttgggcaagttacttatgcctcagtttcctcagttacagtacaggatgataatgctgcctactgcatagcattattctttccttttttttttttttttttttttttgacactgggtcttactctgtcacccaggctggagagcagtgatgtgatctcggctcactgcaacctccacctcctgggttcaagcgattcccccacctcagcctcccaagtggctgagactacaggctcgcaccaacacacccagctaatttttttggtattttttgatagcagtggtgtttcaccatattagccaggctggtgtcgaatccctgacctcaagtgatccacccacctcagcctcccaaagtgctgggaatacaggcatgagccacagcacccggccatagcataatcttgaatactaaatgaggctgggcacagtggctcacgcctgtaatcccagcactttgggaagagaagcaggaggattacttgagcccaggagtttgagaccagccctggtaatatggagggaccctatttctacaaaaactgttttttttttaattagccaggtatggtgacaagtgtctgtactcccagctacttgggaggctcaggtgggaagatcactagttgggcctgggaggttggggctgtagtgagccatgatggcaccactgcactccagcctggaggacacagtaagaccttgtcttaaaaaaaaaaaaaggctaaaaagggatgatgtgggtttcaaagactttatttattatcattatgtttttttagaaataggatcttactctgtcacccatgctggaatgcagtggtgcaatcctagctcattgcagcttccaactcctgggctcaagcaatcctcccacctcagcctcccaaagtgctggaattatggtcatcatgagccaccacacctggcctccaaaactctaaaaaaatgagtatttaactgtgcatataccacgtgcctgggctacatttaaaggtgcaaaaaacattcaagatttccactgcaagctggtgagggaccttagccatagccacactgagtagctgagtcatggtgccaggagttatgtgaccaagggcctacagtgtgatgcagccaggaccacagcaggagttagaggaaggagaccagttagaccagaacaggtgagatgctgccttgcagggatgaggactggagaaaaacacatatcctagccagtctcctacctgcctctccagactgcacacactggctggggtcacctgatttccaccccagcaccagccctagttcccagagtggcaccatcttccccaccctgtggctcagcatgcctcctgtcccagatccccagcccagggtggtgcaggcaaggagggtgttggagccctggaatcagaccctggaagtagataccgcagcatagtgggactgggagaggaggtttagctaggagccacgggaggggctgatccagctgtgaggtctcaccagctaggcagcgagcccagcagtgcagttgtcagaatcaagatccagaagtgggccgccccaatgcgtgtgcagggaagagtgctgggagactggagggttcgtgcaggcagcctcagggcagtacatcccttagaagagccctcttcccaccatgcttggggtgggcaggagccagacccaggaggagggagacaagaggaagaaaggagacagagtacttggaaagctaagagtagaaaataaggcaaaagcccagtcgtaagaatgaaacactcaggagtgctccagatctgtggcagggacaagaactgagaaatagagactagttaaaattacagaaacaggatagaggcagaagctcagaaccgaagcagccaccctgttttagtgagtaccaaggcctcccaccagcttccagccaagtcggcctggttactgctgtgatgttgaaagatttttttttaaaattctacttcttatacacttgcaaaaaatgaaagaaactcagtttctcaaatttcagcctatatttttaaccaaaagtatatttgaaagcgaatacaattagtaagtgtgcaactattatctcaaaaaggtagactagtcaatgtaataaaccaagcatggttaatttatgattaagcaaaaatgtacataatagggctttatgttcatgaaccagtactataatttgaaatatgtaagtggtgttcaaaaaagcaccacctttatatcaatttcttaccctagagcagcccatccaaatctagacgggagaaaggtggaaacacacaggtaccatcagtttgcaaaaagttagcaagacttttctttttctggtattgttataaaacatacataatagaaaatttaccactgtactcattcagtggcattaaatacactcacattgtgaaaaacgcatatcctagcctgtctccttcctgcctctccagaccacaccccctggctggggtcacctgatttccacccagctgtaactatcctcaccatccatctccagaacttttcatcaccccaaactgaaacgctgtacccattgaacaataactccccattgcctgccctgtcaaccaccattctactttctgtctgtgaatttcaccactctcggcacttcatgtaagtgggattatatggtatttgtcctttgccgtctaacatatttcacttagcataatgtcctcaaggtttatctgtgttgtagtatatatcagaatttccttcctttttaagactgcataatattcaattatatgtatatatcccattttgtttatccatctgttgatggacgtttgggctccttccaccttttgcctattgtgaataaagctactataaagatgagtgttcaagtccttgctttcagttcttctgggtttttatacccagaagtggaattgctggtcctatggtagcaagactttttgagatctagattgaaacccttattcttgagccaagcatgagaaagaacactctcagatatccagggtcttttcaccagaaagatctatagaggacttcagtctgctggacagggattcatgtctttggtagcaaggagactgtgggctttgagtctaatgcttaatcatctaatgcctgtaaggatgaataaaggcaattgtggacaccatcttttgcatgttgccatttattattttcgtgcttggaggtcattatactcattgtttttcagtctccagtaataacttggttgacatttccatccttatttttcaaataagaatgctttgcacagagtaaggcactgaatgaatatttttgtgtttgcactagaaacaaaacacagaaggaagtaaactttttaaagtagagatggggtctgctatgttgctcaggttggactagacctcctgacctcaagtgattctcccagcttggcctcccaaagtgctgagattacaggatgagccaccattccggaaataattttatactgaatcagcaatagaagaactacaaagtatcggttgtcaggtttcttggccagagcatagttaacatactgagtgccactaccttcctacagcctgtaatatgccacttttgtgactccctatgtggataaatcaaacactttcagctggaagaggctttaaagttcaacctagttcttgcccaactatccatcctacaatattctcactgtgccatcatccaacctgcatttgaatacccccactgacaggatattcactataccccatggtagttcattccactttgtatagctctgactcttagaaagtgattccctagactgagctgatatctatttccttgctcttagaaatgaacaaaacaaatttggctacttgcgttctttgtggccactaagagtgagtcatatcagagtaactttatttcacttagtagactagccaggcatggaaaatgtagtagtgaccatctaaattttaataggcatttgaccaatttgtgtgtggaggaatttgtgctcaatgaatgattggttggtttgtaactggccgaatgtctgtaaccacaggatgctaattgttgaactgagatcctcctagaaggaggtttttaaacagcttgctgggaagaagccttatggagggatgagagctatcttccattcatagggtcccccgtgtttcttcatggtgtgcaatgtgtatgtatctaaactctcaaaaacacactccagtaagagtaataccaataaccttttattcattccacaaatatttgttgagtatctactatgtgtcagatatgattgtagacactgggcatgcagtaataaattaaacagaccaaaaagaaaccccaccaatatctgtccttatggagcctacattctattggagcaggataagagaatactacaggtctcaacagcaaagtaatactagtctttgattaaagatttgaaggcagtgagagaaggaggaaacctttgaggcagaggtagaaatgaaattctatgaaataaaatgatctgtgatactatcacacagcaccagtacaaaatggatatgttttagtccatttgtgttgctataaaggaacacctgagactgggtaatttataaagaaaataaggtttatttggctcatgattctgctggcgggaagactgggcatctagtgaaagcctaaggctgcttccactcacagcgggaggtgatgtggagccgacctgtgcagagatcacacggtgagagaggaagcaagagagaaaggatgaggcggtgctctttttaacaaccagctctcatgagaactaacagagcaaacgtactcattactgtgaggacagcaccaagctattcattagggattccccaccatgacccaaacacctcccattaagccccgcctccaacactgtggattaaattttaacatgaagtttatgggatcaaacatccaaactgtagcagatatgcacacctgaagctatatatatttattgtttttagcaatgttccctgattatgttcttctccaaatcacaggacacttcccacattgttcttttttgtatattatttgggccgttttccatggcaactagtttcacaaagtacaaatgtacaaatgtgtacatttatttttagtactttttctgattacaaaagtaatacaggttcattgagggaaactggttcctatagaagtgaaattctatgaaataaaatgatctgtgatactaccgcccagaaaaaaccactgtttttgtgtttgttttgctttttgagatgggtttctcaccatgttgcccaggctggtcttgatctcctgagctcaagcagtccttctgccttggtctcccaagttttgagattataggcgcacactactgcacctagctgataaccattgtttatgccaatttggaacatttctctccagtctttttttaatgtatgtgtatggatttatttttatagagttgagatcatgcagtataataataaatcataagcattttgacatgtcacttaaacgttatcaaaaacattttaatgtctgtgtaaaattctattatatgtatatgtcagaatgtgttcaggtttttttggctgctcaaataatattgtgataaacattcttatgcttgaatctttttttctgatcattttcttaggaacacaacaaaaaaggaaatttattgagtcaaaggcaattaacattttaagtcttttgatacatattcaaaattattttctaaaaacgttttaccgatttatactctaccatcagtgtttaagggggcaatttttatttttaaattaaattaaattatttatgatttcaataggtttttggggagcaggtggtgtttggttatatggacaagttctttagtggtgattctgagatttttggtgcaaccatcacctgagcaggatacatagtacccaatgtgtagtcttttatccctcaccaccctcccaccccaagtccattgtatcattcttatgcctttgcatcctcatagcttagctcccatttaaaagtgagaagtgggatatttggttttccattcctgagttacttcacttagaataatggtctccaactccatctaggttgctgcaaatgccattcttttgttcctttttatggctgagtagtattccatggtgtatatagacactgtattttctttatccacttgttgattgataggcattgggactggttccatatttttgcaattgcaaattgtattgctataaacatgcgtgtgcaagtatctttttcatataatgacttaatttcctctgggtagatactcagtagtgggattgctggatcaaatagtagatctacttttagttatttttttttgagacggagtctcgctctgtggcccaggctggagtgcagtggcgcgatctcggctcactgcaagctccacctccagggttcacgccattctcctgcctcagcctcccgagtggctgggactacaggtgcccgccaccacgcccagctaatttttttttttttttgtatttttagtagagacagggtttcatcgtgttagccagggtggtctcgaactcctgaacttgtgatccgcctgccttggcctctcaaagtgctgggattacaggcgtgagccaccgcacctggcctacttttagttctttaaggaatctctacattgctttccatagttgttgtactagtttacattcccaccagcagtgtaaacggaatttgtccatttcatcttaacacatggacacgtgatagggagcaacacacaccggggcctgtagcaaggagtggggagagggaaagcatccagaagaacagctaatggatgctgggcttaatacctgggtgatgcgctgatctgtgcagcaaaccaacatggcacacatttacctaacaaacctgcacatcctgcacatacaccctagaacttaaaataaaagttgaaggaaaaaaaagtgtttcttaagggagcaatttttaaaaatgttgctgattttctaggagaaaatttcttcttcttgcttttttatcatgtctttaatacctgttcttcataaaattatccaattatatatatctaatttataaatgtatgtttattggtgttattatttgattaatgaatattttccagtataagtgattgtaagggactcttacaaatttcatgaagcaagggactgtgcctctttgttcaacactgatcctagtgcctgtcccatggtaaatgctcagagaatatttactgaatgaatgaatgaacagggaagttaacatgtcttcatatattagacattcaagagagagggaataataaagatctgagctaaaataaaaggaatagaagacataaatcaatagagataattggtaaaaaccaaaatgtgttttttttagaagattaataaaattgataaatgtctaaccagactagtcaaggaagaaaaaagagagaagacacaaattactaatatcaggaatgagaaagtggacatcaatacatatcctacaaactttgaagcataatacaggccaagcatggtggatcatgcctgtaatctgaacactgtgggaggccaaagcaggaggatcacttgaggcaaggagttaaagaccagcctgggcaacatagagcccatctccaccaaaaaaaaaaaaaaaaaaatatatatatatatatatatacacacacacacacatatgtatacacacatacatatatatatatatatacagaaaaatcataaacaagtttatgccaataactatgacaacttagatgaaatggacaaattccttgaaagacacaaactactaaagtttacccaagaataaatagaggctgggcatggtggctcatacctgtaatcccagaactttgggaggcttaggtgggaggattgcttgagtccaggagttctagatcagcctgagtaacatagcaagaccccatctctacaaaaaataaataaattaactgggcatggtggcaagtgcctgtagtcccagctactcgaaaggctgaggcaggagggttgcttgagcccaggaggttgaggcttcagtaagccacgatcacaccactgcactccagcctgggcaacagagtgagactctctccccagaccgaccaaaaacaaaagaatatagtctgaatagatctctatctattaaaagaaatggaatttgcactttaaaaccttcccacagagaagacttcaaacctagttggcttaactggtgaattctaccaaaaatttgaagaaaaactcatactaattctacacaaattattccaaaaaattgaagaagaaagaacaattttcaactcatcctatgaggctatcagtaccctgatacccaaaccagaaaagaaagacataaaaaaagaaaactatacacaaatatttctcatgaaatacctgcaaaagttatttaaacagtttctagcaatcaaatttaacaatatattaaaaagtacaatacatcacaaccaagtgggatttattccaggaattcaaagttggcttaacattcaaaactcaatcaatgtaattcataatattaacatattaaaaagtcaaaaccatatgagccatctcaatagatgcagaaaaggcattggataagatctgacattcattttttctttaaataaactttcagcaaattaggaatgaaggtggccaggcgtggtggctcacgcctgtaatcccagtactttgggaggccgaggcgggcggatcatgaggtcaggagattgagaccatcctggctaacacggtgaaaccccgtctctcctaaaaatagaagaaattagctgggcatggtggcaggcacctgtagtcccagctactcgggaggctgaggcaggagaatggcgtgaacctgggaggcagagcttgcagtgagccgagatcgtgccactgcactccagcctgggcaacagagcaagactccatctcaaaaaaaaaaaaaaacggaatgaaggtaactgcctcaatctgataaagtgcatcagtgaaaaaactatcagctaacatcatacttaatagtgaaagacaatgctttctttatcagatcaggaataaaacagaatgtccactcacaccactgctatttaatattgtactggaagttctagccagtgcaataagacagagaaagatcaataaatggtacctagattgttaaaaaaaaacaccatctttattaacagataacatgatcacctgtgtagaaaatccaatggaatctattaaaaagctactagaactattaatagcaagtgaatttatcaaggttgcaggacacaagatcaatatacaaaaataagttagttttatatacttacaatggaccatcaaaatatgaaatttaaaaaaataccttttcaggctgggcacggtggctcatgcttgtaatcccagcacaatgggagaccaaagcaggtggatcacttgaggtcaggagtttgagacaagcctggccaacatggtgaaagcttgtctctactaaaaatatgaacattagccaggcatggtggcaggtgcctgtaatcctagctacttgggaagctgaggcaggggaattgcttgaacccaggaggcagaggtttcagtgagctgagattgcaccactgcattccagcctgggtgacagagcaagactctgtcaaaaaaaaaaaaaaaaaaaaaaagacaagccactcaataaaaatgggaaaaatatttgaatagaaacttcaccaaagaatatatagagatggcgaagaagcatatgaaaatatattcaacaacattagtcattaggtaaatacaaagtgaagtcatattgagataatcatacccactagaatgactaaaattaccaagtgatgatggggatacggagcaactggaactctcataaattgctggtgggaatgtttaagcagttaagcatacatgtcccatatgactcattcattatgcaaaaggaatgaaagcatatgtccacacaaaaacttgtgcattagtgttcatagctgctttatttgtgatagccccaaactgggaacaggtaaccagcccttcagcaagtgaatggataaacaaattgtggtataatcacatagtgaaatactactctgcaataaaaaggaacaaactattgacacacatatgaatctggatgaatctcaaaataattatgctgaatgaaagaaaccagacaaaaaagaatacatactatatgattacatttatttaaagttccttggggagataaaaaaagaagataaaaaataaaattctagaaaatgcaaactgatttatctggatagaaggtaaatggttatttgggactggagagagtggggaagaatgaattagcaagagacaggaggaaagttttgagagtaatgcatatgcttattattttgattgtggcgatggtttcatggcaggatacatatgcaaaatgcatcagattgtttttcttgagtatgtgcagtttggtttttgtcaattatacctcaaaaaaactaaaaacaagtagaagagactgtattattccaaaatttctatgtcataaaacacaaagagaggctgtggaaatgttctggcccatcactatcctatgggacactctggttgatggaaattctctgtttgcatcatacaatacagtagtcaggagccacacgtggccactgagcacttgagatacagccagtgcaacccagtaactgaatttttgtttcgttttgttttgtttgttagagacaggctcttgctttgttgcccaggctggactgcagtggtacagtcatagctcatagctcactgcaatcaccaactcctgggctcatgagatctcctggcctcagcctccctagtagctgggactacaggcaggtgccaccatgctcagctaacttaaaaaaattatttttctgctgggcacagtggctcacgcctgtaatcctagcactttgagaggccgaggcgagtggattgcctgagttcaggagttcgagaacagcctgggcaacacggtgaaaccccgtctctactaaattacaaaaaattagctgggtgtggtggtgtgtgcctatagttccagctactcgggaggctgaggcaggagaattgcttgaacccgggaggcggagattgcagtgagctgagatcgtgccactgcactccaccctgggcagcagagcgagactctatctcaaaaaaaaaaaaaaattcttttttcagaaatggggtcttgctatgttgctcaggctggtctcaaatttctgggttcaagcaatcctccagcctcagcttcacaaagcattgggattacaagcatgagccaccacccctggctgaattttaattgttatttcattttaatcaattttaatttaaatagacatattaggcagcatggttctagattaagggagactaagcagatatgaaaacgagatacaatctctgaccctagactagatcctgtactggaaggtgaaaaatgctatgaagaacataattaagtcaactgacaaaattagaatatggatggtagattaaatataagtattgtatcaatgtaaacttatgaaatttataaccatactgcagttatgtaagagaatatccctcctcttaggaaacacggactgtttttaagggaaaggaccagaatgtatgtaatgtaccctcacataggtcagagagatgaccaagtaatcacaggaatggggtaaaatgttaacaaaggtgaatctgggtaaagagtatttaagtgtttcttgttttatttttatgtttgtaactttttgtaagcttgaaattgttttcaaagaaaaagattttttaaatgcctttatatatgactatggtattacaattatattgtttataaagactcccagtgttttaaagctacattatgaagcatttatggacaaaataatacaatgtctgggccaggtgtggtggctcactcctgtaatcccagcactttggaaggctgaggcaggtggatcacgagatcaggagttcaagaccagcctggccaagatggtgaaaccccatctccactaaaaatacaaaaattagctgggcacagtggcaggcgcctgtaatcccaactacttgggaggctgaggcaggaggattgcctgaacctgggcggcagaggttgcagtgagccaagattgcgccactgcactccagcctgggtgttagagtgagactccatctcaaaaaaaaaaaaaaaaaaaaaaaaattactcaggcatggtggcatgcactggtaattccagctactcaggaggctgaagcaggagaattgcttgaacctgggaggtggaggttgcagtgagcctagattgcgacattgcgcttccgcctgggcgatggagcgagactctgtctcaaaacaaacaataataataataataataataataataataataacaacaatacaatgtctggggtttgcttcaaagtaatgtgggatcttactatagagagtggggacatagctgaaagccaagcagccatagattgattctcctgaagctgggtgatatgtacatggatttattatactactcagtccatttttgaaattggacattattgtatattttgcttaacatttccataagtttaaattgggaaaaattggcatctcactcaacattttttcctttcaagaatattgtatatctttcccttactcagtttgtttcctctggtatggactgggaactctcatttataccaaattatttgttaggaagattatttatgcagttcaaatgttccttaaaataataaaaaccctcatcaaaacaaagactccttttaagattccatcagtggtcatttatttcaagcaattttaaacaatgtgtccaagttccactatgggaaaatattttgctcagattctgcaataaaagtttctttccatatttaaaaatacttatacaaaaaatacaaaaaaaagaaaaagaacaaaaacaaaaaaataaaaatacacaagtaaaatttcattatgaaaaatttcatgaaatacttttaaaaaaatattttggtttaaattaatgtatccctagagatcacattctctgtgaatcttgaggtaaaaatcctatttatgtgcagctgagcccaatgaggtaaccaggaggtgttttgaactcagagtatttatgcctttcactcctaggccttatttttcccaggatatgattttgtgtcttattgtttggctcattgtttgatgggtttaagtggtttggagtttggctttgggaacgtttaattgttttaattgcttaaattcgataaaacactcagctaaaccattctcagcctgcagtctggcaaataccccatcttcattttagtggctcttacatgaatcaagacaaggaaagcatgttcacaaatttgtttgttgcataaacgttttgtaatatgtcaggaagtttgtctttgcctagcagaagagtccaggtataataataataataatagaagaagaagaaggaaaggaagagagaaagaaagaaaaagaaagaaagaaagaagaaaggaagaaaggaaaggaaggaaggaaggaagggagagagaggaaggaaggaaagaaagaaagaaaagaaaagagggaaagaagaggaggagggaggggggaagagggaagagggggaagggaaagaggaaggagaagggggaggaagggaaagagggaggaggagggaagaaggagaagaaggaaagaaggagaagaagtttctcttaggagaggccatatctctaaacatggaagtagctttattgggagaccccttcatggtgtgactctttgaggtgtgggattttacctgtttgggaaaatgaagactggaaatccctggttttcctatgctagctttattgattggtttgccattcttgtgatttttccttcttgccagagatagactactgtgcctcatctaatcacggatgtcagcacgagtgtgttaacacagatgattcctattcctgccactgcctgaaaggctttaccctgaatccagataagaaaacctgcagaagtaagttacagtgggagttggagaagggcttgttctgctaaatgctcctctagttagttttcctttccgtgcaaatcttaagcaagatgtgcttgtattcagcattgtgtctattaacattattctcccctttattttactttttggctcactagatcctattatgtggatgatttttaaatattgaataggtctggccattagattcaattagccaagtggacccaagctgaagctcccacctatgtgaaatgcaggtgcagtctccctcccccttattcccatagcattggggtcttggaaaaagaaaagaatgggcccagagatgagaggtagaaggagttggtttcttctactcctacaagataagacacttgacggatgctaagagggaggacattgcagctttattccctttgataggaaagaagaagaaaaatgagactctaggacatcccagcaatattcaaggggtacagggtgtcagcgggttgatattgtggatgtactgagtgcctcaaatgcctgtcatctagcacatcaaagggcatgattggggatctgagcacaggccccagagggcacctgcttaagacaaaccattcctgagagactgctagaatggacggcccacaaggacagagacgattatctttttctcgctgctgaattctcaaaagctcaaagagtgcttggcactcatagatgtgcacaatgtttgctgaatgggaatgagtaagtgaatctttctatgatgtatcatcctggagaaattgaagctattttttttttaattcttcaatcttgttagaaagatagccttttttaggcgtgcaagttgtgaattttttttcagaaagtctttccctagttagtccacacttatgcacactgaattgtttggggtctgctgacaatgtcattcgtagaactctctggagcttccattgagggatgtaattttctgtatgttccttcacccatttcttcctgatggtgtgtacagcagtgttctgcctggcaagactgcgttttgaaaggtttcacatatatcttttttgaaaagcaccatgagctatttaactgaatccagatgagtcacattctgctcatagcacagattaactttcatactcattctagcaagtgctaaactgtgtatagtggcagatggttgcaaatcccggattttgaaacggagcctgtcttataaaactattctcactgccttgtgagggtacaaaccctgcacacattcaagcattaaatgaaaattttaatggagagcattcagaatgtgaaaacaattagataagctatttttcataagaccacacatgcctgcaataggtcagagggccaacttttctggtctggccactcctctgtgctatttacaccttttgctaggagtgggtgtgtgagggactggctgcacccaggggaaatcactcccaggtggactcaaatttgcagacccaaagctcttcagtgggcggtgattagatctggttcagctcagatgctcattgcaagcttcctcatgtgttactaatggaggggaaaaaggaaacaagttaggcttggggccatgggcggaggacattttcttgacgttctgcatgtcttaccaaccatctgagtcccttaatttctgctactccctccacacccttcctggagaggcacttggaataagagaagatccaatgcaatgcaggcatcattatcatgggaaggagaagactgagaaaggaagagcgagtagagagggagtgaccgttttggagtggtctgagcgctacagattggtccccaggtgggcctgtttgcaagcaagctgtggccccgaccagagtccctaatgctcatccatgtatattcagtgggtatagcccctctttagccagggttcttactttttcatccaagaaaaatgaaatttgttcctaaaggccagtgtcctcatcagccctcgcccaacgtcccgcctcatcgttacattttccattgtctttgctgtgaacccaaccctgactcctgaggtcagcctgcaggagcggcccctgacttcatgcttgcactcagtccattagggcagacagctgtaaacggaagcgagtgctcactgtctctctggagcattatgtggatgaaggaagccaagaaattgggtttaaaaatctggagtccgttattagaagcctgaggtctcttgagtgatctgagcattacaaatcttcagcccaggatacagccatttacgtttaataggaggttgatggatgtgggtaattttcaaatctaatatgaaatctatttttaaaggaatttgatgtcatcgaaattaaactgggggaaaaaagatcaaggcagaatcctactgaagaaaagattcttggccaggatttgttcttgctcctcatctgggcacaatttctcctcatggagagtgctatcatcagtttaaggcatgaattattaaggcagtagtgcaaagcacagaaactgcgactgccttgcctgcccaggtagagccctagggccaaatcagatgtgggttcatcccctgtgctgggctccaggatccctgattctggtaccatgatgagtgctctcaaaaattggtgtgaagcccacgggttcgactgagccaagagacgtgacgtccaggcttggcaatgtcactcatattggttatgtgaccctgagcagctactttctacttctcaggacctggatttcctaaactgtaggaacaggacttcctgccttaacaccctgttgcctctccagtttttttgaaacttactatctgtgcactcagctggtatcaaaatgtactacctggggtcactgatctttcatggtttcagtcttacctgctcagggctccaactctttcacaagttagcactcagaaagatcgtttgatttgttttctgacagtcctgtcatctgacctcacagagctttagtggacactctgggccttaccagattaagttgtgtccatcctgtgggtgccatgtcagagcacctatcatggtaccagatacaggatgcacagtaggtcctcaataaatatttagtgaatgaataagtgagtgagtgaatatctgagaagcacacacatgaggaaatatgacaaaagggtggtgagaaggcaaagagccactgttaaacgtctgctaaaaagaaccatttggagaaggttttttttttttttttttttccagacagaatctcattctattgcccaggctggagtgcagtggagcaatcttggctcactacaacctctgtctcccaggctcaggtgattgtctcacttcggcctccctagtagctgggactacaggcgtgcaccatcatgcctgactagtttttgtatttttagtagagacggggtttcaccatgttgtccaggctggtctcaaactcctggactcaagtgattctccctcctcagtctcccaaagtgctgggattacaggcatgagccaccacgcccagccgaaaagggtggtatttgaatagctgcctgccagattgctgggtgataacctctttaagaatctaaatggttttcagttgaattatctcatgtgtaaatcattctttaaaaaaaaaatcttgctgggcgcggtgtcacgcctgtaatcccagcactttgggaggccgaggcgggcggatcacaaggtcaggagatcgagaccatcctggctaacacggtgaaaccccgtctctactaaaaaatattaaaaaattagccgggcttggtggcgggcgcctgtagtcccaactactcaggaggctgaggcaggagaatggcgtgaacctgggaggcggagcttgcagtgagccgagatcgtgccactgcactccagcctgggcgacagtgagactctgtctcaaaaaaaaaaaaaaaaaatcttgcttgaaacattatttactaatttattttaattttttaaaaatgtttttctttttatatttttattgtatgtgctgctgaagcgagagcttcagcatatttttttatatttttaaaatttttaaaatttttttttatatttttaaaattgttacaacatagttgtacctctttttggtatttattttttaaaattgacataaaaattgtatacttgtatacaatatgttgttttgcaatacgtaaatataaatttttcttaaagacaacattggcttttttagtgtggcaaaatatatataacataaaatgtaccattttaaccatttttaagtatctagtccagtggtattaagcacattcacattgttgtgcaaccatcaccaccttcaatctccagaacttcttcaccccaaactgagactctatacccattaaacaataattccccagctcctcctcctccatctcctggcagccaccaatctactttttgtctatgaatttgactattctaggtgcctcatataagtggaatcatagaatatttgtccttttgtaaccagcttatattgcttggcataatgtcttcaaggttcattcagttgtaggacgtgtcagaatttccttcctttttaaggctgaataatattccattgtatctatacatcatcctttgtactcatcctttgatagatccctgggttgcttccaccttttgacttttatttattaatgcagctatgaacttgggtgtgtatacccagaaatggaattgctggatcatatggttaattctatatttaattttttgaggaaccgccatgctgttttccacagtggctgaatgctgggttttaaaaagagagttgactaaagatcatttcacctttccctgatggtgtaatggagtgattcctataggcagtagactgcgggcccttcctgttctgtgtttgtctgtctgtctgtgactggtgttttattgccaggcctattttcctccatcaaagctcttggcttgtttcctggcactcagttatggcctgcacaggtgaggctgctgatgagtttcaggtagatgaatagaaactgcacacagctaacaatatcctgcctctcctcacatgggagtgagctccagagagagtgccaagggtcagtgacacagcaaggtgatgtcttttcttctacaccagccctgcatgttgtgaccttctctccatgcactctgtctgcagccattctgctcatactctgggcatgaagcaagctccagccaccagtcacctgggagggcacgtcacggattctttttttttttttttttaattttttaatttttttaaagacggaatctcactctgtcacccaggctggaatacagtggcgcgatcttggctcactgcaacctccatctcctgggttctagcgatcctctcacctcagcttcccaagtagctgggactacagatatgtaccaccatgcctggctgatttttgtattgttagtagaggtgggctttcaccatgttggccaggctggtcttgaactcctgacctcaagtgatccatccgcctcagccttccaaagtgctgggatacaggcatgagccactgtgtccagccagatcctttaagagaccctttgaggggtccttcaggtctgggtcccattcacatttccatttttactagcagtggatcttgatcaagttattaacctcgctaaacccgctaaacctcaattcctcagctttgaaatatggataacaggccaggtgcggtggctcacgcctataatcccagcactttgggaggctgaggcgggtggatcacaaggtcaggagatcgagaccagcctggccaatatggtgaaaccccgtctctactaaatatataaaaattagccgggtgtggtagcgggcacctgtagtcccagctactcaggaggctgaggcaggagaattgcttgaacccaggaggcagaagttgcagtgagccgagatcacgccactgcactccagcctggatgacagagcgagactccgtctcaaaaaaaaaaaaaagaaatatggttaacaatcacacatatcttgcagggtcaaatgaagttatgtttgtaaagtggttggcacagcatctggcattcagcaggtatttaagaaatggcagcagctatgatgctatgattatcatcactaatgtaactatcagactgccactaatagtgagaaaaataaagatggcatggtccctgctcgtggaactcagtctagtgaaagaaacagactttgaagcatcacagatacaaaacatactacataaccattgtgatgaatgctacgaaagagaggtcctgtagaaagaactgacttcatctacgaggtcacaaaagatgacaaaatgatgttgagctgatcgtgaaggaagatagaggttagccagtgcagcaaggagccactgagacaagagggtgatgtgtcatatctttaagtgatttgtggatgtgagcttcgtcaaataacttttgggcagatacatggtaaaaataaaatctagtcattactttatgatttcagatcatttcccctgtatcagttatggtgctttttgttcacacaaaaccggaaatccaattaatggtgttttaagtcagaaggacttttattttttacctgacaagtccaaaggtggttggtcctatggatggctcagtgactcagtgatattatcaagaacccagactctttctgtctttctattctggcaaagtatgttgcatttacattttcatccttgtcacctcttggttacaagatggttgctgcagctaccagcatcatatccttacactacaagactcaaaggcagaaaggacagagagcagagaaaagcatttctctttatacacttttgtctttttttttttttttttttgagacagagtctcactctgttgcccaggctggagtgcagtggcacaatctcagctcactgcaacctctgcctcctgggttcaagcgattctcatgcctcaggctcccaagtagctgggattgcagacgcatgccaccatgcccagctaattttgtttttttgtttgtttgtttttagtagaggtggggtttcaccatgttagccaggctggtcttgaactcctggcctcaagtgatctgcccaccttggccttccaaagtgctgggattacaggcatgagccactgtgcctggccacctttgtcttttcaggaagaaaaatctttcttgagggcccccagtaagcttcttatgtttcattggtcagaactagggcatattcccaccccttgaccaatgactgacaaagaagaacatggttgccacgctggcttagaccagccatgactcatgcttgggggtcatggggtaatggttattggcaagacaaccaacagtgtctgccacatccccagaaaaagaacaatgctgtgcagttaaactgatccagcccagccaatgaggtcggtggtgaccttttcccgcgacaccagtctcataaagcctctccacaagctcattttgtgtccttttccagttctctatcttccctggagcctgctatgtgtggggtcttatggctttagcattttctaccaggaaaggaattgcttattggctcctggttatgacacagtttccatctgctggcagaaacacagcatggatagagtgaccttaccataggacagaattgcagtagcctggggcagcatcagagatacgcctcctccagtcccatgatactatgccagcgtggtctcaacagagcaaggcgaagcatttagatccttcttcatgaaactgccaacccctgcatccctaaatagctggatattttgcaagatcaccttttgtttattttgccttgtgccgtccaatgtcactgtcagatgtcactgtagacagaagctctctacatgctttgagcccaagtgatcaggttaacctgagagagatactggattttcttagcttttccatctttcttggaaggaggtaggctggggagcgtggctctcaccccagctctcagctctttggccactgactcagttcagctcagctcaactgagccttggcttgctctttggccatcaaagagggaaaatgctggagaatccacaggtatacttcaggtgccaggccctcttttaaacaagctcctggagagcaggagctattttctctgtgtcctgtagctcaccttgtttcctgaagatttagtgaagtttgcctgcctttccacctctactgcaaagtcttcttcaagacataaccctggccttgtcacctccaccaacattctcacctctagtcacctgtttagagccttcactgatccatcctggggcttgcaaagcccgcacgtccagtcatgctcaggtgggccagctccctctgcctcccagcctcatctctctcctcacactccagccatactcagctcctcacagctccccaggcatgcccctcgccctcatccccaggcatttgtgttcactgtcccctcatccctgggcgtttgtgttcactgtcccctcatccccgggcatttgtgttcactgtcccctcatccccaggcatttgtgttcactgttccctcatccccaagcacttgtgttttttgtctcctcaccctcaggtgtttgcgtttgctgtcctcgagtcctcatgttcttcttcctgttgagctcccttacctatggaactcctcctcctccctggggcctcctgttggccttatctcttcttggaagaccctctcaccccaggactcagtgaggcccctgctctgtgctctgcattgtcttttagttgctgtccttgtctgactcctcaccagagcctgaacccattgaggcagggcctccatctcagtcgtcattaaatctctgaatctagctcaaggcctggcacttggctggcagacaaacgaatgaatgatccgtcccggcttgcctcagcaggcagcacccaccagccctctccatgggggctcatgggagccccgaggggctgccatcagccctgggagaggtccagagtctgaaggaaggtctgcccttcttcccctcagggatcaactactgtgcactgaacaaaccgggctgtgagcatgagtgcgtcaacatggaggagagctactactgccgctgccaccgtggctacactctggaccccaatggcaaaacctgcagccgtgagtgtaccctaggggtggggtgctgatggaaggtggggtccactcatgggggcgggcgggttcactagcaaccagttgtttctggagcccaccgggtttcctgatggtctgtcaggtgtatccttccttatcctcagtttcatcacccatagaatgtgactattaatactatcggcctagccaacttgggttgcaaggattaaaagaattaataggaataggctgggcgcggtggctcacgcctgtaatcccagcacagggaggccaaggcgggcagatcacctgaggtcaggagttcaagaccagcctggccaacatggtgaaatcctatctctactaaaaatacaaaaaattagctgggtgtggtggtgggtgcctataatcccagctactcaggaggctgaagcaggagaattactcgaacctaggaggcagaggtgcagtgagctgagattgcgccattgcactccaacctgggcgacaaagcaaaacttcatctcaaaaaaaaaaaaaaagaataggagtaaaatacttagaacagcactgctaggcataagcactcaataaatgttaactaatattagtatttgctgttaagtgtatttactaggtcagacaggtctaatttcaaatccaacctctcccacctactagatgtgtgtgaacttgggcaagttatttaacttctccatgctttgatttcccatctatgacaaaaagcaaaactaatagtcgtattattcccacagggtttttatagggagaaataggagccattttgatatgttagcctggtgcctggcacagggtaaacttccaatcaaggggaactgttcctatcatggagcctgtgagaggggccagtgcctggcgccagactgggacaagaggccggaggggacagaccttggaaagcaatgggctgcagaggctgatctgagagcagaatcaagaaacatgggattttctgagaaggcttgtcttaattttcttgtgtcagagccacaacaaagctccactgggtgatgtaaatgtatgggaacttgcaagctctgccagctgggcggctccatggttttttatgaggcaccatctccacaggtcctggccagcaggataggagcgcctgagtgtggtgatggaccctatgcccttggcatgcgggagagggggcccatctccatgacatggcctatgcagaaggggccctttatgtgcctttccactcagcaagccccacatctgctccctttggagaaagagatagattgtgagtgaggacagtgcagctgttgagccctgggctccacgctgccagcagggaagtttcccagatgaaataagaggtccagggcagtcctcaggaaagcgtggctcctctagtgtccagagagaacaaagtgcccggtaaaggctttctaaggactgatctcagaggccaaagggcttttgaactggaaagtggtgccaaagtcagtgcctgctgtacgttgcctctgcatgtctctgagtccttttgagaggccagcgggaagcgggtctcccattcaacaggagatgccctggtgaccatggatctgtgtgtatcctgcctgtttcccggagtgtcaggtctgccagctgatggccctggcaattttcccagggcaggtggtcctgacctggctgagcccacgcagatcaccagggacatggcttgactgcccctcccagcatgcttccgggggccagaagagctctaagaacggaccacaagagatcgggaccctcccttctctctgggatctagtcaactctaagaaagtacaaaccaagctgtttctgtctcgcagtccttagagaaagccacaggcttctgctttctcagaggaatcagggagcccaggccataaagacagcaagcaattctgaggcgctcactctgtgcaggcaatgccctgagcacttcccatgcataaactccctgcatcctcacagccgccctactgggcacccacattcttgtcgctatttaaacaagggcaaactgtgacacaaagggattaagtcactgtcctggggtcctgtgattaacaaatggcaacactaggatgtgaacacaggcatgtagctcccaagatccagcaagtgttcgcaggagatgcatccaccagtggaatgttctggaaggcactggtcccagactctgcgggagtcaagaggcccacttggcagacctgcaccaggcctccagtgtctgtccagtctctggaggtgcattttctccataagggaaacctgggaagcagcctgcagggctgttagtgggagctgttcaccacagctgtgtgttcattagccttcggcacttgctgcccggaggaccagctgtgcagcattcggatgccaggataggccacacatgcagtcccaggctttggtttgttttttaatctggatgtcctgataatgggggtaaaaaaaatagaaattgatttcatggagaatgacaactctttttcattttcaattagaaatgaaactatatgactaattcttactcagcactacttgataataatagtgtgttcattaagtggttgctgtatgctagctactgttctgagcgctttacataatcaacccctcttattctcaccctattcctataagaaagcaaccatcaacatccacattcacaaatcaggaaacgatggcaaagaggccgtgggactgcccagcatccatagctaggaagtggcagaggtgtgatttgaacccaggtagtttgatgccagaacctgcattctaagcactactctattagctgtgtggctttgatcttgaccttcctgagcctcactttcctctctgtgaaatgggaattgcacctgctctcagaggtgccctgagactgtggattctgtgcgccatggccctggcagagtgctgctgtcgtcaacaccagggacagcattccccagccattggagttgtatgctttaaccttcaaagaaagaaatgggaaagaaggctgggcatggtgtcaggcacctgtaaccccagctagctactctggaggctggggcaggagaatcgcttgaatccaggaggtggaggttgcagtgagccgagatctcgccactgcactccagcctgggtgaaaagggaaagaaaaccaacaagccaggctgattttctagagggatcagtgatgtggggtagaatgacaccttccctgtggcttgttatgcctccggttttgtttttgaatcttggttgctggtggggtattgccccctcggctcctctatgctttcgcgtgtgtgaaaatgcaggagtggaccactgtgcacagcaggaccatggctgtgagcagctgtgtctgaacacggaggattccttcgtctgccagtgctcagaaggcttcctcatcaacgaggacctcaagacctgctcccgtgagtccctccgcgctcctctcataggggaaggtttgcaccaggagtgaaacctatgtgactgcagagggcacaggttgtacttgggcacccctcccctgccccttgctctgctccaggagatagtgaggatgtccactgggactgcatgccttcgagggagggcggggtgagcatgacggtcacttgatccaatcactgtcgcccagaggtctcactgataaagggctgcctggcttttggttttgcaggggtggattactgcctgctgagtgaccatggttgtgaatactcctgtgtcaacatggacagatcctttgcctgtcagtgtcctgagggacacgtgctccgcagcgatgggaagacgtgtgcaagtaagtgtctgaaggacaagcaggacctgcacaggtgttccgtgggtgccggtgtgggtgcgctgccgacgtgtatatgtgcctgtgtgtcctgtctccaggctttgctgggcctgcatgaatgtgtgtgacagcatctcttagccattgagccttggtggctgcttcaccaactcccctcaatcttccttcccccgtgccctgaagtggctttttgctgtttccacctccctgtcattctgaagctggacagagcccttgtcctcagctctctctgctctacccccagccagctagtatggcacatgaataataataatgtggacccctcactgactgctagctgcatgctgggcactgtgctaagcacacatgctgttgcattcaggggacagatgaggaaaaactgtagctcagattaagtaaagagcctaaggtcaccagctagtgagtggtgggttcaaactctgctggctgtgattccaaagtcagtcctgggagaagaggatgctcctgagaaacgctttgccctgctttctgaccccggtgatctcacagcacatggtgaggctggcagtgatgtgtcctgggtacatatttccttgcagctggtcccaaatcttgtctcaattaaaaaaaaaaaaaattgctcccagacctccttctctcctttactgaagaatgctggtgtgtttgttgccctgaaatcctgtttcgaagtggaccaagataaagaatcgaaatatggtcattttgagagaaggaatcagaaatgaaagaaaaggaccaccatttatcttccccagcctgctggtctttctggttatagggccaagttccctgaccactggtataattgtaggcacaacctaatttatccactttttatatcatctattcatctaggcagatgagctggctgcacagctgggcgtgcctctctatgctgcctgtgagaaaatatttccagtttgggacagatccttggatcttagcaaatgggttatccatgttatagctttcggtggctccctgcccagctgcctcccagactgctgctgcagccagctcagggagggatcgggcacagggggtgcagaaagagggtgggtgtgttgaattgcatcgacattgacagcatgccaaagccagatgtaaggggtttgttggtttgtttaattctccatcattttagattattctgagaataagaggagtcattcttctgtccacctcgttcctgtaataatcaagaactgactacaagatggttgtaggaccctacgaaattctcatgagcccttctaaacaaatgcagctccatctcctttgaatcaggtgccccttcctctcccctgcccaggtccacatctggattttgacctgaccacttttaagtgttgcccattttctcatttaaagtgggtttctaaccaatggcacagtggaaccatctacatgagtaaatgtccaacaatgcaatgaatagtgaattttgttatttatatgtggttgtatctagatgagaacttgtgagatagtcagataagtgagaattgtcctcaggaaccgtataggagagatgcatttcacccaccagctgatacatatgcattgagctattcccctaattgaagactttctgcctgtcccagaatgattcattctgactgtcctgtcctgtaataatgggctaggttttcagcgtggccacagctaactgggggttgggatgtgtgttccccagctctactctcaatgacaaagggccagacgacatgactgcacctatttggtaaagccttttggggggcagtcaggcctggctcagcagataagagtgtccttggctctttatagaggcagcctccacttagagctttgatagcaagtggtcttaagaatgtgtcactcaccttctggaaagttctctgaagtgtggaggggttccaggggccctgggatgagatgggcactgctgtgcccctacctcttcaggcaccttgggttctctggcctctggagcgatgtcccctcccttcctccagccccctgaccgcaagctctgctttcccagattttccccagaggcctttttgcctcgggcagttagatgcacagactcagggtgtggggggtcggggaggggatggggcgatctcttttaccagctgcagctgagcagactccttccctctctagacgtttccctgagattgaccttgtgcaagggcatcccagcaccaagaaagactctataggcctgatgtgcatggaccacactgcccactggcctgcaagctgctggaggttggaggtcagaggccaacatgaaatgactgggagcgtgaatggacagaggccacctgtctttttgccccacggcccctggcacagggtccgctccccgcttgataaccttcagtggctctccactgtctcccagaataaatttccattgcactccttgatttggcagagtgcagaaccccctcttccacttctttagcctcaccccaggccctccctgaagccgcctcctgttctttagccaaagtggcaagtcccccattctctgaacaggcctggtgccttccagcccatcccaatgtcacccccatgggtaacctcctctcccacctgataggctctcctctcctcctcccaccccaggctctgctggggcctctctgcagagctctcctgcccagcctcaccctggggctctctgtgcacatgtctgagaaacagtgtggcagagcagaaagagtactgaactggaagcccaaagactgggtttaaatcgtgtcgcttctaccctaggcaagggaattggccctcttggggtctgactgctcatctctaaactgagaatggtcgttgctgcctttcaaggccactgtgtggttcagggagactgctgttgcagtgctatgtgaacttgtggactgccgtgacccctaaggaattcctcttcctctctcccctcccagcatcagaaccccctgcactgaggagactcagaaggtattgctgcctggaaacccatctgccagggccaggcctgctctccttggaggggccccagagacacacaactctggaagtgggctggactcaggagtccaagggctgtcctatgagggaccctcccttctgcaagcggaggacaccaacggggatcagagccgtcagcctagggcactgggggatctctgctggtgatactcccagtccaactaccacaggcagatctgcgagggcctgttaggctgcctgaggccctgagcttggccttccagggctgaggcaggcctaggcgaggctaggggagtgtcttagtctactcgggctcccatcacaaaataccatagactgaatgttgtttcttaaccacagaaatttctttctcacagttctggaggctggaagtccaggatccaggtgctggcatggctgggttctggtgagggccctcttcttggtttgcagacagccagcacccagctgtgtcctcatattgcatgggttgtagggggtgagagagcaaaagagtgcaggcaagttctctggtgtctcttcttataagaacactaatcctatcaggtcaggatcctgccctcacaaccccatctaaacctaattacctcccaaagactccacctctgaataccctcacatcagggttagggattcagatgtaaattttgggggaaacagtctgtagcagggagtagggggaggggaccaccctcactctcatgtattcacattacaggcttgatgcaacagaaggaaactagagattttcccttattttgtgggaaacggacacatggaggaaagtgatgcctccaagctggccctggtcggggagtcagtggcagagccaggaccagagccgagtcccctgattttaggatcttttgcccagtgtgagatgccctggaaaagcacatctcagttcagctgcttcttggtttgtctgagaaaaagcctatattaagttagcaaaggattggctgctgctagttttattacgagaaaagccaggaagcagtgtaattctatctgtcggcttctggttactgtcttggcagatggccactgtggctttctctctctggggttggggttggttttaacaacgtcttatgtggagccccagacgcaggattgctgtctgtcatcacggcagaggtgcaagtccacagaacacgttgccccactgttgctgcgccacagacttacgtgactcacctgtgtcagcgtgcagggctgctagacagggaccctaaagacccgtgctacatcctaaaacttctaatcatcctgagcacacgctgcagaatccattcacgatgagggtttaattaaacacataggcctgggtccttatgtgtaaaaggaggagaatccttctttgagaggaaaaatgttttctttctccctcttgagatttcttacatcctcccacctatttcacttaagtgatggctcctaatggagtctgtctttactctcctctctgggtttgaatctaggtacttccttaagcgcttggttcctttaccctcgttctctacaaatatttactgtgtacctgcattgtgcggggtgctggggatctctggggttgatgcagattcggtttgtgccctgacagtgtttaaagcttctcggggaagaaggatagcagagacagcgtccattccttatggtgagagtggtgatgtgagaaggatggagccgtgggagcaccccctagtctagagaaagagaagtttaatccaacacccagaggagggggctgtgggagcctcccctagtctagagaaagatgtttaatccgacacccagagagtgagtacagtgagccagccagagatggaggggaaatgcttcactaggggccagagagcgaactgcaggaagttctgtgctctgagtacggggtactgaatgcaagagggaggcggtgggtgagaaacgagcctggggacgccggcgggacacatcacccacctacagccttcagagacttcctggctggcctctcttgagaaaatgatttttgtctagtttgtcttctgagaatctgccaggctgcctcagcacactcccttaagctaggatgatctgtggatgtgcagctggaccagggacacggaggtctatttgaatatagtcccatctctgcccccaggacagctaagaccagtcacctctgaaggttcagggacattgggaaagtcacttcccctctgaccatcagttttctcatctttaatgaaggggttggactagttcatatccaatgagttgaacttccagcacccaaacaaggatattgcctggctcagataagtgctccgtaaacacttgctgaatgaatggacttactgtggtgcccaccatagtctcccaggctgaagacacccagtggtactgagtcaggggtggtggctctgtttgcctgttaggggaccactgaagcattttcctataggggagtatctttgccctgggtagaaactgactccaagttggtttccagacttggtggatagaaagctagcgcctatggtcaggaggttaactatcatccacctttggcattctctaatttcccatccacggttctttgaatttataagtggcccagaacatccctgaagggcagaaactggacattttgctgaacaaatgtgagtcgtgcattttgcaaggtgggtgtgtgggagagagtgggaagcctagctggccacaaacatccacacatcccatggggttcttatttaaaacatctgcacaaaacccctgtgaggtggatctaattaccctcaattttcagaatagcaaactgaggaaatgtttccttttgttcaacaggtctttcctagggatctgttaggtgccaggcattatggccactgccaacatctcacctctgatgattcgttgaaatcatctatggggctaggaaaaagtctaaaggcccaggcagcatcccagaaaccctgaatcagaaacagaaacagagactgtcttacattgttggtgagagtagagattgaaataatctctttggaggatgacttggaaatatttatctgcctttaagtattcataccctttacctaggcaattctgcttctggatgtgtaactttcaggtatgccttcacattgtacataaaactacatgcacaagaatatccattgcagataaggtgtggtggctcatgcctgtaatcccagcactttgggaggctgaagcgggaggatcacttgaggccagaaatttaagaccagcctgggcaacatagtgggaccccatctcaacaaaaaatatgaaaattagctaagcatggtggcatgcacctgtagtcccagctactcaggaggctaaggtgggaggatcacatgagcccaagagccaaggctgcagtgaactgcgatgacaccactgcactccagcctgggcgacagagcaagcctgtgtctcaaaaaaaagaaaaaaaagagccttagctgaagctaggaggacaggactgggcacaagggaagctccaggaaggaagggcttaggggtctgtctggattatggcttgacaaggttgacgtgaaagagctatagctattttattaccatggaaaatggagtagtagtagtattataaattcacggtagggggaaaaaaaaacacctcacctccatggccatccagttgtctatatcatggatcactcaactctactttccactcttacaccatgtgaggaactatcccaaaccatcaggaaatgttctgcattaatagtgagtctagaatttgctgagaaaagcaagtcatgctcagggcaaacaggagggtccaactcggctttgagcctcctctgcagctgtaattgcagttatcaaacttttcccattcttcaaagattttggcagtgcttctccccaaagaaattcccttcacatttgaaagcttgctgtagaatatagcaatgtagtatagtcagaaaatacggggatttatttataagattacaatttttgtctggttctttctcttgttaacaattggtcttgacaagccatcagccttcccaacccttagtttccctagctggtgagtgagaataacaacagctgccttaactaacccaaaggtggttctgaggagtcctctccagagagatactgcaaagatgctttaccaaaaaaagtgtgtggtttgtgcctgattataaaggtcattatgtgctttggggcctttatttaataattccgattcatgtccattttagaaattctactcaatctgaaaggattgagttaactttcagaaatatgtagggttcttataaaaagtcaccactcacctatcctcagtattaagcttttaaagtaacagcctggttttcacaggttcacaaaccttctagtcccccagaagccacccagccctgtaagatggcaatgccatccttcagttgctcagtccagcaacctgggagtcttccttgactcttctgtcctatccatatgggctctttgtattaatccatgaacaaattttatagattctaccttaaaatacagccagtctgaccacttctcaccagcctggtctgggccaccaagatctttgcacagggctgctcccaggtgtccaagctccattctgtgcagagcgatcctttaaaaacaaacccatatcatgccactccactgctcaaaacactgcagtgactgcccttctctttcagatctgacccccactgtgaaccccacatggtctgccccagccaaccttgctggcctcatcccctgccaggctcccggatgctccagtcacagtggtctccttgcctttcctgaaacacaccaaccaagcagctcccgttgctgcagtttgcaaatgctgttctttcttgctgataatgctctttcccagacaccaccactcacttcctgtctttctgcagggctctgctcagtgtcaccatatctgacacaccatataatataacaagccctccctactctccagcccagtagccactctccatccttctatcctgctcttcctccatagcactttttcccacatgacatatcacatatttgtctgttttccacgcatccctcttctcctgacacctgctgccaaatgtaagcttcacaaaagcagaaactttgtttcgttcattgctatatccccagagtctaaaacagtgcctggctcattgcagggactcacaaaatatttgtgaactgactgaatacatgaatgaattggttacctaagtgtaatatatacatacatacataagtagatatgtaaataagttgatattatagttacataatagccagttaggttaatcttattttctaatatttacaagtaatttatctctcattctgtaacttgtattctcatgttttttgttcatttttcttgtggagatgatttatattgtttgatttttatgtgccatgtgtatattaagaatttttgctcactttgggagtccgaggtgggtggattgcttgagcccaggaattcgagaccagcctgggcaacatggtgaaatcccgtctccacaaaaaattagcctggtgtggtggtgcacgcttgtagtcccagctatctgggaggctgagatgggaggatcacttgagcccgggaggcagaggctgcagtgagttgagatcacgccaccacactccagcctggatgacagagtgagaccctttctcaaaaaagaatttttgctcatagacatgctttatattctgaaatgtgtactgtaggataaggcactgttttaattcaaagtgtctgaaatgtcttttatgattgaataagccactaatatatgagtcattttcttcttctgtttctctaattcccatttgattctcagaattggactcttgtgctctgggggaccacggttgtgaacattcgtgtgtaagcagtgaagattcgtttgtgtgccagtgctttgaaggttatatactccgtgaagatggaaaaacctgcagaagtaagtttgtactggagctggctcctactactatgccagaccactgtgtgaaatcgctatccttatctctgtatatatcagttcctctcagaagtcaatgccacacagcaaaatgtaatgtagtgtcctggataggaccctgaaagagaaaatggacattagggaaaaaataagtaaatgtcaataaaatatagactttagttaataatcatgtatcagtatgggtttatcaataataacaaatggaccatactcatgtgagttgttaataatagggaaaactaggtgtggggtatattgcaattctttgcgctatcttctcaatttttgcgtaaatctaaaactgtcctaaataataaagtctattaaaaaaatggacaaacaaaaaaagtcaatgccagagctactactgaagttcttcacttatatgctctgtggcaagaaacagtggtttggcagtatactctagtggaaagatggacagtcagaaatccaagattcagtcaacctctgtctctgccatttattagctgggaaagttgcctaacttctctaagcctctctgcttatttatctttaataatgttgttgttgttatttctggtagcacaaatccctcccaaagggcaccttgtgatgaagccagttttgcctttcagaaggcaaagcctcttagatggggctgcagccagccagcccaggacaagcagccttagagtgaattgctggtgtaaatctcaagacacatctctgaataatcaaaggggagtgtgtgaccctggtttccatccatatcagttatctttttctcaacgtctcaaagcactttataaagagcaactcatgttgacacttttggaagaaaagatgggtaactggaataattactctctcattttttggacagcacagctaagactccaagaagttaagtgattctcctaagtcatacactatgttaggcacaaagccaaagttagatttcagtgctgctaatctaaattgaggtttaatctcctaaggaatcatatcaagtgtttccattctgatatcagaaactatgtctacagaaagttgatgatggactgcattttaacactaaagtagtgctggtgaacgatgatggtgaagacagtgaaacagtttgaagggttagcccgaattagagccgctaaactttgttctcaattgtaacttcctgccccatggaccactgagctcaggtggcagatagaatccagtagctgactccagtggatgggtcctccaaggtgaagtccatgtgaaatgtatgttgttgaaattgttgtaacttgctctcctgtcttcagggaaagatgtctgccaagctatagaccatggctgtgaacacatttgtgtgaacagtgacgactcatacacgtgcgagtgcttggagggattccggctcgctgaggatgggaaacgctgccgaagtaagtagcctcgaggtggagaagaacttttccctctgtggactcagacagttagagaagttcatttaatccttaaagtcctcctttattaccactgtcacaagtgtcagttcctgccttgggtgctctgaaagtgtttagctagagatcagttcagtagccccttgctttttcgggaatttctcagtcaaggcctgagttttgggttctttgcttctcttcattttctgccagccatcagccctttccacagtagctgtgtgggtgcccggaaactcgcacagtgctagtcactggactgaattagaacctctgccagcaatcactacaaggactgaaggttaattacagagctttctcctcttggcagaccgtaaaagtaagggcaaagggtgaaagggtgtattcgtccattttcacactgccgataaagacatacccgagactgggcaatttacaaaagaaagaggtttgatggactcacagttccacttggctggagaggcctcaaaatcatggcagaaggtgacgggcacatctcacatggtggcagacaagagaagagaacttgtgcagggaaaccccctttataaaaccatcagatcttgtggagacttattcacaatcagaatagcacaggaaagccccgtccccatgattcaattacctcccaccaggtgcctcccacaacacgtgggaattgtgggaactacaattcaagatgacatttgggtgggacacagccaaaccatatcagagggatttcctgtgggttttttctattatttttatcatttgcttctataggtcacccagaacaggctctgagagtttcgttagaaggtgtattccccagagttctccagagaaacagaccttctctatgtatatcttcatcttctattatatataaatataatagaagacatatatataatatatatatgtcttctatggtctgttctatcttctatttatatatatcatagaagatatatatatatatacacacacatatatatgtgtgtgatgtatatatgtatactatggtctgtttctatcttctattaatatatcatctccacaggaaaaatggacatacacacacacacacacaaacacacatatattgtgagggaggaaaagattggttgattttaagggattggctcacacaattgtcaggggctggcaagttctaaatctgtagggcagcctggagacccaggcaagagctgatgctgcagcccaagtctgaaggcagtctggatgcagaattcccttttcctctgaggacctcagtctttttctctttaggccttcaagtgattggatgaggcccatctacattatagagggtgatctgatctgcttcactcaaagtctactgattaaatgttaattgcatctaaaaattagctcacagcatcatttagactggtgtttgaccaaacaactgggcactatagcctagccaaagtgacacatcaaattaaccttcacagtacccaaaggaacagagggatgtcatacgagctcagtgaggtgggcattaggagagtacagagcagggatttttccccaccatgagattctgagctggtaattccctattttggggggaggggtggttgacaaagtctacttgcttttgtgacactttgccccagtgggcaaaataaccctttttcaattaagtcaaaataagttcagttgctttgaggttgatttttgggaatttcctcacagactcctttgagataactggggatattccacaagccaacaaggctgggttggagggatctcaatacctcgcttcttcctccaggaagagggactcctacctttagcaagaagttctgtgtgaatgactgacacctaggatgcctgtggtaccctggcctaactctgcagggattcccctcacaactgcaggtccagcttcacactgcagtggccctcttgtggagattttgtctataattctgcccattgtgcctgtctgcactgcttgttcatgcttttctttttgtttgtttttgttttgagacagggtctcactctgtcacccaggctggagtgcagtggcactatcttagctcactgtaatctccacctcctgggctcaagcgatcttcccacctcagcctcctgagtagctgggactacaagcgtgcaccaccacacccggttaatttttgtattttttgtagagacatggtttcaccatgttgcccaggctggtcttgaacacctgagctcaagaaatctgcctgcctcggcctcccaaagtgttgggattacaggtgtgaaccaccatgcccagccctcatgcttttctttctgcaaacatctgcacactcacacacacactgtttattcattcaacacatttattgctcagtaaattgaacacaaggtacaacttctacctctggaatttgatcctaaatcagatttcaccattcctgcttcctagagggatgtgttctcactgattccaattttgtgtgaagcctctccttttaaggggtaatgacaggaaagagccataggctctcatgctatggaggagcactcgggagacagctgtgtcatcaacctgccagatgaccgtgggcagcagtgaagctctctgagtatctaattcttcattgataccttgagaataattatccctgtcttccttgtctcacagggtgttgtgagggttaaagggctgtaagtacttcgaagagtttaaattacctcacacatgagaaatgttcattagacaatctgaactggagtgtttgggatgtctgtggcaaaagaaattagaagctaaagcacatctaataataggatagtaagtcaaggacacctaatcacccatcgtaccattcagactcatgggagctagagctttctgagaggagctttttccccatcctgagtatgagactgcaaaagacattatgaaggaggtttgaagagaggtgtgttttctttaaaagagattacttccacaatctctactcacatgactattcaattcacctcatttctacactgatgggattgttcaactccctacattttcctcagggaaggatgtctgcaaatcaacccaccatggctgcgaacacatttgtgttaataatgggaattcctacatctgcaaatgctcagagggatttgttctagctgaggacggaagacggtgcaagagtaagtgatctgaacttggctctctgctttaattttgttttggagcaactgctttttggagtattttcaggcaacaaatccctcacctctgcttctcccataaatataaatgcatatgcacaaatacagaatggggaagagagggcttaactgcagcacctgtgaaaacactttcggttttaattgacagtaaattcattatcagccaagaggctagggtgatcgtaggctgaacagcaatgtctgcatgagggaggtggagagagctgtgctctgctctgtgctggagaattacattcagttctgggcatggtactttaggaaaaaagagatggatcaacagtttaaacataaaaaaaaaaaaaacacaaaagagcaaaaggagtcttgagagaattattttttaatctgagagtagagaagatctttctaaacatgacatgaaatttaaaagccataaaagaaaaacaaaggaaaatatctagtaagagagtaaagctgtgatacctttttttaacctattagttaacctattagttaccagagatcaaaaagtttgattccttatgttggcaaaggtatattgtagtagggaattataaatggatcagtgagtgtctgaattggtataacctttcagagggcaatttggcaatgttatcaatccagttctagaagtttatcttacagatacgtgcatgtttacaaagccatgtatacaaggatattttatacagcactatttgtagcagcaaaaaactggaaacaagctaaatgatcacccatgagcctggctgaataaattaaggcacatctatgtaataaaacatgatgcagctgttaaaacaacaagcagctctggatgtatccccaagatattttaagagaaaaaagcatggtgctgaatgttttttatagtatgttaccatcgatatattttgtaaaacactctaacatacagtctctctttctctatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacacacatacacacaccctttttctaatatttaagttttgttccaaatgcatgtattattttttagaaaaaaataagataaacacgatttagaaagaattaagcagcatgatcttgtgaggaagttcagtattatgttaagcagaaaaaaattaggaaactggggatctttgtagaaaaaaattttgaggtaccaaataccaatgtgactgtcatctcactcatgatttgtatgatacccccaccccaccccaccctaccctggaaagaaaggacacttggagaagctacagcttagcacgaggacaaagaagctttctaccagggaagctgcatgcctaattagttcagagcataagcttcagctcagacagatctggatttgaaccctgattcatactacccgtgtgaccttggtcaaattatttaatctcggccgggcgctatggctaacgcctgtaatcccagcactttgggaggccaagacgggcagatcacctgagatcaggagttcgagaccagcctggccaacatgacaaaactctgtctctactaaaaatataaaaattagccaggcgtggtggcacgcatctataatcccagctactcaagaggctgaggcaggagaattgcttgaacctgggaggcggaggttgcagtgagctgagattgctccactgctctctagcctgggcaacagaggaagactccgtctcaaaataaataaataaataaaataaataaaatacaaaaattagccgggtgtggtggcatgcacctataatcccagctacttgagaggctgaggccaggagatggaagttgcagtgggccgagatcgtgccactgcactccagccagggtgacagagcaaggctctgtctcaaaaaaacaaataaacaaacaaaaattatataaactctttgagtcccagtttccccatctataaaataaggataataactcacaaagccatcacaaggaatacattagatcgtgtatccaaaggtgctgaacagccgggtgttgtggctcacacctgtaatcccagcaccttgggaagctgtggtgggaggattgcttgagctcaggagttcaagaccagcctgggcaacatggtgaaaccctgtctctacaaaaattagaaaaattagctggttgtggtggtacgtggctgtggtcccagctactagggaggctgaggtgggaggatcacctgagtgcaggaggttgaggctacagtgagttgtgattgtgccacttcactctagcctgggtgacacagcaagaccttgtctcaaaaaaaatttttttaataaaaaataaataaaggtgttgagcccagtgctcacacacactaagtgctcaaaaaatgatcactattacgattcacaatagtaaagacatggaatcaacccaaaatgcccatcaatgatagactggataaagaaaatgtgatacatatacaccatggaatactatgcggccataaaaagaaatgaggtcatgtcctttgcagggacatggatggaactggaagccattatcctcagcaaactaacacagaaacagaaaaccaaacactgcatgttctcagttataagtgggagctgaacaatgagaacacatggacacagggaggggaacaacacacaccggggcctgttgggggtagtcgggagtgagaacatcaagataaaaagctaatgcatgtggggcttaatacctaagtgatgggctgataggtgcggcaaaccaccatggcacacatttgcctatgtaacaaacctgcacgtcctgcagatgtatcctagagcttaaaataaaattaaatttaaaaaacaacagacaggccaggtgtggtggctcatgcctttaatcccggcaccttgagaggccgaagcgggcggatcacctgaggtcaggagttcaagaccagcctggccaacatggagaaaccctgtctctactaaaaatacaaaaagtgtccaggtatggtagcgtgtgcctgtggctctagctacttgggaggctgagacaggagaatcacttgaacccaggaggtggaggcagcagtgagccaagatcgcaccactgcactccagcctgggcgagagagcgagatgccatctcaaacaacaacaacaacaacaacaaacaaacaaaatgatcactattgtaatcatcaacagcagaggtgtccaaagatggggctttcgtggtaaggtgacaaattcctcatcaggagaggcattgaggcccaggccgaatggtcactgggtgaggatgctgtaaagaggatgtaagcaacagcagggctggagtagatgatctttaaagggcttatccatgcctgaagttctagaactttctgaaaattacgttctgaaagcaagtcacagctccattccagtcttatcaacttaactaccaaaaagaaaatgcccaagaaaagtgggaattaacctctggcaaaaaaatagtctaataagtggggctgtccttcctgtgtctgaaagcaaatacctgggccctgctctccctgatgcttttccactctactttgttttgtgtttcctggagaagccttctggatgccattctatgtgtgggggttgcaagtgctagttttgttctgtaagaaaaatgtgtacagaaaggaggagaaaacagactcactgctggaaaattatttcagtatttttgaaatctgctgaagagccacatgcatgctgcctgagtctttttttggttcactcaggaacagactatgaatgtaaatgaagctttgagttggccttttcctctttcactaataaaagatcgataggttgagtgatgaggaaaagcacttaatggagaaacagaagaacccaatcccccaacatgtgcgcactcacgcacacacacacacacacaccacacacactatgacgttaagcattttatactggccaggcatagaaatggttttgcatgtgtgtgtctctacatgcttatattgttgtgcctcacttttaaagattagacagctgcttgatatataaaacagaatgtttatcacagattgtggattgtttgaaatgagatcatctggcccagcacggtggctcacgcctgtaatcccaacattttggaggccgaggtgggtggatcacaaggtcaggagttcgaaatcagcttggccaagatggtgaaaccccgtctctactaaaaatacaaaaattagccaggcatggtggcatgtgcctgtaatcccagctacttgggaggctgaggcaggagaatcgcttgaacctgggaggcagaagttgcagtaagccaagatcgcgccattgtactccagcctgggcgacacagcaagactctgtctcaaaaaagaagaagaaatgagataatccattttggatctgtccatttttcttttgcagtcctaaataacaaaaagcctctccacacccaaattgcttaacataaagcttttatttctgcttactatcgaccatctattaatagttgcctgagaccaggtacagtggctcatgcctgtaatcccagcactttggaaggccaaggcaggtgaatcgcctgaggtcaggagttcaagaccagcctagccaacatggcaaaaccccgtctctactaaaaatacaaaaaactagccaggcatggtagcgtgtgcctgtaatcccggctacttgggaggctgaggcaggagaatcacttgaacccaggaagtggaggttgcagtgagccaagatcacaccattgcacttcagcctgggtaacagagcaagactcaatctcaaaaaaaaaaaaaaaaaatgcctgaaaagcttccatgtaaagaatttatggtgataactttttttttaattttgttttttttttttttacggagagatgcagggtcttgctctgtcacccagactgaagtgcagcggcacaatcatagcttactgcaacctgtaattcttgggctccggtaatctttctgcctcagcctcccaagtagctagggctacaggcatgcactaccatgcccagctaatttttctttttttaagaaagacagtcactctgttacccagggtgttcttgaactcctgtgctcaagccatcctcctgcctcagcctcccaatgcactggggattataggcgtgagccactgcactaaggctaattattttgtaagctttaataggtcagtagggtacttacaggtgtgctacccaatgaacatcacctcattcacttagtctgtcaccacacatttactgaacactttttttgtgccaagtattggggggtggggcacaaaaatgaatgaaacacagtccctgctgaggaggaactcacagactggaggaggaaacacatcattaaataattattgtacaatgtggaacactatatagagtacattagattgtatgcagcttggtgttagggattgtgtcttggtcactattgcaatcctgctatgcccatggccttgtacaaagcaggtcctcaataaatttttggttgaataaattagtagtgtttggggtatatagaaagcaatacaagctgagttactaggaaggctccccagcagaggtgatggctgagctgaagaaatctctttctccattgactgtcagaatgccagcactagggtgatgtcaccctcctaaagttctaggagtcttttgggtattgttagacccttcagtgtactctacacccagctcctcccagacctgtcagtgttccagggtacaatgtagacttggtttcctagacaattgtatatctgccgttttgcttgtgaaaaatactatttttatcaatatgacaagccaaccataaaagtatacgtgaaaattattgttgcttgtggccctcccaacaactcatctatcctgtgtattatctaaagaacaaaactggttccccaaagtggttatgcctccaattgaagcatcattttattctactcttgtgcataaatgattttttattcaactatgtcaactttccttctgttcatatagaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtaatatggggtggaggtgcggtttacaccactcaaggttcaggtttcttaaactcactcagtggtctcagctggccataagggtaagcttctttgagtgtacagaaaggcctcctggcaactgccattatacatctttactaccctgccacctagaagccttaacaggaccccacaggagttaaataaagtgctcaggaaggagtctggctactagaagggtaggctaagctgaccacaggcgggtatcctctcactgtgatttactagccagtgtgtgatctccagtgtaagaatcgcctagatatacacaatagttccgaaacactggtcggcttgctctagaatcaactgaagactttgttaaattgtttctgatgggaacttttactgtgtatatttattcttgtattttttaaccaatacttcaagcgagcattctgaaaatgcaatagcccctagggtggataatactcttgtgtttccaggaggcaaagttagcttttccgaaaatcaaatgatggaacagattatgactctaagctcttgttgctcagtaaagcccagcctcttctctgaggttttcctgacctgagggttacttcagttgtacagatgtgaagcgtgctcgaggagtatgacccttggctaaaggaaacccaaaaggtaggataattggtagagacagtttatggtgaagtttctagattccttgagggagataagaaaacttgaggttgtgaactagtttgcttgaaaactgctttttttttttgagatggaggcttgctctgtcaccgaggctggagtgcagtggcgcgatgtcagctcactgcaagctccgcctcccaggttcacgctattctcctgcctcggcctcctgagtattgggtactacaggcgcccgccaccacgcccagctaatttttttgtatttttagtggagatggggtttcaccgtgttagccaggatggtctcgatctcctgacctcatgatccacccacctcagcctcccaaagtgctaggattataggcgtgagccactgtgcccagccgaaaactgccttcttaaagtacttgttgaggacacactgctttagcaagtcctgtaagaggaaataaggtatgcacagatcaaggcctcatctaagactttatggacccagtgcctagatcaggcctggcacacagtagatgtgtgacaactacttgctgagtgaatgaagaaagaagtgagagtactggcagtcccattggtgaactccattcctcctcacagaaaggctggttcacatcgacattcactcgctgtctttgtgaaggaggtcattttattgatactgcgtaccttcctctttttctagcccaagagtggtagccacaaagtgtcctgccctgaatcatctggatagattgtaaaactggctgttcacactagcctagattgctagagctcatgtcaaactcataggccccctagtctgcattcttaaaaagaattaattaggggaagcatcttagtctccagagacagtggttagccctttcatctcactgagactaatctaccttaccctttgctccactcaaatgtctctacacatcacacaaagacaggtggtagcagaaactgatgtttacttgattcttgaatcaacaagatttatatgaggtgacatcctcttatgaatttaactagtcttatgtatagcaaacagaatcttaaaatagtagttatcctttttaggaagtcgtgcataaaatcactgggctcccggacaaatatgctgaacttggttagtgaccttacacagactcagaacaaggcatcacaactcttgccccttgtcttgaagagccatttttaagtacatttttaagaatctagtctaataaattagctagaataagttatcagtgctgaaaaatgtttggactccagcagaacatattcttattgtgttttactttcaaatgaagagtatataggggaagggagtctaaggattgagtaagaaaagcttttaaagcaaacgcatatccctgttgaaatttaaggctgatcttgggtttgttctttttcctgactttaggggtttccaatggtctgtagattatccttttcagcttagcacttcctcacaaagttgtgtcatcttagcagaagtgggcaaaaagcagcttcacttggcctcaggtcacttacgtttcctaccctgtagctttgagtagaaactaggttattaggtcataaattgacttgattcttagaattcttccagaagagattcccatttagcaagccataaaatagggctcatttctatgaatccagaaggctaattcagggggaagttgcagatttgttaaatggcccagcccagggctgagcaacaggttagtagtttagttccccagcgtctcccagatgcctcacttctctcttggatccctcccttttgttcataggaccaaaataaaaatggtagaaaaataaaaaggaaggttggcatggactcttcaaatcataccacttaacatctaactggctttgggtgcagtacacacaacttccagcccctgggaacacaactctaactaacttgctcttaatttttcctgcaccctaggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaaggtactatagcttacgccgaagaccttagcaaacaaggcagcatgaactcctttttttttgttttttgagatggagtctcactctgtcatccaggctggagtgcagtggcacaatctcagctcactacaacctccgcctcctgggttcaagtgattctcatgcttcagcctcccgagaagctgggattacaggcacccaccaccacacccagctaatttttgtatttttagtagagatgaggtttcaccatgttggccaggctggtctcgaactcctgacctcaagtgatccagccaccacagcctcccaaagtgctgggattacaggcgtgagccaccgtgtccggccagcatgaacctttagtgataaattctcaaccaaaaaaaagtgtctccttcatgggcagggccagcaatgcctagaaacagtacaaaaagaagggctgggcaccatggttcccacctgtaacccaaccattttgggaggctgcggtgggaggattgctcgagcccaggagttcgagaccagtttaggcaacaaagtgaaaccctgtctctgaaaaaaaatttaacaattagctaggcatgatggcacacacctgtagtctcagctacttgggagactgagcggggaggatcgtttgagccctggaggtcacggcttcagtgagccatgattgcgccactgcactccaacctgggtgacaaagcaagaccctgtctcaaaaaaagaaaaaaaaaaggtgggggaaacaggggaggtgggaaagaaaaaagtaatagctaccattgtttgcgcccttgctctgtgccaagcagtataataagtgttttgacacaccagcatgcttcatcctcacaaacaccctagagaaatgatcatttaactaaaaatcaatcattatataaatcaggagagctgaagtgcaatttcagaatatacctataattggagtggaaaggggcgtacctagttcttccaagcccactgttaaaattaatgcctttctgcatggactacttgtttacagaatatcagactgccctttagacttcagattttgttatgcatgcttttctccagtttactaactgtgccagatatgcttacagatagcagttctgcctatttttccttgtactcatgtccccggctcaccagttagatcccagtctaagtgctgtgtcttacccctctagggaaagaactcttgagatgaggggtaacagggagggaaggcctttcagatttctgagtagagaatgttttgcctcttgattgtttcatgcaagttaaaatgcctcaagtggagctgctgccactgcaactaaaatccctcaacaacttcaccttttttttctgccctactttctagacatgacatttttgggagcattcttaagatgtacttagggggtccaagcttctcttacgagagagaattgccctagagtggtcataagtatcatggtaaccaactgcttttttgaatctttggtgttaccaaacaaaactaaaaaaccttaggttatggcaggtaggtaaggaggtggtctgggaccagcttcctgaagaacacacacatgcctgtggacaaccatcacttcttttggtcatctttttctgctcagctctagaagactccgatggaagacaggactctccagcaggggaactgccaaaaacggtccaacagccaacaggtacagtttttaaggcagtgtttttagaaattttggtggagggaaccatggtttccctccagataaaagctgtaaagaagtgaatgtaagtatgttcaaattatgataatgaaggccttttttccctcaaaaagatagttaacatttactcttacattaagccatatttggtaactagcatcgtttcaggtgacagtgtttttttgtttttgtttttgttgttgttgtttttttgagacagtttcattctgttgcccaggctggagtgcagtggtacgatttcagctcactgcaacctccacctcctgggctcaagtgattctcctgccccagcctcccgagtagctggaattacaggcacccaccaccatgcccagctaatttttgtatttttagtagagacggggttttaccatgttggccaggctggtcttgaactcctgacctcaagcgatccacccaccttggcctcccaaagtgctgggattacagacatgagccactgtgcccggctgtttttgtttttttttttgttgttgttgttttttgtttttttaataaagatgtttactccactgaagataacagtctttttgcttcagtatgtcccaaagtaaagctctgtaccaagtgctaggaataccaagtaccttactctgctgatggctgttttataaccaaaagcgttaagcaggtttgattgcagttttctttctctttacagaatctgagccagtcaccataaatatccaagacctactttcctgttctaattttgcagtgcaacacagatatctgtttgaagaagacaatcttttacggtctacacaaaagctttcccattcaacaaaaccttcaggtaattccaagtaaaatattactataagataacttgatctcagcctttcggcttgccaacaaccttagctttaaggaggaaaggaaagaaggaagtaggaaatagtatagaggaaaagagaagaaagaatttaagtaaaatgagaactaaaacataaactaaaagaaactcaagtagtgttcctcagtaatccacagtaagggccacttccagtgttggaagcatatacagtgctttcctggtatttactggatctggctgcatggaaaaagtggaacatgtctttcattatggtttcctccatatgctgattcattcctattattatgcgtctgggaagtctggtggattctagaggtgaacactttccatctgctttctcaggaagccctttggaagaaaaacacgatcaatgcaaatgtgaaaaccttataatgttccagaaccttgcaaacgaagaagtaagaaaattaacacagcgctatatccttttcttgcattatgcttctgtatggaatgcaaagaatattatcaaaacttcacacactctatgtaggttttatcaactgaagtaaatcccacgaagtcacaaagaacagtgatctccaggaaaggctttttgctttaaaaagcagcctcacaggtgtttgagaggcaagggcaagccaagcttattagcagcagtcaagcacttagttgccatcggctgttctcgggggcttagcaataaggcctgtcagtcagcatacaaagtaaggaaaaaagagacactggcctaactccgtctctgctaggaaggtgtgtaggacatgatgaggtctgaagtgcatcaaaggtacggtaagtatagacaaagaatgttgtagaatgaagaggtttcaaactcagtactccaaacttttcctttagccccaaggaacaccacagccacatatagattcagtgtgtttagtttctggaggacaggagtggttttttcttttttttcccttggcagcagagatcttctctatcggcactctaaaaaatgaaacactccaccaagggaacagcaggatccaatgattcatttaaacaatattaaataaaaggaatgcttggggataataaagaaaagaggattcggtgcttttacatattgaacaccctgccaagtgctctaaacttaaaattacagtaagcgtactaaagctggctgatatctcaagtgcatcaactagtctatagggaaatggcttaattctgaactatctctgtgccaatgggcttatgtaataaggaacaacagcatagggcaattccatttctgaaagctggaaatacgctcccttaagtaaaatgaaataatctttctgagtggttaattgacgaatatgggctctcattctgccctcaagagggcagatagagggtactgaggagcttacagggaagaccaatacctattctaatgcccttttcttctcgcttgcctgtcccaccccaaagttctactcacaagagactaaagaagacatatttttacataggtcagaattcctcaaaaccgtggccttatgtagcatcatggtgaaaactccgtatcgccctttgcttctgacttcatatcttactttccaaggccgaattctttcattgtcttctcttcaccagattcccaacattatcaattctggctcctagaagtgtgctatggcaaactaatttgcaagcattaagggtggaagtggaatcacaattaaaaaaaaaaaaaaaaagactgcagctgggtgctgtggctcacacctgtaatcctagcactttgggaggccgaggtggccttgcttgagcttaggagttcgagatcagcctgggcaacatactgaggccttgtctcttaaaaaataataaataaaataaggccgggcacggtggctcacgtctgtaatcccagcactttgggaggccgaggcaggcagatcacctgaggtggggagttcgagaccagcctggccaacatggagaaaccccacctctactaaaaatacaaaattagctgggcgtggtggcgcatgcctgtaatcccagctactcgggaggctgaggcaggagaatcgcttgaacccaggaggcggaggttgcagtgagccaagatcgcgccattgcactccaacctgggcaacaagagcgaaactctgtctcaaaaaaagagaaaaaaaacaaaaataaataaaattaaaattaaaaagacaaattcacactgagccatctggctttgctgatgttaaaaaaaaaaaaacccaaaatatttgtcttgacagaatatgttaaatgagttctacaaatttacaagtcagggttttaacatacttgacagaaatgggaaaaaaaaccaaaaccttttagatttcagaagccaaaattttacgtggataaatcaagttatatttaaatgtaaataaaaatagacaattcttcatcttccttaatttgagatttactagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtattggactttaccttgatatatgtatatggatgtatgcataaaatcataggacatatgtacttgtggaacaagttggattttttatacaatattaaaattcaccacttcagagaatggtattcagtgcaaaaattcttagtttaactttaaatggaagatatgtatgtatgagaaatggccaacatgcctatgaaaaaaatgctgaatctcatcagtaatcaggaaaatgcaggttaaaacaataccatttttcacccatcagcttagcaaaaatgagtatattttttaacaagtgttggtaaggatgtggaaatgtgaggttcttgtagtaagaatgcaaatggcactctttgtagagtaagtctgttgacatctcataaaactgaaaatgcacacaaccctgtaaatctagcaactgcactcagttgatttcagcccatacatacaaagagacctgcataagaatgttactaggctttgtaaaagcaaaaaataaggaacaacttaaacatcatcagaaggggaactgataaactctggtgtaatccataccacagaaatacaacaccgcatgtacaggaatgtgctacatctatacaaataaatggtcaaactcaaaacaaagatgactttaaaaagaatgacaaaatgtttagcataccattcctgaaaattaaaaaaacaaaataaaaaatgtcacggtgaaaccccgtctctactaaaaatacaaaaaattagccgggtgtggtagtgggtgcctgtagtcccagttactcaggaggttgaggcaggagaatggcatgaacccgggaggcggagcttgcagtgagccaagatcgggccactgcactccagcctggggacagagcgagactccgtctcaaaaaaaaaaatgaaaagaaaaacctagatgggtaccccactacacaccgaggctgtttgttatataccccattgctcctagactacaaacctgtacatcatgttactgaatacggtagacaactgtaaaacaatggtaagtgttgtatctaaacacagaaaaggaatttttcagccttattataatcttatgggatcactgttgtatatgcagtccatcactgaccaaacgtcattctgaggtgcatgactatcagttctggcattgctgccaaggtggctcaattctactttactctctgttgtgttcaggctccacctagcggcacaaaagtctgcctcctcctttttagcaattaaatacctttcaacctaacattttatctctctgccatgagactatgtgtgtgtgtatatatatatatatatattttagctattaaacacatttctcctgggggaagaaaaacctcatggcaaaaaaaaaaagcctccaaccaatgcattaaaatctacagattaatccaagatatttaacttgaagattgtctaaaatattatttctctattttgcttgtttttgccacttgtaaatctcagagttctgcattccattttcatcacttattggatttaatctgcaaaataaggctaataataatattgagtggtcagaggattaaatgagttaacatatacactattttgtaaggtacctaaaacttttattatttattttttgagatggagtctcgctctttcacccaggctagagtgcagtggcatgaccttggctcactgcaacctccgcctcctgggttcaagcaattctcctgcctcagcctccgactagctgggattacaggcaactgccaccatgcctggctaacttttgcatttttagtagaggaggggcttcaccatgtggccaggctggtcttgaactcctgacctcaggtgatcagtcagcctcagcctcccaaagggctggcgtgagccaacacacccgaccatattatttatttttagagacagggtcttgctctgtcatccaggctagagtgcagtggcaccacgatagctcactgtaacctcaacctcttgggttcaagcaatcctcctgcctcagccacctgagtagctggcaccataggcctgtgccaccacaatgggctaatgtttttaactttttttgtagagatggggtctcattacgttgcccaggctggtc

SEQ ID NO: 17391 - DNA, 152583 bp, Human; identical to SEQ ID NO: 17390
  misc_feature (1)...(152583): n = A,T,C or G

SEQ ID NO: 17392 - DNA, 254964 bp, Human; identical to SEQ ID NO: 12583
  misc_feature (1)...(254964): n = A,T,C or G

SEQ ID NO: 17393 - DNA, 198637 bp, Human
cactggtaactctggcttttgggttcaggattagacagagtggttaaactaaaatatttatcgtaagtataaatttgttccacaaacataacatttcaaaggtagctttgtttcctctttccttgcactgccagctattaactttcggttcattagtcacgattttcagaatccacttggctgccaccttcctgcagccagaccatcttggatcagagggtgggccagccattcccacgtcacacctgccacgggatcgattttttcccccattgaccacagtcactttttgtcaattaattaatgttattcacctggtacccatcttgtgaatggtaggtcactacggagcggattactacttcatatcccatcaatgacagagccatcattacgaaaaccttttctgacaaccactgaagagaaaccatctccacaccgtgcattttgcatcacttccgttgcttctttacctgatttatcacaaagactatgtaccacacatcttctttattaatgcattgacaatcagtgaagacaatgaaaacccaccacttttgtccgtgaactgagaaagaaaatggcaatgtcatatggcattaatgatgcatgagatctatgggtgtagtgtcacgtctaggcgtgtagtaatccagtcttcggccttactccagggagaaagattcagctttgttactttccagtcactctctcccgtaacacagcaccttggcacagaaagcagagcgacaaaacccagaatgaggacagttaaaattcaactcaagctacagccatcccaacggtcctccccagctcccgcggaatatttaccaagaccgtttaaagcacttaattaattcacttcagcttcgctggagaggtctcagggttcccgagactccattacataatatctttcacaaagtctattcccagctcgaatggaagatggattctcatccagtgtgcggaggttccatgcctttgcttccctttcccggagttcgatccggcgataccctcccgaggctgcagccatcgccccggccccgagcttctggggtacccgccactcttcgaactccaatctggccccgaaggtgcagccgcctcgccctcctggctcccaggccggccgctgcggccacggtgccagcgagcgcccgggacaccgcgactctcgctgctcgctgggtgcgccccaagcccatccgcagcgcacccgcggcgccggggccagagccgcagctcggtggcacggccggctcggtgcgccgggctcggggaggaggagatcgggaagaggtggaggcgtgtgagggagggaggaagggcccggccgcccgagagggggagggggaggcggagggggccggccgggccggggagggggggcagccaatgagcggcgcgcggcgcgtgggggtggggggaaggtctgggggaggaggtaggatgggggagggcgcagcccgagcggctgaggctccagccataaacaagcgcccggaggagcggcgcaggagtgaggcgagcggggcgcgcggagcggacgccgcggatcttgtgctgcgccaccgcgcccactcggcagctcgggaggcggggaccggcccggaggctgcgccgctgcggggccggccgactcggaggaggagagggaggaggcgccgccggcccgggctggagccgagcgcagcagccaccgccgccgccgcgccagaagtttgggttgaaccggagctgccgggaggaaacttttttcttttttccccctccctcccgggaggaggaggaggaggaggaggggaagctgccgccggcgccaaggctcgtgggctcggggtcggcgcggcccgcagaaggggcgggggcctcgccccgcgaggggaggcgcgccccgggggccccgagaggggcggtgaggaccgcgggctgctggtgcggcggcggcggcgcgtgtgccccgcgcaggggagggcgcccgccccgctcccggcccggctgcgaggaggaggcggcggcggcgcaggaggatgtacttggtggcgggggacagggggttggccggctgcgggcacctcctggtctcgctgctggggctgctgctgctgctggcgcgctccggcacccgggcgctggtctgcctgccctgtgacgagtccaagtgcgaggagcccaggaactgcccggggagcatcgtgcagggcgtctgcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaaggtacggccgcccgctgcgggccccctcccacctggcctgcgccgccccctcggcgctggttgtgccgaacaaagtttgggcgagactttctggaggaaagagggctctgcgggaagaggggcggccgccgcccccaggagagtgcccccgcggccctgcgttccctctccttgttccccccgacgcttaggcagtcgcgggcgaggttgggtatggtgggtgggggcgagcgagtggaggatcgcccctgtccccgcgcagacgcgcacacgtgtggccgttcctgctgggactgggtggcccggccttgctccccgaggtgggggcgccgcgggcggggggcactgcagattctgccgcgcgcgagcccctcggggagcccggccctaccgccctccccgcactggcgcagtgtggcaccgtgagccgcacgccggccgcgaaagtcctttttctgttggcggaggagacgtgtctccagctcgcactccccgagtgactcttattattttttccttgagctcttccttcaccccttcctcctcctccgcagataaatcagtttcagccgcggaatatgtcagcccaggggaagttacacacggtggttactcatttatttgcccattgtaaacggtcaaaggctttctctcctgaaaggaaaggggggtgggggttgcacctgggagtaaaaagttgttgctattagtggctgctttttaatatcagatacccgcgtgtttcctgtcgtgttgccggttcctcctttttgtttgtttgacagcggggattgttctgctggcttctccagcacgcattgtgctccgcggtgtcgagattgacggtgggagaaacagattagattagtggagtctttctcgttggggagccaatgttagtgcgtgttggctttaatccctgcccgcttgcgtcggccttcagggtgcctggtctggtttggggtctagagcgaggcagtgagttattttgatgtggctaacgggggcacggttcggtaagcatcagttaaaagtgggatccctgctctggctgacgttgggctgatgatgctgttccgggggcatcctggcgagtgagcagagcgcacgcagcagcctcgtttctggggaggcggcgaggagggacaggcgccctctgcccggcgtgccttcctcactactcacagccagcaccgtccagggaacggtttattccgaagcatctttgtgtgtgtttgtttagtatgctgggatactgaaaaaggaggtgacagccttaaggataacaatggacctattaaaaggcttcagtgctgtgattctctctaaatacgcacagacacacacataggtacttatttatacctgaatagtttggggtttggacagttcaggaaaataggggagggttttctggtttggaagctagtgggcagtgatgagtgaagggaactcttctcagaggggagggacttgctcttgctttgctgcacacgtaagacattgggttagaagagatcatttgcctgaagtacaaaaaagcctctcacctggtattgtccccttttataacttgtttttatgccttacctcaagaaaaatggccatgagattaacttctgataccattgtatgtgttttgactttgggaattctgaatgacctagactaaaagatgcatctttgaaccctgccgcttcaagtgtataacttaatccggcctctcgtaaatctgaaaagaacaggcgacatgaaacacagttaaatgcagtggaaactgctgtgttccaagaaggacttttgcaggttctgaagattctaacccttgttttgtttcttcttagtctgtttctggtgaaggaagtgctcagggaacatttacagtaatcgagtgttgtggcagcaatatcccatgtcacagtatagagttattttggcagtttcgtgagcctttcattcctctgaaatgatgtgatccctcatagcttccttttttctggcaacaccctgtgtgcttggtattcgctttgaaatgcttggaagggtttgttgacatgattatatctcaattagtttctctagaaacactttttattttacaggcctgttttcaactatcaatattgtgtgtccagggcacttcctttaaaaaaaaaaatactgaaaacagcagtcaacttgcattctaaatctgtgaaaccaaagtaaggacagtgttacctggcatgatataatggttggatttagacagatattttcaatcgtgtgtttacaatttcagtgttttcacttaacgacaagatttatggaaagcatgggataagtgataccccaaccgccccccgcctgccatttttaaaaaaagaattagaggagccttcagatgtcagcagttacctagaaggtattgattatctcttgtttttctgtgagtttacaagaaatttcggaatggccagtgtttccctcagtttccatttttattcagaaattcacgtggtgaagcatggttatcataactaacatgaataggaatcaatatattttattcatgttgaagtctcttttgctgcaatttttgcactaaaatgacccctactggttgtatctgttaatgaaaactcttgaaaacttatttaattggctacgttgtaaaaacatattgcatgttatagaaatattatcatgactaatctccctgctttcgatgacataatttaaatacaaattatattctctgtttgccaacttgcagtaatttttagcagtgtttactctcatactggctttgtaggggaaaaaaattacgtttttaactgcagttcacaaaatgagttagataaatcatgggcagaaatgggcccctttcagcttgtggctcacagccttaggtttttaaggcatgctggtctagttggctctcagtaaaagtacattgaacaaacggaagaacaatcctatccatagaaagaatgctgaaggaaaaaaaatattttctgaatgattaaataatgtgatgagttgtgtcctgtgcaccatgtgagatgtgcacttggatttcttttccgcattgtttagattgttattaaataaattctaattgaattattccttttgtggtgggggctgggggtggtaagtgcatttgaaaaaatgagcatggagcctgatacctaaaagtttttcctactttctgtcagtctagaaagtgctttttggaacttaggagagtgcaggtctttttcctctttccattcgtctgctaagacctcctgttgctctttgcagcatcctaactggcctgttttcttggccaggctgcctgcctccaggaaaatcacctagaagccagagaaacaagtgtggatcctgaacccctgagaaagaaatctggatggaagacatctttggaggatcgaaggcagagtttagaaaaattaatgaagtgagattttctagaaagaagattttgattggacagtgagaattatgttttgagctaaggggttgagagccatttcttctcccatgtgtcatagcgctttatgcttctataaggagtgaggcaaggtgagagagcatgaccagcctctctgggcagttaaagggcagatggtgacttgctttggcagtttgtacagacagagtgatgaggaaccaggtggagactacttgagtcactgttccgaggactctgttgtattagattcaggtgatagctagatcagataagcaccaatttttttcttggtgactatttactcagtagcttcatattttggaacttagcattccatctttttcaccattgctatctaaaaacgacctctttcagaacgcaatcctccttttatttcccccaggaattttaactgttccttttacccatttttcattgggcagtgtgtaagagaactatgtatacatagtggggtacttacagcaaaaaacagaattttgtttcctgaaacttgccatgcaaagtttctttgcttatccctggaagacagtcagtgaagatgatggctgcttggaagaaaatgtatgcgggatctgctccagaaagcaggctgcaggaggccagataatgaacccaaacatttcattctgcacaagccgcatggaaactactctcaccactctgtagtagggcctgaagttaagagtccacgaattttaattcactcattaagtaacgggaggggggcaaaatatcagcttctatagttagaaaaattaagctcttggctttgttttggaataatgggtttcatttttcctctcagaagtccttaggtagacagggagcccttagatcccagagaggaacaagcagagggtctataacattatgttaacagggaatgggaagagaaaccaacgaagtaaacaaggaaataattagttcctcccaaaagtaaatattggcaaaacatggagagaccaactattcactgcacttaaataaatgacaggactcagtgaccttcactttgattgccaggcttatagaatcttccctgttattgaggagtcctgtcacataaaacacttggcaaagggcagatggattgtgtattatcagaatggcaaaaatagcaagtctggagatatttgttgccattcacacatattgtacactgaccaggaaaatctccaagcaagaggttggcagtagggttgtaagcagtcagattaatatatgaagaaaactgaacagtccttaatctgtgtaggcattacatccatttgtaggaggtatttggtgacttggtacaggtttctttgttttgtgtggtttgttgaagatgcaatgaccgggatgaatgagtgaacagctgggtgaggcaggggatgggcattatgaagttgggggatatattgtagatgaaacagatgaccctaaggaggtaatgagggggtggactaaagaatgacgaatgggagaagggaaaatattgaattcatcttagcacaagtatatcatcctttgaagaataatccaaaacacattccagacattaattgtgaaattcctgaaaaatgtgggtgtgcttaacatctcccaggctatggtgcaagcagagatgatagtgttgctttagcctgtaaatacaagagggtaggaggtggtaaaatgagtggaagggaaatacatttagtgaagcgggttcctgtaacactgtgttccgtatggcacgtttggtatcaggattttggagacaccccagtaaagctcatttaattatttgagggagaaacagtagactagccaagcatgcatgaataacacattgaaagctttccttctcagaggtctaattctgcaaagctgcattttcaaagatctgacttgcctttgcatggaaatcagtcattcattcattggtcttctatgctgtacaaggccttctgctggggtgagggggaaactagggagcccggggacctctccaacatattctttgctctgtacacttaatcaagataagaaataaagacagcaagactgcaaaaagtctattatgtagacttgcaaaaagtctacataataatataaattcaagccaagtagaagtgattttgcaagtctgtgtatgattaattggctagtgaaatatatggataaaattagttgtaggaattaaagcatctgaagtgatctcttgaggctctggtggcaaagcagaaaggggaatttgaatttgaactaggtttaaaagtgtgagtagtagccctttcttttggcaggggaggtgatcctacccattctccttagagcctgtgcaattggtctcagtgtttctcaacatctaagaatgaagctgcattcttaatgctttagtagctgtgcttcaaaacggcaagtttccttttgagagtgattttctctttgttctagcttgtttcactaggcggataagcgtgggcagtaaactgggaggtgtccctttatcagcacctctcagcttcacccaccctgctgcttgccctgggcagtagcctggtcacatctttgaaaacctctgtttagtcaagacttcctaagtcaagacagaggaatggttgaatatacctctatgtaagaataccctcaaggtaaacactaaactcttacgtgttttatcttgggcccacatgaaaaaagtaaatgtttttaaagaacctattttcctttgttagttgcaaagtgaacaggtatcaattccttacctccctcctccagtcccagttaattccccacgtgaaaatacctacatgttggtggaaaagtgtaatgttcaagaacttggggccggccgtggtgtctcatgcctgtaatcccagcactttgtggggctgaggcagatggatcgcctgaggtcaggagttcaagactagtctggccaacatggtgaaaccttgtctctactaagaatacaaaaaaattagccaggcttggtggcaggcccctgtaatcccagctactagggaggctgaggtgggagaattgcttgaacccaggaagcagaggctgcagtgagctgaaatcgcaccactgcactccagcctgggcgacaaagcaagaccctgtctcaaaaaaaaaaaaaaaaaaagaacttggtttctggggtcaaatctgcactctgcttctgtgtgtctcagttttctcatctgtgtagtcaggttaatgatagggttgctataaggactcagtgcatccctaatgagcagttaaaagaatgactggcacatggaacatgcttactaacaaggctactaaccagtataagtgaaacaattttacttgggctcagtctcttgttctcttaatccccatctacctcagtcattgatggtaagcagttaaggaggttgggctcttagaaagggagcaaattgttactgaattcagcagtcgtcgccgccccccccccccatgactatctttttataccttgtctaaatgatttctacaaagtttgtatattttgagtaatgttttaggtctgatattattttgcattgatttgtaggaattataaatgtaaccatttatctgtgaacaaataattaaaaatacttaatttggggaggaggcgggaacctagatgtgctataatcagcagtgtgcactttgcttcacattatcttctgggaggaaattttgctcctagctcctgagtgtgcacactgatgaccactgcaggatttggcctggcttgagcaaagaaacagctcgacgccatgggggctatggttccaacctgctgctgcagttggtataaactaggcaaaaccagaagtcagaggattatccattcctcttgttctttttctagctctacctgttcttctgccattcttctgcctgaaaatattcatgagcatcgcctatgggtcttgtctctgtgctttacagtagtgacatcacttgtgtaagccagtttttctgttagtcgtcggtacctcctaggttcgctgtgggggttaagtgagataaaactgtgcttctgaaattttagtgtgcacacaaatcacctaggtatttaaaattgcaagtctgattaagttagtctggggtgatgcctgtgattctacatttctaacaaatttctggctgatgccagtgtcacaggtgccaggaccacacttttaagtagcacaaagctagtacctatgtatacagcatgtatcacagagtatgcatattaaaagacctgataaatgttacctgctattatagtcattatttttcagccaaaataaataagatatggtccttgttttcacacaggccatgatctgatggtaaactggaaaagcagacaattcattacaatcagttcagtaagccatgagataacggaaatgccaagcatgtcaggagcaagtaagagggagtctaacccaaatctgaccaccaggaaaagtttagtggaggatgcagcaacaagaaagacctgagggtctcctctcctccctccttttttcctgcacttcttgtgcaggatgttttaggaaaaagaaaatagggcttggggctagacaaacctgcattgaaatcttaaatctgttatttttttaatcgtgagatcagcttgtttagtttctctgagcttcagttccctcatctgtgaaactggaatattaatagctttctattaagtaaatattgtagtgaggattagagatttatatatatgattacatagatgtatatataagattgtgtgtgtgtgtgtatagtatgtatgtgtatatgctagtttctggtaccaaatagattttttaaaataatattaattttaatttccattctattttctatcctttcccattttcctctttgttagctttctctgtaagtttaaaaatttaccttgtgggcacacatttcctccaaacttaactaaatctcttcaaaggggtgggagtttcgagggggaattcaaatgtcagatgtttgtcaaagagaaaagaaccgtgaagtaccgagaacagggggctgggaatacagggtctatgcaccaaggaaacatgcgttggtttgatccagtgcaactacagttcccagcgcctttggcatttcagcagaatgtgaacacttgcttgattttgtggtttgagcccctacatccaaagagctatttcaaattaatatttatttaaaaatggccttttaatattaatggcatatggttttatgacagtgaattaaatttccttttattgttagaactttttgaggatttctggacatcactggagacgttggagaccccaaggatatagccaggccaggttgatatatctcactgaggttacagaaggaagcagcggcaagcctagccgattcagagaccactgcgggcttgggaatgagcaggagagggtgtgagggccagaggccatctgtgttgcttttctctctcccagtcattctagccatctttgatgtggactaatagtcgaggttggccatgggtttgcactgtctctagggagtctttgtgatatagtgcggggtaggaagaacacctagaatcaaaatatctaatgttactagctgtttagttcttagtgtgggtatggtcccattttaggagaacagaactatgaactatgtttgtgttttttttttttttttgagacagagtctcactctgttgccaggctgaagtgcagtggcatgatctcagctcactgcaacctctgactccctggttcaagcgattctcctgcctcagcctcctgagtagctgggattacaggcatgtgccaccacgcccaactactttgtgtatttttagtggagaccacgtttcaccatgttggccaggatggtctctcgacctcgtgatctgcccaccttggcctcccaaagtgctgggattacaggcgtgagccaccgcgcccagcccagaactacatttgcttaactgtgactctttcctttgtacctgaaaataagtatcatttttatccagtaaatattggctgataattcataaggcagatgctttaaattggctattgtagaacaaggagaaagaacttgatgaagagaaaaatccttggaatcagtggtttacaactttttttttccttcctgatgatcaaaccgtattatcgcatagtagaaattggattttcttccagaaactactttagtacctctcatttgtagcacttctatcaagagtgctggtattcggacatgtaacctacaaacaaaatcagaaagatgtcaaaataacaccctaattcagactatcctgagaacatttgtcttctgaatatttaagaaaaaaaaataagtgttaattatattgtagggtgttaccattttgtatttcaagttcctgagaagagaatttgaacagtttgctatttggaaattttagcaaccagctaccttgcctatggaaagattaaaaaaaaaaggagagggagtagatggtggtccataggctgtaactggaaactatgcctgtcttatttagcatttcaaaacaaaaaccataaacaaacatctcagattcaaaacagaaaggaatttctggcagggcagaatgaaacctgagactgcagagtcccagtctacaagaggtaacttatttagcttcttatccaaaggccacagcaaaacgtttcacagctgtgattaaacaaaaggcatcttttgttggagaattgtgatacttctttttaagactgcgaaagacctgccaaaataaggcaaagctaccttgaggatgtttgacctgaactagactttatgaagtagttggaccacttcaggccttatggtgtgaggagtgtgggatgcataggcttggacctttctgtgtgtgtgtttataagtctgtagagacagaatattccatcatgttatcaaatgcagatctcgaaaaccttttctcacttcccatatttgggagctttgctttttttgaaaagtatgggcttttacagtctgagtgaggaaaagggatggattttagacagttttgtctgtggaagtcaaagtagaaggatttttaaacagttggagacagaatgggtatactgtgtgcttttcagaaccactgagttcctatatttcaggcagattttaagaaaacttattaccactacctatcacatcaaaatgaaagaccaaataaatttctgtgttttaatcaagactgtgactgtatttgtgtatatcctagcttgtttcagaaagggtttgaggctgcccagaaaggtgaatattacagaattcttgtatgtgataacatgataaaggagaaaaaaacagccatggcttttgaatcccccttcatctcttaatagcccagtgacttaaataaaacccttcaacttcccttggcatgactttgccttaatttgtcaaaagggaattaaatagttacctacctcaagacaggggaactgaatcagatgatatcttaaggttctactggtcataagatctatgcttttatgacctagaagtgatagacaggagtcgaatattaccttgtgtttgcagagccagggaaggaaaaagtgatagtgtctacatgactgccaggtgctgtagacagaagggcttagaggaaaagatcaagagttcctccatggttatgtttatcaagcggcagtggagacagtaaagcgtagtattgggaagttagtgacagcttttaaatgcctgaagtcttttaaatcatattcaccgtggctgagtctggattcagggtagaactcaaacctctcttatgtgtttgctgccttccctttctccattttcttatgtacttcattaattattaagactatgaggtaggtaggtgacagagactgcaaagggagaagctagagcgaagacaggccaaaacttgcccaaattcacatgctcatttctgcctctgacactaggagagagttgagtaattgctcttcttcctaatactgcaggcagcagccaaattctccacattcttttacctttgctgctgttttcacttgccagggagtttccttaaggagcagactgaatttaaagaaacatagcagtaatagtgcatgaaagggggtgtggggtcgctggccaaacgtggcatgttggtgcctcacgttgggaggatgaaaggatgattcctgcagagggacatgctgcacactgcgcaagctccctcacctctgtgtacagctgagccactgaccaggaagctctttgcttgtatgtgagacagcaaatattcactaaatatgtttcaagtacaagccaactgcgaagcttggaaagttgtccagaaacttcacccttcctttgcatgttgtccagcggcaggacgttgagcaaggttaggtagtatgaacctgcggctctaaaacttaaagtaataggcattattcgaaagaaaatgatgcccagcacggcttccagtgtatattagcaatcagcttgtttgccttgtggttattacattttttgccaagagcagccttccagaatgaggtactagttaattcccattgggcatttattcattaataagtctgctgaatgtgaaatattccatttgggagtatgtcatatgagaaaactcagtggctaattattacatagctctcttccatgattctcactttcagcgcagttacctaagccaccatttcctaggtatgtaaacttagataatttttagttttctgtaatactttttgctttttgctccagaaaattttttttcactccaatctgtgaaattgttaaaagtttactaataactggataaacattttatgttgtactatggcttgctctttctttccattttaaaaagataatatcaaaagttaaatcctgttccagatcttaccgtctctcttccaggctagatttctgggatggggtggtgttaatttactaacctgagcttttgcccaatctagggtctcctttactcttttctggtgtataaataggtctttatttgcttttcttccaggttggttggtgcatattagcttaagaacttttaaacctctgcggcagtaatgagaatctgcatgccaagggcccagcatttctctacaaagcagcccatgagtgcatgtgtgtttgctgtagtgaagggtctatgttagaaggtgagttagagaccccacttgcccacatctgtgtgctgtggtttggccctcctcctctggtgaatccctaccacagcccagtgcctgctggatctcaagtgtcctgaaagccattggaaagatgctttccagcagtcttaacatttgcctccatgttctttccagcaaggatgagtgcacacagctttccagctactgggcaacccagccattgacagaaggtggtgcaagagtcaattcctctgtgaggatcccttccaataacagtgtgtgcattaacgacaaaaagttctgtaaaaatgtttgcagggggagcttttgacctgcaaacatttctacagaactttttgccatataggaacatatgaaatgttatatgtaatataggtcagaaatgttgccatataggaacattcgagaagatgataaatgtgaggaaagtgataaaagtttatacaacaaggatctgtacaagattgtggtagatttgctggcctaaaaagatgtactcagggtagtgaactatttctgtagcatcagccactgggcccctgagtgggaatactctttgagagacaggaagctaattccttctttgaatgtgtagttaactttgtgccattggatgtagggtgtgcacgtgcatgtgtattttttcagttgctgagggcacaacacagacaaagaataccgtgcattgtattatggatgtgctggaaacaacgccccagcttgaagcaagttgactgtagtatctactctgtagatcagcaaactgaaaatgacttcttaataaaaggtcgcacattgttttacttactgcatttgaaaaaacagttctaattaagatgctttgggttttaaactgcctgttaattgggatatctataagtgggcaagtagagcttctgaatattgctgacttatttcttagtgattgggacaaaagctttttttttttttttttaaatagtatgccatcattaaacagtttttgaccttacgcagaaactttaaatgtgacagcagaaagaagcagcagaaatttacagtgagaaatggaagacctctgtaggtaaataagtaaaatgaaagaagccagaggtgttttttgttggcagtagatgaaattattttcaaacactgccctgggaaaaggtgagccctcagcaaccaagtttattgactgtctattcaggaaattgtattagttgctttggaaagagaaaggaaaaagaaaagactttctgccaactgagggctggaaaacttgagggagataaagtatttacatgctttaataacataaagcatgtccaaaagaaatacataattacagctatgtttggcactgaaaataatccaggttattatatttttaaaattgtgtgtgaatatgtaagtgaatgcccttgagtcagaaatgcttgagtgataatatttcttgagagaatggaaaagtagatggtattaggagctaaaaagagagagaagggataaaggatgaccactagttaagaaggaacagtgaactttttttctttagaggggacatatttcatatgcatagttattccccctctacttctaatcttagtataataagcatttaacttcccataggaccttagcagtctgcatgttattactaaaagcccacaggtaagggaaaattagacccctaaattaaagacctgaccatcttgctcctgaagttttaggttttccaactttatttccagtgtatcttggacaaagaccctttgagagctcagaaaattaggagatgtggtcaacacattcttcttaatatctagtgcaaccaaagacttggccagcaactaaggccagcaactggaaaatgggtgtggtgtcaggtttcagacgcccccatagttgtcttcacgtcctttaatatgtgttggcatccctcaagccctgccagtttatgctctttcctttgtgaagccttcctgccctgcccaggaaaaagtaatgccatcccccatcccccatcccccagtgaccataaatagcactttctccttcccctgttatagcacttttcatactgtgttagagttcacatttctgtctctctgcctcattgtgatctatttgagtgccaggattgtgtgttattctagcgcttggcacacaggaagaactcaatgagcatttgttgactaaatctagactcaaggtcatccaagatattatacaaaaactttttcatcgaaccatttggtctgcattgtggaaactgaaacgaatggcactccccgttaagagaatcccagtgagaagccatagcattgcaggaggaagctcaaactggttaactttgctcatgccgatcagtcttagaattttttgtaatgtttccatgatgaattagtttcagctgtatttttttggcaaatatttaaagataatttttatttgtgtggacttttcttcttgtcagtttgtcataaaggtgtcatctttcattcactaaccccttatcagcttataggaattttcctcgtgggtggttgcttgtaaccttctcttgactgccagggatctgatatactaaacggttgagatactgtggtgatcagctgcttgtaaacaataactgataaatcggttataaattatcaacacacttcagatgaccatatcatcatgacttggtgatagcaaaatagacttctgaattctcagctaatccaggattgtgtcttaacaaacatttatgttgattaatcaggagggtgtttagtttaagaaacatgtactgaatgttcaatatgtgagtgccaagtgcagtgtggtgcaacctgtttactgcttcaggtgatctccagatatcctaaggaatttttaactgtacagcttctttggggaaggaaatcctaagccaacaacctgagggtggaagtgtgtgactgggaataattaaaatgcctcacaatggttcgagcaggaattccataggaatgcactttaaggcatttaggaaagcaaaattccgtttggatttactccaaaccctatgacttcagagacaggaatttttgatgattagtggctggagccccaacttgttatttagtaattccacattcagtgtggaattgttttttctgtagcactagttataagttctttgtttgtttttctaaaggttttaaggaggtttacaaattaagatggaataagacattagaaacttaaggatacatagcaaattaaaaccttgatacatttggtgctaagcttttcagctgctaaagatagagagttttggccaagataaagtatatagagtcaaagacacatgcagaattctcctggatataagttcaggtacctgtgccattttatcactttagtcaatgtgcccattttcttagggcaggtttaattttctgctgcggcatggcccttcagctttcccaagtttacgatgctcatctcatacctgatggaaattgttgataatgttagtgtatggttggtggctttcccagtagcccacttcagatccttttattggtcatcaccagttacaaaagttttaggaaagggaaggagagaagctggaactgatggctaagtaaagttatagctgtagagctctggttgtccataatgaacagtggcaatgaacagtgaagatttaagcaaggttattttttgagggtccactgatgattttcctataactcgttaaaaatatttttaaaacttttatatggcttcatataaaaaaagcttaaaaatctgttcccagacttcctaggcaggtatgttttcttttcagtgttgccttctctaagactttatcagcagaaggagtatttgagctgatggcaaatgctgccaaaatgagaagtgtgtgtgtttctcaaaactcatgatcccacagttaaatcgagggtgtgggtaaaggacccagaactgttcttgctgatggaatagcacacttttcctcagacattagtagagtaaatgaatggaggcagaggattgggaaacactcttgaaggagggagtgcccatcagcctgtaagccaaagtaaacagttcttgtaactgaaaaatagacttcctggaaggagagaaccagagaagtgggtgtgaagtgcaaccagcaagtaccattttcagtgatacagacagctggcttaacctgagtcctgacaagaacctctcagagctatttggggaaatcagttgcttgaaccagcctttgactggcctatcgttcctacagctgtacccaaagatggcacttggggagaaaaggtcacatttgtttgtgatagagaaagcaaaccgatggggcattttgagaggtagaaatgaagtcatcatttgcggagccggtggaccagcagaatggccgtgggaaggtatccctgaacctgtatgtgtggaaatgcaggcattctctgtcagtcttttgtcacagtgagaaaatgtcattacagtggacagctatgcacacgttggagattatgtgatgtgtgcatgtgcatccatgtgtacaacatacacccatgcaaaaattgctcacagggtcatgtgcgtgtcctggtagtctgttatgtccattcttctgtaataggagtatgtttttcaaactgaagctgttaggttctgttaattccaacagaacaaaaaaaaatctgcctctggccatcattcgttaatttacatagattagatacatgtagtctgtctcctaagtggcttatataaagccgtgggcgtcttttcctgtgtctcctcttcggcagttcctaaggcacctaccaggtttatagttgctgatgtcctacccatactatgtgtcaagaaaggtagactcaaaaaggattgatgcagatattccttagaagttttcatgcccaaagattcttggaccttagttgcatgagggaagaggccttgcctcgtgaaaggagaccgaagccccttattaaaggggtcactcagaaaaaggtgttatctaaattccctctttgtagttttatttcttcaatgtattccccatcactagctgtgtgtgctggagccaaatgttgggcccactgccatcttttaaagaatgctactgtaaagggataactttactagacagtttgggaaatagaagaaacaattatctaaaatgctcttgttccaaacacaaaaactagcttcatgtttttgtgtataaccctgcctagtcttactctgtagacatccttccccccacacccatcgtgtatgttttttatccccatctaacattatatcaaatacattgtcctatgttgctaccttgtcttcattattatgatttgtcaagcaattgggttgtactgactgcagtgttactcctcatttcctttccccctttcttttccatactacttaaaaagcaagaaaggaaaaaaaattctatttaagagaaaatcctatgtagtcgtaatggaatttattttcctgagtgcctgggcgtgctccaaacagatagctgtgattgtgtcatctcttcttactaagcatctgaccactcactacctgtgcatctgatccctaggctcatggcatgagggctgtggctcttgatgttttttttttgatgtgcttagtatcaccagaactgtattgactctaagagtatggaagctttgtaaagttaactaacgatttgtaggttttgtgcaaatagccagctctccaggtagagacattttaattctgttgctttttttttttgtagcatattattatattgcagatgtttacttagtatgaaaaatggatataattaagttctaaatgggtactagatattaacttcaaaatgaatttgcaacttgtatgctttgcatatgccgtatgctttgcatatgccatatgctgttgtttccaaggatgtaaagcagttttccacttccaccatcttataaattaaaaccagagggctagacgttatccagcaagggacctacaaaattcgaaaaaaaacttcggatcattatcaggattaagtttgttgaaattgtatcaggaaaatagacttttccttgtattattattgactcatataatgcaactcatactggtttcatattcagaaggtatatagcacctgttgtaatatttcaggttgatttctgcaatctttatttaaaaatacaaatccgcaaagcaaattgcataaacggtatacaaaatgaaatcaccaggcttcaaatatattttatgtaaatgttaagtgctctttagattagcaaaaggaagacaaacattttgattacctctttaatactaaatttttgtttctgaattataaatctttgaagatataattagtgtaagatatataccaatcaacatagtccagaaaaccctgaacctggctgcttattagttggaaagagtacctatttagactttctaagccacagtatgtggctaagtgattaatatgcactattacactttcacaaatactttttggaccaacatattgacttaagggagcatactttgtactaaaaaactaatttgaaggtgaaatcacagcaaatttaacagttcaaccttgtgtatttgtagagttttagttggatcataggataatgacattagctaaagtcagcaagcatgtaaaataaacattttgaagtttaatagtcatttatgttctacaataataaatatttggcacccaccataaccaccactaccaaaatatgtatgctgaaattgtgtctccaggatgaataaagaggtgtaaggcaagctgacacccattagaaaaaaaggtttagaaagggagagagggcctggacttccctaagcttaaccccaacatagggcctgtagctcctgttggaaccaatttataaaacttcaaggtgggaatcaatagattgtttccagtgttatatagttcctctttaatcagttgatcttcaaccaaagcttcaagtggtttttgtttttatttattgccaaaagcttcttaaccaatgtgattataaatgtttaaattcatttacagtgaaatggatttgtatcttccttgctctacagtagatagtgaagcctccgtgacctgtgtaagctgcaggttgaggagaatgtttaaacagtaggcgagcgttcatacagtgtccctggactgcatttccttgcttacagagccttggagctgggccaactcgcatgagcgggaggaggagaggctcagttttgagagccctgggtttatttctggctgtggggatacgagaatgtgggagaaggtgtaaacatagtttgagggaggtcgtagacttggaggttcttgccaggggtaaatgctggctggatttgtttatggatggatttgattatagctgcttcacgcttttacctctggagttggtgcttccaaggggtgatgctcattgtctggatctcctttagtgggcatctcagaattctttgctgcaccaaccacagcatttcttttccctttcttttggtatttgtattcaaatgcctgacttcctgacctgctgtgagggtttttaaaaataatgaacaccaagcttcttgggaaaagacaggtatgtaaatactgcaagcttatagcatttgggggatggagttgtgggattttggagtttgtgacccccatgtgtctgtgtatcactctctctaatgtagagagacagagcagcagttcctgagctctgtcttttgtctcttcatgggttggtcactgatttcccctttcagggtctgaatccctttcccttgcctccccccatgtgggttccggaaggcccacatccaacagctgcccttggtcaacccccagccctgcacacaggtgttttctgctgttcagagctcaggggcgctgtccagccagctgatgacagctcactggtggcgctggtctcactccagtgctggctctgccctcttggccctgttgcttcctccttggaggattagtcaccccagtcttggggcattttacccacctgtatgactagcacacattgcatccacttgccaaggagtgttagggatacagtctcaagaaaacctgcccagtagaaatgacttcctctggagaaatttagatgataaattccatagggagaaatcatgttttattaatgagaaacaaaatcgtgcactagtgggagttcaggctcagaagccagtgcatagtccagcctggcgacctggcatggtgtgttaccctggccaaagctccccaacctctgttcatgatttgcctctgtaaaatgggaataacaatagtatccatttcttttgggtggttataaggaatacttaagttaactcattcatgtaaagcacttgaatagtggcttgtatacagtaagcacacagtaaatgtacattgtcattgtatctttgtacctcaacatctgaaactatggtttatacatagcacatactcattcatgctttgttgagtaaatgtaatattcagaaggtgggaaagtgatttccttctctcttatcataaaataagagttatatttggttgaaataaggcatcataggcctgaagacatttactccctggctgctggcaggggagtagaatgttccaaactctatgttgataactgggtgcctatgatttgttaatcatacctaacaaactcagtctgtcaggtgtttcagtaaaatttactgactcccaaggtaattttgaaaggacaaagccatcaggtgatttgttttcaataagcattattgggatatttcagactccaacatgtgcagtggagatattaacgagactttaccctttctaaacttaggggcttactctgcattgtaacgtatgtttgcttttaaggcgatagatgggtagatagatgctctgtaattgaatagcctactgggcttctgtgtagcacagcactgtgtaagtcgcaggtgttcagtaaatgtattttaaatcaatgagtaattgatgggatatttttcttcacattacatcacattgaagatgcttgtgaggaagttttgttcatgattgtcctcctaggcaggcgccacctaacatgtttctctctagctgcggggtattgaatttgaggctgctctcagcattactgctcatctcaaagaggaacaaatggtcccccaaatggtccagatgcaacagtagggaaaggagtgccaccattcattctgaggtgcctgggccatactctggatgaagctcacagctctaacgtaaggcggtaagtcattttttttttaaacttaaggaagttaatttgaaagtttatgctgatgccatttcatatgacagagactaaagggtatacgtccttgtgttctcttggtggggactgctgtcctaaaggtaaaagattttgatccagaggttggattgttcctcgtgtggcaacagtcctctgacctcagtcattttcaaagtctaatgtctttttggctaacaaaagacatcaagctagagattaaaatttgcagaagatgggagtttttttgttgttttcggttttttttttttttttttttgagacggagtctcactctgtcacccaggctggagtgcaggtgatcatatctacaaaggtgacaagaacatgaacctgcagtcctgttatcagcattttgtaagtgcttcttctcattctaaaaatatgtattgattttaaaaatgaattctgtaacaggatagcaacagtagtaaaaatcctttttatggagaaatttagagctttcagctaacatacacacatactcattcaaatgaaacagcttgtcttgttttaaagaaatatttctgttgtccattgtacaaattttaataacttgtctttcctttttttaggtctctgtgttccagatttttttttgtaactatgaaatccttgccttgtagtcaacttaaaatgaaataaatttatcagtgcaaatgagtacactgtggttcttgtgtggcaaaattatgcaggtggtttgaaggattcattgttttattaaaagactagaagaatgtacaaatgctttccttctttctcatgtttctctcacccaaactgaagtggtccatttaaaatctgatcttcataaaaggaagagttgtcacaggacatctgatttatgagccatctgatttgcttctgctgtagttccacactctgctggggtacaaaaatcaggcacttttatttcagccctgacaacagtgcggccttcccaaagtatgagaagagcagcgtgcagaggttatgtgcagtcttccgaacagagcactgaactggtttttaatgaagggtaatatgtacttggggtccaaactctagttaattccggaaaacatatcccctcactagtgttgggtcttagtaaatgagtgttctgtgttgaatccttgcttgagaggaaggaggtcataattggtcagggattctatttctttctttctctcttttttttttttttttttttttaaagaaaagcaattgcttagaatgagatgaatctatatcagggtatgtttttgtaggatcatattaatcatcttacccacagactgactttgtggtcaaactttactcataaggatttattaaaagcaatggtttggttaaaaaaaaaaaaaaaaggtatgtttatgggaggaatgtagacatttagttgaagtacagttgatagactttgaccactcagggatattttctccatggactgtcttacagaggcagagcctaactgcatatgcttcttatgactctgatgcatgaatggcagccctaaatgggctcctcttcacttattccttctccccaatctccccagcactgtgttctgtttccttccctgcaagagtctgcgtttatcagtcaggtactcctgtcctcagagtgccaggccagctctgcatccttctccacaagaccaggctgaagtctgcctgttcacctgttgatgctacacagtttgagctcaagctccttattctttgccggcttcccttttttgagttccagtggagtggtactcttgtgtcagagggattcagcactgcccactatgtcatggtactctgcgctgctcctcttgggtctggatggggccacagttgtccagtcccatcatgctgcagccctaagctccagagggtgaccttgataggatgcacatcctggagcttaatttcataagccttgggggcctgcaagcaggaggagttggaagcccttgagaggccagatcctgtgggtttgagcgcagagtctacagagttaaaacctgcagaacaaagaaatcaaaagaaggacataaagaaagtttgggagacattgagtctgcaaagcaaagaaatccagtattgcaaggggaagattttgctttgggaggttgaagttttgtttgccctccgaatgaaagtggtatttctgttcgttagccaaaaaatcatcagactttgaaaatcagtgaggtcagaggactgttgccacaccaggaatcagaattgtggcattggaagtttcttcagaaaagcacctttaggcccgcccaactttacagattaaggaagtgagacccataaaagtttgtcatgttctcttattttaaaagatatctcgaccatgtctgcagttatggcctctttttcctgcctcacccaaaggggtcgaggagctttctcttgcccactctggagagaactcctggggcccccccgctgctctccctgccccatgactttgtcccagaatacagaacacagtgggctggatcagcctctgctgaacttttccctgccagcctccctgcccgccttcttgcccccgcccctaccccccacacaggaatctagagccctcccagtggtggtgtgaagcctctggaatgtggcactctgacccctggcagttgagtgtcctggatggacctggcctgggaaacaggaaggactcgggggagggggaaggagtgccccatggccttgaggtgggatggagggaaaggaaatgctgcccagcgcggccccacaggcagctcccgctagactcccacactgggggcggggctggcagggcagggagccggcaggtttcctcagaccaggcctgtggccccggggcctctggcagagccaggctcaggaaggtgaactgccagagcagttggggtgaggaggaaaggatgtgaggggaaggaggaggagcaggccagaatgcagaagcaattgtagtaggagaggacaaaggtgatggatgagaaaaggaatgtccagtgactgtgtggactagacacacttctcactttagaaaccaagtatattagaaagcggaaaagaccctcctaaagaaacttccagccaggtgcagtggctcgtgcctgtaatcccagctactcaggaggctgaggcaggagaattgcctgaaccggggaggcagaggttgcagtgagccgagattacgctactgtactccagcctgtatgatagagtgagacttcgtctcaaaaaaaaccttccatgccatttttattttagagtaaagcacaccccatttggataccccagtgctttttaacatgctcagccttggcaaagatagggtcactggggttagtgaaaggggtgggtgcacatgcaagtgtgaggccaactgttactcacctgtccctttctgttttctttcattggtggacccacctggaccacacttgggtctgttacctccctcaaagaggtttccagaaaaacctgaggacgtgcctcagggtgatgatatgcccagcagctctttgctcctctccgggattagggaaccttgtatcctcaacttcctcctaattaaagcctttggcagaatcaggatgcagaaccagggcctggaaccgcctcagtaaacccctgtggaaccactagcagatcatgctgtttccaaactgcgcgtgttggcaagccagcttttcactggggatgtttaaaattaaattccatgctcttgggaaaggaatagaaactataggcagagtctgtttctgaaacacctgttttaagtggaaagcgatcctaactgctgccatacctgaagggcttgtgtttcctgtgcagctggaatctctctgtgctgagtaaattaacttctgtgcccagggtagtcttgaatgataattagtgctccgtggccatgccacacatcctgtctgaagcaagggtgctaataatgtcctttcctctcttctcacaagacattatatgaagtcctaggaatagtggtcctggtgctaaatagaaatgtcgtggttatggcactaatttattgggcctgccagcccaggtgtgcagcatccctttcctccacccgattgataagacaccaggtgaggtccagtgtgatgctccaggcagtgctgcagctgagttggcctgtgtctcctggctcaaggggtgcatcttctggtctgccttgagaacttaccagtcttccataaattggaagttcaaagcaatggaatgaacaatggagagaacaagcacatacacataagttaaaagctgtgcatctctgtatattctaatcctttgaaacttggtgatcattattgttcattacataggatatggatttgatcagagcatcctttgggagttgtctgcatttggtatttccttttatatcctgaaagctgttagttcttgaaaggtgtattgaacctaataaaatagtaattagaggtatttccacaaattgtgagctttgtcatttggatagtgtttttgagacttcttttccactctaaataccaactttaaatagaataatatgacagaattatgatcttgaaaaatttatctacttaactgcatgtgggaatacatatttctgtagcatgtggaaaaaggactgagtgatgcatacctgttatatttacattttcttttggaagcaaattattttctacatgtgtatgtttatgcctacatgtgttctaatttgaaatgtaaaaatctataaaaaatttttccttgactgctatgttttaaaatatctgaaagttacctgcttcctagtccttggaaggcctgaattattataaagtttatttctttgcatctcaatcattcccaaaagattttaaatatgaatgcataagtagtgaataaacaaacctgaaagtttgatacctacagaacatttttaaagctgcttctttttttccatgcagtattgttagtagagtataatactagttatgtcgtagagcagtcacttactcatttatttacttcagcaagtggatattggggcctgctgtgtgttcagcacagagtgagtatagaaatgagggaagcagtttctgctctcaagaagctcagcaatgccttaggataagggaagtgctgggggcgggtgtgctggaaagagagagggatgggtggaagaaaattgaaaatcagacttctttgaagaaaagatacttaagctgggcacactatggtagtagcagctttctaggtagaccggaggaaaaaaaagtgttcctaagcagagaaatgggatccgtaaaggcccattggagtgaacatgcatagtatactcagggaatcagttgattgagtaaatatttatggaggccctactatgtgctgagccctgttccaggtgcagaagatacagcagtgaacgagacaaaaattcttaccaactggagctttctgatagacagaatcagccaaattagtaaggaaaacatacagcatacaagaggagagaagtgctacggagaaaaataaagctgagaaaggggacagagacaaccacagtggtatctggtttgcagttttaatggtctgccaaagtcttgccagaagttgaggttgattgaagacctgaaggtgtgctggagtgaaccatgcacacacctggagtaggatgttccagacagagggaacacaagtgccaaagccttgaggctgcagtagccggggaagggaagagcagctgtctgcacagtgggaggtaactggacggtcagctagggctaggcacaggcctcatttatcagtgtgaggggtcagacttgaccctgtggtcaggagagtgccatcatagatttatagatacggcttgtgctgtcatctctgggacccccaaagtgaggacccagtgagttggagctgagtgtctgttaggtatagaggtaagatactacacaaaggaaactcagttttgtgaaaaacgtgtaaatatgtttttcaaacatgttcttaagactttttaatctttctatgttcttgttgtctggtttatttcccatgaatgttagggatcagatcactgctgtgtaaataatagtccacccaaggtattcatatgcatttcttgacatggcctaaggcaagagtcctgctttccattgtcccctaatttatatttgcttctttctggagagttttaaaatgaatttcaagggcttgatgcctttaaaatcagtggatcaggccctgtgttgcgagatttcttaatgggccacagttgtctctgtgattctcatttccagtttatagcactactgtccacctaaacatacactaaccatgtggatcttaatgatgttttaagaaaaaaggttttgacatacatgccagacttccacttaagatgaaactgggcaactaggaaatggtatgccgtacatatgaagcactgtttattgaatattggtggcaaattttgttttgttgctaggaccagattcttggagtgtgtagtaggaataaataagaccaaacacaatcttgcttcactgaaaaaaaaaaaaaaatcaaaggtttgggtttttaggcaagatatttagggaagatatttctttgtagaccagtattagagttaatggcaaggatcagtagtataattgttggaatttatgtcactctttcatttatcttccacttggtttattttgaagacttcagataaattattaaggtaaagtgcataggagtgctgaagttgatttgtaaaagcattccttgcaaaaatgattgctagctgatttcacaaagttgttatcctgaaaagattccttattgcaacttccagatcattacaccttttaaaaactattatttgcttttcaggagtattgctgtatatgaaggtcttagcaaagaacctctcgttttcctcgatgatagattagttgagatcatgtttatattggtgggttttcagttctgatggctctgcagctctgttccttggctgcaaggtgtcatagaggggcctctgcttgtcctggtggttaaaggaccatcagcaggagtctccaggccgtattactggagacggacctcaccagagtgagatgggagaattagtggtgttcctgtccttcttttccctgatgctcaggtcttccggattgacattaacttgaaattttgcccagcctttgactacctcactttcctgtttcttcagctcctcatgtcccctgctgggtgacagcctatatgggatttagacctaggttgctcagcttccctcctcagtaaaactgatgaatccatggagagtgcttattccagtgtctggcacatagaaagtgctcagtgagtgttagctgttatcagaagattagtctcagggggtgaaatgtgctttattatctgtgctacctcttcacctagtataatgaaaaatgtatatccttcacagtgcttattttcagagcaccatgtgtatttaattgttagaaggtctagtcacatttcttttcactctagtggttcacacttttggatgtgtgcaattcccatacctagtcttctggtttactcttggtgatttgactaacagattttaggttagagcatccattaatatttataaaatggtactgtgcattattcatgtcctcaagtcacattctggcaagaagcattaacgtgtgtcacattatctaattattgtcataatacacagaagtggcaggaagggagattaaaagtttattatttaagttattatttatttatctaacatggttgaggcatattatattcattcactcttttgacatgtcataaatattgatttgtggaagtgttgcttgatacagtattgaggttaaaagaaaacttgcgctaatattaatatttcacaagtaggaagactgagatccaaagatgtttctctgttatttctaaataattgactttcttcctctaccaacaaacttactttccagaaaaagtttgctgctcaaagattcacattgctttgattaaattcatgtgctcgtcctctctatccctatttattccttctgcaggtatttattttgctaagctactatttgctaagccctatgatagttcagtgatgaagagtaaaaagtagatcgttagtttcaaagaacccacttcgggtaaaggagattagatgaacaatttcattgtgctgctgtaagtgaagtaattttaatagatatgcagtagaagtcctacactggaaatagtacttaattcagtccctatagagtggggaaacctaaaggaagtattaaccactgaggagaagtttccagtgcagatgaagagaagtagctttctaggcagagagaacagccatgaatgtcatgaaacaacatgggacattcaggcaattcatagtcactaagtcttactggaggaagaggaaggcatggcagagatgaggttgaagaagtttgctgggatcaagtctaaactggctttgtgttattccatgccgggtactcaaatgactgcatgttggacttcattttgtagaccattgctttgcaactccatatccttaagaagtttggttaggctgttctcttaacactccttgctgggtgttacttacattaaagcacctctgtaggaggataaaacactgtgaaccaggtatgtaagagacagctaatgacctggcttaatccaaggatgtctttttagagtatcctgatgaagagatcaaataggaaataattagacatttctccaaaatacttttttcctcaaccaagatttattaatttttaagtaagagtatgtttgataactgaaaattgatatcctttgaagctggataaacatgcagttacattttttactggacattcaagttcagagacagctgcgttgcttaatcatggcatgtgtctgaatagaaggctgatctagcacagcacaaacatggaacaggggagaagacctgagattttccttggaaactattggattttactctcaaagcagagggaatataagagagttaaggtctgtgccacaaagtgcagctaggaaaacatgtaaatgggcattaaatacctaccttggtgatttaaaaaatttcggaaatggagccattcagtgtctaactttgagtaacttcctggtaaaacctcaaaagagaaagtgattgaaaaaatagacatcagagtatctggatgagttaacatgctgtgtgagactactcattaaaagccatttataagatgtcttaataatctttctcaagaaccagttttttaattttgttaactgtttttgttgcttttactttctccatagatttattatttccatcctccttgattctttggacttactctgttgctcttttttcaagttggatgcttagttcattctttttttttttttcagcttgtcttatgccctgtgaaatttccctttaaacactgtcttaactgtgtccccatcaatgttgacatatggtacttccactgttcttcatttttaagtatttggtaagttccctataaacccctcacattaaaaaatctttttattatagaaacttccaaatatatacagaagtagagacagttgtgtaatgacagagtgcttcagcagttgtcagttcatagccaatcctgttttattaaacgagatttactgagacctcagctagtaaatcctctaagaatggagatactggaaaggtcctggaaagtgatatttattacattaaaagacctttggcttgccttactctacatagtgactttgttttcaaaacaaagtctaattggtctgataatggaacattattttaaatttaaattatgactgccataggcatatgattctctggcactgtccccaataaattgttagcattgtacaatttcaataaagatgctagaatcaaacacaaggataaagtctaaaggggcctcatggattatccattctatgtcctttttgtaattaaaaaattggagcttagagagctaaatgccttgtttggggtcctgccgtgaatgagtgacagagctaaggttgtggtctcctgggccaaggtcctctccattacaccatccccctctgggctgtttcttcgtatgcagtttaagatggcccctaggttaggcagaactgtgaagtaggagagttgtgtcccgtagccccaatttctcctgtccttatcatttcttgtttcatgaaacatgaaacatgaaactggtgcttctctgttagttgtattgctgaggtgtatgatgaaaagtacagcaatgggacatatacttaataacaaatattttgctgtaagttgatttattatattggatcagtactgcttgtttttcagtgatttcctcacttggacataatacaaatcagtgttcttgttgtttgttatacatttagacatttacatcagtttaaaagttagtcttcaacaaatatttgtgtccacactttagtattccattgtttgaaagattcaggctttgtccactctggtttatagttacatatgcttaaaattttttcactttgtggaaatgtctgtaaaatacatttttgtaacatgaatcatttctactgataaccataaatttgcccttcctgctttgcactgattgcggcacaaggaagagaaagagaaggaagcaccagctttgggaacataggccttaagcttgaagcagagagaatgaaagcagactgtattagattcctcctcgagcagaacggaatgcctgataacagccagccaggagctgggggagttaagagcagcgattttacattacactggagtttttaggctggcatgaaaagagatgccagtattagctatttgcatcttcctgtagccacagggatatgtgaacagctggagaattaatttgatatatattcccaggagcttctcttctgccaacagaattccattactgtgagcttctgcgtgtgtactgtgaatttgtttcttgctttttaatatctgctatagcatatttctggtaagtggattgccatataataggatgcagccatctcttggtttggagtaaactctattaacctaaacagatacaaggtggaaaaggtaagaatctgagcatacaaatgccttccaccttcaggctggcagaaatttcatgtgaacacacagtactttgtccagtacgtgcactcatacctgaaatgttttgtttcatgttagtggaatttcacacaccagcaagcagatggaaagatatgttgaagagcatagaggttgaatccaggaccactcaggctagtgttgccacagctcgttcctgtagctccttagcacagggggctatatctgctggagctgcttcttcacatatctggtgttcgttatgcctccacacatcttgtaagaggcctcatgcttcatatccttctcagtgcccactttcctgccctcaggatggaaacttctctccaactagcctttgcattgaaaatctttcatgtcaaatgtagaaggaaagaatttcaggcatcaccgagaatattgaaagatattcttagaggagaaagactaagtccaggacaagactgaatgtagctattggaagtacaggtgtttcctgccttggcaatataagttgttcactcttataaagcaaataaaaaaacctactcatattctgcaaaatcattcattacactaaaaataagagagctgttgggaaaaaatagggttggggaaggtcactcaagacctatgcatctgtgtgtatagaggataaatgcaaacaataagaactcaaataaaaatactggcccaggtgagctgtccctggcatttatttgcacctggatctctggtagcccatgctttgcagccctccacactccgaagctcattctgcctcctttcagggcacggggtgttgaagatacttacttttcatgtggaacggtgttaccagaattaaacataacatccagtagtttcttcatcattgtttttatgggggttttttgtttgtttgtttgttttgttttgtttttagtacaggggcaagtgtctccagccttctcatttctgcttgcagtttccccagatagtttaatacagaggacattttaaccacgagagcagtcatttcttgcactaaagaaaggaatttaagcaaaattttcagccttttcttcaggtcttccatatactggtaagacttaactgtgagaaaacttgctcctgatacttatttttatttatttatttttttgacagagtcttgctctgtcgcccaggctcaagtgcagtggtgcgattttggctcactgcaacctccacctcccaggttcaagcaattctcatgcctcagcctcccaattagctgggattacaggcatgcgccaccatacccggctaatttttgtgttttttgtagagacagggtttcgtcatgttgcccaggctggtcttgaactcctggggtgaagtcatctgcctttcttagtctcccaaagtgctgggattacaggtgtgagccattgcgcctggccaacttttgatttttttttttttttttttttttttttttgagttggagtcttgctctgtcacccaggctggagtgcagtgacatgatctgggctcactgcaagctccgcctctgggttcatgacattctcctgcctcagcctcccgagaagctgggactacaggcgcccgccaccacgccagctaatttttttgtatttttagtggagatggggtttcaccgtgttagccaggatggtctcgatctcctgacctcgtgatccgcccatctcggcttcccaaagtgctgagattacaagcgtgagccaccgcgcccggcccacttttgatttttttagaacattaatgtgctgggaaaaatcacatgagaaccagcagaaccgctgtattatactgacaccattttcctatttaccagttacatattggctaaatcacattaaagaaacattcatttttatggttccacggtaactgttagaagaggtacccagcattcttttgttattccttggcctaggtgtacctgcaggacatgctctttagaacagcagttctcaaagtgtgggctacagaccgcttagaagcctgaagccctttttgggtggtaaatcaggtcaaaactaattccataatcctattaacattttatttgcttttttttctttttccactttgcactaatggtgcaaaaaaaaaaaaaaatggtacataaaactcctgatactttagtatgaatagaggttgtggcaccaaattgtgctagtaagttactgtattcaccgtgtactttcagtaaagcaaaatggtaaggaattaaaataataaaataaaaattagtttccttgaatgcccttgatcgaagcaatacaaattattaagtttattacatttcagccctcaattatacatcttattaatgttctgtgggatgaaatgggaaatacacataaagtaattctgctgcatactgaagtacagagcttgtcatgagaaaaagtgttatatttcaagatgtcttctgaacatccaagtggaagtgttggtttagcagtttaatatacctggcacttcactgtagtactcaatattggacatatttgaacatatatgaatttgaatatatttatgaaattaggtttctctcttttatacttagagaaagtaacttatgtaatatcctaatttggtatcttgcagaaattataaacttaaaaatacatttgcagaggtacctcagttgtcttcacctttcaggctaggagactacatcttgtcacatttagggtaccaggaaaaaacctacttcatatagttaaaaaccagtacctctgtttttaactttttttttttcctgaccagtccaaggagaaaccaggagctatgttagagaatcagaaccttgattcttgtgctgtgtatgtggatttacttaggaaaagagagattttaaaacataatttgccaactgctgttagcagaactcttgggctcagatttgatttccataatccaacctcattacatttttgctttcagtccttgttgattttgttaaattattttaaaatatagtgttctgtaattgaataccagaaaagcatttgtctcagtagcatgttgtacttgatcctatgaagcggtggttgctagggaaaccatttcccaagaagaaaaacaaagtattgattaggagcgggcagagaattgaaagagtttactctcaaaaaaaagaaaataaaagtgtctacgatgttgttagctttagagtcagtgatgcttcctggctgaacatagtggcagcaatgtttctgaggggaatggtcacctttacctgagcatcttcaggtgagtctgctgctgctgccaggaaacttctgctgagaaagcagcagaaaacagcaaggggccagcggcctcatcaaaggccttttagctgtgattccagatttgagggaaatggtcttcctgtggggaggcagagaaaagcatctggcagtgaaaaccaattagctgtgagatgggctgcttggaaggactgttgatgccagccaggtgataagaagttgaagtcttagagctgaacggggggaagagagtaatgatagatgatgcctagtgagaaatgtgcccagtattccaagcatttctttgaaatgtgtgcctcatacagtgctgtaatgataagcttttaaaataggatttgtattgtttaaacatgttctttatattatcttgaaacatagttttccttgtgatgttttgtatatatgtgtgtgtatatatgtatacacacacacattttttaattagacactttttttgttaaagacacaactgcattgaccataccagtgacatatatgtgtgtctatatacacatatatgtataatacatatatatacatgtgtgtatatatgcatatgtgaggcttctttgtctaccggggaattatggcttacataaaaccactatggtaggggacaacaggtctgtgcagatgtttgcgggagcatagaggatggagcagcttattctcctggggcaggtagagaaggcttctcaaaagaggtaacatctgagctaggttttgaaggatgagcaggagatagcagaggaagaagggaaggaggtattccaggtggacgacactcccgagtaaagcatgggagcagttcctgcgtgtttctggtaagagcctcaagtgtgcctagagcattaggatgtgagagcgactggtgaaaaatgagtctgcagaagtagctacaagccatgccatgaagaagctgatattcagcagtaagaagctgggacattttcttattgccaagagagaattactgggcaggtttgttttttgaggaagatggatctggggacattgtggggaatgaggtggagagacaagagaatagtggcagggagccaggttagaagacattgtggtaattcaggagagtggtgtcttcagggagttccagttagaatggtgggaagggatgtttactgtggaaaaaattctgcaataggatcaactcaataactgcacatatttataagaacagtaataaagatttcctcttaaaactgtgaaggaaaggaggacaaatatacatggtttccagtagttcaaatgttacttgaatttcttacaagttttttttaattcctagggctaaactgcctttcagttataaatttgcatatgtagtcacaaaaattccttcatggcaaatctgactgaactgtagtaaaatgctagtactactggcatgttaacagttaaacagataagaaatcacttggatgcacattttgttataactgaagacaaatatcaccttcttttctatgttgaattttttcaatatggtgtttttcttctttttctgattttcctttcagagtactttactaatttcattgttgtcttgaagataggaatgtacctttatgtgtctatgttatatttgtgtgtgtgtgtatgttgcttctctctgtctatatatataaaacatatatatatatcttatatatgtatgttgtttctcagaaccaaatttaggctaaataggagaacagattttaaataaaacataaattgtgtgtcggtataaacttcaaatctgaaagataatcattttactaaaagctgaggctttgatcaaataagtgagcctgatctcctgaaatctaaaacaagagattttctattctcccttttcaaaggaccgccctgaagctctttatgtagtagatgacattcttgtaacgacctcttgatgagaaaattatttatttcagtcaggaagagcagacttttacttcacttacgtactgagcaatgatgccagcaataaaagcttaccctataaaaataagagccatttgtttgtactgtcttttttttttttttttttttttgaggcggagtttcactttgttgcccaggctggagtgcagtggcatgatcttggctgacgacaacctctgcttctctgtttcaaacaattatcccccttcagcctcctgagtaactgggaccacaggcatgcgccaccatgtccagctaatttttgtatttttaatggagatggggtttcaccatgttggccaggctgatggccaggtgatctgcctgtcttggcctcccaaaacgctgggattacaggcatgagccaccactcccagccaaaaacagatttttaagatggcatttatacctgccttagtttgagcaagaggtttaaggtttcttaaattcaggtactttaaaaaattctcttcagatatgcttatcagaaacatgtttactatgtaacagtcagttcccatttcaggtgggtaaagtatctgttaaagataatgttaagtgtgaaaaaaccccatataatggcccaaggattcacagagagaaatagtctaatttcctatgaggaatattatgaagaattgagcctgcatatgattctgtcgtattcattgcattttttggagctgagtcccatgatagctctttttaaaatcgaccttatttattgtgacctgctccattccatgatcagaacctgatttggtctcagcctttgtattcagttacctcagcctgtcactaagctgcaccactttagtttttttgttgtttctggctttgggttggcagtgatggatactatcagtctccccaaacgcattagaggggatcccctccattgtaactcttttggtggtgtctgatttttgatgttgattattagctgccttaatgtagtaagttgaagagctgttttaaacctaaagttggtctctatcaatagagtaaaaaattagctttttaaagagagtctcaccctgtttcccagaccggaatgcagtggcgtgatcaacctcgtgggctcaagtgatcctcccacctcaaactcctgagtgctgggaccacaggcatgcacaaccattcccagctaattttttgttttgtttttgtagagactgggtctcactgtgttgcccaggctggtcatgaactcctgggctcaagtaatccccgtgccttggtctctgaaagtgttgggattacaggcatgagccactgtgcctggccaaaaaagagctctttaaaaaataattttgtagattgacaaatgtgactcttgtaattttattgaacatgaaaaaacccaggaatctttatttgatattaaacatttttaaaggcatctcagttgttgttgtaataacacattaagagaagtagtggttttttatttccaacctttgtgcatatagctatttaatgcctacatggatggctattatttcacttttttcagttattatgaagagattgggtttcattcatttgtaaagtttcagccagactgcctttcacaaattgatttgtcaaaattgaatgttaatcttgacatcccagtgcgtttttgcccgcgaacaggcctttgaatgaagctgcaaacacacattatctggttgttaattgttttacagatgagaactggactgatgaccaactgcttggttttaaaccatgcaatgaaaaccttattgctggctgcaatataatcaatgggaaatgtgaatgtaacaccattcgaacctgcagcaatccctttgagtttccaagtcaggatatgtgcctttcagctttaaagagaattgaaggtaagcattaatttttgttaaccatccagtcgtaagccttagcattatgtaaccctgagtagtaatagtatttgagcttgaaaaggcaaagacaagtttacagagagtggtagtttgtataatcccaactaagatgcataaagtttaccaggtgcttatgtggtgggtgtgtttccgagacgctatggaatggcggtgctgtggtggtgtgagcagggccctctgtgccagccctcctaggccacctctgcataatggatgatttcacaagcggtgtgcttgagatcagcatctgttgtcaccaggtccattctgtttgatttaccgtaggatggtgctccatgaggagtctgctaattagaaatgcggctcatctggcatgaaagagttatctctttagcagaaatgggagaattatgcagtgatgattgaaggcttaggttggttttgctggagggcaggaatcacatagggcgtggagggatcattaggctcttcacctctggagataagtcagaaattgcattcaagtaacaagaaaattatactgatatggctcataacttttgtacattcatacatacaaccaagaaaaaacttcaagaaattgaatatatgactcatcaccacagtaatcttgagtgaagtacccagagcttggtgccatggctcatagccaaaaggggtaaagcctgggtttgggtctcagctctgccgctaaccagcattaaactctcgtagccccagtttcttcttgagggaaaaaagtactgaaagaggcattcttaaatatacctcttatctctaaaatgatgtcgttgtaagatggagtgattggtaatataataccaaggattcttaaagtccaaaaatcaagcttataagggcagtaaagcaggactgaagttttggaaatgtacttagtttccaagttatattaaatggtaaggaagaagaaatttgcagtagcctacaaaataacatttctctttgtatttaccagtgctcctgaatcattagaaaagaatagagtagaaaacaatagaaataacatttgcgaattgcagaggatcctagagaacatttagtccagtccttgaacttgaacactgggaaactgagtttccacgcatttgatgagtatcagtgctagtactaatcacaccaagtattcttcctgtcacatcatgacttaaacaatgccatgggttacctaactcatttctgttgttcggttgccctttgctccccacacccattgcctgccacaaaagggtattttgccaacttcagtatgtaaacatttagggatatagatgacgtgatcacatgtctgtttacatagttaataatttacgcatacacatttaaacttactcatataaagtcatacacaatttagaatcattactttttgctattcttacatttcaggaagctgtcctaaatggtgagtgcgtcaccattgctgtcattgtctctactcaggcccccttccaggtcatttaatcccctgctcctgaacatgccctcttcactgccacctaagttgtttgagatgcagcagattttgaatctaaggatgatgctatcccaggaagttttgtcccaaaacccagtgtctcgtcacataaaattaggacaattgcatttgtaattagttaggcgtgtatttatgatctttgcaatgtggagattgacatgtggagattaactttattgatttttaaagtgattctaaaaaggctgtttgtgagatccagcatttccaattttgagatcattcccacaggaataattaccgtatctgattgaatttctttacttgttattttccaacttattatttcagatggcttctatgtaatccaaatgtggaattagttgaggtcatttaaggttaatgtatcttctacaaacagtgctttgttattcaaaataaagtaccaggcagtatgtgagatcttgtaagaagtcaggattaggggatttcccttttctgagaaggaattttgaaggaaaaagcatacttatattcaggtatatattgtatatgaaagaattagtgatgaaatcatacttaataaatagtcacgtcgttaatagtgacagagacttggaatgctataggacctcaatgccaagaaagtatgatttggaattgtgtgataaggtatcatggagggtagactgaacgatttagaatagtgatgatgatagatttcagaagtgaggccaacatggacgaaagaagaaaatgtggaagtgggaatctgcatgacttacatggaatacacttgggaaactggtctgaaagagcagagttttatgttggtggacaataggaaataaagattggagggaggataggaccagattatgaaatgtcttaaacattgtgcaacaagcttaagccgggtaatatgagcaatcagaaatcattataggtttatgaacagacagaatcagaaagaagatggtgaagtcaacattaggcagactttggttgtggtggaatgcaaactggattagcagagggagataatggcagtcaagaggctcgttggagagcttttcagctgtttagatgtgttaccacaagaaactggactagagtggcagcaggaaaacagcaaagaagagatggatatgcaccattttgatggaagaacctacggtatctgctagcaggaaagggaaggatgaaaattacacaaagatgattctagggtttctaacctgaaatagaatgatagtgcaagtaatagaagtaggaagacttttgaggagtctcgtgataaaatggtactgaaaataggggtaattattttagggcaatgtagaggtcaagaagagcttaagaaaatataggagatactacagcatgtttggatcatgaccggaatgatttagtaagaaggaaaagccaataatgtaagaaaggcgattgcaggagcaaagactttaaggaataaaaaggacaaaattgtttgtttctcagggaagtataaaagaaggtcatcatctgacattgagatggaagaaagggtgtggaaaatcaaagagaaagaggaaaatgtaaacagacatctttaaaggagaggacaaatgaattaactagggaaatgtagtagggtcacctactggtgctgacagcttacttgaggttagtggttatgcctttgaaaagaggctggccagcacagttgcgtgattttctctagttcttatgtaggtgtgcagtttaggtagagaggtagccggttgggtattttcttgaccattctggtagaaagagagagagggagtcatggggattgatgattatataagagaactttatggtgattgaccatttaatctacactgagaaggagacaaaatcagggagtcagtgatatggagagtagaggggaggttctagtgggattgaagaattaatggagtgagatagctaaggaagcaagtagaaatgaatacttgaagagaaagttattattggttgtaatgagggttagaaattactatggatgatgtagttgattgaagaggggtgaagaacaacatcactgggggtgggaggtcagataggtgagtcaggatggagtgcctctaccaatgatgaagatgccaaggaatagtagcagggaagagacatggagccagaggttctgcaggtaaatgccacacctccgtgtggctggtgataacctaattgcttatgcttcaagtggagaaagttttattttttaaaggggaaaaggaagaatgatctttaagtagcagtgagaacaaagaggatacctatgccccttccaggatttatggaatgtgggagataaagccattcccatttgagaagacttcaagggaaaaagagtaatcaggtactacctaggtttcaatttacacaagaaggtgaagggaacatccagatggaagaatgagggcagaaagaattttgttgataagctctagaaggcacagaatgggatttgggagggaggcttgtacagggcatgggtgattttgcaaagccaggaggggttaagagtgcagtgatgatggatgacctggcgaatttagacttgctctcgaatctcttacaggaaggtgaatagtctagttaaagcctccttttagggactcttctttgagtagtttatagtattaagggtgtgcagtggtggggatagggcaagcagaatggtattcttggcagagcataatgagaaaacatgggtctccatttctgtgtttttggtggtgatgctgaaaatgaattcgaaatgttgctataacattttttaaaacgtgtggaagtcattgcaggccatttcaatgttatagacttatggagaatactggaaatttctgggcattgaaaaagttcctgtgtattacttatgtttgtttaaaaggagttggtcctcaattttactcagtgttttcttttctaaaatacttgaacatatcaccataaaatcagtttgttaaaaatataaaggaaataggatactggataacagtcagccgtggcttagtgcagaatagtttgtcagagtgatctgtattttctaaggaagaagtctgataaagggaatgacctgcaagttatcccaccttgatcttaacaaagtttatgcttccgtgccttactacttattcatcagtgatttgggatatgttagactgagcaccacaaaagttaaattagtgcaccatgggcacatcagtttgatgcagtagtaaaagcagtgccagcctctatagcgccagcctctgcagctgccacaggtgtgttctaggggtctctctgggctcagtggtcataagtaatgtcaataccaaaggtttccatgatgcagtgaataagttgaacttttaagtttgcctataattccaagttgggtacatggcttttaaaaaaattattgtaattcagtggtcataattcaagaattaatcagaaatgtgaaaccatgccacatttggtgaagaatataaaacaccctggaaatcattcatctgtttatttcatccagcaagtatttatgaaatgccagatacatacgtggcactgttgtagttgttgaggatacagctctcatggagcttaactccaaagggggacttggactgaagtcctgccaccggaactctagcatggagacactttcagctgtagcaagaaaccttctgccatcccctaagtacagggaagacagaggctcccagctctgtgcccacccacatttttatacagggctgaaggtccatggggagcctgggtgtcatgcaccaagggtgtctcctaggtttctcaaacttgagagagcctgatggtcacacaggcagtaaatacataaataaacaagaaaatagcatatggtatgataaaagctttggaaaacagtaaccagtatgctgtgatagagaattacttggaaaattgctgtattcagggacctcagggacatattctatgaaggaagggcagtccaaactgaaatctcaaagcccaaaggagtttgccttatgatgacctgaggagagagaattccatatggacggaacagcaactgcaaaagctctaaggagagaacaagcttggtgtgttgaaggactagcaagaagaaacagcgtgaccagaatgggggggagggaggggtaagggccagaccacctgagcccttgtagaagatgatgagatgtatggattttgtgatgagtacacaggaaagccattaaaggattgtgagcaaaggtttgacatgatttgtcttttaaaagatgaatatggtggaaaaagagactggttggggtagggagatgtaagagtatgaacagagctggctggtaggggttcttttagtagttcatgtaagagataatggggactcgtacctgagagctggagatgaagagaattaggtgcattcgagataccattggaaatagaattagcaggagttgttaatatggatgttgagggaaagagaaatcaaagagtactcttcgatgtggagtttaagcaaattgtagtgccctttactagagggaggaccagatttaggaaggacccaggagttttgggcaaattaaatttgacatccacatagaactatttgtcacaagcaatttttaaatgtaattcagtaactcattaagtagaattcatacatacatgctctatggtgtataattacaaagagatatccctgagaaaagtcaaatctctccagaaaaagttataacctcatcaggagtttgtatagaaaaataagaataacctactttgcagtgatttatcaccaggcagaaactggctgaagaggtgtctgtgttatccataaaatgtgttttcatcattgctgcatcacacatcacatgggttagattggtgtagaatatgtggaacctagtgctgcttgcacagtgaacattttgcaaaaggaggaagacacttagggctttagataattctcctctgttttagctgaaaacgtttggagaacgttgaatggtttatgatttttggctgttttgaattatttcctctatatagagaaaaaatagacaatcaaaaattggcgtgtgatactatacatcattgttttatattgagtggacaaataagaaccgtgttgcattcataagatggataaatcaaggaaggttttgtggaggaactaggaattgggtccaactctgagaaatttgttgattggctcagcagaagggaaggagagtttaagagcagccttggatagaaaagagaggacggacagagaggtacagataggaagatattaaggaggccaaatcagtgggcttcagtggctgattgactttcggggatgaagaaagggaagacttccagattgtgggaggactattatcaagataaatgctggagaggaggtggtcaggatagattttgggaggatgataggatatattgtggtgtcatttattagaatgtgaaatacaaggagagcagctttgtgggaggttggatgaggtaggtactctgtttggttatgtttgaggtatctatggagaatcaaggggaggatgagagttacaggtctggaactcagagagagatctgagctggagataagaatttatgagtcaccctctgagggagactgtggtgtctaatgactttttgagtacataaatgatgtgaggagtatgagcatttttaggaagattaatgtgacagtaatgtgcataatggaggaaaaaagtgactggcaatgttaacacacgaagagtgataccaagtgtatcttatacaaaaggaccccgtgcagggaagctggcacaggaagtgactcctctgttagcatggtagaagaaaatccaagggttgctactgttagccaagtgaaagtctaaaacacaattgccagtgcccatgatattgagatgtataaaatggaatacattattttaattaattgttaattgattggttgactaatttatactcccttgttcaaaaaagcctttaaaagtatctgactatagtagagctggtcagacccacacctggaattagggctagttcagagtagaagcactgaaatgattaagtaattggatagagaggtcaagaaataggattatagtcatagactctttcagtccagaaggtactcagcattctctacaagtaccttccgaggcgaccgctttcagtttagagctgctttaattgttgattcattcatgcatttattcatgtattcattcaaaaagaatgtattgagcacatgccatgtgccactacacctcagattcactagggcaaatttagtttgcttttacctgaggactattttctaaatgacctaaattgcaacacattttcaatatactatgggagcttgctttgtttttttgtttttatattttgattttacattgtatggctatgttctctgaaatgaaactaatttttacacaaagacttctgttttatagccttttttcttttcatttttaaaagcgcagataacagttgcctcagatcattaacttaattatcctgtactctaaatttactatttcagtgctacctaaggaaatggtaatatcatgagttttttattccatttttagttttttacatttcacttatttcacttcctttttttctttacacaagtaaagcgtacgtgctaaattttattctcgattgttacctcgtccttggtctagaggctgtagtacaaccctgtgctgtgtgtggcctaataaaatgttgtaaatcttatgtcatctgtaatgtttgtcagtaaacaaatctttagtatttagaaagaaatattatgccattttttatttatataactttttttctcaaaagcattttgggtattttttatgtgcgtgggagaaaatgctcacagaaaacacccaagtaaatgtgatctggtggagctgggagtattagcattcatgccgcctttgaaatagtgcaacagaatttcctcttaatgttcctgccactagaaccgcttcatggagacacttttcagctgtagcaagaaacctgctgccattgcataagtacagggaagacagaggctcccagctctgcccctacccgctgtcccatacggagctgaaggtccatggggagcctgggtatcatgcactgagggtgtctcctaagtttctcaaacttgagagagcttgatggtcacacagagagctggcttaactaggactagactagggctagggaaatctgcatttccagcaagccccaggagaagctgctgctgcccattttcaccacagtttgagtagaaaagttatagagtgtttatgtgaatcgacttcgctgcacagagaaatggatttgttgtgctggtgtcagagaacatcatatcttcaagtagtcactggacctaattttgatttccactacttctttcattgtttttttaaaaaagcatatcttatacattgctttgcttcaaatgttaatacatggtaatgatttcattatgcaattaaaaaatttttttctcaagtaaatgttaaattaaaaatgaaatatttcatattatacaggacctcatggtaagggacaaaacaaaccctgggactcggatgctggaaaaatcatttgcttttaatagagttgatccttttcataggtttacccatttggtctttgctaaactttacaaatatgtctaaaactttatgtctatggattttttttggcaattatattgatctcctgtatggcattaaatgccattatttcaaaatatttcctaatatgttattgactgtattagaaataatcattaattcacaaaatcagatatactgaaaattaaattatatgttctccaaaaatataattgctgtttactatgagagtattatatagcagagttaaactaataagacagtcgttacaaattatcaccactgtaattgttccattggagggaggatggaaatgggtgggttttgtacattttataaggtttatgaagtttaagggaaaggattttggggaaagctcttggcctttccaaactgctgttaatatactcattgatagtggaatatatgacctttgatggcacttgggaagctaaaggaaaaatcagctgggaccttgatgataacgaggtccctgacccacccggaaggtgaggttaaatgtgttttcctttggtcaagggaagggaattccagatcctttgctcatgtcaggaaaaacctttgtgggggccaggacttagtgttttaaacttgataagtcttactagtttaactctgctaatatttgacccctcccccccccccaaaaaaaaacaaaaaaagataacctctcaaactgattctcttactcgtcctgaaaccaagcattctgtattgcaagggccatgccctctttgcttcaggactttcatgtgtacagattcctaaattttaagttacacagctgcttcatcaaacttactcatcatagattctagttttcttaggctagttacatctgaaagtggtattatgcttgtgaatgtgttgctttagctcatataatttgtttaaaaagtttattttagaggaatccagttaacactgcttatcaagtttagaaacactaagtcctggccccctcgaaggtttttcctgacatgagcagaggatctggaattcccttcccttgaccaaaggaaaacacgtttaacctcaccttctgcgtgggtcagggatctcattatcatcaaggtcccagctgatttttcctttagcttcccaagtgccatcaaaggtacttgtttataaggcagtaagaccattatgcaactttaaattttatcccactctgtttgtaaagacaatcacaaattgacaatattctttgtcttttcttttttggagcatatatacagaagcacacacacatatacatattcgtgtgtatgtatatgtatatctgtaaacacagatatgtaaagtgactttaaaatacaagtacatgtgtttcattttaaattctagcgatgtcattgggaaagaaagtgtagacaaagttacatatttttgtaagtagtgtacttttatttacgttgacagttaatatttaaaaattttttgttacagatacaaattttggggagaattgtccttagaaacatgttttaaatcgttgttctgatgtcttgataactggtaccaggaaaataaaagggttaccaaaaggcagaaaccagtttcaaattatctgggaaataaaaacaggaaactcagggaacttggcctgagaccagttggagaggagcagttgttggttgaataattatacctgcattttaactgttggaagtcatacagcgaccttctggttgttgtgatttcttgtgcccgtcaaaaaaaaaaaaaaaaaaggaagtcacgattaaatatcttatgtccagttaccaacaggagtgtgagtgtaaaggagcctctttattcctacacattaggttacaaaaaggattggtataaaaaacaaattttccagttgacatttagagtgatactttctatacagtcatctgtaaacagcataataatgttctataccattcattcatggattttttttcaccttcttctttgctttaactcttaactctgagctttgaagccatctcttctgtccaaagatgtgcctagttcaagcacttttctgtcctctttccatacctaatcccaggttggttaaaggagcaccagaagttgtaggtgagcaggttttgctacatctgggctttatttcaggattaaatagaatgtacttactatgtgtttttaaaagagacttattgttaatattgcaaggacaaaaacaacctgacaggttgagccagataaatggtgttcttgagggccgtgcctaaaacttcaccaacccaggatgcctaaaaaatgttggtctaatgactgaccttagcagggtgacatgttcactgctggggtagccctgagcactcctgcgcgtgtttgtggtttctgacttggctgtaggtgacctctcagtttttcccagggctcggcgtgtgctctgtaacacagagctgctgagttgctgctttgcccagctgtgtccggctaagccctggcccccacaaaggtttttcctgacatgagaaaggatctggaatcccagcccgggaggccttctgagctgctggcaaaggatgctgtgagtggagaccactccccatggcagagctcccttccctctaaggggagctggagctgtcccttctgtgtccacaggggttctccgcctcctgcagagcggagctgcagccccaggcttgtctccatcaaccagagggtttgcataagcaggagctgtcaggcaattaaaacctcgttagttagtgtaattagtattccaagaccatgatctgggattttggacaactcaaccaagctggacagtttatatcctgcttatgagaagaaaaaaaaaaagtctgtgcaagggaagttcaagaaagagtctgggagcataaccactttagcataaactcacagacagtcaaaaaagtgatcatttcaaatgttcttataattttatcactataggtaaggaatctctattagacactgtgttttttctactctcctgtcttgccagtattatatatttactagtatcttgattaagagatcctcagaggggaaaaaaaaaaagctcttttaaataaagagagttttaattaaaaaagaaaataatttgctaatgggaggaagcagggctgaatgcataccatcatacgtaaaaatataccactaagcaaagccctactttcctccagttcttgttgaaggttaatagagctaaccttacatgaaaattgtaaagattgccaaatttgtctttttcccactatgccctccctattcttttagtttttttccacctcagaagcccagcatcatctttctctcgtttccaccagtaactataatctaggaaaaattttaaatttaaatttaccctttttgattggttgtaccctagagtgttacctctgccagcatccccacattttaatcttaattgtgaaattcatattgaattcaatccagaaagaaggagcaaggatttctgcagtcaatgataccccttcctgactgagccctgctcacttggggaggattgtcctggggctggcccattgcataggggcatttgagatgaatatggaaaggacctcgccctaagaagtctagtgggagagatcatagacacaaggagttataatgagggtagagcagccatacccagtctgaatagtgttatgcccggtagacattctagaagacattgataaacaagaatcaaagctaactttaatcagtttaaaagctactttgtgatttatagacacatatgtttacttctagaattggcacttctttgttctttgtgaaatgtgtaacttaagaaaggtatttaggagcactaaaattaaatatttgagtttttttaaagaagcattctaataataaaatttgactcattccctagttcatattgaccttcactaagcatactgttctggggcatttgaataatttgtttcaaaagctatgagaccattcttttaatggtgcatacgctctaagataagaataatggattcccattggttgatgatacatgcaaaggtagggatatactcttacagtgtgccttcctgcttttgattcgtggtttctcttgctaagtgttttctgcatcaggaggaggtgacagcagtaagtggtgcctgtaaagttggaaaagggaaggaattaacatgaattaatgtctgtgtgagtttttaaggaactggaatgtccctctaaatcgaggatgtgttttttttgtttctggttgacaacttcctagttttcctacacttcattattcttttctctgtcactgggatttttttttcaatttcccgaaaagcaaatgaagtgctttatccttatcagtagcctttcttttcctgttccaataacaaaagaacaatacaggaatttaataatgttaaaaaattgctgtgtctttttcttaatatatccatttatatgtctgcagataaaatccaagttttacagacatagaggaaagctgtttatataagtaaaatgagctactattgtatcttgtccttgtcagggttttctttttttgtcttttcacccagtttagaaagtggattttttttttctctttaaaatgtgtgcccatgttctgttattaagaggaaaagtcctgaaaatacaaagataggtgaaaacactggttatcctctaacagaaggacactttaaagattcctaaaacacattctgatcttgtttatgtatctatattctattaaatattgttatttactcttcctgctgctttggaaaaaaaaaaagtccaatctgcctcacagaccttttataaatatcagagttgtggttttgcaacagtgtacatgaaaagacacttgtttcagtgtttgagttcatggcagggtgcattaacgtggcgtctgcaagtatccttgaagccacattgaggagggaacttgggacttgttccatggtggtcctgctctgacctcagaggaccttgcttgctgacttttttaaggcatgaaacaaattctcatattctcagtcgtgtctgacgcagatctgggtactagtcagggttctaaactgcctaaataaatatcttgcatataacatctaaagtgacatttatctctgtggtactaaaaagaaaatactattccacttacatgttcttggtgccctttggcattttgattgctaattacaataggaccttcagattgccttctgattgagacctaacttatttctgtttcatctggaatttttcaaatacaattattatgtggtgttaacacttcattgcagcatggaactcccaaaaatgttgtgtatatattctttcatgcctctcagcctggcttcatgtctgtctaggtacaggtcttattataatgttgcccttgggggtccttttgatatatcaagaactaaacctctttagtcaggagagtgtattctgtatggatttataataaatagtctgtgttcatatgcataggaaataatgcattttctgaaaaaaattatgcatgtcacttgtattttttgtactttatgtgccggaagaacattgtatacaaatatgtcccatgtgcatgtatgaatttatatagctacatgtatataagcacatatacatccatgatgatatcataggtaatatgtggaaataagtgcaaccatgtgattatttttatcttattctttgtgtgtgtgtgtgtgtgtgtgtgtacagttacctgtgtgctattaaatgtgacagtgccgataatagtgttacattctctggttaagtgtttcctgagaattttggtcttccttaatggtgcacattagttatagactcttaacccgtgagatacattccagtggttcgtttctaagaatcgatgtaatattatgcactttgtaaatagcttatagaggataagctatgactcctgaaataaatattattcaaactgcttccattttcatttcccttatcactataacaaccacacccaactttgcaattaaattgtgttgtctatctgcttcccgcacactagtgaagctgaccctattgaattcaaaggaaatatgagagataaagtcgaaaactgtcttccttttgttgacatttctaaagcaacaagtcagaaagcttgactccctttaggtagaccagagctgctacgggtcatgattagatggtatgtccactagtaactgtgatgacgcccaacagaattatttgaaacattctcagtaaataaccaagaactccagtaagcaaaaggggagtagctgttaacttgcagtttcagttttctacaaatgggggcgcagggggtggggggcgcacggaataccgaggacaaaggtaaagatcgacatagaatggaagtcaccagatttctgcgtttaacccattcttgcccagcccaagtgaaattgtgttttggagaagcctccatatttggccatcgagagattggcagtgggaattcttggctgtattttactgctctctttattgaaatatttgccacatctgacagttctgtcactgttcagttcagagggatttttaaatcatatactgactttgatgcttcatggatttgtattatttgtgtattcctcagtcatactaacctttgtatcaagatttttgccatatgactcatatcaaagtttttaagacatatttaaaacaaatgaattttaaatagtggcccatttgctatatgttaaatttgatatacaaaattttatacatcttaaatttatatatctttgatatcttaaatttggtatacaaatggtggcccatttgatatatgtttgcttaacataatgtaacatgattgattttgttatatttcccatgagctgaggtactgttgttttctattaccagagaagacatttcagatcttttaaatcttatgtgaagtacttcctaagaagagaagtaaaatgagtatatctcacattagttactattatctgcagcatcaaaaataaatgaatatccccaggaaaaaggttataaaattacaacacctagacacattgaggtaggtagtaaatgtgaaatgggcttacgaatgactttattcacttactggcatttgggagggactcaggctgtcaggaaaatgaaccaatctgtattaatataaagcgctagaaatataaataaatcatgtttgaaagcgataccaggattttccttgaatgctgctgaataaattctgcttgttaaatgtcagtgaaatgtatgtcacctgcatgcataaagtgagagggccacaaaaaacatccacttaccactttgaaatatgtaagccctttaatgttcctttgaccttcagttaaaggacatagtctcatagcagaggaaatgcctcaaattctagcatctgggtttgtttctttatacttttttggcatagttacaacagtagggcttttctgtcctttaatttttttcacagtacagtcaacacaggcttttcacacaagcgggaaaggacggttgtgaggccaaaagcaatatgtttcttctctgtgctccacggcagagcctaattgaatggcttgttgtttcagagagagcccagaaccaacaagcagacaaacagaatcccacacaaatacaaattgcgtataaaattagatacctacacacgtgcgtatcaatggatatgtactaaaaatgcagtcagcgatctcttattttgagctcattggcttagtcaccgtgttccaattctttcatctttgcagtttttggattttcatctgaattttcagctggctaaagatgtttcttctacagctgaaaagagaacctagtttcattacatacacttgtaaagtgtatgtatttggatgggggtgctctatttcagccctattcatatgtcaaccatattgtcatttatcattagcaaaaggtcacttttaagctttgcagaatgaaacggtgagatccgattttccattaattaaaaaatatacatcataacagtatgctggagacatcttcatatatttgtgttttccctgctttacatccaataggtttctgtgtatgagcttctcctgagactgaataatagcagcacaccctaatgcaccttttttaatgggaattcagttgggtaccatatgcctttctcactgctgaaggccttcatgctttggcatctctgctctcatcttaccggtgattgtgggccatttgtctggttctgacatggaaatattaggaagcagtgctgttatatacaaatccttatagccttaaaattaaatgcagctctcaaaagcagcctaaaagttaaatgacacacaaaagcttgttttgtctgaagtttatatgtttattctgtagagttacattggatagggtagttatcagcccttagcaaatgcctacttagttttccttaatctgttattcattcattcattcaacaaatatttattgagcgcctgctctgttcagacactgtgctagattcagggcaaacaagacagataaggttctagtccccccccgagctttcagtcttaagtggcaaaaataaaattatgtgattgctgttgacgtacagggtactgagactgagataggatagcttgagaaagtctctcctctgaagagctgatgttttaagttggactgaaaggtaagaaggagctggctgtgcaaagagctcgtggaagaacattctagacagagtgaacttgcccatgttcagtgaccccagtatgggagaaagagttttgtgtcccgagggacttaaagttgtgatgtggctgtagtgtattgagtgagtgttggggagagtggcagaagaggaagctggagaggcagggaagggctcagttacacagacaacatggtaaggagtttggattttattctaagtataataggaatccatgaaagagtttgaagcttcagatggagatgagaggatgccctttttaagatcaactgtggctgccatgtggaaaatggattgtagcgggaagctagagtagaatcagaaacattatttaggccactgaagaagagcccagccaggagactgctatgtggctggaccagggtgctagcagaggagttggatagattctctgttccatttggaaatacagttaaaagggctcaattaggttggatttgggggtgaggttgggggtagacttcagagtgaccccagggttctggcttgagcagttggtaccatttcctaagatgggtaagactgggcaaaaactaaggggagtcaaaattacctgcttgagaaactgagagtatactggaggcagaagtgattctgagtccttttcttcgtgtggtgatgctatttggaaatcaagtcattagagtgtttcactacctggaacacatcagtaaaattgtgaaaattccaccttggtagctcttggttacagctcttcagctttgtcttgtgctgttttatctaatcctctgtctcttctgtaggctgtttctctgacctttggagaaggcttttgtttcttccccagggatgtcaacacaacccatatcccaatttgtttggcttccctttaaaattgttcatagattctttctgtaagtttttcactacatgcatctactatttcaggcatgattatcgtcacactagaatcccggtggaaccaaggctagctgggggaaatgaaagattgtgagtgtcatatctcatgcacactccagagcatgtggagaagcccataccatttaaatcattcttcctccatcccctaactgaggacttatgtggtaggaccttattatacttagtctatgtctgtgtgcttatcataccacattttattttcctgtgtgcctgccaatatcctctgaaagcagggacggtgcctggcatctaggggatagttaatgagtgtctgatgatttaaaaaaataatggattggggctgggcacagtggctcacgcctgtaatcccagcactttggggggccaaggcacgcggatcacttaaggtcaggagttcaagaccagccagggcaacatggtgaaaccctgtctctactaaaaatataaaaattagcttggcatggtagggtgtgcctgtaatcccagctactcaggaggctgaggcaggagaatcacttgaacctgggaggtggaggttacagtgagcagagatcgtgccactgcactccagtctgggtgatagggtgggattttgtctctaaaataataataataataataataatggattggaactatggaactaaattataaaagataactttcatgatatgctaaaaaatgggactttattgccattgaggaacctaaattataaaagataactttcatgatatgctaaaagaatgggaactttattgccattgcaagcttgtgaggagagaggtagcatgtgaagttaagactagaatgaccggttccttgattgaaaacaatcaataaaggtgctgtgaacagattatcagaaagtatctgtaagtataaaacacattcagaatttagaaaacaagatgtaactcctactacaacactgcgtttgtcttctgaaaggaagagacatcacaggtttagtattttttgacctgtcatttgattttagtttacgcctaatttcatttaagcttatccttttggccatagtcccatttcttttcagtgtttttgctgccagtttttcagatacagaaggaaagtcatatttgctgtgtgcagttggaagaaaccctggcacagttcctccagaaaccaaagacagaaattattagccatatccagaccagtagctgactggctccaattcttcctcccatgagctttcctgattaatgggagaatctgttctgtagtcgaacagcctctttcctgagcccagtctgtcctggcttcagagcatgaccagctgtgcagctgaagccattgccagggctctgtttctgattctgctcctcagcatgttggaggtgttggacggggaagcagaggggtgggaagagcatccaggtcagtttagatgtttcagcaggtaacagacgtggcaccgtccacccagaatcccgccactcccattggactctgtcctcttcagaaggctgtcattctgcatggtgcagatgttgcagtccttcccttattcttttgtctttttgtccagaccacttagctcctgtgtctgtggtgattaaatgctttgtaactttttctgacatccttttcttcacccctcttctctcttcccctactgtctcgcccaccatacctcttctgttttctgtttgcctttctttcctctcagctattgcattttcccctttacactgaaatagctttgtttattggcctgtttccagcaatattaacatatttcaattttttactcacctgtttaccaatttaacaaagctaaggtggttcatggcagtatttggggcctgaaatatgaaatactgtcatagcagattgtatacgttcaatttctgttacctttctcttacctttcttccttattctagactcaatctatttcatttcaggggtctgttatctgagtgtttggagtttgggatccttgtaggatcttcaaagctaaagacctatctccactgcatctctgagatcttaaaaacaataatatgaagatccagaataaattggtgtcagttaaactctaaccaaagaaggtttaaatgcagtgagcatttgagtgataaataaggtacggcccgaactcaagaggcttccagttttcttggggagacaggcatgaacaccactcactagaatagaaagtagaatgaaataagtactttcataatttacaggtacgagaaaaatgcacaggattactgagaaaggagttatattctgactaggaaaatcagaaattgtggcattttctgtgaacattgaaggatgaacaggatttcagtaaatggagaagaaaggcaggagggcttcctagaccaaggaggtgatggtggtggtgggtggaggagaattgtgcatgccgatcttctgtgcagcactgggtggcaggcacattgcacctaaatgagcactgactatgctttcaagaagttgggactaagggaacaggtgcaggttagaattgtagcctgaaggtaaagtaagagctcaaggaggagtgtttacttcctgaattttagaaatgtagcatgtttataaatagagccagcagagagggagaaattcaaggcacagtgcaggagtgcaaggccccaggtaacacgacagactcttctttgagtcctgcctctctcacttttcatgtttgagctctttttattgtttgctttttgagatggtctcgctctgacacccaaggagaagtgcagtggtgcaattatggttcactgcagcctccacctccccaggctcagcttcccaagtagctgggaatatatgtgcacaccaccctgcctggcgaatttttgtattttttgtaaagatggcatttcactgtgttgcctgggctggtcttgaactcctgggctcaggcagtccacccacctcggcctcccaaagtgctggcattacaggggtgagccaccgtgcccagccacttgagctctttattctgccatgtccgggttccccttttctatgcaatgcagaggtggtataaagccactaaaccaaggaatcagcttcagaaacaaggtaaagctgccttcactcaatgggaaatcacatctatagatcaccgctctgttggcagggtcagatgactgaggtgtcttgtgtcttgatcaaaagttttgtttccactgggtctctgtcctgaggtctccatggatctgtgaccttggacaagtcatttaacccctaggcaccttccttgccctctctgttaaaatgagatgatggtcccagcgctgtcttaggcctctgtgtcaccaccactggagttgtttaaaatccaggctgtataggttctgtctcctcttctcctcccactgccttccccacttctccttcctctctcctgctgtagtcattagcctgatgtatcctgacagtatccctgtaataaatataagtggaatttgctaattaaatgctagcatttttaaagaaagtttccagcaattggtagagtagctgagtggtttataggcttcctattcaagagggaggtgtcctaaggtttaaaattaaggttctagtcataaagaaggcttttattattaggacaacatggtaatttggttgagagaggacttactctctgcaacattaaaacatacatatacttttgacagtttcagtagtagctttgtccttttgatttacttctttggacagttgtgattgacatcagattgaacacatggttcagtaaaaactacagctccttgaagtacttttgttaatattctaatctcctatttgcatcattaacaagagcacattttattgccgcttgaaatagactcattgacatcccagaataggtagttttgatattagctacttgttaatgctgcccaggccattcacattccatgttcttgataatgtaccacgttcttagtacacagcccttacttaccacattgaagagactgaatgcactgattttaagaaggaggtcttgtgcctcctagggggactagctcttttagtattatttctcttatttctgaagcttatgttagaatctgagcataaagcttcatttcattttccctggagccaattatgatctcaaaatgagaagtgcatgagtaaataaatttaaagggggcttttgggaaatgttctgacataggcgatctgcgcagcacatctgaaatacctgggatgtggttatatacagtggtcatcatattcagtggtgacattcagaaatgatggcagtttataaataatcctaatttgtagcaaatatgtggctttaaggccctgtgatgtgattgttttctttgttctgttgatcttgtgactttaaagtggcattcagttctctgttcattttaaatgtttgtcgcttctgacttctgtttcctcttattgttttctgtttttgtgtttgagcccttaactcaggtgtatttatttccccctcccaacttcctgccctctttcttcttctgatatcttctctttgataaccatgtcttccatgtttagtgttctcttgccctccagcaacctatgttagtttggttcatttgtttaaaaacaaatctcctatttttgagaatgagaatgtggtgttattaactaacatttagagcatgcttatatatcagatgtccccaggcattttctatggattatgttatttaatatacccaagaatcccatgaagtaagttaaaggggtgaagtaacttgcccaagatttcacagcagggagaggtagagccgaggttggaacccagatggtttcattctggatctcctattcataaccaatcctgttactttattgtctcaactgttcagtccgtcaagatttaatgatcaccagcgttgtcccaggcacagtgcagacacaaggacactagatccctttctcttgccatatgtacggggtcttaagtgccatttgagaggttcttccatagcacctgtgcatgccagtgcctaactcttttcaaaagttcaggaggtcttcatccctgtggagctgaggtttgcaggataattaagagtttgccagctggggaagcagagaaggcatagggacatggggtaagaaaggagagcacagtcgacactgcaacagctctcatgtgactggagcataggtgctgccatagcagaacagatgggcagttggggaatacgtcgtggggttggttgagtccaggtggccaagggctttgagtgtcatggcacagaatttggacttcatttttcagccatttaggaagctagtacaaccttcttgagtctctcctgcctgttttgcctcattccacagaggccactggagatctggaaaccccgtggtgtttaacattggcagctgagacctctacgtgatcagcttagaggaaattttattgcagtagcattgtaaaaactagtgttttcatacagtcttttgatccttggtcccgcataactactgttaaatccaaaaccataagcagaaatttaacatgagtgcttatattcttaacttgtaagatgaatacagagatactttccaaagaagtttttaatgtaaatttaaatgtatgacttttatgcaggtatggtatgtgctttttcctgattaaatttcctttttgggggagaaattgagaatttaaatgatgtcatgaaacaaaaggctttggatactgttgaaaagctgcaatcagtactgtttaaaatgcttactcactattacaattaatctttataaagcaaacatctttcttgatgggacttttttcaaaaaccatttttattagtctgttttctggtggtagtaagatgactagatatgagcccagtttaaactcaaattcttacttttccactttcagtaagaaaaataattagcattaacatttcagtggaattgcaaatatattgccctagcttactcagggaaagggaattaccagctggcgaaaaagcagtagaatgaagtgtagtcaggcgttatctcacattgagattcttaggtggggactctttgaaacaaatctcaaaaaaattttaaaatccagaagatggcctcttttcacagccattaccttggaggcccattttcttgtcctaacgtagctgcccttgcatgaaggaggaatgttttttgtgtctcttgctctttccctcctttctttccttctttcctttttttatttttaattgccttcagtgtttgcagcagttttttcaatgcctttggtaatggcaaactttgattttttgaagttggatttaattttgggaaacagccaaaaggcatatggagtcatacctgattaataaaataggtaagcactttggagaattctatttttgctaaaacataagcttaaactattaggcactgaggcagattttattgtatatctcatgaactgcctttaaagaaaatgtcaaaaggaacattacagaaaaatgttgagaagtggcagaattgggatactagatagcttccttaggtgactttgaagaacaattttattgatgtgaatttataagtcctattattttgtttcttgggggatttgtctctattttgcggttttatcttatatattcaatatagttaatgttctttaattaaaaaaaatctttaggatactttagtagcactcagtctttaatttgaatgtctgttagtgtagtactatatatgtggggatatacctgtaccagttaatagagtgtgtagttaataaaaggtggcagggtggtaaacctttctccccctgcataattgaatagttttaagtgccatttgaaatcctgaatatccaagattggattccaataactgtgtagcctgagaagctttgctgtcagcagctgctggtgtttgtaagagttatttcactacttatcgctcttcagattcaccatgaatttaggtagtaatttaccattgcagaaggggcaagctctgcttctgatagtgttatgatactatgtttttgcttccttaatgatacgattcttgaggtagaaaaattaaaaatatgtggtataaatcagcttcatgaattaaattccccagatttaatgatgacagttttattcctgggatgcttacgctataactccctaaatgcttcatttaatacttcggaaatggttgttctcataggagctgttattgcaaagtcagtaatggctctggggctgaaatttgctttcttaattctagtccattgtcttttgttgtcatgtttcctcagtttccttagatatgtcacaccaaggactggttacagaaatactgcagtgcattatccaatctaagcctgctttactttctttcaaatgagcttttaagcatataagtagcgtatataatggaaacagaatttagggtgcttaggtaagaaaggaattacttccatactagagtattttacagctttgtttgatctcttaattgtctagatcagagattcttgggtactttcaaattcattttaatgtaccatagccctttaaaaatgacaaataaatttaggcagtttgttttcagaactgatttgaagaatttcagcatactatttaaggtaagtagtcctatactggggatcctaagctagagtcagcttggactcgttgaaccacgtgaccacccagggtttcctatagagcacgtttttagctatttaaaataattaccatgctggacctggagacctgtgaatagtccataaagttaattacaccttgagacacaccctctgctcagctactcaagtaccgtatccactttacaatgttcctttgttaacaagatctatgtggttgaagtatgtattatagtaatgtgcaattcattgtgtacagacatttccaaagtaagataatggtaataattacacagtaaaagagttcaggccttttgcgattgttgtgtagctaggatcggaaggctttgtaaacttgatatgtttttgcatactttgggttggtgctacctgattatggtactaaagtatttgagtcctctgcccttgtatcatttgtttgttagactttacattgttgactgggttccatgatttataaaaagatcccagaatcttttgtaactatttaaaggtcagcagctaatgataatcagaactaataatagatgcttacttatgcgccaggtattagtctaagccattgatgtgttagttaatacctctcaacaagtaagtgaggtagagacttttattattttatagatgaggaagctgaagctaggaaaggtgactgaggcccacagacttgtagtaagtggtagaacaaactaggcagacaggtacgtaggtaggtggatagaaagaaatagagaaaaaaagagatttaagaatagtagaaggtgtcagtaaaggatataatagctgatttcctgcctgctgtggtctaggcattatgttgggctacaaggaaacaaaaatgtatgaaactcaggcccagtcctcatggaaatcacatttggtcatggattaccctgatataagtgtaaataattaatgatgcaatgtgaacattttataaagtaggttgtgcataaagtctacgaaaatagactgagagaaggaatccaacttgtaggggaggcagagatgaagagatattcacagaggagaaggcttttgcttaaagatgaccacagtgccctttgagagtgggaaccatgtattgttcaaccgtgtctctccagatctctagcaaagtgcccaggatgtcatggttgctcagtaaatgttgggtggtaggtggtagcagtctggccagatgggtgaatgttggggaagagcattgtaggagatggacatatctgatgaaaagcacagaggcagataaggccatggtatgctcatccacagtagggctgtgtccttgggaagtaggacatatgggagcatggccactgtgctacttcacacatcactctccttttacttttagtctctactcccaacatcctcactttacctgctttaaatcgtatttgtatttcaaaaccctgataaaaatttctcacttcctccgtgaagttttttcagcagttgccatgcaccctagtctctcctttctctagtcacaatcctttttgttcctgccactcatgagcctcaatggatatctcacttacactgatttgatctttacaaattgtatgcatgtattaaattatcatatgtacccacccccaaaatataacagattgcctgcagtcacctctttgattattgttttcttttgttaaattatttcctctattctctcttcttggagtgcagagaaccttaggattcatatgctacccttcctattggtacaagaggacacggaagcccattgagatgaaaataattgtccaaatcacgtaagcagttaaagtcaggcccgggactgagtccatggctgagaccaatccatgctagctaatgttcctcttgttcttccgagctcagtagtgagtttgtggaggtgagggactgggtatcatactcactgtgggtcaagtagctgctcaggaacatttgcaaatgaaagaatgaataccacttggctttctgagtaatataaggataatgtggttcccagccttaataaacagctctagcagactaaacatattgatagtaagccctcaactgttagatatactcattcagaaataatatcagaagatcaactgctgagcagaattttcatgttaaaactatttcactaggagtactggtacaggtcggtgttagactcattactgaaaactcacttgaagaactctattagctttacatatttctagcagattaaacttagattacttacttttaaattattattggaagttagtctaagttattttccaatatagaatcattgtcttaatttaataattcttgcttcacaataacataatttggaacggaaattagattccagagtgcccttgtaattacaaattgaaaaatccttttctgactcaaaagggggcttactggtgacaaattccattatcagcaacattctcatcagaggctcagatgaggtggtgccttctgatgcattcttaagtgggtaatgggtagaagagttaggtgtgaggttattgctaaatacgaataaccatgaattatacaagatttattactcagaaaccaacagagtagagccttgcaattcattgctttaacattcatgaattcagttatttatgaaacagtgacccagaggatccatgtcatgtagtggtttgtcatttgaatcaggtgaagcccctgtgcaggggaaaatcacttagctggtgacaagccaaccacccaattgtttttagcccattatcacatatgtaggaagtcatgaactagtcaaaactgttttctttgtgaaagaaggcctggtgatgggagtgcagaggaataacatgttcctagaaagtgatgattctttaccaaaaaacagaaatctgggaccaattaaaaagccggcatgctgtatttggcaatagattgaatctctgaaatgcatagtccagaaccaagaagagcaatttctggaaatacctcagtgagtgtactggccagtgtaaaatttcactttctgggacaattatgatccatccgttttttataggaggcccagtaatgatatcttgactgaattgcctttttgagttacaatcattaatcttgaaggtcatttgagatgtctcaagtctcttatttaagtctttgagatcaagtaaaatccctagcatgtatcaatagccacctgtatcaaacattgtgtatgttttttaaataaagaatatctggctataggattcccttagcctctttggaagaaattatcttgaatagggaagatagtgaagaactggtatgtccaagtagaactaggaattagagcaatagtctggatcctggagctcagaaaatgggcagtaagtcagggacaaaaggtggcttcttaatctgttgttaaaaattacttagagtagaaattcacattgagccagtccatcaagctcccagtatcactaaagaaaacctgtggtactaccactcccccttgtttatatctgacctcccacaaggctccttttttgtatgtgtagtgctttccctattccagacacatttttatgttttttaattataacatggacaaaggatagcattgacataaaccccaaattttaataaatgactttcctgaaaatgagagtagcagtgactttaaaaatggtaagaaaaggagccgtgcgcagtggctcacgcctgtaatcccagcactttgggaggctgaggcgggtggatcacgaggtcaggaattcaagaccagcctgactaacatggtgaaaccccatctctgctaaaaatacaaaaattagccgggtgtagtggtgtgcgcctataatcccaactactcaggaggctaaggaaggagaattgcttgaacctgggaggcagatgttgcagtgagccgagatcgcaccactgcactccagcctgggtgacagagtgaaactctgtctcaaaaaaaaaaaagaaagaaaagaaaaagaagaggagaaaatggggaagaaatagagaaggctggcttcatcctcctcatttgctaggtaggagatctgcagtgccttcacaagactagggaggcagatgcatccactcaatatagggatagagtctttcagccatcagcaggagatgttcaggtaattaacttcccctcataaaaccaaggatcagaacaagagcagagaagcactgtttgaactgtgaggaagccatggcagcatgagagggtcttgtagacagaaagctttcagaggtgggagccgtaacaagccaaggcctgaagcagacacacaacttccacaggaagcattctaccatctttcatgttgagacaccctgtctagtcttaccagtggctctggtggaagagcttctactttcctctggctggacttcatcttctgaatgggttaaggagactgccagaggtctaaacttctggggattcagttgttacagagaagtccctatggtatggaggccctaggttgttcctcatgggcgctctctctgtctagggctccagccccaagatccttggtgtacagacagattgcccttgtattccatcttgcaggcctgccctggctcccattcctagcccatttgttcactgtgtctcagggggcgaggctccgcctgtgtggctgggtagcctatcagcacctggctggtggacagcactatagctgtcctatgactaaaggttgctcttctgacctttcttagccactccactaataaagggttatttttgtgttggtttggtttgtatgtttagctgatttcatgataaaggaactttgtaatcaaacactttttcagctagattctaagcaattttaaatattatgtaagagatcaaataactatcagtgtaagatgcagactacagactgaaaaatgagaaggttaggatgatgactgtgtgttttgatggaagcagtgcaggacttcccaggagactgggcttctggccctgccttgacattcataggtaaatgacccttgggcaagtcatttggcttttctaagtcactgttttctttactcatatctacgaatttctgattaagacaacttttcttctcctttgacaagtaagtcttgtagacagaatcattcccacatttgtatgtaatattgattcccctattctcttgtagttaaagcttcaaatctctaattcatcttttttgtaggaaggattagattgatttattgaaaattctgagctatagaatactgtagaagaagcctgggctttctgcttaaagttcatatatacagaaaatctaggcttgtggatgacaaagcgttttctgtacctcattgcttttattaaaatacccaacttattatagtgtctcttatttagcagttggttaaatattcctggagttaatgagtaagaatcttctatcttgtaacaaatagatgtagagctttggtaagaagtacacatattacttgtttgagtgtttctcaagtgattcagaatgctttacttacattcgctcttaaggcaaaatacttccattattcttacagttcattgtcttaggaaacttgttgcagaagtttctaattgtccccatatacatgtgttcattctcctcttcctgcgtagatataaaatgtttaaagatacagtcacccagaataaagacaccgttgagggaggtgtggccacgtgactgagtcctggtccatgaagtgagcataaatgacagtgctccttttcccataatgctgtttagagttgcgccttccccttctacttttcccctctcccacagttggaataccatatggacaagggctgcaccgtagggattgaatgggcaaaaaagctgaaaggaacttaggtccctagcacctgtgtggagcccaatccccataacatttatagaattaaatttcatgacactcttattgcacataacacaaattcccaactactggcatgtggctttgtgagagctgtttcaccataatctgttgagacttatttgtggaatcatgatgtcccgtgacatttgaaaatggaagagaatcctggaatatgggagcaacactgacgcagaacacagtgttcactttggaagcagtcatgatctcttcttgctgtggaagcctcaacagtttgcctgttccctccattgtactcctctctgaattctctctcaggcctagatgctgggctctgtgtgggttgctgtatggtatagaagaggatgagattggcggggacggctcttgttcaggtccatcaagactgtcgctgtcctctataccttgagccagctctactgtgcatttatagaaaagagagaccagcacacagaaagagagaaagcagctgtttttagggggaggagagaagatggtggagcttacaagagactgatgtttgcaagtggatatggtataaagtagtagttctcaaagcacggtgcctagacagcagcatcaggagcctgtgaatttgttagaagcacacatcctgaggcttcacccaagaccaggggataagatttggcaatctgtgcttaaaaaagcgtttgccttgctcacttctgagaaccagtggtctaaagagtgttgggaagcctgacagtggtagttacaagggtgtaccctgatgggagtcctgggatcaaaaagacttgaactagaagtaagggaccaggtgagggagcattcccttcagagagagttgttaaaataagccggggttctcatgatgctgctgaaaggagtgtaagtactgtacctcctgtgtttgggaccaagggtgtatctagccttaggcttccattccagcacatcccgtcagccagatgtgcaaaagttcctccgtatacacactgtactgcttaaattgctggtattttgaaatagaaaaaggtgcttataaacccatactgactgtgatgaacagggagtactttttccacctacctctgcttgggaggctgaaccccatcttgccctggaagatggctttgagccagaagccaagccctttaatggctatgaaggggggaaaaagtatgatttccatgtaagggctaccaagaatataagtacctatttaataaattatttgttgaaatgccttttctattttggtagttgaagtttgaaaaatgtttggagtactataattatcatttctgggaaaaaaatacacattgcagtatttttgtttttgctacaggtcaagttgtagttcaggatggaaagtaaacacatccctttgctcagctgcagctcacatatttgtagtctctgggtgccctcttggcagtcgtggtggatacccaaaggacacaaacagggcatagaaacgcggggctccatcaggggcttgccccagtgcaagtctgattaggaagtttgctggagccgaaggaatggcccagaagggtggagatgccttcacagaaggagtcctaggaccagaatgaggctgttctcagaggcatgcccacctctgggaggggtctgcagaagcactttctcaccagggagagcctttatggtatgggtctaaacactgggagatctttgtttgtttttggaggcactccttaccattctatgccatcttgtcaatttgacaactttgtaaacagggcccatccacacatcttgaatgtagaaatagctgagaacagtctccaggagaaattacctatataaggctgcttccttccttctctccagagtggagacgatttataaagagaaagtattggaagctgacagagaaacagcacttgagagtaaaacttttggcatgtaagaggactgtgtgtgtgtgtacccatgcctatgagtgtgtgtctgtgtttcagaatcaactttacctttctgagacatagcaagcatggagtgattacatctgtgccttgggacatcgcgttaggtgttaggtttaaaacaaactgaggagaaaacataagaacctgtgagtactctgtgtgtgtgtatatgtatatacacatatatgtatgaaatgtttttatacttacacactttatattttacataatatgaaaaagtatatattcttttactctccaaggcagtcttgtagaataaatgtctttatgccctgtacactctattcagcaccctctttttgttcttgctatatcattttaattacataagtaaagtcactttcagaaatctcagatcaacacacgatattctttgaagtctttctaaaaacatctgaaatccatatgccacctctgggactcgggaattttttgacaatattacgataatacccttggtttattgttccttgtctttaaaatcacgtaagatcacactttctactacactactaaaaactctatagagtgttgacaaatactggaggtttaaaggaacatgactggctgctcctttaattcagcaagcgtttgtcggtcttccttgaatgagcaggaactgagcatccttggaacctgactgcataggaagggctctcagaacatctggttggaatatgttcataggagacacccacaagggccagcccctcattttacagatgaacaccagacccttcactctgacatatttaaaatctgacattttattatgtacttttttcaaattgctgtcattgttgcacaaaggaagaaccaagttaccgtgtcccttcctcagtggaggaaaagttgatagaggttttatttgttgttctaaaatggatgccaccttccggtaaacattacttggggagttcttaatttctaatgtttatgcctctgtgacattttcaagctgttataaagagtcttcttaaaatgttgctgagctggctatacaaatttagttcatttaatttacctcattagtcatttgtcccattctctaataattttgattccttttttgtgggtcagtgtttatggcaaaatgtgttcggtgggggaggtattcagagaagactgtagtttattaggtaaaattaaacgttttgaaaccagtctttagttctttgtacatttatctaaaccatccttaggccttattttattgccagatttttaaaaaaataaattcattgttacattttgaaatttgttatggtgtgtgaatatataaatataattatttgaatggcaattttttctgggagtaggttggatatatttttctggtgtgaattaacagatgaaataaaatgtctctgaactcagtaaatatttgaaaactgttttaaaattcagtaggatgcaaacaggccacatttggcatccggctctcccactccccagtccttccaccccactacctcccataaaaggcaaatcctggaagccactctgaacttttttccttcctcccaggaagctctgacttttccaggaagattccagggaacactagttggatccgatttcctaagaattaaagcagctttaaatctcctgggagtgtagaggatgaaggggttgagggtccctagaacaataggtcagcattgactgcagattggagtcagctggggaactgtaaaaaaaaatatataccgataccagggtaccacttccagtaattctgtttaattggaattggtctggggtgcactctgagcttttggatttttaatcttctcctagggtttttaatgggcagctgaggttgacagtcattattctggcactaaattttcaaactatagtatgcatgagaatcacctctagggtttgttcaaacccagattaccgagccccactcccagcatttctgattctgtaggtctggtgggccttagaatttgcacttctagcgagctccttaggagatgccgatgctgctggtgcaaggatcattgtttgagaaccatcactttagagcagttcatctcaaactttactgtgcatcttgctaaaatgcagattctgattcagtaggactggagtgaggtctaagtttctgcatttccagcaagctcccaagctcccaggtgttgctgaggctactggtctaggggccacactttaagtaacaaatctctaatctaaagcatcattatgaatgcaattccataacatcgtttgggaagaaaagatgtgtggttcaggagattcctagaggcacggtggggccgatatatgccttagacctggtggcaggcagagatctggagggctcagtgcttctttggcacttggccagctgtggcttgccagggtgttggaacatgcccttggcgaagctgtactgtcaatagggagcttcattgtaaagattctctgtttgcttggagtaaggcagtggttctcaggcccaattgcacaatagaatcaccctgggagctatttaaacaagtactaatgcccaggctcctcccccagaatttctgatttaattggtttgaggtgggatccagacagtggtatttttaaaatctttgtgagtgattttaatgcacagccagggttgagaaccactgaattaagaaatcacgttacagtcttacagatcacttttttccctttatatttggctaagttatactgcacagtgatgcaaactagctttattaggtagtcaaaaacaatttaatatggcatttttgacaaaccaccaagaaaagactctgcaaagattccgtcgctgttaaatcctaaattcggagtcttaagatagtgctgggaaagtgcagtgggtgtttctgaacgagcttgaaatatgaaatatttctgggactgtatcaacaagtctaattttttccccttggggttatgattgtgcggaacaagtcttcacagcaaagcttgccaaaaaaggttatgataaaatcatggaatgtgtatgaaaagaattcacagtgtaactttaaaggagtcagtctctaaatttaaaaacttagggatgacatacgtattacatttgtaataaaagttttaagaacaaagtaatgctgaatataagaaagttcctccttttatcacatgatatctctaaggccaaggaacaagtgaaatagaacagccagcaagaaagtaatgaggatacgctaaagacactgaacctctttatctttgcaaattaattttgtcctctgtatttaagcaaaaatgtagctattgactaaatatacagataccagcaacgccgagtaggaaagttgaagctcttcttgcttttggcattatggacgactagtgggaaaatcatgggctttggcagttctgccacttgctttgtgaccttggccaagtttcttatcctctctgggtctctctcttcatctgtcaagtagacatgaagatataatctcttcttcacacaggagtacaaaggcgtgtgagaatgagtagaggcgtgccccacacgtaggagatgctcaattagtagagatttctttcatttctccagcatgaccatgagaatttaatgcttaataagaagcattatccatcaaaacatttttcttgttgagtctttattggtattttctgcctattaattgtatcagtttagatttcttattaataatcatgaagtctgtttttccacttgaagagtaggccctttcttcttgctttagagccatcatttttgccattccctttgtctggaacactcttgctttgtgttttgtgtgctttctcccttctttcatgcaagcctgtgttgcgatgccatgtcagagataccttccttcactcgcctggtgacacatggcacccgtatcactgaatatgctgcaaagcctttatcataacctggcatggtgctgtgtagctttttattgtctgtcttctccagaattgtaattctcaaggttggtctccctgtgctactgagtgaccaagggcccccgtgatactctaggctgataccacggctactctagggctttagattataaaagacatcagagggaggtgtcggaaaaaacagtgaccccagactcttctcttgactttgtgttctacctactaaatttccgctatcaaatataatccaaatttggggtcctttgaattccccgaagtagcttgaaccgcccaaggattgtctcaggatggctgtgtatctcactgtgtgtgtgtgtgtgtgtgagtgagagagagacagagagagagaatgaagaacgagaagagatttcaaaatagaagttttcagtgtcagatgtatgggactctacaaactttaaatagaaataatggtaatctgccaatgtaatttttatcttctttttttttcctcttactaccagtagtttttcatttgtctttgtgttttatttaaatttgcttttaagcagaagctcttgcatgcatttgcttctcgtagatcatgattgtattaggttggtgcaaaagtaatcgcagtttttgtcattactttcaatggcaaaaacagcgattgcttttgcaccaacctatacttccttgacatatggacctgaagagggcctaaaaatggccaagatccagtcatacacattaaagtgaccaggattgatagaaactttccagggttatggtaaaatcattttatattgggtgagcctgtcaatattttaatactaacttcttaaagattattaagatgatgaaaccaggttatttttccatagttacttctgttgcaagtgatattgtcactttggtctttctatatctgggcaggctttttttttttttaatgtctgttgcactgttatcagtgtaatcagacatagaagttattttaagtattatatatagatctgttagacaccatagggaaagagttaggagagacttcaaatagataaaattaaaaattcagaagtaatgtcagaaaaactttctaattgatggagtggctgtagttttatccttattttctccatggaaaaaacatagaatagagacagagaagaataaataaaatctgatgggagaatttatagaaaaggctgaaaaaaaaggtttcagaaaaacaattcctgatgttatggtaattgtactacatttaagtgacaagctgatgactagttcggggcagaggaagatgcagggtgagtagggattctagataatttattgaaaggtgaatagagggttgaaagaagagaaaaaggaatgttaattacaaaataagaaagatggagacttttgaaatctaaattatttgaaagcataacttcacaatttgaaggcttgaatcttatgcctgctagtcatgaagttaaaaacatagctttgaaaaattaaagtaagtgctggaaatttgaagagaagttactggctcgtagtagattttacagatccctcttggaaatcaggtaaaaaatgggaggtataggtaatcagaatgtcataattaagcttgatttaatagataacgcaagattatatgtaataaacagaggatatatgttcttttcaaatacccatctattttaaaattggttatgagaccacacatacatacacacacgtgctaaaaaccaaaaacatgcaaaactcaagaagttaacaaaagtagagaattgtacagcctacattccattctctggcaaccaggcagtaagactataaattaaaaaagaaagctccccaaaatgtagctatgcagaaatttaatatcactcttctaaaaagtctttaaaaaggaaacatataaattacttagcaacaagtcacactgaaagcaatacattatcaaaaatcagaatataaccaaagcaatatttgattgaaatattcaaagcataattaaaattgtttgtataataactctttaagaaatgtgtttgttataagacaaccaaatagaaatgaaccaagcattaatcttaaaacactagaggaggctgggcacggtggcgcacgcctgtcatcccagcactttgggaggccgaggcgggcagatcacgaggtcaggagatcgagaccatcctggctaacacggtgaaaccgtatctgtactaaaaatacaaaaaattagccgggcgaggtggtgggcgcctgtagtcccagctactccggaggctgaggcaggagaatggcgtgaaccggggaggcagagcttgcagtgaaccaagattgcaccactgtactccagcctgggtgacagagcgagactccatctcaaaaaaaaaaagagttagtgtaactttgaaactaaaattggataaggccaacataaaaagagagagaactaaagatgaacattactcaagtttataaatttaaaaatcttaaaatgttaggaagtcaaattcaacaggatctttaaaaacagtttattcttagaacacaaggatgatttaaaatccaaccgattatattaataaagagaaagccagtgtgattgatcatcttgaaaagttgaaaagcatttaataagatttaacctgcatttttaacattcttacatcccttctagccgtcaaactctgatcgacttacacttaagactgtgtctttggtagcctaccctattccacttttattacaaaggcagctcttaagacataaatccatctcttcaggctcgaactgcaaaacacacgtcgagaggtgacaatgttgggactgtcaaaaagaacttaaagagtgggataaccagccgggcgcggtggctcactcctgtaatcccagcactttgggaggctgaggcgggtggatcacaacatcagaagatcgagaccagcccggccaacatggtgaaaccccatctctactaaaaatacaaaaattagctggatgtggtggcacgcacccgtagtcccagctactcaggaggctgggacagaaaaattgcttgaacccaggaggtggaggttgcagtgagctgagattgtgccactgtactccagcctggcaacagagcaagactccatctcaaaaaaaaaaaacaaaaaaaaagagtgggataaccagtaagatctaatatgttgggttttaatggagatgtttaattgaagcatatgtttcaaaattctgattattacatactaaatattttgtaaaataaaaatgtaatagaatatgataagaatatattaatgacagcaaattaacaagagtaggaattaagtgctatttgcaatcaaagtcacaaagcttttcttaattataaaacaatgtgtttgccagataagcagtctaccaaatgcagtttacaaactccaacttaatctgcatacattcaagattcgccttctcctcctcacctctttgatttattctcctccacactgatggggctctgagagtggaattccttattagttaatcatgttctcttctcacggcagttccttggggggttatactatgaaagtgggctagatggattctctgagactcctgtttgacccaagcacatgtggcgtataggctgtagctcccatgagacatgcagtgagataagactggtaagagggagcagggatgtagctaacccggtagctttaacaaaaaccacatttctgaaagggaaggagctgtgcccagagaaatcagctgatgactcaggatcacagtagtgattcctgagacaggagtcatattattacagaggaacatagctggaactggatggaccaagtttcacatcaccacatcaccatttactagctgtgtgaccttgggcaaataaatctgaatctcagtttcatcatctgtaaaatggagcaaataataactaaccttctggggttattgtgacatgagcacatggcatgtgtgttaatgaagtctgttcttaggacagaggctgttttattttccattctgctttaagctgcttattggatattggcatgtgggtgatagccacagggagggtagaggcctgcaaatgaatgtttcccctgagtgaggcacaggtgccatgaagtggtattctatccaacaggaaaattaagtgtagtcataaggtaggtggcagaaggaaggcagcattaagactcaacccatctcatctcgttctccaacacacccggtacccagctgtggtaaacagtgctagtatttgtcttcctccatattctttcttgccaagtgcctttccaacctcctcccacgtctccttcctccccagatattgtgtgccttcctgttgttgcccaggttcccaaagtcctatctttctaagaagggacctgtttttctgaattattctcttcctctttctatataatcaaatctctaatttgtcccatagtgaacggtacagtcttgaaaatggcataaggggttctaaatcgccaggtacccctgctgctcatccaacctcatctcctgtttgtcctctcactgtgcctcagccacactgacgttcttactcttcctgggacacacaagcctgcgtcagcagttccttctgctgggatgctcttctccaaagtatctccgtggctcgtcccctcactccttcaagtctttgttcagccgtaaacttctcaatcatgcccatccattctcaccacattgtaactgctacccacttcttctaagcattccaattccctcttactctgttcttgttttcccctcatagcacatatcaccctttactactatataatttgcttctttataatgtttgttacttatgttctgtcatcctccaccaccatatcaactaacaaggtcaggaacctgtgtctttcctctttactgacatatcccaagctgctgaagcaacaggtgctcagtcaatgtttcagtgaatttactagaactataagtatgaagagtctcctatattatgtcttaggtagacaagaaatagataaggaagaggaaagatacagcaatcaaggtagaaaatgactagaggaacaggcatggttttaaaaagagatccactgctatgatatcaagacctgagtggactggaatgaggtgacctggattcttgctttaagtttaccaatgaccttagccaggtcacttaagctctggggcctcagacgttctttatctacaaaatgagaaaactaaactaggtgaccttttgggtcttatcctactacccaattctgtgtttgggttttactttaggaagaccaattaacacttacggaaacattgcctggtactaactggcatcaatttcacctaatgtctcctgaactccccatctcccaccaaaggtcctgggctgggatgatgtcttttagtctatttccatcttttcctcaagggccttatgttcgtataggtctcttaaaactcaacccaagaagctaaactgtggactggggtttcagaagccagggctttgctcctccatcgtaaaatctgagtaaacccacattgttttatttttcgcatctctaaaattgagatacagcaatgggtcggcagataatattagacagaggggaataaggtgcatttgatggagctctgctagaaatagaagcacatcaggtgccatttcaggaaattacacgggaatttggctcattatccatcttgctaagctgccacatcgtaaagtcacagactattaatagaataccattgataactcagagtgtgcaggtagagttcctccatgttgattgtcgtacacattgtctccagtttctgaagtagccatgatttgtttgtgttttaaggtacactgttttcaaagaacagcctttaaagctcttttgaattcaaagatctttcagttactcaaggaatgggtccagttttcagattctccacgccatgggtgcatcttcccttcagctttcttcattttggtcattgctccagatgttcattgtttaacacaagtgggtagggagacggagaagaagggaatttcaggctcatattttggtgtcatgggcagatcttgggtgaggttttcattgttagttaaactaagtttgaaggtttacactgaatttctttccctaccgtcctctttggctacttaaatagatcatcaggactgtttgttcttctgttgaaagtgccccacactgccctgggcataagctaaattctttctctcccttttagaagagaagccagattgctccaaggcccgctgtgaagtccagttctctccacgttgtcctgaagattctgttctgatcgagggttatgctcctcctggggagtgctgtcccttacccagccgctgcgtgtgcaaccccgcaggctgtctgcgcaaagtctgccagccgggaaacctgaacatactagtgtcaaaagcctcagggaagccgggagagtgctgtgacctctatgagtgcaaaccaggtatgcacgagctctgtctcagcagccttgttcctttgcatcagagggtagcagatccctcctcagccacccctggcctctcctttcacacgaagatgggccttctcaccggtgtcctgtgaatctgccactttgggctaatggcagcttgacttctggccttctagtcagagaaccagagtgatcatccactggtacataagcgccttcggagagcgagcgtgtcttttcctcttttcttctttttttccttcaaagtatgcttgactggggaggtagggttaaaatttatggtactatggcaatctgcttcatttccccagagaaggtcagagaccttatttgcagctatatctgccactttgaattattacatttaaaaacaatcatcatacgtaaaacagaaagttatttttagatgaatacatgcatcaaaacgccagaagtttcataatgcaacactcagccccaatctttctctttgccaattcccccgcatctgccctctttactttatagcatgtgccaagtcatctttgactgtttactcaccctctttgccaacatttgatgtactgttgtatcccagctgtttcttgctttatattatttctaacatccttgctcttgtggcagcatttccgatgtggtctgtgaacacttctgagttatagcgatttcctctttgcaagtttctaatcatcggccagttgtttttttgtttgggtttttctttttctttctttcttttttttttttaactgctagataaacgctccaagcaaagtgatcctttgtccgtctcttgaactattctatcaatcagaaatgcctctggctaactgtcactatccatgtaaccactgctggtttaattctttctctgtcttcattgtagctcttaaatatctcatccccacctctttccttacacagaaaatttgaggaatattgcagttctatagcattaactggagtaacatgtcgacactaggactgggtttgtggaagcaaggagactttggacatttgtcaagagctagtatttcatttagggactccaaaagcaagtaaatataacaataaacggtgcctctctgtttgcccctttcagttttcggcgtggactgcaggactgtggaatgccctcctgttcagcagaccgcgtgtcccccggacagctatgaaactcaagtcagactaactgcagatggttgctgtactttgccaacaaggttagtttgccattagtttgtcaagttttctcctcatttgttagcatcatctaaggtacattttgagcatgcagtttgttttcccatgagaaacctagtcctttcctgtttctctggaagaaatcactgaactgtttgcattacttggtatttatatgtatctttcctcagatcaaaaccaggtgtcatcaggttaagtcgttaaaccttatagattctttctgtaagggtgcctgtacacttttgagggctgggacctatataagcaaatatgcccctctgtatatagatagggaggcaggcagtgaggtgtctatcaagagtagacacatcatttgatcctctgcagtgaatcttgtaggtgcttaaacaacatgttcaatgtgatgaaacattgggacccttgatgtttggaatcacacatctacccagacccatttcttgctgaggtcaagaggagtcttaattcttacaatgctttctggaataacaaacacatctctctttggcttgactgcggggaagagccactgtcattttaaccctagtagcagggcatgcacttagccccctagaactagtttttctctagaacatgaggatctccgggtcctgtcctttttagtctacaaagcaccaccatagagctgtccctccttcgtacttggctttggggaagactgttcttggaaatgtagggtttacagtctgttttcccccgactactcacccctcttctctgccatgacctcccttccatcttttgcaggtcaacaagccatctttatgactaagtcatttcatgtttttcagctttcgttctgcgtttaataggatgagttaaaactgtgccttatttaactcaatttccaacctcttcttcctcagtcccagtgctaggcatttagcttctgggtttgttgcatgagtacctgtgattatgcaaatggttggataagataggagtagatgtggtccataggtaaggtaagtatcagttatctgtccgtaattgaagagacatccagaatttgttctgataattactttttccttctttcttctcataaaataagttaaatccttggcatctcctagcctttgttctgtcaaacctagtattctctaagacatatcctttatactgtattataaaacagatgcaaagatttttgtgaagataacatacattggtgcagccaccttcctatgacattagaatatgataatttatgtgcagatgcttaggaaggggtgaaatatcttgcaaacataaggtattactaatcagtaaaggagataaatggagcatcgctaacagtaacagatgtcccttcagggtcttcctgaaaaggaaggtggtacattatattggagaacctaattaatcaaaactaagccggttgttaacgaggtagtcctttagtgaggaaaatggacaattctcagttcactattataaatgccacatagagccatctgcacataggaggcacggtcagctattttttcagtcactctagggggttgaaatgggtagaagctacaggaaggtatatttagtctcaatttaagaagaaactttcccacaactagtgatgttctgtaatgaattggctgcttcctgaggcagacagagctccttggagctggatagatttctttccgtctggatggccacctgcccggaatgcttacaagaattgtattaggttggaaaggaggttgaactagctgccttccattttatcctcaagcttctgtgagtctagaaaataaaacttgaagatgattattactgtgttgacataattttgacttcagcattcaaaaatgaagaatggccagagttaaatttgcctctaatgaagacattgaaaacatagagaaggaagtcattcaacatcccactgtaaattatttgcagagaagggataggttctcacagctctttagtttcctgtatgtcagatcatcagtgacccatactcatcccctgctcatttgttcgctttgaacagggtctcctcctccagctctctcacgagtcctgtgcctttgcagttgccactacctcttcccggactcccttctgcatacatataggcagcttctacctctccttcaagactgcatttcctgctctttgaagtgttgtcactcttcggcccctgaagatgacttaagtgtccctctctgctcccttgtcatccatcccctgtgtatctttttatcatagcacttttcataacacattgaacatactgatgtttttttgtctgtctctcctgtcctgtgtgattgtcaaggaaagggagtattttgtagcctcttgtacctaaatataatgtgtcagcccacatctgttggtgaatgaatggatgaacaaacaggccctctcttagccaagatgatttatatgttgaagaaaagaaaaagaatgaatatttttagtttctagttaccttcctgccattgggttgtaatactactccctgtctcattttcaaatccttgcacttttcccccagtccccactttatggtgcggtactcctcaatcctgtagaaaccctccattccaagcacagcagtcatctctcacagcatgggatgcctttcactctccattccatctcttttcatattgctcatccagcaggactctaattaatttctcctctgtccacgtggtcttcatgcttcaaccaacaggtcccactgcctagaaacttcccacataatcctttcctatgctgtcagttaattatcgactttcatactttgttactgaattgtcgaatgcgtgaagtcttgtcttatcagctatacgatgttcctaaaggtcaggaattgtgtcatcttttcttttcctctgtatgcattagtgctgaatgagtcggtaaatgcagaatatactcaagctgtggcttagacccattcagcctagtttagcatattcagtggattcctgcttactaaggagggtgatgggatgataggttgtacattgattagagaataacaacccaaataatcatgtgaaaatggaaaaaaaaaagcctaacatgtaataataatggtagtattttaagagaaaaactacgtaactttattcttgtgtgtgagccatgtcaaatgtccactctttaagagcatatttaggcataaagaagaagattatagaacatataagatcctattatgattatttgacttttaccagcatacttataagagcattgttaagaaattagagccatttgagagcaaagctgattatgtggagaaatcaggggagaaagctatttacattttaggacataataaggtaaaatatctgaaactttagctgtaaagaattacattcagtgaaagtaacaactccctttttataagaatttattgcactttcatgggctagaaagtgggtttgtggacttttctcccctatcttgaagaatacattcctccctccttcattcccatccaaatggaattgcccttccctatgagactatttcacccattcgggcccttaactgccccatttctgtgtgagcttgatttgttagttttctctggaattgtatgttttcagttgattcattcatctattcatcaaacatgaattgagttcttaagagtgacagacactattctccggatgttcttacggtgcatgggtttcactttccacttctatccctcacaaatactggttttcccttctacctgtggcctttgtgagtataggctcttccttatttccttgctgcctttctgtcttgtttaatggcctttcattttcacttcttttgtgtcttttctcttgaacttcatcctgtttaaacatcattcttgtgtgtgatgtaattaatttttaaccattatttgattcttccttccctcaacttggcatagatttccaggcatcccgccgtttctttttatccttttttcttctgttggcatgaagacatgatatgagttatatggcagtgcattctacctttcaggagagggtggagagggataagaattagtggctctgggacttatactgggcctaaacactacacagtgacaaaaagggaaaatgggactgtctgtgaggtttaggacaccttgtggtccttgaaagtccctttgtgagtgtctgcatgtgtgtgcatgtacagatgctgctgtgcataagagaatttacaacagaaacttaaaagacagatacattaatgcaaattatttctttgcagggaagaaaaaaaccaagatagtctttaagtgacatatagataacaatagcagtcacaccttaaatgtgtaaagtgccttgctgtttataaagcattttccctattcatatcttaccatcactttaattctatgaggaatttataggtatgagaatggagattgagataataagagacttgcagaaaatcacaaattttccttggtacaagagacagagcaggttcaaggcttcaacccaggttttttaattttttttttattgaaaaccctgtgctctttccactggagcttttttgataacaatgttttgttgtttttaagtccaagaaatatatcggggaatatgaatttatatctcaccaacacatttctatctgcataccacatacgtgtttcagttattcactgctgtgtaacaaccgccccaaaagaagtagctgaaaatgacaaagatttattctttgtcctgattctgtgtgttgactgagcagttcttctgtagccagctggcaggttgactgagactggatgtccctcccatgtttggaaactcagctgggatggctggaaagacccctctccctacatgatgtcagaagcaggagaggaagttgcaaagcctttggagaccaagagttggaagttacagaacacttctgccatgttctgttggtcaaaggaagtcccaggtcaagccctcattcaaaggtttggaaagtaggttccacttcttgatgagataagccacaaagaatttgtggccatttttaatccaccctaatctacatttaaccaagatagatgccctttagttttcattttctgattgcaggaatttggtggtgtgtttcagaaacgtgattcttttccaaaaactcatgcccttctggccctggaactctgggtcttcaggtgaaattcgggcagcattatagttaagccccctgtgtgcccagcagctctttttctgcttctttcttcacttgccatttggcagtccacccaggagcagacacgtgatttaagagcctctgagccaccgcttcagctttaatatcatttagccaaccattatttttaaccttccgcttcttgaagagtgctgtgaccacctaggttaaactaggttttctcccatcatacaaaagggaatgctactttgggataccagaaaatctgcctgataaaaccgggtccatttttaaaacaaaacaaagcttgcaaagatgttgaatagagattctcctctgtaatggttgagcttacctgagagaaatggattcaccagaggcagatgcatttgaaggatggatccagcctgggctatacatctgagagtccatgttctcctggtgtccaccagcccagacctcagcccaactgggctatttctcaggaagatagagagttctaagaccacagtgttttctctgcacttcctactccttgctctctccagtgtttggacctaattttacagactcttcactttgcctccgtaatttttcaccagtgtttcagatacaggcttacacggtagacattaactagttaaaaatctagacagtaatacctccaccttactcactttcactgtaagtcacgagttttttaaataccctacgccttttgataagtaactttgtacctttttattattgacaagtcacctattttaaatttatttttatgaaatttgtcccaaactttttgttctaaaagttctgttatcaatttgttttataaatatgccgttcttaaaagttattgagaaaagtccaatccagctattttaaggtagaaataaattaagtcattgtttataatgtccaaaaacttaaaatagagtttcttctgggttgtgtgcatttcagaaagccagattcccaagctccctcctggctcctgcctctctctgaccaagggcctgatactcttccagaacctatatctggaacatgtgtatctcttgtgttctgagacactagaccaaaaatcctattttatttttaaatcaatcttcagaagtatttttttgacttgtttttttttttttccttagcttcaaggtaattaaaaatgttagattatctgtcagctaatatgttgactaatatgtgacttctgttttcaccaaaaaatgtaatagaatatgttggacacatgaaattctaagtacaatttcactagaaatattgacaagccagaatcacagagctcaacacaggaggcaggctgtatcactctcctgtttcatagagggagcattgtggagctggaagggtcctagccggtgcacatcagcggaacaggtctgtctggcacttaccactgagctgcactgtcccttgtggccctgggctcactcaccaccaggccctctccagtcctgcctctcaggagccctaacattctgtgtcatgcactttgttattgtctgtaagcagacacatacctgtgagtaaaccattccgtagctaaagaatactcctctgcacatcacctggtgctgttcagaaagggcacgaatcatgtgtccagagctagaatccaggcccacttcggcatgagtttgggtgaggctctcacattgtctggctcggttttccagtcgaagaaaggaggggaggaaggatttgattgtctcaaaagtaacttctacctctaaattctttgactttccaaaagcctttagaagggaaggaacccaagccgctagcgacaggagactcctgggaaacaaaggtaaagaaaaattttaggaaatttcagagctcagaaaataatgggagagatatatggctcgcctagggataagaaaaggagaaagtccaggggaagttataaaagaattatgggttttttctttaaactttcttaaaaaaacaaaacaaaaaaaaaaccttagaaacagcaaaatgaaataaactactagagtaatgatttaagccagggtaatcagaactggttggattgtgaaagctgagtaacaattcagtaaaatagattacgtatttggtcagtggttagttgactattgttagttaaccttttttttttctttacatctataaatagatagtccctacgtagcagaagcagagaatatctggccaaaggctgactccgcaagataaggatttactctgttaaactgctttctaatagaatgtcgatatctctgcctgtcagcctgccttggtaaatgtgctggagagggccatgtgtgtatggttcctggtgcccacacaggctcacctgtgtgaaactgcatcagcccatacatggctacttgctggctcctggacccatatttgcacttgtttctccccttctgttgccacatcactttccctgaggtcggattgtgtgtgtgtcttctctgtcttcagctgctccgtattcatattgttcttttctgtgttttacatttaatcgtgcatacacacacagaataatattcatggacaagttttaggttctcttttcctaactttatgattggaccatttctttctgtctcttaaaatgaaaaaagatctactcaaagtgacttttttccttgtttgaacctcagctttatttctctcccataaaacattgaccttagaaggcaatttcccactcatatcctgtcctatcatcacagctccaaactctgtaactccaggaaaggaaataagataaaaggaaggatggtagtcccattgtgtctgaaaaatatgtcaaatatacagcccatgaccagagcgaaggtcatcaatgtcgtttgctttcactataacatctaaatatttgcaccaagctgcttcaatttgaaattgtgctctcaagaaaattcattttgttggtgctgtcttgcattatgataatagaatcttagcagattgctagcacactgtttcttgtgaatagatagagatgtttagaagaagttttctggggttccagaattcacagcctgaaattgactcatactggatgaggccagccgaatggaatctttggcaggttatcccttcccttcagaagcacttgagttaaatccaattaatctaaccacatagctacagtgagtgaaaacaaggtacagattttaaaatgctccaatcggttaaaacagttaaataattacatactcatcgaggacctcatggaaggcagaacactgggcttggtgtggggtatagtggtgaataaaatgtggcacatgctttaaagagtcttaacatcttacagatatgaccaatgccagtttcaaaaaggctcccaagttttggaaggtaataagaaggaaacacacaacatgcacacacacacacagtcatctgccctcaaggaaagaatcaattaatagacagtctttctaccaaacaatgaaaaccaaatttaagaaaaaccatacagtaatatgccagctttaaatccaaactgagaaatcaaggacctcaaaaagcacatatacatatggaacaacagatgacaattttttcttatccctcccttccctcctgaaaactcaataggacaggagggattttcttattcctctgttctggaacatctgtctgcttctgagaaatggaacgagcagcaggatcaagaatcctttagtgctctgtgtgctcaaatgcttatccttccgtggtagagctttccaaagtttgtcaactcttatctccagagctacagcccataactctgcggtttgaagcctttaggagggtgttgggaggtgggaggatcacgcaagagtcagaggctgtcaacacagtgcgcatcaacccaacctgacaaatatgtcaaagccagaaacttcctgagggtggcttggaactgtcagggtcatgttcagagctcagaaagcacttctttttttcttcttggagacagttttaagtttttttaggccatcaaataatatttcctgtagatccatgtgctttttaccattgtgctaggcaattaagttgcttatatcatgcctactcaagctaaccagttttaactatccctgcatatgcattttcaaagggactttatctaattaagagtgttgtaattcattatcatgtccatctgttctaagatagtgtctcagagaagatggcacttaacagtttgggttttttttttttaagattgatctgttagtagacaaatttccataattcagttcatttttgttgttgtcgttccctttaatttgaataatttctccagctgctttttgggagtaaataaaattaagttatataataagtaaaatatgcattagcacagcacagatttaaaacattcctgactcctgacatactattatggtagcattctctctgtttttaaacacatgcagaaaaaaatttggaagtgtatttgaagctcatctttctcaactaagaaaagaacatctattctgttgccctctgtcacagtaatttttggcccaaaagagcgagtcaactcatgactaaaaaagccagagtctatattaaactctgatgtttttaaaacaaaataattgtaggaattccatgttattattggacctatccccagattgaagaaaatatgctttcctagaagtaaagccattgcccattggaaatgaactgtctccctagtagagtgtttgatttgtcaataattctcttcagatgcgtgcgtgctgtgtttcctgtactagggccttaggctttttttatctcaccttaaatttgacctagtgtctagccttattttgtatttgtcttagtcccgaaaacaagcagggaaggctctcagtcagtggcttccagtttaatccgagtggtcatggatatcaccagacactgtatatgtggccctccgagtcggactgagagaaggtaacttaactgaattccgtaagcctttcagtaaagttgaaagcggaatccacagcgtgataatattgaaactcagaggtctctccataccctcttttgctatgtcatcatcatggcacatgcaaacagaacagctctgcaaaaatgctttgtgaaattacttgcatagctaataagcaagtctaaaatgtaaaagccctacctgtaatgaaaataccaaaagcaacccaaatcacggaatatattttactcttcatgtacacctttacattggatatggcttattgggttccccatcattgtagttgcaacagtttgcagataattcagggttatatttggtagacatttaattgctaattagaacccaggaggtagagacagctggtttctcttggccttggtcagtctgttgtgaatgtattatacagcaagtggtttgtaaattattctttcctgactttgcttttgattgaaaagaaaggaagttatatgtcatggctcttatgataatatgatcagggactttgatttccatagctagatcatgaagagttttaatgataattcctaagacattagattgtggattctttgagggcaaggacccaccctatatatttcattctcatcagtacctagcacgggtaagtaatgaatgcttttaactaaattagatagacaattagtctgcagcaaaagtcctagcatcaaaaccccatagtgttcttggattgttcagggagcagatattttgagcatttgtcatgtgccaggcattgggctacccagcaggaataaaatatagtcgctgatgtctaagagcatatattataaagggaaggcaaatatgtataagtcattgtagtttaaagtgttgtgtgctttggtagtagaagtgtgcaaaaaacacaaagttagcaaagcaaacacatgctaattcctatttggagaacggtcagatttgacttttgaactgagtctttaagaatgagtcagagttcacaagatggagaaagagagaagggcattctaggctgttgttgatttttcgacttgtaatgtgtcttgcagcttaaaacattaacactaatcccacctacctttatgattcaagaaaaagggaattcatgacaatgttgggttttcttgagataaccactccattgcaagactgcattacttgtttaaggtgttttgttactttcctgtttcttacaagtgaagacgcttcttagtatggtaggcaaggccccatattactcagccctgacctccctctctggccatgactcctgccagtacccccataataaccccagtcctcctctcagtacatagtgtacttctggtgggctaacctattagtttaaacttaacacactgtattctttcttgcctttgtaaatttagtgtgttctttcctctatctggaatgccttccctctgtgcccactcccccacatttgatggtcatttcacaaactgccactcacacccctcaccaccaccacacacaaacacacacacacacatacagcatcagctgtttatctttgtgctgctagttagagaaggcatcatggaagaagtgatcgtcaggaatgaaccgaggtctctgaggcatgatggggggcttcagggtagaagatgcagagtagctctgacttttctctagctgctcttaacagcttgagtatcagcacagaggaagtcaaagggttgaatcacagtttgcagttagtagttcttggggctgaattttaccccaagacatgttttctttaatgtgcccctttttttctatttttaaattagtcactgatatttaaaaactggcatacttcacgtaaaaatctggcttctcttgagtacatggaaggtatgccctcattgagtttaccctttggcatggaatgagtagtgatgccctgttagaggtcacagaccttcttgaggtgtctagagtccccctctactcttctaggattcctgcctgattcaggtttgccatctctgggattaagtaagttgggtttgggagacagatacagaaggaggataaagaggcaggaaaggtaaaggcgttaggaagatggtggttcaagtgaaacaccgtgggttttgggctccgttgttaaagaggtacagtcaggaggaggttcaggccgcagagaaaaggaaacgatctggggagtagatgtctcagtgactttgaagtgtcagtgtggtagagcatgggccagggagaactggaaggatggaccattgtgatcagcagataggatgtgtgacttcagagagttcagagagctgtggctgcaggactgagtcaccgaagtagagggggcaacaagggtcactggattccaaaagatcaagtgaggccagagtattgaaaatactttgtccacatagactctcaagcctctcagattataatcatataaaacagctaacaggtgttgtgtgcttctgtgttccaggcactatcctgggtgcttttcatcagttcgtttaatccacatagcagtcatatgatatgtgggtactttaatcatccccactgtacataggctacaattgaggcttagagagattacttaacttactcaaggtcacatagttcctaagcggccagaacttgaacctaagactgtgttgttgccaaagtgcattccccaaacctctgccctctaaagcgttggataggagacagagtcaccggaagggaaggtttgcatgagagaggaaagcaaccatgtgcaagtagccagtggtcaacttggagaatgctgacctcccttccatcccaggtgaataagtgagtaggatgtggggattctcagtctcactggagatggctataaggaaatagaatctttaggggagagccaggtaaatgttagaaacaaattcgagtggtgcattgtgtgatatgttcggaggatgggggagtttgtctgcagaggaaagtttggaggaagcaggggagtcagttggaagggatgagtcccagagcagtgctctctggggatgtgcattccttggaggatgagagacaatacggtctttcactttgcactgatgacaaggatgagaggctgggaattgactgcccaaaggaatccaagtggatgcatgcttaaagtcatctgtttcagcactagctcaggccccagatggttctggcggcctgaaggagtgttagcagccaggcaatggaggctttgctcagattttcaagtagaaggttagtccagacatcgttggtgtttgttctttgtgtgctctggggagaggatttaatagtcaacctcccattgtgttctcatttgtggttatatataaaagcttccctaaactaaattccctaaacttagggccagaaccctgtgtatccccagccgcaatccagcttagtacctgctgcatgtacacactcggtaaacagctacaaaatcattacgtgttcataaacaagctgattcattgttccaaagcatctattttctgaggcagttggaaattccactctgaagtgggaataacctatgttgctaaactaaaacttattctccacttcccagcccagttctcctttccacagcgtgatgtgccagtttcccttcctccttttccaaactagtccttcatgcagctctcactcccatcctgtcttactctctaaagccatcctaccagccgtgaaagcagatgccattgtcttcccctagacctacggaagtgaaggcagggagccttccgttcctgggacttggccagctctcgatgtgtgatatcggattgttgagctggactgagtggcccaggatttctgccagatcccagctgtaacatttcaacaggggcacgggccctgcgattactttcagctgtgtttctgctgtgtctgtctccacccccccaccacccaccgctggggttgagtcccttcaaaactaaccctgattttttttttttttagccactcacgtcaaggtagtaatttgtgaaagatgccgttgttttctccccaccacacctactttctgtggggcagagtcctagaagataattgttaaattcttataggaaccacgtagacttacaacttctgttctcctgcagcttataccactttcctttcaacttagcaccttaagataagcttccggagccacatgccagcctcgaggaggaagctaggaagagaagagcttaatggctgctttattattattaccagtagtaggaaggcaagggaatattttattttatttttatttattttataaattttttatttccataggtttttgggaaacaggtagtatttggttacataagttctttagcggtgatttgtgagattttggggcacccatcacctgaacagtatacactgaacccaaacctaattgtctttaacttataccttccctacatgtgagcatgtcctttgattcctccccccagaaaaaaacaaagcgtaaaacaacaacaacgaaaggcagagtgattttttctggtggtcttcaaagggaaagtgttgaagaaggtacagtttctgctcactgtacacaggggagggatggctgcggggggagagtgtgatccccagggcagggctgcacttgctgtggctacagcacatctgtcagtgttagggggtgtaaatgccaggaaatcacgcaggaataagcttgagacaggggagaaagggtgaaggagggttagttattcatacacagatagtagtaaatctcttatggtgaggcacgaggaaaactgtgagcctaaggaactttcatagggaggagtgctgttttccataagaagggttggaccctcagataggaaacctgtttctttttggatattttatttgcagcctttaaaaaaaaaaaaacttacacattcctggaaagagtaagaaatttaatcagtagaaagatagtacatcgaatttaattaaagttgcagctactttttatagaatagcactgtgttttatatgtcattataatttccattcccgacaagctatttcattaacacactgtgtagaatcctagtaacacaagggctttgccctttttgctcctcatttatccttgtttcctgactaaagggcgacctcccacccacctgtaagtagtttttaatttataggcggtcatgtctccacttttgaaggcctcaagcactcacttccggtgtgtagtagatccagtattgaaagaaatcttttccagaagacctcactgacttgttttcctctaggatacgggcagaggaagatcagagtctgctggggaagatgaggaatatgatggcttgctgcttccgagctgcctcctctgcagaaggagcctactatggggaatgttaggataacatcagcacccacaccaggaggatacctctggggtgacggggcgaggcagaggttgaggggcattcctgttctttgctgaaagggctgtgggaggggcaaacaggactcctagccctgtggcctcctccaggaatctcctgtaggttatcttcctttaaggtttttctggtcattgtagtaaaacaaactgttgacccttgcgcttagttatgtagggtctgaaacatgcctagtggtagggagacaacagcatctagcatgttgtttcttttccggccttgcttagagttctttagtagggaaaaaaaagttatataattattatgcccccacgaaaaacaaaacgtcaccagtgcaaaggccctatcttgagctgggcctgaaggttgaggtgcttggagaggaggaggatcaggggagtaagggacacaaggtgactgatgttcctgaaggacagggtgcaggtgagtgagaagaggatgagctgaggtcagtttgcagcagtgacgggaatgggaatggcagtgatagaatcaaaggattttatatttagagaagagtttattatgatccacctgtctcactttatggatgagaaaacagtctgcaagagtttaagtagcttgctagcagtcacacatttttcttctttgggtgacagtattggataaattggtaatatttctgttcttttcttccctcgtggtatctctcacttttaagcaatggtattcaggcaggaaggagtctttgtaagtgatctaaaacaagtactagtaatcattgttctcattataatgttaaaactagttgtacttgttttttgcttttttgtttttttttagtggaaagtacaaattaaactgtgaccacccaggctttgcgcatctaggcacaaagttcttggaaagtggattgcaaattcccatcagcagactctcctggagagcctattatatgggcagattctggagccgctccccaaacctgcagaaaaacaatgtttgagtgggtaccctggcatctgcattttaaacacattccatagtctttccttccacatactaattttgaaaagcactgtacctagaagcttgcagtctaaaatgtataaaaataaaaaatataaaacaatacatggtctaacccctgacttagtatccatgaaaaagtttatttcagattattggttgggtacctttatcatttttttactattatttataagacaagtaagacatgccccctgcactagaggaattcacaggagaaacagtctgattttgatttagtatgatgggccgatgcacttcaagagttactaccgttacgtactgttgcaagtcagaggagggaaaattaatcctgtttgttttttgaccagagaaggtcttacagggtagatggtcttaaggttgtggggaattcaccaggggcaagggagaggcagggatttgaggctgggtggacatgagctgtggctggagtgataaggggtggtggcaggtgattgagtgacatcagatcatcattgttgctggagtgtagggtgtgtgcaggaaccagtagaatatggaaactaataacaggtagaggcagacttaggagcaccttgcaagctatgcccaggagctcggactctgaccttctggcctgcctgggattgtctgtgaagtccaggaagcaaaggacatgaagggaaagcttaaatgtgtactcaccgcccttcagtcagcagaacctcctaagggggtgagtgccctctaggggtttccatgatttctgagttccattgtactcaggcactcaggtgcccactgagcttgaatccattacctacttgagaaaaaaaaaagacagctttaccaagtcccacctggctgcagctgtggttacattatgcaaaaatttattaatgtggtacctcgattgatcattatattaactctaaggattacattagaggctttatttttctggttacttgcaaatacaggttgcatcttctttgaagttaaaaagcccttagcccacatattgtatgattccatttatatgaactatccagaattggcaagtccatagagacagaacataaattagtggttgctaagggccggagatcaggggaaagggagtgactgctagtgagtacaggatttctttttgagatgatgaaaatgttctgaaattaggtactagtgatggttatacaaccttgtgagtataaaaccactgaattgtgtactttaaaagggtgaatacttatcgtaagtgaattatatctcaataaagctgttttgtttcattttttaaaaccttagcacttctgctcaaggtcatgcaaatagctctgcctggggtggcctttatgaattcacagtagagaaatctcagtgctctcctcactttcttttgtgtttttgttttgttgtgttactgttattcctgtcttgttcctctgcagttcacttccacttaagaaacatttatatgactagacatgataggtactagaagagcttatgttaaggtgagtcctcaagttaccacaaaatagagaaagagggtgctgtaagaaaagtgtggtgtttgggggttcagagaagaagctgttatccgaggttggcctagaaagacaactgggcataagggctggatgaggaatgtgcagaggccattagggcaggcagtgcagagacagcaaagtgcggacttatttggagaaaagagcatgaccgtagcaatggaaaatgaagggaaatactgggaaacagaattgagaaagggttatatggacttcagagtgttgaatgctaggctgagaaagtgatacataaaatgaggagtaatggaagataaattttgactgcagaagtttgggaactgagccttaggatgggtgtagcatggtttgggagagacagagacgtgggcagggggagattggactagaactggaaattggggagagggcttcagaaatgaggggtaagtgttgaaatcagctcactgcagcttttctcatgaaatgctgtttgctctgccccttttgtgttctcctttcctttgcttgctccttatccagagatggggataaagggagggaaagattagggaggacaaaaagaattaaaatgaagagaaagaatgtggtgaggacggtacaggttgcatgcgtcagttcttctgtagttcagcatttcctgttcatgactcagtagaggaaaatctagtctcttctagtggaaaacacagagaacaggaaaccctatttaaaatcaggtcacttgactaagctgtgtaactcctgttcccatcggtgaaagggaagaatacctcctgcagtgtgtgttaaccagagaatctagaataatcttactgaagaattttttaaaactacatgggactcatatcatttgtagatataacagacttcctgggcaaatatgggtcatgatggggtccccttttgttacctgacagagtgaatgtaaacatacctgttaaaagataactcatgtgagttgtattatgttgaaaataaggaattgctatttgaccatttcgaactgcaaaactggcagtttcagtaaggttttaacctaatagatagctacccaatagatatctgacctaagcccagatttttaccttttgtggttctttcatcagctctttcttgattaagatgctaatttcacgttcaggggaagctgtgaaaagtcaaaagatggcaacaggtagatcagaaggctttgcagggaaggaaacaaggagacaggagctggggtcacaccagctagcaaaaccaggatctttattatgcagtcagtttagttgtaaagattcagcataaaacattttcctttcctaggtgggttaataggtggttgggtgcaacttcagctcttctgtagcctgctggagacaacttgtaagggactttaaaaaaaaaataggaatatttaaatgttaggaagacgtaatgcatataatgtttactctttgggtgacaggtacactaaaagctcacacttcacctctatgcaatatatgtctataagaaacttgcacttgtactccctaaatgtattttttaaattgtaaattttttaaacaaatgttgggaaaataggtcaaacataaaaggggaaaaaagacttcatggcagacttagtcatggtgttcagtgtggtgtgactcctaacagcatagcagagaacccagcacgtaagtgcacgtgttcagtaaaggttgttcaagtgttgaaggacaacatctgaagaggtattttttggttgactgtacactctcaggtgtttagagtagaatgattccctggagcacgtgtgtaggcaagaatgtggaatcatagaagatttgtaagagaaggttaatcagctattcttgcgggatgctttcattgtaatcacatctacacattggggccagggtgtggcctgtcagtattctagccccatttatctataaactccagagagttttaagttgtacagagtgccaagtacaataaatgtaaacaatataatgttactgttatatcacagcagtatgattatgtgcttaccactgcaatggctagggatataagcgtgacaaagtatgggatgaccttatcaggcactaaaagcccagctcacatttactcagcgctagaaaatgattgtcctgcaggaatatagcgtatgaattgagagctccaagctctactcacacaaaacaggcaaacctttacttgaaaccactggtagaaatacaattgcagcaaaacctgaatgacctaacaccctcttctcccaggaatccaatagaactgccaccccacatggaagaatcctcaaggagcctaccttggggtgatagtggggtgtttaaagccacctttccagtggctttaatagtccttgatgcaaatcataacctaaagtaatttcttttctagttccatggttaactataaatgtaattaaatctctgggcctcattattgaagtacttgtggactataagcatattttaatttattaaagatccaaagaacaataagtgaacaaaccaattacttaaataagaaggggggacaaaagcacaattaatgaatgtattgatagttttccctgctgggaacattacctttcctgatcttgacctctaccgtatgtaaatacccacatacttcctgccaggatgtctttttttaggatgtcttccttttactcctgtcaacctgggaactcccgccgtcatcttctccaccctctgacccatacatctctccccaggggagtcccagggcagaaatctagcggctctttcctcatcttacattcacatgctgacacccagctgccctaagtttcctgtgtcctgcctctctttcattgtagcagatgcaacattttgtctcctcttatttcacctgcccgtatttgccaggcttctgcgtttagcaatttttgcagcagcatcgaagttaggggtgagagccagcacagccagcttgcagctcatggaacacccccattcatgcgtgcagagagatcgatgctcaggtgggagcttaagatccaaaaaattaagactttcagcttccaagatagctgtcataaagttcacttactacagcttaggccctctctttataaagagctcctcagtcttcagtccgtttcttttattgtgcacagtcataaattaaatattgctcaagatgagagtggacttaagacaatcacactgacaagaaaatactaaaaagctaataacttaatcattgaaccaggagtcagaaaatctctgaaaaaccctaaacatcagttgcagcaaaggagcaacatgaggccatttagcacgggaacactcactctgtattagcctgtgcaagcatcgattcacagaagagcataacagatacatatgaagatgtccctgagtcagccagaaaatgtttgttacgctcaataccagtctggttaagtaagaaatgaggtaatgcattttagaaatatttctgtcaaaatggttaaagttaaaaattggggtgtacataaaggagacaagccttagttatttgaaagcaaattatggtagaacccctcctgccttcccatttcccagtgacaccagataaaggaggcagtgtcgtatagaccaggtactttgccacagccactgccactttgtttgtggtctcccgacttctatgttgttgtttattcatggggttttccttcccttttctttggtttcagatgcgagtgtctctctggcttatgtggtttccccgtgtgtgaggtgggatccactccccgcatagtctctcgtggcgatgggacacctggaaagtgctgtgatgtctttgaatgtgttaatggtacgtggggtttctcttgttctcagagagtgtacatttgtgcagaggaggaggagggagggttcaacttagctgcttctgccttttacaaagcagggattaccttcaggggcttgctgaagggcactcaaaaaggtttgcttaagatccaccgtgcagtaaagaaagttaggttaggaactatcattccacccatcagaaggaggattctggaaatgtaatagcagattgcatgtagctgtcatactcagctgtgttacagaatttccaaaacttagggatttcaggaaaaggatcctggagcctgtgagagttttcctgctgtcactcagtaactggtcccatggctgtcgggaggtgacctggctaaaactgcattgggcctgccacacttgggaacaagaaaaacatggctcatcttgtttagcattttcctacttagaacatctttgcacctgatcttagccaaaaggctgagaggcggtggggaagacatctttaatcagtggttggtcactgatagcggcctgctgtaggcttgacccacgtggccctgaaaaaggattcttgggtcacgagattccttctgacagaatctgcctctccctttcactttatatgggaggatttggtgtttggtggcttgatgttgattgagtttaggtgctagaaggaaggggaacctgcaacatgcttctctaccagaatattcattaacaaaaaataaaataaacaagttacatgtcaataaccattcagagcattatttagtcaatacttgtatacacaggaagatggagatggatttggacaaatacaacaaaattacacatagaaatattcatatcaaatacttcctgtaggaattcagatgtcataaggtctcctgccctcccaaggcaagaaaggttatgttgcagttgagtcctatttggttgcatcctgtgatttttaggcccgtggccaagttgttttttattgtttatttttgctttgaagaaacacttgcagtatggctttatggttaagaaagaacacagactagaattaataacctcagtttgaaaattgggtcctccactcactagctgagttaactttgaggaagcttcttggtttccctgggcctcagtttctacatctctaaaatggactgaataacagtaaattaaacaaggtattataggtgaactaccttgaattttgcctcagatgtaaataatctttagtattcttttttttttttttgagacagagtctcgccctgtcgcccaggctggagtgcagtggcgcaatctcggctcactgcaagctctgcctcccaggttcacgccattctcctacctcagcctcccaagtagctgggactacaggcgcccgccaccacacgcggctaatttttttgtatttttagtagagacagggtttcactgtgttaaccaggatggtcttgatctcctgccctcgtgatccacccgcctcggcctcccaaggtactgggattacacgtgtgagccactgcttccggccaataatcttctgtgtgcacactttctattcacatccagaggcacagttctggacattggggatgggggatagagatggtaaggttgaacttcctgacttacagaccttataaatacaagcatacaggaaaggggaacagaaaaagttctgtgcacttaaatcacctctcggtgcttctccccactctggtcattatttagccagtaatcacatccattaaacacaagcaaatggccaagcagaccttttttctggaggtgctacagtttgatttatgataggtgagattctgtgaatacttgtaccactggagacagaaatagtcactgcttccctgggttcccagcatctcagatatgcttcatccagtgctcatcacttggaaaagacttaacgctcatgcctgtctctcactccaaaatgtgaactgctggaggacaggagtctgtcacattcatccttgtgtctgtagttgttagcctattatctgcctcacagaggacacccagattttgttgcatgagccagtgaatgatctaattcgtatcatcttagttccctctagaggtgtctgttaaatgtcagcccataaatgggttactttgtaggaatcctccatctatttactgccctacactttaatcttaagtcatttgtcccctgaaaatatcatctctagtagaaagatttgctggtgtttcctatgggtgaggaaccggagtgcccttcttctctccttgcttcttggttctagatacccatgggtcattcctttcttatcagaacatagactttatgtcttgctccagtctgatgtgtctcaaactactaatagccgtacctccaccttagcaaccttgggatcagtctgcagggcctgtcctcatttattgccacttattatagagccctgacttctggaataggatttgccatctgtcctgagaagatgttgagtggacaaaacacagtcactacatctctggtcgttgcttctttcttgccaccataaacttgttgagtgatctttgctttcttcctaatcctgtggaactgtgtctattgatatatcagtcattcacctgtagaggagactaggaactaatactgtgaagattcataatcctacagaatattgttaagaacattgtctcaaagcctgcattttacttcttttgatatatacattcatactcatacacacacatatatattgatagatgaatgtgtctgtgtatgtatatataaatatacttaccacctagtgtcctggaaaaatctgttgttgtaaggtcaccattagaagatactacatatcaaagattcattatcatcacttagaaaagcagaggtctattttatatgtataaaaccactcgcttatacacagaggatctgaggaaactttacagtgagaacagattctataagatagtgataaaatatttatgagaaaggagactcacagccatagaattgtaagtaaaagttgaaagtgaaaaatcaaacagaaagcacccacgggtatacagtccatcagtgcctatgcagttgtgggagttaaatgttaaattaggcccccagttttctggccatcaaagtgaaaaaggagatagggtcaaatacgctgttcttattttcaaagaggaaaaaacctgctggatgggacaactgtctctctaatagagatttttcatatggaaaggaatggatttcatcccactgaatgatgaagttgatcatgtgcttaattgcgttaacaccacaaatgcagaaactggtttcctgggattgttctcaataaaaagcaaaggcaaaatattaaaatacaactcagttccaaaaggtcagattgacacagctagaccgtaggtgcttggaacattgtttctcaattttgcaaactgcccaaccatggtgaggtagatccaaagaccccagttcagaagactgtgggtagaatgttaacatgactgaccccacatgcagaaatggattatgcactgccgcactcacttcctatgctgccatccatgtgatccatatgcttatgtttttttctttttaaaatcaactttaaagtgaaaacatacaattttaaaatacacagaactcgaaaactcgtgagttttgaaaacactagcctgatgagtagatgcagagagagcatcctccataaatattactttgtttttgtagtttgattttattttgttgtggcggagggatgggagagttgcagaccagttcatgacagtttgtaactgcattctctgacaagcgccgaaaggagaacttatgaggctttggctgaacaagatccttgttatttagaaaccaaaggaacaggtggtatgattatgtttcttttatgtgaacttagaagtcatcaaaatcatcacctagaaatatgacctccaaagcagtgttgtaacagccctccaccttcgtcaagaacccactgtatgtctgctcctgcccacaaacaaatgtcccatcagccgtcagctggagctggacaatggcctctactgttagatgggtggatgctctccacttaacacagtaccccctgctgtcttacacatggcccacctctcgttcctggaggcatttgggtttgaaatcctaggtgtagagtgtgcaagtgattatttggtttcttagatacgagcatttgtccaacgtatatacacaaacatctagataaaatggaatatcttggttggaaagtcgtagccaaaagctgactctgtctgtatgacctacttataaaacgttccccaagtgagtaaatgaattagtctatagtattgttattggatagaagccagttgaaactaccagaaatatttttagccttacggtatttaatactgaaccatttgttctgacagcatagttagcagggccagatatatattgaggctagcccccattcacagctctaaacaagtcatcagcacaaaagaggaagagtaccctcttcccagtggtgccaagagtggtgggtggatggggtggggatgggagcattacttgtgtatggcacaactagccaaaagcaacttcagggggttatgaagtaagttcagagaaaggggatctgaatacaacttagcgtgtgtttttagcctgttttgtgccatttgaaatacttctgttttggagcactgtccctgtagcactctgcttctcacagcagtattaaaatgcagcactaacagtgaggagcctggatgaaggtcatgttgcccacccagtaattagttcctgttttattcaggcatatacgaaaggctaataaaaactggaagtaatcttatgttggccctgacagaattttctctaagacagtaacatgtgaaatcaccatttaaaggggagccgtacccagcatcagcttgctcctcatgtaaaattttggcctagaaaattcagacctgcaggctgttaattttcaaaaaaaaacactagtacagaaaacattaagaacccactgtctatatagcaattatgctcataatgtttctaaggacgtaatgtcttctactgatagaataatggagatattctggcactttgagagcaatactccactcagtatgtgtttattgagcacccctcgtgttcctggggccttgttaagctaattttgttaaagagtgatacacattgttgtaatcctttctaagggttgttctcttccccttttcctgaaataggatatgcttggtgtcctccagcacacacacacacttcccctcttctccctgtggaataagccaattgaaactagcaaacatatttttagtcttatagtatttaataccgagccattaattatgagagtatagttagcaagaccagatatttattgaggctagtccacattcacaactttaagaacatgtcatcagtataattaataaagggaaaacttaaggatttaaaaacacacagaactcaagaactcctgagttttgaaaacactagcctgaatgaacagatggagagaacatcctccatgaatagtccttctcttttcactttggttttaatttgttttggtggagggatgggacaagctgcatgtcgaagctgcagagagttatctagaagatttagctatgaaaagtgatgaaggtggctacactaaacaacagatattcagtgtagaggaagcagccttctatggaaagaagatgccacctgggactttcataacaagagagaagcagtcaatgcctggcttcaaagaataggctgattcttattaggggctaatgcagctgataactttaagctaaaccccacggctgttaagaattatgctaaatctactctgcctgtgctttataaatggaacaacaaagcctggatgacagcatggtttattgattattttaagcccaccattgagacctactactcagaaaaagagatttcttccaaaatattactgctcattgacaatgcacctggtctcccaagagctctgatggaggtgtacaagattagtgttgttttcgtgcctaacacaacatccattctgcagcccatggaccaaggagtcatttcaactttcaagtcttgttaattaagaaaaacatttcataagattagctgctgtagatagtcattcctctgatggatcagaactaaatcaattgaaaaccttctgcaaaggattcactcaccattctagatgccattaagaacacaggtgattcaggggaaggtgtcagaatattaacatggagtttggaagaagttgattccaaccctcatgaatgactttgaggagctgaagacctcagtggaagaagtaactgcagatgtagtagaaggagcaagagaactagaattaaatgtggaacctgcagaatgtgactgaattgctgcaatctcatgataaaactggaaaggatgaggagtttcttcttatcgatgagcaaagaaagtagtttcttgagatagaatctactcctggtgaggatgctgtgacaacatcttcaccagataaaacgacaaccagggatttagactattacataaatttagttgataaagcaacagcagggttttagaggattgactccagttttgaaacaagttctactgtaagtaaaatgctatcaaacagcatcacatgctacaaagaaatctttcatgaaaggaagagttagtcaatgtggcaaacttcattattgtgttatttaaagaaattgccacagccaccccaaccttcagcaaccaccatccttatcagtcagcagccatcagcatcaaggcaataccctccaccagcagaaagattactatttactgaaggctcagatgatcgttagcagtttttagcaataaagtattttaaattaaggaatgtatattgttttttagacataatgctattgtatacttaatagactatagcaggggtgtccaatcttttggcttccctgggccacattggaagaagaagattgtcttgggccacatgtaaaatacactaacactaatgatagctgattagcttaaacacacacacacacacacacacacacacacacaccatcttacaatgttttaagaaagtttgcattcaaagccatcctaggcctcatgtggcccgcaggctgcaggttagacaagtatggactacagtacagtgtaaacataacttttaaatgcactgggaagccaaaaagtttgtgtgacttgcttgagctggtctggaactgaacccacaatatctttgaggtgtatctatcaccatccaccaatcagtgtagtttggtaggcagtagcatgtactaatagtctatattacaaaattctcttttaggagttctgaagtatattcaagaaggaagggaagatcccagaacttagaaacttaaagtttaattttgcagacgcaaaacacatacaaaaaatcactaaaaaggcacttctgtgcttcatattgagaagtacaaattacacagtaaattatttcttcataacacttttccacatccacttaaatcatccttttgtggagattgtggcaatctccacactgttctgagattcacatctacccctgataggtgaagaagtaattggtcattgctcctcaaaaaccacaggtagcctttttatcatatacttttcttaagagcctctataaatctctttgaacatcaaacagatttcattgtgttgtgtgacttttttcacccttaaagattgattgtgtttccaggctgtgtttttaggattctccatctttctcacttccactcccttgatccttgtgcttttgctagtgaaacctaagtgccacagttctctcgtcagtcccatcccctcctgcttaagcttctgcacaccctaccataaaaacaagtccacttgaagcagctttattcataaccagaacctgccctccacacttcctcagatcatgcaccagggttgtggcttcacccagatggtagctgtggttgatcaactcaaccaaataattagtattgattggtttattttttttagtttccatggatgttcattttgttagagtacagtattttgcctcgctctacagcctgcaaatttaatgtataaaagtactccgttttctatactttttggaacttatagtgtagctgcacaattcctttcaatcccaactcagattagtttgttagctaaaagtatatagaagaattctgagccatggtaagatgattcttttttaacattaattttctgaaaaaatgttgtatccatgtagcactaaggaaggagtttaaacattcacatgtagtacgtgtgcacacataaaatcactgcctcattcatgtgactttaagcaaatcacgtcatctctttaagtttcatcttcattatcgaaaaaactggtactaataatactcgttctgtcttcttagcggggttgttataaaataaatataaagtaattgtccttgagtacaatgcaaatgcaaatatcctccaaatgcggtgaaagtattttagacatgcaaggggacatattaaatgatttggggatggacagaagagcccttgaaagatggggatatcatcatccagctttcaccggcagattgagcagggctcatcacctcaggagaactttcttcagcttgggagtactttttttaaaaatagctttaggagacaccatgcaatttaccaacttaagttgtgcaattctgttgttttcagtgtatgctcagagttctgcaatcatcaacacaatcagtttcagaacattttcatcaagccatcagaaaactcctgaactgattgcagtcactgcccattttccccctaagctctcagatctaggcaaccactaatctactttctatctctatggacgtgcctatgatgggtgtttcatataagtagagttatataatattaataccttgtcttttgtgactggcttctttcacttagcataatattttcaagtgtcattcatgttatattgcatatcagaacttcatttctttttatggccacgtaatattttattgtatagatatactactttttgtttatatatcagttaatggatatttaggttcgttctttcttggctcttgggctgctaggaacatttgtttatagtgcttttttgtgggtatatattttcatttctcttgggtatatacctaggagtagagttgcttgatgatatgataactcaaattaaggaactcacaaactgttttccaaagcagctgtgcttttacatcctcactaaaaatctatgagaattccagtttctccacatcctcatcagtgctcgttactattttttaattatatccatcatagtgggtgtgaaatggtgttcattgcagcttagatttgaattccccgagtgactaatgattcgagcatcttttcatgtgtttattgtccatttctgtcttatttgaagaagtgtctgttcaaaggtttgcccgttttgattagattatttttatcgtttaattatgggagttctcggtaccagtttttttaaatcagatatatgattgcaaatactttctcccaatctgtagggttgtctttttacctttttgatggtgtccttttaagtcccaaaattgatgaagtccagtttatctgttttgttcctttgttgcttatgctttgaatgtcacatctaagaaaccactccctaatcaaaggccacaaagattaactcttatgcttccttctaagagcactgtaggtgtagctgttgtatttagatcataactctatgattcattttgagttaatttttgtatatggtgtgaggcatagggttttcttctttattcttttgcatgtagataatgcaaaagactttcaacctcaggcctggcatggtggctcacacctgtcatcctagcactttgggaggccaaggtggttggatcacttgaggtcagaggagttcaagaccagcctggccaacatggtctttactaaaaatacaaaaattagctgggcatggtgtcatgcacctgtagtcccagatacttgggaggctgaggcaggagaatcacttgaacccaggaggtaaaggttgcagtgagctcagatgacgccactccactccagcctgggtgacagagtgagactctatatcaaaaaaaaaaaaaaaaaaagactttgaaccccactgagtcttggccatcttgtcaaaatacctgtaaatgtgatagtttattcctgaactctcaattccattgaactatatatctatccctgtggcagtaccacatagtcttgattactatagcattgtattatgttttgaaattaggaagtaggagttctctaactttgttctcccttttaagattgttttggcaattctgggtcccttgcattttcatatgaattttatgatcagcttatcaatttctacaaaagagccagctaggagtttgatagagattgcattgaacatgtagatcaatttggggaatatttccatttaaacaatgttgtctttcaatccatgaacacgggatgtcccgtttacttaggcctttttagttttttgaaaatgttttgttattttcaaaatacaagtttgtacttatgttattacatttattcctaagtattgtatactttttgatgctattgtgattggaattgttttcttcattttctgattgttcattgctagggtatacaaacacaatttggggagttgcaattgtactctgcaaccttgttgaacttgtttatacattctgatagttttttagtggatcccttaaaactgtttacatacaagatcatgtcatctgcaattagagatagttttacttcttcctttccaatctggatgcttttaatttatttatttttcctaattgctctggctagaattttcattactatgtcgaattgaagtggtgagaacacacctcattgtcttgttcctgatcttagggggaaagcacttggacttttgccattaagtatgaggttagctgtaggacttttgaggatgccatttatcaagttgaggaagttccgttctattcctagttggttgagcatttttatcatgaaagaatattagattctgtcagatgccaaaaactgtgtctatcgaatgatcatgttgctttttttccttattgtgtgacatatcgtattaacattaatattttggatgttaaaccaaccttgcattcttggaataagtctcacttggtcatggtgtataattttgtttatatgttgctggatgtggtctgctagtaattttttttaagatttttgtgtctacatttataatatactgatctgtagttgtgttttcttgtcttggtgggagttattttaaatcaactaaaattaaagaatgaatgtagggagagtgtttcaaggcagagaaaaatttaaaaatcattgatatcgtgatgagacttctaaatatgggactatgagtcctcagcagaacataaccctgaagcacaatggaaggagcacaaggtttcagttgaagagctactgttttggcttctgtcgtttgctgtgtgactttgagtaaactacctaggatttcctcacttttaaactcaggataataatacctatgtcagaccttcattatagggattaagtgaggtgatacatatagagagtattttgttaaaggccaaacactattaaaattatacgtgtttataccatgtacagagaaaaagaatttaagagagagcactgggggaacagaacatcaccacttcaaaaaagaccataataaaatttttgaagcagaacaaaacctaatgtggaggcaggatcattcatttgaggtagacaatgatttaaccaaacaaatagaatcactttaaagcacataccagatatgtgagtgtcatggtcataaagtttagctttgtctgggatggaaggaagtcagtgtagattttcctagggggaatttctgttccttggtgtaaactggataacagtgtgttttattttattttgttttgcttcactttattgttttctgttacatgaacttacattgagttgagtaaatttccatcaacttataacctcctattagaaattttctagaggctgtttgaaaaacatcaaaggacacaactaaaaaatgactacaaatatgccttgtttgttttaactcttttcagatacaaagccagcctgcgtatttaacaatgtggaatattatgatggagacatgtttcgaatggacaactgtcggttctgtcgatgccaagggggcgttgccatctgcttcactgcccagtgtggtgagataaactgcgagaggtactacgtgcccgaaggagagtgctgcccagtgtgtgaaggtaagaaaaggtgctaattacagattaacaggagcatacatggtatagagttctaaaatcaaaatcgtcctaattcagtctcatccaaaagtaaaggaatattgaagttccttttttagccttttttaagacaccatggtctgtcttttagcatgttaaagccaggtagagtgtgtggaaacacttccctaagggaagctatgcctgggtgtagacaatgggtcacctctttccacaggcaacgtgagatgtcccagagttgttttccgttcctcccctgcagttctagcaattcctcagcaagtcctagggcaaagctttatcttcaccctggcattagagctcaccacctcctcacctcagattgctcagttaggataatgtgggcctcaccctgacagtctcagcctgccggcccagagaggaactaactctgccactgtcgtaatacccaggaccctccagggagatcagggacctgctactgcttctctgaaaatatgtggtggttcacatggggtcgtggtatcaggtcaccacctggtgacaccaactcaaggcccagccaggtgtcaggtgtgactctcaggaatctgctttgtctggattccccttttctctccaagaagtaatatgttcatgttccttcaacaggctgcatcttcccatcactgatgttcataaacaataagcatttcaaaacagttgctctgaatatcactccctgcaacccacacattttacagattaggatgttgaagttcagaagagaaaagtcacttgcctgtaaagtcactttacactgcagccagtaacaataaccccgtgcctgactgtgtctatagtgttcttctgacaacacaacactgtttccccagaaaggaaggtcttgtgagccttcctgtcctaaccaggccccagatcttcaatctgaagtcgcatgtgttaatcttatgcctgatctctgcacacaaagtgggagggcacagtgtcatgccactttccatacttcctcattttcataaaattttctccttttgatatttgagcaatatttacaacataatattgaagatctgaaaatgtttaaagtataaaaattgcattcctaacatagttcataacagtgagttcttttccctactagaggttattttacccaacataggagaaaagtagtttattttttaggtgatgttgacaattaaaaagaattacttcaaatttttaacctttctaattgttttgttccctacctgcccccagtctgcaatagttctgaaactgtgcagcagttgatgctgtaaaaatgtagatacgaacctctgtgtagtcatcatactgagttgtctgggcatggatccagttatgtctcacttcctggaattcagatccaggctcaacgtagaaaaatatgtattctaatactttttacacaggaatttaaaaaatcttctcttgctcaggtccattggccgcctccctctctggcagactgccttcctaacgctgtgatggcattattttaaatgctgaccttctaactgactttattataatgtcccactatgtccttagaataatgatgaccaaactctatgaactgtctggattcctctctcagcacagcagtagttgtttgttgaagccagttttttatgtatttctgagaaagaaaattgagtaatttatctggttgctctcaatagagggataagagagggtttcatatgcagtatttatatacttgtcagtaacctcagaaacttttttttttttacagtagctttggctacttctgtctcccacctggggctgcagcttagcttcccaacttatgggagaaaaaatggcctaagttcacagcgctcctccaaggcacagtgacccatggtatgtctagactagccttgtcatgaacaagtccacagcaagaccactgttgcccacatggtcgtgcaggtacatgagatagagttttagaagtaacaatatcactctgacttagggcattgttgcttccgctttacagttagggaagttgaggtttgataaacatttatgtctacaactgcgaagacattgtcagagcctaaaatggagtcatgttttctaattaccaacccacagctcttgccacaaagctttccaactttacagagtgataacacctgcacattggtttttagactacagatcctcttctctgggactgctgtgtcaggatgagtagacataaattcagtgtgacagcttcttttgcatgcacccccagagactcctcatgcaaccctgcgcttctgttgatcacagtgggaatagaactgctgatgactagaacccagggaaaaaatgtctctgggtactgacagagataagatttagaagatgctcagtctaactctgaactcatgttctcatttagatccagtgtatccttttaataatcccgctggctgctatgccaatggcctgatccttgcccacggagaccggtggcgggaagacgactgcacattctgccagtgcgtcaacggtgaacgccactgcgttgcgaccgtctgcggacagacctgcacaaaccctgtgaaagtgcctggggagtgttgccctgtgtgcgaaggtaaatcttgcagatgctaatgagtccctggtgaatgtcttctgttggagaagcttctaccagcgtacgttcttgtttgtttatttccttgggcataatgtctgcttcacgctgttaccagttgccaacaaatttatcaaacagctcaaactgatgatttgaggaaaggttgcacatgtgaaatgagaatagtgtggtcgttattttgccattgcaaatatgcgcgtctgaatactttacagtataagaatatgtacattttaattaagttcactttgaacctaattaacacccaaaggtcagcctaacaaaatgaaattgaaaatgagaccgatgagtcaatcttagcacctttgacttgtgatgcttccatatgcccaagcgtcctggcaactagaagaaaagactggaaccatgaaagccaatttccactgcctagtgccgtcaccgagtatctgttctacttctcatataccaatggctgtggctttgcaattcctctagtgctgttatttatgtcgtggttacctgcatttgctatctctcttcttgttcagtggagggaagcctgaggcatcctggactagtttttctgtcccgactcctattccagctcatttcctccatcctgggaagattctctgcatacttaactcatgtcagtctttaatcttgtgtccatgtgtgttagtgcagacaagggcttgaatatttgtacagacatttctaatagagggtatccagcattaagaagtacatttgcatagtaaaatgaactaatgtggatcaaaaattaatccatgttgaagatggatctttctagaatttctaaaaacagatattgaaaaatggacttatctttccagaaagtcagttaagtagactaagtcttttaagtgcgaagaaatcttgtgcttccaccgaaatgttaataaactcagactccagagtttgcctgactagcttcatcagcctctgaggggctagacttattaaagaccttaaaaatcatataaaagtttaagcttgaggcctctctttctgttgacatcaccgattcccttgtcattactgtactcagagtgcagctgccacactccagaactttacagcttccagatgaccagttttgtggaagtcacccacccctgcatgtatatatactcctcccattccctaaaggcagcatttcagtgctgaaaaaaaaagagcatgtagaaatacatatgatggttgtatagtcggccttacaggaaagggtgccttactgaagcagatgaagataagaatgtcagtccctaagaattagggacaatctgttgccaacttgaaatatttaattacgaatatttgggacacacggtaaggaatatgaaaagcataaattcataatccagtaaacattagccttttaacctcatgggtcttatgtcataaattcaaaataaaactttaaaaacttgttgaataaaagagcctttcctctggaagtaaatgaaaggaaggctgatccttttgcacccaccttttgcatttatcagcatatccatcatgaagagtggagaaggaaggcagttggtgaacaggtagatatatatataactcatttattaccattttcttagcacacattgatgtttgggtaaggagtgaaacttagtgtggtcacttagaatttggtctctgcaacatctgcatagagttgtaatctaatcatctactgtttgagaaaagagttacagttttggtgagccattaatttgaaaaaattaagaacctcctggaattcagatacagcattggacacaaagataagtaagagataacctttaactttgaagagcctatttaggctgagttttgaattaaaccagaagaaagggaatgtccccgttgaggtatggtggggtaagtgcatcacatttgtacccaatttcatttaaccttcagagcaacactgctgaagcctttattatcccattttggagatgaagacattcaggtttaaggcgatttagatcatttcccccaagggtatagttgccattgtgtggctgagtgaagatcaacggaagtttgtcagattcggctccatttgtgcttgcttcccctgccccacacagcatcccagcctaactcatgccctgcttctagtgtcctcacccatctctactcacctctggcttttggctctgttgaggagtgagggcagtcagcggaggcaagggaggaaatcattttgcagtttgaaaactactccaggtattttgaatgtgatcgtccacctactgtctcctcgcagtttgaagacctcaggggaaagatgcctttgagatgcatccctgagttcacttctagagcctcaggtctgggcagccccctccacctcaacagagctcagcatccttgtcatttcagcggtaaagttctgctggccttttttcctctctgtctctttcatgctctggctctgatctctcatcaaacgtttcagaagattccattttctggttctcagaaataatttatcttgcttttcttgtttttgtttttaacttagttgagtagtgagtttcatatgaatgtatttactctccaataatgctttcattttaagatgtattaataataagaacacagattattttagtataggattaaaaaacagtgcacagcttaagataatgatactaaagggttatttatggctactaataataaacttacaaaataacacaaggtgaatggatcttactgcttagtttatagggtccaagaaagtctctgggatcatttgaagacattttttctcagcagtcattcaatatcatacttaaatataatttcaaatgatttcagagtagcaaaaggattgtatgaaataagaaaaagtgcaaggtgttaatgtgcaataaataagcaatcacccagaaatagttagaggaaaaccagaaacactggtatttacttagtttatacacacaataaattcctctgtgcacagttgcgtaaccagtgttggcccttaccctattagctacagtctctaggtacatcgtcagagtatgaaattagatgaaaggaccccacacaaggattgtggttttagattctaagtaaactaacagcatcactaaatatggcgtgttaggacctccagggaggaagaaccttattgtggctgttgttactggagacacataccttccaaatgacaagataatgtgtcttttggttactcctggaggactagggacatgaacctgggggcccttaaagactaggctgttacttgacagctaacttgattcacaagtacctaagtgctttttaaattggcacttaagtactctcatgatgaattcttagcaagttattgtcaacacccaattcaggtatacagataagcctttccagtctgttaactgattatattctcacattttgctttgttgacttttctctacatctcttgtttatcgatctcattatttttattttctgacccctgtgaagagctagggtggaaacgtgtggaatagcatataaagttttcagttgaatggcatacatagacgacacagccttaatctccttaaaaactaaaaacaaaaaagagattggacggcagaattaggtcttcatctgcagggccactgttatttgtaacccttaatgacagtggctaacatttcatacaattgttatgtgtcaggtttaagtgctttaagaggagcaactaatttgagatcctcacagcatcccttcggtatgggtgctgtcatcccagtttaccatcagagaacacaaagttcggaggccatgtaatttgcccagggtcatacagctcataagtgacagcacagtgtgtccccaggaccagaccctggaccctgaatggacagtgcctctgcgctgcagtgcattataccctgaaagaggctccatccccctgtaaagaaagaatttggcatattcttttgaatccctaaaacaacatgtgatgtgtaagtagatgctcaaaatttttaaatgagtaaataataagtgaggacagtgaggaggaaagaaagactggagcaggaagtcccaaccagacccttcatacagatcttctttttagttgagtgagggagcagaccctgatacagggttaccttaaccagagcgtcaaaagctgatggccattgggacccctgatctactagttgaaggaagaataatgtcagcatgcttatcactgaaaacacattttgagaacataagtaagagtgttatggaagtgtgtgacatgaggtgggcctacatgtctacaggccagttggaccagtttcctgcattgacggttcacccttctgatgggcactcagctctgggctccatccctgtgtcagcctcatgggccttccaagactgatgtgtattctgtggtttattctgtcccagttcagcccctgaagtccagaatcacagagtttaactggggcttcccagaccctctaaggctaatgcttgctgccacgttaatgtactgtttttaagacgccttgtgcatggtgtaggtgccactgcatttcagttacttacacgggcaaggattttttttacattgtcattagatattgagaattatttgctgattttttttttcaataatagcaagtataaatgctgccaaagctgattcttaatgtcagagggatcctgaggagaggttgccatttccattagaaatctattttgtgattgaaggtaagataaggtatcggggagggaagttttggctacatgacatctataacatccccgtgattactcaataagaaaaattcaagagatgtggacaggtgtgtggccagcttagctgtgacacctgatgcaagagattagagcttcctggggactttgaagtcttgatgtcagacctgatctgccttctcatcttgggctgcggctggaccctgcccaggtggccactgtgatctgagtgttcttcaggcctccttaggtgcaccatctcctgcacggaggagctgatgattttgatgaccttagggattttgaagccaacaccagagtatcacttttcaagaactaggaacaacttaggtaatattttaaaaggtagcattcagaattatactcaggttgccagtaaaaaaattccgtgctagcggttgggcaaatgggtagtttcccctctactatttctgtctgtctgaaaacaaagcaaaatccatgttctatctctaacaggaagtcaaagagttatttgtagattgttaaagctggatgagaggtatatcagagtccatagtattcagtattttttaagttttcttcttaataaaaagttaaaattgctatttgcagacatattatcagatacccagctgagtttcaggcctaataattctgctaacctggacttaactcttgaagtagaggatagaggaataagagattcactgtgcatggattccttctaattctgggtttaggatggaatgtggttgaaccaaaaaatccactatctttcttcctgccacctggctttcttggatctcttacttagggaatcctggtcctacttgggacagtgttgaagactggatgtcaggcacgtcttgacctatgtggatttagtaagccacttcagtctcagctcacccaatactgtaagttgtgctcctctaaaaggctggagttctgtgagctgtcaaatatattgtcgtcttcttcatcaatcccaaatttatggaagcactatattctctccctgaaggctgatgatatagcttgaatcaagctgcccttctaatgagatttccactgggctgccagaaaagtctgtaccaggcacatatctgggtgggaattctttgaaacaagaaaaaatgtttccagccctgcccataatgcttcctcactgaacagtatctcaaatgattaagctactgcttttgtggcacggagtcaaacatagtttggctgaccccaagaggcagtgaagtcaaagatgccatagggtcacatgttattaacattctggtacataacagggatcaaaactcagtttatgggtggtattgcttcagtgccatatacgatgctattattagtaagccaagaataataaaatattcgtaatagcctaaagactgttaggcatgtgttttatcctttaactctaaacgtcctggaaactagttccataaatggaaattaaaatataacacagtctattttttgcttgtccaaataaggtcatatgttgggtaacaaatgcgtagcaaatgactgtttcttaacctaggtctttaacataaacatcagaaatttttcaatgttgaatattgtcatattttgatttttctctgatcatttaaaatgtctttacatatttgcaataaaactagaatataggtaaagtaaatgcaaaagacactcacatccagccttaatatatcactttcaagattttgtgatttttcacagctatatagaaatatgtacattatatgagtggctttctttacatgttagatccaccacttacattaatagttaaacaagtgtagaaataaatgttgtagaagtagtttaatagagaagaaatgtttattcttacttatacctaggagttctgctgctggttctccaagtccagcatgtctttgcttgtgtcggtaatgccttgctctttgtacttgattttgagtaagactgtcatactgaaccaagttttacgagtaaaaatgaagattggtcttatactcttaatttgctagatgaccaaactgatcaatgccttaaatgttcagaattgttgagagctaattctgaaacacatgattagaaattcctctgcccctgagtttacagagctcagctgttaagtatttccctgttgaagtggcgtgcaagggggtgggttgctctttatttcctctgctgtctacttcccatacctaaaagggtattattgctgggagtctcataattttcctactaagacaataattgcatctaatagatcagacttgggcctgctaattttcatctaatcaacagaggcaggaaaacatagtctggaatgctaactatgtgaatgaaaaatatttagtcattcttgaaatgataggaatgtttttccaacaagcttaaataaacacaatctcttttgagactgtgctaaactttttttggatgagacaactcttaggcaaccaaacagaagttaatgaaggttattaagagacatgcccttcagaaaaggcctgcagactttaaaaagaaaagattccatcttctttatgctgcaaccattgataaatagcagaattggtttactttttagcttttgtctacccagtagaatttaacattttaattagtaatcatactgcccaatgttcaacagataccattttacctaacatggctatatgagaccatcttattttaaaatcctcatcttcatctcctactgtttgcctcagttccaaggaattcattggactcaacactcctgtatttatagcacctgattacacttttcctatgaagcatgtttgtttattcccaccaacacaaggtcccgccagataataaaattatttttaaacatactaaaatgtacatattcaagtgaagtgtttttcctttcacaagttatatgggaaaaatgtatacttactccagggatacagtcattcagaatatttttggtgcctctcttttgaaactgactttagagatcatagcacatccttttgaatatccttagctttgtaaacccttgactttgaaggtttattagactctaggaaatagccaaagtcatttatgttgaagtctggtttaaaaaaaaaaaaaaaggtggccgatctagctgagtaaaactgtttagaggaagcaaaaagtgacagtaaaataaaggcactttgtcttctatgacatagtaatttgctctgaaagcaactatgaagaggtttcaaacagaattttaacatgaacagcattttggcataagaatatagcctctaaaagtgagtacttttatcaataacacttatttgtaagtataactcctggtgtgtttataaaaaaaatcaattcacctactacatagtatttttatgacttctagggattagaggcatgtatttaaatggtcatatactgtattacaacgtttttctgaaattgcaggtgttctattccaacatttttttcaaatacattagactaaaataatttgcctacagaaacaggtcaaaataggttgcgattctaatataatttatttttagtattttagttatccaattccacttctagttataccatactgtttcctggtatagtcttaagtatatcctataaaaacagaatgatttcacattgcttaatatatgagggttagcactgaagatagtgaaaaatccagtgagtcactgttaaacccccattagaacttttctgtgttgtatctatctgattattgaagatacagtgtcacacaagcatataaaccatctgttgcaatactattttaaaatcgtaggacaggttcaaagaggggaaatgtccattaaagaacgcctcttgcgcatgtgtgggtctccccatcacaggtggctgatgaggtggcaggagcagcatcatacccacctatcagcctcttaatttgagagccccaaatactcccctgcatgagctcccagaatgcagattgggaaatctgttgccaggggactcagcaaagccagatcttggtccaggggtcataccatcagtttaatctaaatttgatgtgctttgagcaatacgggacatgtaacatgtttctgaaatttgccagaaagcatgcattttgttttataaatattttgagtttaagttgatcagcagtttgaccaaatttttatttaccatttatatctacagaatacctgtttacacctcagtggagtttaactttcgcatctgagagattagctggatttatctggtttgtttgaaacagcctagttcaggtatatggaccatttgagatcacagaatttaatgctagctgccagtaaaaagatgcagtcccaggctccagctcttactttgcagcagcctagtgaaacacaactaagaatcctcaagatcctaaggccaagtacttgatccttgtggaccctgcaaatcatgtaactttcacattggctgccggagcaaaccgagagttgatttgcaagccaccgctcgaccagcaccagaactcaaagcatgcgttctgtgtgcttacctcatccctgactgcagcttattcttttctagctaaaatttacctggatccccatttccttactttaaaaaagtattcattcatgatataatttgagactgccttggatctattacataatctaatgaggtatatttatgtgcttctttatgtataatcagtgcctaccatttgcccgtgcctgtgcctttgtgccttgcatggtggttgaacccccttagtttgcctatcagtaggaagacaggagatcatgttgtttttcaccttaatggacagctattgccctgcatgtcagctcacttttaaaacaattcaaggagtctctatttgttagggaagctgtaatatgtttggagataataagctatccacttgggatggcctcgggccttgcatacggagagggtcggcaagctcagatcttttcaaagccataaatctctcatcctttctgggaatcaagtttttaaaagattccatggagattttatgttagacgaattccacagggggtgtgtcccatagtcctgtgacagagatactaagaacatgactcattgcatgaggagcccctacaattcttgttatgaaagtactggttgaattttctcttactgttgacatatgtttgagatccctgacttcctaacactgagatctgctcgttaaagacagtttttagaaataggtcttctgtgtctttcaacttgagagtggcaagaaacactggcaaagataaaaagtagtataaatgattctgtgatgagtttgcccttgtccctaaagatctagcaaggcccccatcatgagagaggaagaacaggggccaggcacacagagtcattgtttcgacccacattggattagctgattactaagagatttctgttctcttggagacatcatagacatagtcaaaatgtagaacaatgatatcagactgctactcagcaaatgtgaaaggcgtcactggctggtcactaacgtgctccaaagcttaccagaccatatgaaaagatagcacagacccacccaccgtctcagatgcttttcacgttatcagtggagacaaaaaatgatgcttaagttacaacaggcagggttcagaatgctgaaccaattgccatactatttatcagctgtgcatttgaggtctgtgaaagggctaagaattcattaattagccattacctgagaccagttatagctctgagcagacaagatcagcatgacatcaataattacaacaagaagtaatgttgctgtcacccttacagtatagtcttttcttgacaagcttgtttgagcattattggaatattgtgaggtagaaataatgagtattcccattttctggaagcccagagaggtccatcataacatgttagcctaatgagagagcagggactcaagctatgttttctgactccaaatccatgaccttggcattgcttcccagtagacccccattgtgagaagacgggatgagaaaaataagatgatgaatgtcaaagtacttgatcattgtggcttagattcaaaggccagtccactcctggctccatccccattgctgagacccggttactgttattctgaactctgtggcccagcctttgatcccgggttcttctgatgagcctctgactggaattttgaccttgctgtttgacttctgggagagctggatccgttttctgcttctacttgtttattcctgcatcctcccacctagggacattactcaacccaagagccccgacccactctcccatcctgtcaggcttgacctctgcccattcttgtgcatatccatccaaattctaggccccaggccctaaccattggcacttaagtccccactgagtaactgagctgctcagcctccatcagtctgccaggcaccaggataccatcatcagcacgtgtgcattctgctatgcactcttccttttctttctctgattcttgtcagtctctaattaagccggttgtcaatttgccaagcagtcagcaaaagtgcccataacttcacgcagtagaagatgagctcctgagttgaatgactgcctagctgttttcaggattattttaataacactttttatttggcattatcaaggagtagggtagttccagaagtgaattctccagataattaaaatttgggatgtcagatcttacattaagaattttataggaggccttctataatgctttgtgtacttttctgccttcttaagccaaagatacagatcatatgatcgtattttaacccatctcaggaaaccgagtgtcatcactgagtaatctcattttggacggcttggatttggggatttgcactccattttcaccattattaagtgtgtcaggtttacaacagccttaagatctggctttctgcttcagtggagctcatttattgtgtacctcctatgtgcaaaagactgccacagtggtgtggaccctaaggaacttactgtctaatcttctaaaagttagaaaattagagatacagcctcttaggacaattttgaatgggagctcttctttgccaaataatgttacactgactttaggtgcttagatgtctttcgttttcccgttttgttcattcattgagcagttctatagaccaaactgtactaggtgctgaggttataaacaatgaatgaagtattgtccctaacgtgcagacccttcctccctggttttcaaccatttgccagaagggtaggttccagttaccaaaagtctgaccgcctgacccatcctccaagttgaaaatagctacttaaatgtgcacacacacaaacccgcatacctattaatgtaacacattatttccacttaaagctaccaaaatataattcctatgaacattagcaataaaaagaataagaataaaatgtaagacaagtataaaagatctagattcttagaatccagtgataattttgtgagctatctcaagctggattcctggaaaaagataccccactctataaaaaaaaattttaatttgtcttttgtggtcttttaataatctcaataatgctaccatcttttcctattaaatatgtttttggtaaaggaagaaaaatattaatatgtctaacagccaagattccttgggaaaagcatacaaaattaataaataggtctaaaataaatacatggttgcttccttttccgatcacaaaataatacaaatcttgggaacatttgcacactgttcattttaaaataaaataaactgctctgagataagtacttcagaaattacaaggatgtaggtgttgttatgagaagtgtacaaagggaaaaaggataaccaaatgtgtagcggctaaaagaatttgaaaactccaaccgtaagagacttttttccatgacttaatgaggctttcttaagtacacattcagatgctacggaaattcccacttccagattagggaatttttgtatcttcaattttttttttttcttattgtctgctttagtagagttttccctctagcttcatttgggaaaatttcatcttcactgtactttccttcccaagatgcaattatgttgacaatttagtgatttatttgaaaggtgttctgaccagttatgggtcacatttgaaaagcatctgtgttaacagcttgacatatgaaaatacagcaaaacagacaagctttgatgctgtcttggccagccttatctccagttttatggccctggctaggagacctgatatatttagccattgaactgccatgtcaagtcagtgacattttggaattttcctactcattggatattcacgttgcttaaccacgttcagccccctccaaccccccaatccctgcccaaaatagaaaaataaaactaccttaagaaagagcgcctgaagtaagtctgaaaagaaagcataattgttcatttttgtctctcataatcaaataagcaggcttgggaatttacaaagaagagctatgtaaaatctgcaaagcattattaaagcctgaaagaagaggtaataagagaaacgagagacagataggaattgttagcttcatttatcttaatacttccacctgagtattttttcacttgtaaagaaatgtaagaatgtgtgtgtctttaaaaagtactttttctgtaatcccagcactttaggaggctgaggtaggaagattgcttgaggtcaggagttcgagaccagactgggcaacatagtgagacctcatctcgaaagaagaagaagaaaaataaataaaaaggaaaaaaaaaagcattgttttctagaaatttgcctacaaagaggtttttccagaaagacttttcttagtgtgtgggtgtgtgtgcatatgaatgcataggaacagagggtgctggcagacagctgctttccacagccaggcctgcagtttaccagaggacagcacagtgaggcagcagtcctagagaccatcagaatctggaaacagagttaattaccctcctgacaagacagtactacacacagacccaacagggatggctgtgtatgccttccacagttgtacatttacagagtcacccacccatactcaagaactgctaattggttgtcagctttcccagggctgctaatcagaaagagtgcttcacacatttctcaaaggagataattaatattatttctgagggagaaccagctcatagtaatctatctaagaaccttgtatggattaattcaaaaccagcagttcagtggagtaatacagattagacagcaatttaaaagcatccattaatattgtcatttaggctacatatacctgaaatataaaaattattgtattgtttcagaagtgaatatatataattatacatttaaaaataactgaggatcaaagtatgttcatttttattgttctcccagagttgttgaactatataatgtgagggtaagactgatctacaaactttataccagcatcttaaaaggctgaatttgagtttcagcttcttacttccttggccagtttttggagaatttctcataaaataaactaacaaaaggcaagaaagtagagagcttagatttgtttgcttaacacatttataacacctgaataaccgaatatgtatttatggtttagtaccgtggccttgaagttagattcatgattttcattttaactttatatttttaatcaaattaattgtgatcccagtagcttaatttcgccattgagtagataaaattgctcctaggaaatatgtgagcatcaatataaaataccgatggtgtttttcaataacagtgtctgaagctctctaatttgtaaaaaatactaacattttcctggaaataattttactgacaagacatctgttaggctttttaggttatgaaagaagtaaccctaaatttttaataaatgtaaaataaagaatcaacatgtgtttgtgtatgttattgcacgttagaagatattttctttcaaaattttgttttctaagacttgggataagaattggtggctgagcatctgcactcctgacacaatcccaagggttctttaaaaatagctcttctggacagtgtaaggtgcttggagggtctctaaaaatcgttcaagaaaacaacaggtagaggagaggaaagtttcccactcagatgctgagtagaaaacagcaaaccaatgtagacataacaaacacccatttttgttctttattgcttctaggctcagaatattttagaattcttctccacaaggaagctgttggagggttccctttagaaatagttgtagccaaagacagtgaattcctgctgtttcaagccttcttcctttggaggacattaaggtatttctttgattcctcagctgattcaatacaagatgagatagaatttcaaggtgatcctataaacagtacttcactgaatttcccctctccaaaaccccacctctgtgcaaggatttcctcattctcctaaatgaggaaatctaagaacatttctctcctttgaaagaggcctactaacacatttctaccaagctagtttaacgggggacagttttctttgctccaagcagcaagtatcatgtacagggatgcatcagtgccgccagaaatcttagcaggacctctgttcaattgaactttgtttacgaaacacgccaaagataggggatcaccatcatcctagaaaggcttgtattctccgacacacagtttcagtgccataccccctgtaacataggagcacagaaatgtaggatttaaatgagaatcttctggtcttcagaccaaaatccgacaggcaatttccgtattcaaagcactgttgcatagactagagaaaagtctgggataataacaattcctgatgagcaaatttcagaatgctctaacttttagacaagcagaatgtatatttcacatactttgctcacactccctcaagcctctttatttatttatttatttatttttttttttttttttggatgagaaacagtcatactgagatactatgattctagattctttaaaatcacctcttctcccaccaggaactctcttggataaaagctatgttaagaatctgaccagctcttggtcattattctttaagaactataaatataatattgatttgaaatgctttaattgagaacagtgtcaaatatgtctcactttggagctaattatttagcataagaaattgaatctcagttgtctcatggcacttgtttccaaaaaattgccctgacattagtaataggatcagttctgagattatataataatatgttggactggaagcaaactctcaaatatgtttaacaataatgtgagatttttttctagataattcataaataggtagatagtctatatacttaccggtcatatttttgtcgtaatgttgttctcatggaaatctaactactctggctatggtctcacatgataggaaaccaagcactaaaatgttgggagaatgacgaaaggcagtacactataatggatgacttcaattgaaatgccaggagacaactagttgcctgcaaatgtgtacaactcaacagttactccaattacatagggtattagcagtaaggacccaagacacatgtgttaccacccggaaaaaaactttaaaatttgttccagtttgtgtctgagtaggaaaatgagatgtatttgttaaatgtaataaaatgagatgccaagtgttaaaatgtcttcttaagaaaacctagatttctagctatatttaacatatcacaatgactattgttgtgttcaccctaatctattgaggggaaattgaatagttctaatgtaaattgaaagttttcatgaataaaagattttgttgtgtttttctgtgtttaatgttaaatattgagggtataaaaatttgaaatggctgtacttccctgtttctttcatctaatataggtcataagtgaatgggaaaatactaatttcagaggcacaaaatgattttttgcttcttgcatgctacagcgttgaggcttggaaggtatcccatgggacttgttttacctgaaatatttaacacacacattgtaagaccagcacatactgaacggccctttatgcaattttatttgttcaagtgaacaaaacctgttatgctgaatattttaggaaaacatattgaacatatttcctctcctggagaaatgtgtgttagatgtacatctgtgactgtgtacctaactgttgaagccatttggatagattggcttctgtgactgatacggggctgcccaagtcagcattgtggttctgatcctcaaataacccagtccatttgttcctttcactttctagccacagatcacaaccttaatcgcatgttaatctaatatattttttaaaaaacagcacatacatcactattgagagcaaatatcatttagaggtagaagatcatctttgtaaaagttggacgatggattctctaagcaaatccctaaaattcactgctgctaaaattccatactaccctatgatatgatgattatacatttttcaaggtcagtttaatcttcagtatatacttttccatagtatgttttctgaaggcaaaattttctcataaatttcacatattaaatgtcagtaaagaatagaagattttggtatgtgtagatatgcttaagacatttctttacccataagctgtccaggaaagcagtgtgcctagagttcagaattcttccctcaactttggcctaatcgctctagaacatagaagtcctttctcactgggataacctgtggtgggtttacttaaacctgatacttgccttctacgctctctcatatttgtggttagagtaattttgacaaaacattggcagtcttgggactgaagactggaatagaatcattatttggggtagctaagaaaagtagtgataaaagaaagactaataggtttgagaactaaagatgtttgcagtaaattttaagagaatggaggggagcagcaatacgctaactcaggatgtcttaaaacaactaaactttagttattttttgatgtttacagttatctgtcaggaagaataccttggttattgaaggaaattagaaactacatcagtgaaaagtttatataaaaattttagtaagatgctgttctttgtaataagaatagagaatgtgctatactcacttgatacatatttttactgggagaatgctgatctaagcatctctttagtaagtcatcgttgcctgctacctgtgaagagttgaatcactgtccccttttagtagatggataaaaatttagaactcttgatctcagcagtggcagctaaaacacttattttgatctctcttccctggtaacaggagatgaaacttgagaaaacagtgtggactaatggatagagtgttggacaggaggttgggaacctctgttctgttctattcccagcctgctactgggttactatgtaaacttagataagccagttaccctctctgcacctcatattttccatctgcgaaaatgtaggtagagacattctatactcagctctttcacaaagatattgtgagcaacagcttactttgaagacgttagtatatttttgttgaaaagatgttgcataagtatgtcagtgcctctgttccctttggcaacaccgttcccacaacctggcattatataaactgtcccttattgatgcattgagaaacaggtaccattacagcagattttgtgttgcacagaagctgagagtgtgactggagtcagactgcctgggtttgaatcttgggtccaccacaaactaatgctgtaaccatgggcaggtcagtgtgctagatttcctcatctgtaaattgaggataataatagcacccacctcattggaatatggtaaagctggaaggcatttatgaacagcactttaaaccttatataaatacataatatgctttatgtaagtatatgtagttaccgttattacccaaagcaattcttcattaatatggtaaagcgtcacctctggtcttgctttgtttagtgcccttattcccagcatggctgctcactctttgtcctgaatgtgtgtatctccctctgctcccacaagtctctgggccctgaggataagtgtgtagttatctgtcgtatcatctaccataagtgagggagtgccacataaaagataaaagaaatccaggtgttttaagctagtctcaaaaactgatttattaatttggaaaaaaaatagtaaccgatttcagaagtattacagaatgggactgagataattgatagttgacagctgtatcctgattattataaaaaataaaccggaaaacatcaggaagaaatagaagagcagttaacaatttaaacagagttcatgttaacctctctcgtctgcttccagtagtggtgaccatcagagaagaattgtgtgaaggtaccaaaaactgcatgaattgctcaaacgcaaagaagcagagtgttcacattttcaaaaatctgaacacaaatatatctgtttcaggggttaaagatattactggagcataaaagtttacgatttgatgacaattactgatttgatttttgtaacattatggtgtggaatttcaaaaattgaatagcatctaaaaggtaatcatatgtttcattggttatttttttctctatttattattagaaccaaccatcatcacagttgatccacctgcatgtggggagttatcaaactgcactctgacagggaaggactgcattaatggtttcaaacgcgatcacaatggttgtcggacctgtcagtgcataaacagtgagtagacagaagactgtatgttttttctgaggcctaatatgatattgtcaaagcatattatgtaattgaatatctttttcacttctgttcagacattcccttgacaacctgaaaaaaaggggaaaaaagttatttttaacacaaacaaatacatagtcatttgggagaaaggagctgctgctttattgtgtttttttctctgtttccttgatggccagttgcatcaggagtgcaacctggagtggctttggagtgcatccttccagccacccagaacgctctccctttagtacacttgccaggtcatccagtgacaaggaggtcacccacgcatacagtgtcacattccgcatatgacagccataatccttagactgtgcttcactttgttgaccccagctttgcctccatgcagattccaatcatgtatccaggccctgccctctagagtatagaagagtatattgtatttcttccagaaaaaaataaaataatacacacacaccccacccccatatatgttaaaaccatttcgaattcccctaattcttctgccggaataaacatcctcattctccttgaccattcttcaggtgacagttcctagaactttgttgatctttaccatcatttgacacacaatatgtcattgtctttacataaaatatggcccacaatcaagatactccagaatgggcaggcatggtggctcacgcttataatttcagcactctgggaggctaaggcaggcagatcactggagctcaggagttcaagaccagcctggacgacatggcgagatcccagcctctaccaaaaatacaaaaaaaaatagctaagcatggtggtatgcgccagtggtcccagctactcgggaggctgaggtgggaggatcgcttgagcctggtggggcaaaggtcacagtgagctgagagcgcattactgcactccagcctggatgacagcaaaagacactgtctcagaaaaaggtactccacaatttggtctgctgaatacagtgctactgtgtggcctaagtttgcattagctccttgaattgcacttcgttggctgatattgaggttataagtagctaaaaacactaggaacttttttacatcacctgctgttaggtggttctcatctgttctgtaatagaacgtttgattttttttttaaacgatataaatacccggccaaatataacaagaaattatccgaatcattttaaaccattttctaactagttgggatatttttgaatctcaataatgtgatcttatactttatgcctcccagcttatattaaataagcacaacttatatatccttatctaaatcactgaattaaaataaactgcacagaaccaaggacaaagacctgcagaatgatgctgaacatagctgcttacagtagtcctaagcatttataccttgagtagagttatttagctgacaacatatatctccacaagaaatcttgaaagacacttcgcccgtatcttgtctgaagtcaaaatatattgcaaaatacatcagagcattcctttgctggaaaccctatttttaaaatgagctgaagttataggggcctggcttatttttccagaatctgtactggctcctggtagtcagtgctttattcccctaaatgtcacaaatcatatatttaacaattatttctgaagaattttcagttgtgaatgtcaatttatgtagtttttagaacactttgtcccttttgaattgacatttggcctattttcttaaatctctttccattctcttcgatctctctcacacacagtactggttctgtaataagcgggctttctgtgggcctgtggttgtaattaccatggctcagagacttggacttaacgtagacagatgctcactttctgatttatcagttatctcaggctttaacataccacttaaccttaatcatttgtcactattttaaaaatatttttgaagaagatacaaaataggagttaagccattctgcttcctcagttacatgtgaccatcacactatctacagtggcgttagtgctaaaactgagtttataaaacgcctgttggccaggcgtggtggctcacacctataatcccagcactttgggaggctaaggtggatggattgcttgacctcaggagttcgaaaccagcctgggcaacatggcaaaaccccatctctacaaaaaaaaatacaaaagctagccaggcatgatagcaagggcctgtagttccagctactcaagagtctaaggtggggcgatctcttgagctcgggaagtcgaggccgcagctagctgtgattgtgccactgcactccagcctgggtgacagagcaagaccctttttcaaaaaactaacaaacaaaaaaaaaactcttgttgagcttgtagttactaccatctttaaatttcctataagcctctacccatttgggggtattctgacttcctacacttgattctgttcggggaagggtcagtccctgttgccttttatacctccctttagaaagccaagttcactagagttgccttggcagcccaagttttctcaaatggccaaccttgttttttgaacaagataattagtaattgtcatgaagtgtttatattttaatccttctaatgcctcttacattaagaaagctacatctttcttaacatgggatcatatatattaatacattttttctgagtttctaaaaagtctaaaaatacagatttcattgtgtccagtcacctcacctacacttgcgcctgggttttgctattgtgaaatcttggccacccggtcatgcttatctaagacttcggtcacttcacacggaatctttcatcattaagttcaaagaagcagtttccctcaactgcctttgaaggaagagtcaaaatatgtcccttggcaaatagtcactggcaaatagtcatttggcaagttgagactataaggaggatgcatatttaccctatctttaggttagtgttttgtttggcattttaaaaggatcatcagcatgtgctacctgagtgcacctctgtttcattcacacttaggaagaaataggtacaggaggagaccattgcattttgtatcaataaatttattatttgcaaattgtacccatttatacagatagctggccttccttccttccttttttcacctaatataaacagagcacctgccacattctaggtagtattctaggtattaaggccacaaagatgactaaaatgcaagaccttccctaaggaaaaaagtcttctgtagcataaacactcatgaaatatcactactttaagccaaaagctataacgtacaaatgtaaattattttaagaggaagctttggtccttcagcagaacccaggcttatgttcacaccagagtagagaaagaactgcccgtctcccagggctctacttggtgctcagcagatactggctgagtgaataaaaaggaaaccttcaggatcagagatgcctttggatatcattcttgcctgagatctccctttgaggtcttgctattctaataatatatccatcttattttggattcttcttaaagttagtcttgtcatctcgctcactgccccactgtatacctaaagacttacttcaacactgattggaatttttcaggttgtcctatacagaagtctagacatacagcattctgctgtcacctcccccattcgtattagcaatccaggttatttggcaactttggaagccacacctttgggatgtcagtcaaatcaaaccaaatttccaggtcctgggttttgtcagattcttgcgatcgtatgcaactctcctctcaggctctgcacagcagcttttgtgttgcacagaagctgagagtgtgactggagtcagactgcctgggtttgaatcttgggtccaccacaaattatgctgacttccacatgggtaataaaggcaagttgctttacttctttgggactctgtgtccacatatgtaaagggcaaataatagtacctaactaatgggttattttgaggactaaataaatgaatgaatgcaaagctaactctggctggcatatggccgttgcttactctgcactgtaactattttatagcatcttcttctgagtcggcccaagctagccaacatggaaagcccccagcgtccccgcccccctttgttcccaccccatcagcctgcctccagttcttcctgccctctaaggacactcacaccaacagctttccttttactttttcatttcattgtaaccctcaaatattatctttctcctccttggttttagagaagggagtttcttatagccaactatggaataataggttgttttttttctattgcagctgctttatataggtatttattttgtcccaaattcacccttacattatttttctgcatcccatcaaaacctttttcacatacagtagtcctaagcatttatacctgttttctcttaaggattaggcctagtttccattagcttctagattttttttttatacagggtcttgctttgttacccagattggaattcagtggtgcaaacacagctcactgcagcctcaacctcccaggctcaagcgatcctcccacctgagcctcccaagtaactgggactacaggcactgccaccacacccagctcattttttttgtatttttttgtagagacaaggttttgccacattgtccaggcaggtcacgaactcctggcgtcaagcaatctgcccgactcgatctcctaaagtgctgagattacaggtgtgaggcaccgtacctggcccttcaagatttcttaaaacaaggccagcaccccacaagtatttcttctgtcttcgttgatttgttgttcttcattcactcattattttattcatctagcatttgttgagtgcctactatatcctaaagaagattaaaaatagtccttacccttgactcacattggtaatttgttggtaatattagtcatatgttaatatgttgtaaagagacaacataatctagcatattttaggcagtcacattaggattgaaatcaaaaccctatagaaacatgtgcttcaaaagtatgtggcaagtatatgatacagaattctttcatttgaacataacgtaatttgccgttttaatcggtaacaaataacattcttgtaacactaagaaaagtagtactccaggacatacagaaagtttacattatccctgactcagttcctcaaaaacttgtttagaataaaaaatgtttttaaaagtatgatagcaacaaagtttaaaactaaaatgattttaaaatgatataaagcaactagtaacctaacactttgtagatacaagcttttaacaacattgctctttaaccagtgtcttttgctaatagacgtaatatacctgcttactacataaactctgtatgaaaggcatctgcatgaattaagtagcatcagtcttttggcatcttagtgtacacatctttaaatcaagtggatttgatcagattatttgtaagttctcttccaattttaacattctttaattgtagacattaatagtgctttttctagaaactgatgcagacttgtagaattctgcatcagtcagcagagaggaaagagccttcatatttttcatgaaatatgtatctgaatcaaacatcacaagaaggttgcagcatcaaatatagggaggcaggctccttgttttatttcactgtaattctaaactaacacctatcagggtcaaaattgggaccaccatttgtaatgttgcatttctttacttagtagtcttgggaacttcatggccatcctgaactgataataggtttgtaggaattgccagcatctaagagtttaaaatacactaagtcctcacttaacatcctctgtagattcttggaaactatgactttacgtgaaatgacatgtaacaaaaccagttttaccagaggctaattgatataaacaagagttaagttcctaccatatatttctggtcacgaaaacatcaccaaacttctaaataaagacctaaaacatttctaatagtaacaattaaagtaagcatgagttatatatacatttaagaaaggttaacaaaaaacaagtacaatgatgattccccatttttaatgaatcagtgagtgatagtggttgtagtggtgctgtgttgaatcaacgaataaatgtttgcaaagcaaacattgtaaggagcacctccttctgccatgcagttcaaacacataccatacccagtgtggcaggctcactgaacgctgttgtcctgcagtgtttattgttgtacgtttgtgtgattatcacctgctttaacagatttgtattttataagaatttgtatttattcactcatttattttccaacttgcttattccagtccagggttgagggtggccacagcccatcccagcagctctgcaagctgcaaggtaggaatcgaccttgaacaggacaccatcccattgcagggtgcacacacacacacacacacacacactctctctctctctctctctctctcacacacacacacacacacacacacacacacacactcagattaggaccatgtagataccccagttcacctaacgtgcacatctttgggatgtgagagtacccagagaaaacccacacagcatgagagaacatgcagtctccacacagagagtggccccaaccgagaactggtttttattcccctcctaaaagttatgacacaatgatgttgaacaaaaccattgctgtttgaggacctgctgtactacagcaaagaagtatgcagtactcctctaggggacaccatccacagtgtgttctccatggaggttacgttgtatttatatataatgaatggcgcccccgacagctgtgtcacgttttgagcataggagcaaacattcctttttttccagaatgaacagagttttactacatagttgctatcgaccggccatgctgtacaggccctgtactttgccattgttcatcactttctcttcaatcgtaacttctccccatgtattagaaagcaattttagatcacggtaaagtcatgacgctgaaaaattaggaacataaagccacctttttctgcgtggttgcctcaagtgatgtactaaagctttacaaacaaacatataaacccctacccttctatgaatactgtttttctactctttatttatgtttttatttatttattttttttttagacacaggttctcaccctgtcacccaggctggtgtgcagtggtgcagtcacagctctcactgcagcctcgacctcctgggttcaagtaatcctcttgcctcagcctcccaagtagctgggattacattcactcaccaccacacccagctaatgttttattttctggcagaggcaaggtctcactatgttgcacaggctggtctcaaactcttggcctcaagcaattctcccacctcagcttcccaaagtgctgggattacaggttccagccagccgcagtcagtctcctctttatttaaatgtttgctatgatgatgcatttctcttaagaaaacttcataattgacatatgtggatttaggactaccttccagtttttaatgttgtctatttctgaactagaagatggtattttgagatgttttggcaagtgctagtatttcaggaaaatttcaatgttatcagagtaagttattttcatgctgtcatttctctgataatatagcagtcttgatgacagtggaggagtaggtaacaagaacattgattgatgcatttagttagcaaatgttgttgaatacccactctgtaccaaataccatggttgtccctatacagtgtgtgcctaaagatactagggcctgggcctagagctccctctattgggaagctgaatgtagatgggccagagcataacatgcaggagaatggtcccaattcagggcagcactagagcatcccactcctaggaggcatagccagtctccttctaatgaatgtcctgtatttttatttaaatgtaccagcctttgtttgaaattccattccattgcaaagcagaggtagattacagactagtttttatcacattgtttaaacttgaatggagacacaacagttttctttaaaggtgaagcacattcaagatcaaggtctgtggaaaaactccttctttattgcaggaccagaaaaataaaggcaccaaggtgctcaggctccaaaattgcagggaatttaatcccaagggatgttgactgactctgggaggttttcagggtgtttttaattcatctgtttcccaacataattcatttgtagccatgacctaagcattcttgtgacagaaaaatgggttcacaattgacatctgtgttagagaaacatgactaataaagtcttcttttttcaccattcccttaataatggggaatgaaaaattatgacctttcaagtcatataattacaaatttctaaatgaaccatttagaatttctcttttaaggatgcaaattagtaatcagttgctttacagtgtaatacaggcacatgaggttatatttatatgtgtaataaaaggtttatgataatgacagagtagaaaattacaccataaatcacattttccttcttaaaagatagcaaattaaatatgcaaatattgccaactgagattcacaaaagatgctatcttgaaatatttatgtaaaacacggacccatttcacctattcattgtagttaagttttaattttagattataatataagtgtgttttgaggggacagatgcgttctgtttttcccagtgacttctgtgttattacaatattcatgcttaaaggacggccagataaaataaaaatttgttcatcattccaataattagactctgcttcccatttcaccagtccatgtagaacaatattcaaacattgctgtactttggccatcaccatattaacttcccttctttaaatttgattgtctttcaaattctatatttaattcacacaggtctcaacttgcttgctttatataattaagcatgctttttttctttttaaccttaaacatttctatttcccttttctctcgtaagccctatataaccttttaaaatcattttagaagacttctattaggctaataacttcagtaatgttgctagtcaccattgctactttcctttttgctcttctaaaatagtattgtaactgactagcagaggacagttaaacatcactccagattctgctaacgggatactttgaacacttcaaatagtggttacttaaaccttaatatgagtattttttcaacacacacattttttagcctgtgaactaaaaagcctattatgtaagtatatccaaatacaggggtatttgtcagcacatagagaaaaaacatatctaaatgtaacactgaatattttaattactatcattttgtaaaagatgtacttttttgaaagtaatagtaagaaatcccttatgctgcatacaatatgcagtattatatgatagcatctaacacccataaaagtagttgtcatgtggatatttaaaaacatgcgttatgggatgggcgcagtgactcacacctgtaaccccagcacttgggaagctgacactggcggatcacttgaggtcaggagttcaagaagaacctggcaacatttagtagagaaggcgaaaccgcatctctactaaaaatacaaaaattagctgggcgtggtggtgcatgcctgtaatcacagatgcttgggaggctgaggtgggagaatcacttgaacccaggagacagaagttgcagtgagccgaaatcacgccactgtactccagtctaaatgacagagcgagagattctgtctccaacaaaagaaaaaaggacatgcattattatggacatgcaatagaaataaaacatataatgaaaattggactgtaaatttctaattcccacataatgtaaatggtcatcagtggtttgaagtgatttataaagttcatggaaaaatgatctcagtcattaattgtaatagttatcagcctgctgttcactcagagcctaccagatttgagtacactttagaaatctatgcatttcaaagttggactttattttgtttattattaccaaaacatggagtcatgtgataaccatgaaatagcacagtctatgctttttaatgataaccagtgccatggtagagctgagaaattgagatctgtggaagagtggaggattcagggaccgtatttcagcatcgaagtgttctgctctgttcatctttggaagaaacatgccgtctctgtgtcttcacagccgaggaactatgttcagaacgtaaacaaggctgcaccttgaactgtcccttcggtttccttactgatgcccaaaactgtgagatctgtgagtgccgcccaaggcccaagaagtgcagacccataatctgtgacaagtattgtccacttggattgctgtacgtatttgttaattcagaaaagctattatgaagtgcaacttggtgaaatgtttctacacattttgttttatatgttgtttgtgaattaatctatggtatattgagcccagaatgtctatacttgttttgttaggtgattcagaaagcagggagaaggttgtatctccaaaaaaaaagaatcaagttttacttttactttttatggacatgggccagacacaccctttgtgcctgttatatgagactttcccatagcagagtcctttagacactgctggcaagattaggagatggaattgtgaggtcccagtgttggaagtgctacaactcttcacacctgtcccaaggtctatttgtgatcatttatttaacacatactttaagatcaattgaagaccgaccccccactcacttgaaatacagtgcatccttagctgccatgcctaggtgtctcaccttggaactagtcagcgtttcgtatttttttctttatctagcgttagatttttatgaattttcttggagctaagggccattacttttattttttaatatactttattgagtcaaaccccatgagaatctagattattccagggggggaaatagacacttcatatttgtttctttcgtgtctgtataagcacctatatttgcctttatatcaggttgatgcctttagaaaaatcaccttaatttatatttttccctttgctgtctttctttcatttcaatctgtctttccaatttgatatgtttatgtagtgctagattccttttcttttttttttttttttttttcaggcagggtagtgctctgccacccaggccgtagtgcagtggcacaagcatggctcactgcagcctcaacctcccaggctgtcagtcctcccacctcagcctcagcctcagcctcagcctcccgagtagctgggactagaggcatgcgccaccatgcccaactaatttttgtattttttggagagatggggtttcaccatgtttcccaggctgatctggaactcctggctcaagcgatcagcctaccttggccttccaaagtgctgggattacaggcatgagccactgtgcctggcctagtgctagtaattataagggacttagacctatcatctctttcccatcttctgtcagtcatctttttcattcttcatttaaaaattctaggtttgggaggggtcgtctttataattttcattggataattaaattggaaacattgttccgtaaaattccccaaataaaataatgaatcatcatcattcttaatcctaaaataagaatatgatgtcaataagagtattatgtcttagcctaactgctcatataaaatgaagtagttgtatcacaatagtaggtagcttcaaccacttgctacagtatcatgacagttcagaatcaaggctgtgttcaaatccaaccgtcatgttggagaaaaatctcttaggagattgtagatttcactttgtattcctgtcagcacattcagggaggacccagttggacaccttggacaactgaatattatactggctagaacacatgtgttaaggacacacaccaaaagagaattcttggccagacaccacgtgggagtgtcaggatgaaggcagcagttggtgccccttttatgtacctgctgactaaagaattactttctgcatgcagcagatacttccagaagggagggagggagggagggacggatggatcgtaggtgggtgggtgggtggatggatggagaaacaaatgagtacacagataaaccaacaaaatctccttcactttcctattcatggagttgcacattcatctttttattgtggtgtaccactctccctaattaaatcaacagtcatgtcattgagattctgagagccacatcctagaagcacgtaagtgcttgggcaactctctgccttggtcatgagtaagtggtggtaatggccacagggagctaattacccatcactccaggaatctttgagagcaaaagtcaagtcattctgtttaatagcaatatcactttattgacccttggtctgagtgcttgggcatcatttgagactttgtgattttctgacctctgacaaaattttaattacccaggaagaataagcacggctgtgacatctgtcgctgtaagaaatgtccagagctctcatgcagtaagatctgccccttgggtttccagcaggacagtcacggctgtcttatctgcaagtgcagaggtaagtgtgtacacacggcccttccccctcaaagcagccaggggcaccgaaacaaggaacataaggacaccctgtaatgaaatggtttcggtggttgctgcctattctaacacaaatgtcagtctctgtgggaccgtcccacaggactcccttttcctttcatttttatgaagtaaaagctcagaatagaatgtaaagtaagtatatgatggacaagcacattgactaaattaatcacttcctagctctttttacttctatcaggaactttagcctaaagcacaattatctgaacctctatagagcttctctctgttcaggagtaagattaataaaactgcaacagtaaatagccccatttcaaagttctagagggtgggtatagctcagaagttagctgctgtatttccagataacagttttccatgagaatttagcctttggctgaataagcacatgccagcccacagctgtgaataagcacagagcctggatatccctgctgcctgaggcttctccagggagcttcctgaagccactgagcatgcaccctgaccgccgtttctgcctttaccccagctccagccctgctgcctatccctttttatgttgtacttgtcagcatgatgcacagattaaactataaaagattcctaaactttgttttacgatttttcaaaactggacagttaccaccttaatggtgtttctaaggggttggagtaaacaaaaatctagtcactgctttaattgttctgctgaacaaaactctgttatttgcaaggggcccaggatgtccccattggatgaagcttctagagcgatttttctgaatacattcaacatatttgtaaaatttgttataaaatcagtgcttgtttattgtataaaatatgagaaagtacagtggaaggaataaaaaatcagcgatcatcccacgaattggagagaaactatttgccggtttttttctctcttttcttttttcaagattgagaacatactgacttaaattcttttcatgaacatgtcccatgtcacaaactgtcctgtgttagacgtaattgttggtggctggggtccagtccatgtacagactctgtaggctgtttctcctgtgcagtagccacttctttaccaggctgccttttgtctgtccagaggcctctgcttcagctgggccacccatcctgtcgggcacttgtctcaccgtggatggtcatcatcataaaaatgaggagagctggcacgatgggtgccgggaatgctactgtctcaatggacgggaaatgtgtgccctgatcacctgcccggtgcctgcctgtggcaaccccaccattcaccctggacagtgctgcccatcatgtgcaggtaaaagctggctgccatctgtgtgctccataagcaaatgacttctgccttgcagggccctagacacatttgtaactctggggaggttggaggggacaacccctggaacacttttcagcactgtgtggtttttgtcaaccaccaccacagaatcatccaggcactatcagtgaagaaccaaagaccagagaaaattctatcattgtagaaatggctctcctcctttttgaatgattgactcagttatgtaaggtctttggactacatttttgtaaaggtttgtgggctgatgttcttacattccagctctccattttattgatagcatattaagtctgaatgtcctcattaatatgaggggattggtactagttttatcccataaaaccttatcacatttaaagtaatgtttgagagggagaaactttttgaagtctgtggctattgctcttttttaaattaatagacatgtggcactcttgccaaatggagagatttagagtgaccacacgtccaaaacatttaaaatcataatcatggtaatcaggataagttactagaaaaccagaacagatttgtaattcaagggagtctgaattatgattgtcaataacagtaattataaccataaacttcatctagtacgttttatccaaagagctcaacacagtcttatatctattatttccctctctgtgcaggccactttgagttagggaaaaacacattgaggcagtttctcatttggaaaacagacacagaaagattgactgtcttaccaagagtaaaatagtatgtccaccaaaaggcctgggagaaatgaagtctctcaaatcttgtatcagatttctttcaaagttaagtctactgtcagattttggaggatgattgtttttcctctggtcagtccaggtcctgtatctccctgtgcgtgagtccacctgtgcaaaaggtgtagccgggagcctgaggcctggtccttgtgcaacaagactagcctgggagggaaactgaccttgttcgccatggttggggagcaggggagagggacacttgaagtccctttcagctctgagattctgcacagctcaatagctacagtatcagagtgacaggcagctcccataccttgtagaaaacgagattacaatgcagaagagatgactctttttattttgttttgtttccctgtagttcagttagaggtgctccatgtcagaactctttccttttttccgatattttgctagttaagtgtgaaaaactgctagagtcccctgcataagaaggtaaatgaggactttaatatgatagaactctgtgttgactctttggggagggaaaaatcatgtgtttgcatgaagacccctgctttaattataggtgtgaatgcatagaggagggatttgtacctgggtctttgctaaacatgtcctcaatgaagaattctaacagctagattggtagaaatgcaaagacattaagaatggataattgacctgagaactgaaaatcagtagaaccagaaagatctttctctattacagagtcatggaaagttcttacgtaagcacacgtgaagttgttgttgataccttactgtgggtgtgtcaacatctggatatacgtgtatgaaaacacatttctgtagatggatgtgtagaggtaaatgttttctgcaaatctttagcatgttgccacataagcctccttctgattagagactccagagctgttgcattcacggactcctactttaaagaatatttttctcccctcttcattccaagatcagctgtttttcttcttgggatacatgagtatctcccgaactcttctaatgaatatttactaaatgatagtgtctctcagattttctgtcttccatacactctacatttgagtttctcttttgtctccatgtctctggcccctcttgtgttttgccttgaggcatatcgtacggcaaaaaggtgagccagaaagcatacctgcaaacacgcacgtcagatttcttctgaccacttccgtacatgtcagcatttaacaaggcagtaattgtcagtcctctctaagccctttttgaaagcaataagggaggcttttgctatattcatttatcgatactctttgggactttttgtttctctgtaaaccacagatgcacatttaccatcttgttcagcacagttttcattgtaattctcttcctctctgttgttcttatactggaaagttggttacagttgcttgtgaatgtaagcattgattgatgagtatcagttttctgtgatactgtccctgggtctaagttccagccttttgtaattcccttgagataaagctgtattagaagttgttaccctcttaactggaaatcagcccacatcacttaatttcattagtattgttgactctcatgctaaccaccactttgaaagtcatagccccaattcactcctaagaagatttcagctctgagcatctctgcatatatgggcccattctggggcgtgacttccactgagctccaagcatgagctagccgtgatgtctccagactctttctcggcgggattcaacactgtcaacacattcctgaagtgcttgttgcatttggattacgtgactatggttaatgtcttcatacttctcatttccccagcaaaacttcagggcaactcccagcccctcttcagacattttcaacattaaattccctctctatcagtgtcatctctccaagagaccaaaactacctctcctctggggaaagaaatgatagttatcaccagcctgccagcatttacctctcttcatgatgatattgccaagcacatgtttagtctcaggtgagggttttcagactgttgattctacaggagcattcctgctcagtttgctggcagctggcttagattggggtgtggcctgctcgacagcaggacatatttccaagcataaaagtactcaggatcccagaaataataaagcagatagggcatcgatcatttggaagttttatttaatctggagacatatccatgatccaaacaaccatagacttgggttgcagtttccctcgtctctccctgagctctcagtttcctcatgtataaaataaggtgactgtaaggaataaatgaaataacacatgtgaagtgcttagcatggaaataactgaaccgtaccaagtattctgtaaatgagagatctgaatccgagacagttcctacacattcacagaaatgccagaagaggcccctgttctcatctctagagtgggagtcccctccctgtaatttaatgatcttattgaattctcttattactgttgacagacttaaaccacttgaacctcacgtcctaatattagctcttttgccattgtcttctgtttccatgcatggaatattttcttcactattctcttaataagaatagagcgagatgctcttcacagttcatctcttctatcccttaaagcaaacagcaccaggctttcaagagttggaaagattgcagatgaataatgtgttctgattttgtgtcatttcccagatgactttgtggtgcagaagccagagctcagtactccctccatttgccacgcccctggaggagaatactttgtggaaggagaaacgtggaacattgactcctgtactcagtgcacctgccacagcggacgggtgctgtgtgagacagaggtgtgcccaccgctgctctgccagaacccctcacgcacccaggattcctgctgcccacagtgtacaggtaagcgacaccatgccttgtgggtgcttggtggggaaggatgcagctctgggtgttgtcattctgtgggacccacagggcaggatcagccccatatgggagtgtgccaaacccagtatcccatcaggaacagctggcagcctgcttcctgcatgtattctctttatcaaccacctatttatgcagtcagcatgcctcacacctgagatgactgtgaaacaaaaaaggagactgttgctcttgccaatttttttccttaaccctgcatctcaaactcgaggcgtatacctaagtagagaaagtcccaccgcaccaaattaaccaaaagattctgttactgtgaaaagtcatctttatgtaacaaatgagaagaatagttatttataaataatgtaaacaaaattctttgtaaataaaattctttgaaatataagggtggcgaagagactttgaaatatgcataatgccaccccctccaagttgggatgattagtaagttaatgccaaaaagcattaagtgactagcactgcacatgtataaggagtgctattattttctactttttatttctcagataatctgaccttagcaggtaaatgtatggccatgaaacttgttagaaggaaatttgtcaagatgttaatcataagttactggttttatataactttagtagtacttttaattaatactagatgtgactttttcaaaagatatttaaatataaaattatcaagttgacaggactagttttgttttgttgttgttgcttcttattcccatatttcaacttaaatcaataaccatttactttctaaacatattcttagagcatttctgctcagcaaaacataaacccttgtattttattacttcttttttttaacattggattatctagtcagctggccagaatctgttgttccgtcattatgtgcagcatcatcagtgtctaaattttttataagtttatgttgatggcatttttggaattgatcagatgaacttatagggatagccacattactggctgttgtcatcatgcacggcagcccaagtattaccattttagtacagaactgttaatctgagaagcttaattagcactacagcttttctagtataagaaatagttcatatgtgttacatttttaggatatgcatgacctatgatttcctaatttgttgtcatcacaattcactcagattcaaaccctactgatgttttttgttaatatatagcagtgactttacttacatcaccttggtagaaactacttagagtgatcttttccttggtgataatgaatttatgtacttttagctatttagtttacaaatatttgtagaatgcctgaattgaactatggggattccaaggttaatgaaaacagacatgattcctgtcctggagcaatagccgaaaagccaaacaatccaatattccacgttaagtcaataatgataaagtaagaggtgtgccttgaaagggaggattcaagaacataggcaatccgggaaactaaagcagcaaatacccctggtgctatttgtgttatgagtgatgaacttagggattgactaagggagtggcactgggggaggaaatgcctccaggaccactagctgaaattcattgatgggacaccttactgaactcagaggttccacccataaagagaaggagagctatgtggaggtgggaacctctgagtatgctaacatgggtggcatgtgcagaggcccatgggttctagccaagcaaggcagtggtagtcctgcattcctttccatctttccaaagaacaggcaacccctcatgtgcctggctttgacttctcattcattaacttaggcctggatttttttctttacctctaactaaaggatgtttctggactttttcattcatcgttgtattgagatacaaaaaaataaaaagccttaaaactcaaattatcagtttcttcccatcacagtaattctcaacagtggcattgataagtggcatattacacatgtagaaaaatatcatctctaatcttaggacacttgcattctaaaatggcccaaaagtcatagctccacagtgggataacagcttccaaagggtcgaatccctcatgatgcttccatctgtagggtgccttgtcatttcctctcttcagctttccctcttctctggcctggtttaaagcaaggtctggtgaggaaatgaggaaagattgcacatcactgcaagtgaagctacttcaccagcatacaaaagggagagggtaaaatagcacttgtttctttccataagtttaaaattttctttcctttatttttagagttggaaaaaagcatggcagagaagagcgagggaggtagaaaataaaaagaaaaaaggaaacactgaaaacagtgaaaacactggtaaagatcaaataaaggagtaaacgtttggaaacagaagtgtaaagaaaagggtctagagcaggaaaaatgagaaaagaggcccaaagaagggagatgctgtgggtaagattccaaatgacattgtcggtcagggttgggccaggagcctcctgcctggtggaaggaaacctgcagactctacctcggctccagccctcacaccgtcactgccagcgtatcctgatgtcctctgggttatttccaggcctcagtgagagccctgcagattccaggctgttcgtttcactgtcattccatagcttcagcacggctgtcccttcttcttcttttcagtttttagacagaggttgggcaatgcttgcatgagctaagttaacgtaagtcacaaaaacctcatggagatttgcagggcctagtgtgaacaagagggtgttgtccttatttctagccaaagcaaaagttagcactggtcagtctcttagagaagaaattatccctcgacgtagataaccacgaaaaggtcattgagaaagtcatcccatcttactatctctaacctatgtgggtgggatctgtggaatcatatctgtaataggacctagagtaccatggagccgtggaaccaatggctgttcttcaacttatgcctgctgcctttgggactagtcataggagatacagttactcagtttaaaggagagggtatgggccaatcccattatgctggctttcctgtccctcagagaaggtccacaatgaagtaactgccttggtcctcaaaaaggcccttcttgtcacatcctgcttactggctgtggggtatattcatgaggtggatagaaggaaaaagtggcatgtagagcttctggatcatatggcaactacatgtctcagttgtttctggttcttgactaaaaataacagagctcatgaagttggttctgggaagaacatacgacaactcttttgattgtgtatgcattgagaaaatgtggccctcttagagctttgctaggtagggctgtcgtggctgtgtctagactcttgagtggtgaagttgattagaagtgctctcttatcagttggactatgacatttctaaactggaaacgcacccacttacattttcctttctgatatctcaatcatattgctgcttgaagttacaattttcattgattttagtggaaaccgatgcccaaagtgctatctggattttctggtgacattttctgttgcaagttgtaactagatctggggacttccaggtctcagtctttagatagcaaagacacagatgatttgcacatgatttctctgtggttgcatccttatgagtgatttagatttcttatctttcagtcattaatgtgaattcctgaacattggaatgttgcatttaggtggtttttggtagtctggtacaatgagaatttgtctgaatattgattggtcaaaattgcatgtggccacaagtaagagaaaatccagctacaatttgtaagtaaatagaggtctattttacatatatgacaagacatttggaggcagatgtttatcagcattgattcagtggctcagtggggtcaaggcctttctcttctgataggggtgtcacagccgtgatcaacgcactcctatcaaggcaggaataatgtggaaggatgatggcagaacatatctacccttctttgaagaaagtgaaagctttcccagaaatcccttcgttagccattaggtcccattagctacggctagatgatggggccaccctagtttcaagggagcctaggaaagcagggaacagaattgtcccatttacttacatgcattgtaatccaagtcctgggacttccccaaagaaaaccaggatttcattaaggaagaaagagcggatgttatataaacaactaacagaataactgtaacatctcttttttgatctttgttattttgtttaaaaatttaagacccttcccgaatcatactttctgatttgttactgcgtcatgtatttaaggaggcaccgaaagccatcatgactgggtgtgctttgaaacacactatgttgcatagttgctggccaacagcatcttctttgctgacctatatgttcatttttccagatcaaccttttcggccttccttgtcccgcaataacagcgtacctaattactgcaaaaatgatgaaggggatatattcctggcagctgagtcctggaagcctgacgtttgtaccagctgcatctgcattgatagcgtaattagctgtttctctgagtcctgcccttctgtatcctgtgaaagacctgtcttgagaaaaggccagtgttgtccctactgcataggtaagaccaaggaaaaaaaaatccctcatctctaccagttgtcactaaatctgtattgacagccatttgctagatcaattaatatttttgaaactggttttttccctgcttgacatgtcacacagacccagtgtagcaacactgagcagaagaaagatatggaagatgtactcccaagaggaggtgctgtaagaataaataaatgaggccaggagtggtggctcacgcctgcaatcccagcactttgggaggccgaggcagacggatcacttgaggtcaggagttcaagaccagcctggccaacatgatgaaaccccgtctctaccaaaaatacagaaattagctgtgtgtggtggcacacacctgtaatcccagctactccggaggctgaggcaggagaatcacttgaacacgggaggcggaggttacagtgagccaagattgtgccactgcactccagcctgggtgacagagcaagactccatctcaaaaaaaaaaaaaagaagaagaagaagaaggagaaagaaatgttctctgagaatgtcatactgttacagcactgtcgtgttctatcggggtccttggccagttcagggttttcaatttcagaactctgtttctccagcctattttttacagtggttttttttttctttttttagacagattctcactctgtcacccaggctggagtgcagtggtgcaatctcagcttgctgcaacctccgcctcctgggttcaagtaattctcctgcctcagcctccctagtagctggaattacaggtgcctgccacctcgcctagctaatttttgtattttagtagagatggggacagtggtgtttttttccagatagaaacaccaagtctcatattagagcccacttagtgtataaagcttgctgctgccttgagatcaactaaatatgaaatattaatttaatctcccagttgttcctgtcttctggcacttaatggattctgtttcaaccacgtggttgtccctgtcagtggcctaggcacacagagtgaggcctgagtaactctagagccctcaccttcttgtgacccgtggtggtgatgcatctttgtgagcagaggatctatgtatattagcacctaacatctggagcaaaactagtcctatggacataagccagatgctgttccgaggtccaaaaggtgagacagctggcagttctatcaaggacagcccgtgttccctgggctttcaccctcttttaacgcttttgtgtccagtaaagctcaaagtcaaatgaaagacaatgacacgtcttaatcagatagtgcacctataatcagagtagcagatgaaaaagtttacagtctgtactaattgcacatttattgttggggattttccatgttttctaaacacaagtcattgcatatatctggagtgatagatggggaataaaggagatctggctacacagttttgtggcatttctgatagataagctgaggaatggtggccataactcaagctcatgaggacatctccctgtccttgtcttgtgacttctggccactagacagggccactctgagtcttttactctgcgtgttggtatatgagatggaaatgcctgttcttaggaattttacacagattttcttactgtaatggtcaaagagtaataaaagttctgttttaaaagctagatggccaaagagtaataaaagttctgttttaaaagctagattctctcttttaatagggttaccatccatataatttattcttcaaaccacgatgcttttgagagtgaaaagggggctgttaataattctgatgggacaatagtcatacatagatcaggagtgtcccaagcaaactggatatgtggtagccctgcattttagcaccggcttctctgtactctacccctaagctttctagctcctaagtggagcgaaaaatgtatcaaggcatatatccaatttagtgctacttaccttttcgaagagctgaccaaaattcacgcaacaaaatgacactgcctttggtgagatctaaatgaaagctataactaagctactctttcaggctgggtaaggggaaagtatagccaatatccccatagttatatatcaaaacttttttttttaactttttaagttcagaggtacaagtgcagtaaagctttaatactaaaggaaatagttcacaagtcaaccagggatacttatgtcatacttgggaaaccagggcccaggaggtctgagaattgcatgttaccttcagaggaaaaatctaacagcagatctctcgtgtgttgaaaattctcagattgttttgtgtaaatttattgttgttttgctacttaattgttaaatttgtaattagtaaattattcgactagtaaatttgttttcatgtgatagtagataatcatctctcacaaaaccaatttaacaaattcaaaattatgaagagaaacctgcaaatcgtagtattctgtagtctttctttttattttttatttttttgccttcatactttctattccaattcctgcatctagattatacattcttcattggtgtagaaaaaaaggaccagtttggctcaaatttgtgattttgattttaagttggactgcagcacttttgctaaattgtggttcatatgagctcgtaatggtatagtggacattttgattctgatctgtctccctccacaacttccctccccctcccaaactgatgcacgtataattttatcatataaacccatgacttagcttcaggggaccatgttgggaagacttaacatttgatgaactgtaaccgtgtaccttattcactcgttcatcttaataatttatatgtgttgtattattgaaatagtcattaagccctcttctgtctgcatcatatttactttgcaagtagcgttgttagataggccttcatcctttcttatctagccctgctatatctaaacatacgaagtcaagttcatgactatgatatagggatttcctgtctgactctccggtttgcgtttgggcttgttctcttatcaactaagaagtcctgacttccagtcagcttggtccctatataagggtgccaagcctggccagcacaagcacacccaaaggcagttgccagctgtgcttcattggcagagcctttatcaccatccagaggtcactgagcaaaggaaaaacatggaaacacaccatcaggcggcatgtcttaaagcacccaattgtttttccagtgggcaccaaagaccagtgctcgcattgtttcctggtttaggctttctcagttttaactcagattatcatctattctcaggatcttgtgtatctcactgttagaatgtacagactatctcaccccagcccacagtgctgacctcaccttggctgtagggctcttccatggatgaatgttctccctaattagtcaaatacagatctctaaaaacctcaaactcacaattaagggacctcttttattagtggtcaaaaaaaaagtatgcatgtgaagtatccttttttcctactgtaagaaaaatgaaaagtggtgattctaccaaaaatagttttctgattacaagtatttgtgttccttgtgtcaaattgtcaagtcactaatgagcaatgataatgcttctcttttgatgttcgagggcctcatattatgtgtgctaatttaataggatatgtaatatagacataattaataggattgatgattaattttgaaaagtgaacagctttgtctagtttcttataatatccatcattagggaattcattgttctactagaaagaaactaagtagtaattacccattcactttaatggaacatcttctgattccctaatttttttttgtactctggttttctaagtaaatacattcaaacttagattttattttcataagctgactataatgaagggttaaaggatgaagaacaagaatcaaaagttgacaagtatgacgcaggtggagataaaaggtctggtgggaattctgatgggtgaaaagagatttcatatgtggttccttgtaaacagcaaatgcctctgttatgacctacttagccatgcaagagtgtactcgtttctaaagcatcccatggccatttcactgatgacatgctacatgcctttctcaaaccttgccagagcaaaaattatttcagtgctttcagtgaagtctttatttcatgacttcaaggaggatagcagagaagtaaattagcagccctcataccacaccactcatatgcctgtggggatactcatatccccatatgagccctgaccacatcaaccttgctctaatgttcgtgttggtgatgcttctgcccatactgagtgccagactctggcagcttctggaggggggaccgtgagtctttcagtggatcctccctgtgtccaggggtcagtcattcctggtcagatattaaaaagaaaaagtactactttgatcgtaacgtctatcttaggttaatttccaggattttcaagcccacttcattgctgcatcatacctgttgactttggaagtcaagatgctcaggtatgtcccccagttaagccactctaggtgatcaggactgacgttgaataaatagctcatgtgttggctaagtcttaagtgttagtatgtagaacattgttttgaaaattatgacttggcaagtatttgttagtaactacgtgttattttagaagatatttcaaggtcagatttttaaagtcatttgttggctagaaattcttgagtcagtgtatctttctcacttcagaaattgtggatgattgtttgtgtttattatatataatataaatatttacttatacattatataaaataaatacaagtatatatgtggctcataacttccatgtgaactaagttaaaatgttctgattacatgccttctaatcagcgagtatcattgaagtgtttttaagtgtcatatatctttaaggatctgtgaaaatgagttctattataggtagatggtacactaaaaatttcttacaggttgtattaatacctctgtttgattagaagttagctatttttatatttatatatttactaatattcgaagtgggactttgccatggagctggcttagcttgtgttgtgactgtatttcttctcaactggctgtgatactgtcactgtatagtgatcttctccatagtgatcttcaactcgcaaatgattaaataatatttaaccttaatagggaaatgtctataccttatatcaagtcaatacattattccttttgcttagatttctgtttatttaaacataactctactaaactggtatcttagagatatatagcatctctttggaacatctgttggtcattgtgtatttaattcagcccaagaatcaattatagtaaatatttaattcaggcatctttaagctatacaacccatgaaacttaatgttacgcatttcgaaaccataatgatatgatggtgcccaccttcattggaacatttttcaccgctgcttctccagtgtattttcttaaaattaaaagcttctgcacattggaaagagaacttcccttggagccagagcattataatcacagctctgtcacattctagctttatgtctcggtgatatgatgtaaccctagttcagtttcctcatctataagatggcaataataatattgtcctgtgcttcacaaaagtgccaagaatattaaatgacataatgtacatatgcaaaaatactttataaacagtaaacacaatttaagtgtatattgattcagtagaattgctgctctcgtaacacagattgcagctgatctgagtaacattatcaaatagattctagtgtctcactgttaaatgtagcgtctggctttctacaagagaaatgcctggatataacatctcagtgatgagcttttcgaggccgagaatatcttagataatgctttggcagtgtacctcatcctgcctgctcccatcttaaaaagcccatgtcactttggtcactccatcgtaacccaggtagaaacagtgtgctttctgtagctcagctgtgttgtgacagggccttgcccacaaaccacactgttctttcatacctctagacattatcagaagtgagaaaatagggctcatttattttggtttatgttgagaggctagtcccatttgaagagtctgaacttactgtgcatgatccactgtgattcctgggaacagagtacgtggcatttatcatcagggcgcaccctcatagggagatgtatacctcctgcacattcttcagtgctgtcagttactgtggacctacacggaggcccaggttgtcacagttagtgctaaaaagattgaaacaaaagatgagaggtgtgatttgaaagaaggggaaacaggatgattttctgtgtattgtttagagagtataaaaatgaaaacattctggttgtcgtgcaccatgctaactttggaactggtctaaagttatcacaacaaaaataagcagtgtttgatttcagtttgtttgggtcttaccctatgccctaggaagcaactgatcttgctgcttccataagcagctttctcttctcacttcagtatcctttccaggcccccggctgtgtaaacagaaattcaagttgttctggttaacttgggaaaaacccctaagctgcatagtctttaggtgtgctccgctccagccccacgttcttaatttaaagagctctgctgcacggaagttaggctgctgcactgctatttccagagagatccaacagtatctgcctttctcttatttcggtccaggaggccaaacctgattttgtaccctctagtggtcaaggatatgggggaagaccccatcacaagagggcccacctgataagaaccctctggagactgctggcagagtcttcttaacaggacttggactgtgaccagataaaacatcttctataggtgcagaaactggccaatctggaaggtccaatggcttctacgttaaggttttcttaacaagatggtataccccgacttttacatggattgcttcttttaagtcctaaaagaagttgtatttcttcctccttatttgggccaccttgatctttagttgtttctgcctgccttttaaaatgacatttttatatttccaaaatgatttatgtgaataatgtccatgtacctgtagatgcatcttggattgtaggccctactatgacatgagaccacatttaaagttgaaaataaaatgtttccttcaacaactatccatgaagtgcttaatcaacccataacaaatgcttaacacaaggagtaagctctattactgagaaattgtgtcctctgcatgcagtggttctcagccaaaagtgactgtgtttactagtttggtgagatttctttttgtagaactagggcttggaagcctgagcaatcacctatttctttctagtatgttgaagaaatctgataggctcttttaacctttataaattacttgcacttcctaccctaagaaataaatgaaataaaataaaacaaaaatggaattctaagaaaagccttaaactgtggccaaatctgctttcacagcaattaagattgaggcagtatggagaggtaggagtcagccgacatgacagcatgtacctcatttttttaaaagaaagatggattaagatcagatttttttttattggaagctaaaagttataaagtaaaatacccaaagatttaattaaatcagtaagcatttgttgcatttttaaccagaattctttaatcatttcctgacagaatgactgtgtattagatctctgcctcattgaaattgtctaggccccctgcatctgttttgagcaagacttcagttgagttccatcttttcattcttttacagtctgtaaaggcctggtgagtcagcgcattgaaaatcagtcatcatcttctgtctatgagttcttagtggcccgtacattattttctcagatccctgcatcattacaatttccatgtgtttaagtctcttctttatgttttttaaaaaaacaagtgaagccagtttctcaaacaggaggtgctcacattctatttattctccaagtgtggagtttgtgcccagcatgtgaccgacaatacagaatgaaaagcacatgacaagccagggatttcagtgtcttgttagaaagtgaaatgaaagtggtattttattcctttgtggcttagagagtgctgtaatgcattgttacaggtataaactaacatttttagaagtacttcccctattcttgcccaggtcagctatgtcattggtaatacttggctgccttttctaccgctcccctttctaaatctcatgttacccatagtatacatgggccctttgtatgcctgcctaaatgacttcactgaagttttctgtaaatccctcaaacctcaaacttaagaacccaaactgtaatatcatgttattagcaggaccagctgtctgcgcgtcttttccagacactgggctcatccatttggatatggactcccacaaagctgacgagaccctctgggtgcaggagcgtctcctgaggaccaaggccttgaatgccttgttcacttctgcatccccaacacttaggatgacactcggggggccttgatctcaatgtgtgggaagaacaaatgcccccgttatagtactgtgttggcttgttttgcagtgagacttattctgagattaagagctgcatttagcttcttggccaccaggatcccagagtaaattacttttcaggactctaaatagtacgcaggagatttgaaagaactgatgcaatttctaaagcagcctgacttcctcccaggaggttactcccacaccaagcctctgacttcatgaccaccagatttagaaattgaagtatctatgtaagaagttgcctcctaggcagaaatcaagaaatccaactataacataggttagagtccattttggtttttatatccttccacagaggaaagaggaggaagaatctggagatgcgtttttggtttttggttttttgtttttttttttttccagaggctcatgtatatcctacatcatggtcagtttcagagcagggctgtgccaccatctcagtgactcctggaatactaaattggatctttgtagaggaagaaaataacacagttctagattttccctagctgttaattagttttatggcataattaaaatagctcaggagtaaaaacaaagtccagccttaacagcctgttaagtcttcttttcttatcttgaaaagaggtaagataatgaagtttaaacagttgaagaagttaaccggaaaggaattaacatttcaaggccttgccgcttcttcctcctcttgtgatatgaaccagaattgagggaaaataggcaggagggaacccacactgaattttccagactctactgctgaaagacattgtatatttttattgtaatcatatgtgatgcaagataatattgctcatatctgaatcccaaaagaaaagaagatgtttgtctgagcatcccatgaggtaagcagccccatggaaggaccagctgcatccagcaaagggctccaggtccctgacgtagttgacggtgatggcagaagtaaatctttgtattcttgcagagactttgtttctgaaagaggccaaaagtcatttcaaactgaatctgacggataagataggggccatagctgagaaaaataagtagcgaagccgatctaaaccaaggtgtaactgtgaaatagtaaccatcttctttgcacgtttcaaaattggccctggacgccatcgcaagaggaaaattccaaagctgtgcagcagcggcagtaccattggaagagtttacagcctaccaggactacttagaaggggatcatgtttatttggatatataacccctgattggtttgttttaaaaataaacgttattatgttagtgtcatacctcatggtttccttggaacattctcctctaatcctctttgagagagtgggagggagagattgtgaggggagagagaagtgttaaacagagatgttcctaaggaggaccaggaatcctaaattacctaaataacccacttggttatctccactccttgatagcactgtgtgaggtatgatgcagtcaggtaaaggacaatttatctttgaagacaaagataaattcgagtccccattttcaagagtcagtgagaagtaacagcttgtttgtgtggcactgattgatccttgtccgggcaagtggtccctccacaggttatccggcttggcacacaacagacagaggtgctggcggactgtggaaccagacccgctgtggttcccctcctcaccctgccacttcctagctgtgcatcttggacaactgattgaatcttgtgcctcatttttctgtggaattgaaacaataccctgacccattgggcaatggagatcaaatggcattgatgcaggtaacatgcttaacacagggcctggtatgtagtgggcattcagtaagtggaagttacgattattattaggtatcaaagaacaaaacttaattgtcagaataagcaaaccagttggaataataaacgtagcctttagagttaaatggcacaaccctgatagccacacataaactgttttggttatttttcgttggatattcccagtctttatttctacatccctcttcaggctgagtgcttaaaatacatttatatgtagtctcaattagattatgctgtttcccccaaaagactacagtgactattattttaatttatagaacctcgaattgcatggaatagctaccacatctccctttaaacctggtagcttccaaaacttcctgatggcgttttcgcaaatgggtccctatgtgtcattgaaggagacagtgtatctaggaaaagaaatgaggatactgagcaaggtgttggtggctcatgcctataattccagcattttgggagactaaggcaggtagctagcttgaggccaggagttcaagaccagcctggccaacacaatgagaccccatctccacaaaaaaaaaaaaaaaaaaccctaaaaattatccaggcataatggtgcatactagtagtcctaactactcaggaggttaaagtaggaggatcacttgagcccagaagttcaaagagctatgattgcaccactacactccagcctgggcaacagagtgagaccctgtctcttgagaaaaagaaaaaagttattggttttcccattgcctccaaggcattcagagtggttgttctttctcataatatcattttataaatattcttttagacagtgatctcatacagttactgaaagagtatttacataaaccctgtatgctgtagctcagcatttgatctttgatatttcttctgtggttttgatacatcagttgaaattattctacataggtcagtatcattcagaaaacaccacacatcatagccaggtgctttaggtccacgctcagtctaagttcttcccatcattattctcgtgtgtggagagaggaagggaaggaaagaaggaatgaaggagagagggaaggaaagagggtgggagggaaagggaaggaaggagagagggggaaggaaggaaggaaggaaaggagggagggagggtgaaaaggagagaaggaaggacagagggagaaggaaggaaggtgagggagtgggaaggagagaggggaaaggaaggaaggagggagggaaggaggggaaaggagggaagaatgagggagagggcaggaagggggaagaaggaaggaaggaaggagggagtgggaaggaaggagggagaaaaggatgggaaagataaggaaggaaggagggtggggaaggagggagggggaaggaggaaagaaaggatggaggggacaggaaggagggatgagaaaggaaggagggagggggaaggaaagaaggagaaaaggagggagggaggaggagggaaggaaagagggagggaaggggaaggaagggagggagggggaaggaaggaagggaaaaatacagacaggaaggaaggggacaggaagggagggagagagggaggggagggacaggaaggaaaatataggcaggaaggaagggaaggacagggagggagagagggatagggaagggagggagaggaaggaagggagagagggagggacaggaaggaagggaggaaggaagggagagacaggaagagggagggagggacaggaaggaaggaaggaaaatacagacaggaagggaaaggaagggaaggaaggaaggaaatacaggaaggaaaaggaagacaggaagaaggaaaaggaagacaggaagaaggaaaaggaagatggaaggaaggaaggaaagaaaaaaaaaagaatatagacagtatagaccactgcttggccttgagtcagaagagttatggacaagatggaatgaggagttttacctcctgtctggtttctttgtacggtaacactgttactcaaattttattcagtgatattgcattgtatgggccaaggttcatgtaaaatataatcagtgatactgctctatcaaacattgcttcttttcataaagaattctcagcaaaacagactctaaatttgatggccaaaactaatgtcctcaatgcagtgtccaggctcagtctaagttcttcccatcattattctcatgtgtatggagagaggaaggaaagaaggaatgaaggagagagggaaggagggagggagggagggagggaaggggaaggaaggagagagggggaaggaaggaggacaggagggagggagggagggtaaaaaggagggaaggaaggatggagggagaaggaaggaaggtgagggagggggaagagagaggggaaaggaagttcagagtactacttaaattaggcatcattggatgattctgttcagccaatttgacacgtgcattttggataccttagtgaagtcgcctcttttaaggattccatattaatcaagaacttctatcatgagtttcttttgaaagcctccaaatgagtttttagcctaataactagtgtgccagaaaatttctgtggagcatctacaaacatagggaagtgcattttttaatagatactgaaaaattgatttctgattacaactagaactttccatgattacttaatgccccttgttgaaccttagacagcagtaatgagaaaaatgatagaagttgttgacaacataagagatgatgcatttaacactcgatctcagtttcttccttggacttgtttctaacaccctcccaatggattgagatttgtatctgtggagtaaaaattttacaatattaggccattattagtgccatttataaaggtgcatatgcttgagtattgtctgccctccttatccataaccacagattgaaaatatttttaaaaacatacaaatttcaaaatatagtataacaactatttacatagcatttacatcgtgttaggtattgcaagtaatctagagatggcctaaagtatacagggggatgtgagtaggtatatacaaatactacgctgttttatattagggacttggcacatgagcgtctttggattttggtatccatggggtcctagaaccagtctcccaagggacaattgtaattggtaagaagaaaatgtagagaccacagatctgtgagcatttctgtctgtgaccttcctctggaaaagctcagtctgaagcacaaactgggtcttcatagagaggcacttccagctgcctcagagcactcgctgcaaagcttcgggctgctcagagaaaatggctcctgatgccattatgggcttctcatcgtgccctgagatgtgctgggttctgtttcttgtgtctattcaatgaattctgacccttcaagagcttcccagatgctttccaggaagaaccctgggccctggggacgactgccttcctaaggaactttccttctagatatctgcctttgtagtttttcatgtttaagtgacaagtagtgagtggcgctgcttgtagaatctgaacacaaaatgtccccggattagtaggtgtcatccagttatcagtctcgtgctcacacccccgccaccgggtttcgatttgcccatctctgctttgctgctggatctgctggtccttggggcctcactctgaaccacattcttgtgtgctagagggaaatttctgtgtgtgaaatgtggccactagggagtcagtaagttcaggtacaccaggaaaaggcgttgagtcccagagaaaggaaccttcaaggagaagcttggaagagggaggaaatgagtgtgacaagggaccatgggaagaaggagcagaatgtttaaactgaaatccctgtatatactgtacagacaaatagctctttttttctcaaaaaccagttttctgggggaaaaaaatggattgccatgaaatgaagctgtttttaaagtagaaatgtccttgtaggtgagagaaatctacgcagcatccctggaaaatgaaggaagtggttatctcggtgctgactcccactcaagggttgcagaggaaacctgctagttccttgtgatgttgccattatcactccttaccattcccctgtattgtttacaaaacaggaacttcttgaatccatctctgtaaataaactcagctggactttttatcaatctctttatctctttctagatgacagtctaaggacacttatctaacaggtaccattccctgccggttgtggtagtgaccaccctgtgctagcctcagtggccacaagatgagagccctgagggtcctcctaaggaaatgaaagactagggaaacaaaagtttcaccaagttccagaagtcctaaagcatactgtgattatacaaagctatcccttgatctctcacgtctaataagatcgtgtgcgttgtcacatcagcgactccatcatgtgctgttcttttcactagaagacacaattccaaagaaggtggtgtgccacttcagtgggaaggcctatgccgacgaggagcggtgggaccttgacagctgcacccactgctactgcctgcagggccagaccctctgctcgaccgtcagctgcccccctctgccctgtgttgagcccatcaacgtggaaggaagttgctgcccaatgtgtccaggtatctaagccaccatccttccatttgtcaagctgtaatgttgatttaagatgaaatcgaagcagagctcgacctgccccttctttcattcgttcacacggcccaagtagcgtgtcaggcccagttagcgcctccacccaaagaccctatgggtaacttggaaaactatgaccatcccgatgaggggcagattttggttccatgccagaattcctcgggttcttttcttctcatttgcattctctaaactttagtataaccaacctgttaatgacacctgccctattagactagcacagttttagtgcagtgttggactagcctagagaagatggtccaagatgggacccagaagggaagatgcttaaaagccattacactgtgaaaatatattagaaccaaagtggaagacctgcatttaaagaatatagttctggttcattctttttttacttcatcagttccagccagtacccataccatccacgcagccttctcccaagccctcagctgaactgcccatctctttccacacttaacgcaaccactgagtgtaccccagctggctgttgtgaatccccatgcctacatctttccccacgccccactctttgtgtctgctgcattatccctctcatagtttcaaacctaagtccttctcagctgcccagagcctcacctagcccttctcctagtttccatgcctgcatctcctgccaaacaattcctctttcccctgcgtctaatcccagaaatgtaagacctgagccctctccctggggactgacccctagacacacagatttcccggtggtatagaccacacagacccaagtgaaggctcactctaagatctcattgaggtcctcagcgagtcaggagcttttctgtcttacctcgattctcatgttttctcgcagcattatattagagaaccttgttgtattcaatacagggagctgggaaccatgccaattcacaagtgcatctgtactatgcagttgtaagatagggcagttgttaaacccaaagagtttaagtgagctctgcacatgttggccttttgtttaggcgttgtgcagactagccccaattgagcatttctaaaaatgtccatttatctcctaaaaaggataggatgttctgcaaggtaagggggtggaaccatttttcagagccttcagttgggttctctttatagttttccatatacacacttgctgtgtatatggaaaaagcaagtcttaagtgctttaaatgagaataagaaaaaatatatggttttccactggaattattttatctagtgtatattcacctatgtttcacaaatttcataccagtttccccagtaatatgcttttaatgatataaatgatgaaacttgaccttatttatttcacgaagagtcatttaatgccttttatgtgccaagcactgttctaggcactggggacacagcagtgaaccaaatagcagtgcacacggagcttacgttgtagtagggagaagccaggcagctaacaggtaaacagtaactaggtagccaccaagatggggatccggctctggagaaaggcatagcaagacagagaggctggggagaagtggggcaggcaggttgttttgtattatgtagaatggtcagggagcaccttaccaacaagatgagatttaatgaagagacccagaattgcagttctcatggggaacaggcagaacctctgggtatagccagcgccaaggccctggagtgggaacgtgctgtgcgtgttcaaggtagagcagtgttcaaggtgcatgttcaggaggagctgtgtggaggtaactcagtgagcatggaggaggtaagaggtggggcagagaggcagccacggccagacacaaagggtctcgcagatgagtgcaagattgtattgagtgagatgaaaccttggaaggtttggagcagggagcgacaggatctgacttacctttgaatgggatttctctggtgctgggttgaacatagactgtggggcatggaggtcaatagtgaaagcagagagaccaacttggagacttttttaagaatccgggcgagagatgacagtgacttggacagggtggtagccgtggaggtggggagaagtgggcaggttctgactatgccatatgagtcgcatcagtaggatttcaatgtatgcggggagtgagtggaagaggagccaaggatgactacgacattttggtttggggcatttttagcttgaaatagtcattcagcatcaaagtggagctaatgaatagacaaatatctaatctgggcttcaggaaagaaactgaaagtagatctacaaatttgaaagtttagccataggtggtttctagtctcaaggtttttaagccttgagactagatgagagcaccgaagggtaagaataaatagaaaagaaaagagagcgcaggaccgagccctgagaccttctgacttttggagactgagcaggtgcagagggcctagcaaaagaaatagagaaggagcaccaggaataaaggaagaagccaagagggtcagtgacatggaagccaggtggagaaagggtttctggtaggaaagagtaaactgctcaatcaagcgccactgttagccacgtaagatgcgatgtgggaacagacttgtgcacttagcactgctgtaatgaacttcacagaagtacagtggtggaggcaaagtctaatcagagtgatttcaagaaagaatgggagaggtgaattcaattcacctctcccattgcgagttatggttatgcaactctcatgcagaccataagtgccaagttcatgaataagacagactgtgaagttgagggtccttggagggtttcacagagaaaggacatgagctagattttaaaggacagatgtgctgtcttcattggagtgaagaggataacccaaccaagacctgagatgggaaaagtcaaggccggtgcctctaaggtcaaggccagtgcctctggagcagtgagttttagtagcagtaggtaaggacagaaacagtagctttggcaaggatttttcaggccttaattatcaaatgaagagtgtagattttgttctttatagggaatggggaggcttatttttgagcagctgaatgacatgttcacaaagatgttttggggtaacctttgtgtaacagggtggtgtgcaggaaggactaaagcagagagagaccagaggccaggacagctgtaacaggcactgcaaatgtcctcggtgtgataacaaggacccaaattcaggtagtggtggtagaaatagaggtcaattcattctccttggtttgtgagtttgataagagagagtacagatattgctaacatccttgttcatcattagagatttctccagtgacttctcagttaagatttactattgggttgaaatttaatttctgttaactctcctttctgcatctgctgtattcctgatgaaacatttttctatctttaagcaaatactgcaatcagttgagcttttgccaccttctgtttgatccagtatgggctgccaggaaggctgtattcctgtcccattcttgcatcggttcattgtgtgatcttagtcaagactcaccaccaaagtttcacgcttccatttctcatctggatagcacatgccacctcccagaaatgctgtgaggattataccatctcagaaatgatggtgtgggagcacttcccggtctgtccagcaaacaagaaccttgcttcttcctttagacatagcaactaacattctgaatatcctctttctttacaaaacagtttcacctttaccatctttggatatgagtacagaacctatgagctgttaggtgattagcacctgtctctttacagaagaaactgaggctcaggaaaggtaagagggttatccgaagtcatggagctggttagcagaggatgagacccctgctcctaaattgacctcaggttccatctcccaaaaaaatgctgacctcagcttgtaagcaccaagcacctcgccccgtattccagaagaggacattttaaggaaggcaactcttagagatgaccagatgcctctgaaagtaaaatatatccccagtaaattatcttgagttcctccaaagcgcaggtcaagtatgagcacaggagcgattgtgaccgtgtgcccgtgatcttcgtggtagggctggatgtagctttgtgtaaatctccctggcactgtccatctgtaatgccaacagctgtaaagggctcttctagtaaataccagaagggttatattttagagtcttgggttgaaggcggtctttggccatagaaggcggcctgggtctaggcgtggaaacaaatagcattcccacttctttttgtttcaacaagcagttttttaactgaaagaattgttctttttggcaaaactgctcagaggcagcttcccttttatgttcaaattaaagggaaatgactctcttcccttggacttgaggactgtgaactggagctgtgcgtgttctgtgataaagaaggaggtgtgggtggattttaatcagagctgaactgagtggtggagtgagctaatacacaggacaggttatgagctgctggaagtaagaagtggctgtcaggcatcactcatcaggagagacccatgggggccaggattggtctcactcaaaactgtatgcccaaaaccagtgcctgccatgtaggaagtgctcaggaaatatttgttgaacaaatggtaatacaattaatcactgaagaagacatcctccttcaccatagacagatccttctaactttccctgctgtttccaagtagagcccctgtgggaagaggactcactgtcatgcctcagcttggtggagtttcaccggaaatctacccatatgcagggtcaaggcaaaagaattccaaagttacgtctctccctctcactcaggaaaaaacctgaggtggaactgaatcaatcccagctctggggcctctgcagaaacttttactacttagccattgacatttacaggtttgttggaattggtgtcgcatttgccctttacactgaggcctcagaaaccagtggcagttcggcccctattgtcataggaaggctcagtgtgaagccctggactaggcaggggaggggcagaagggtgtgtgtggcactgaaaggtgtcaagtaaatggcgacatggcttttctgcccatattcacccaggaaattcataccacacatgagagtttttcagtgggtgcattaaataccatccccctgcacacacctcccggaatcacctagtccagacctaccgaatcaggacctgtgagagtcagcacattttctaagctctttgggtaattctgatatgatttttaaaaatttgagagtcactggtttgtgctcaggcccctgcacctgcaaatggtaatgttttcagtaacttctatttttaattctcgagtttgcagggatgcactgaacctgtagaaactataattgttcccagttctttttatgtttaaaggttttataatataactaagaaagcagaagactattcttggaggcaacaagataacttgggctttggaatcacagaactgcatttgaatcccagctctaccacttactagatgcatgattttgagcgatttaacttaacctctctgggtttctttccctggctgggtacccagttaactcatgggggaagcttagcaagtactctcttctctatcactttcctcttctctcaaagtcatcttaaggtttacttctcaaaagcctgttaactttgagacagaaaacaatcactctgagcagaggggattattaatcctattttaatttatatacttatactgtatattttatgttggtctaaattaggctatggtgagtatttaggatcctacgtgttgagtaattgctttataaaaaaatcagtgaataatatggcaggatctgcccgaaaggaaatacgtgcatgacacaaacttttattgtcacattttgaaaacaggttctgaagaattaattgctttaaaatgtggggctagttgtcgttagctggatgaagtataaatacaaagaaatatttgtaggagctgagaaaagttctgattttttttttttttaaaaagacctgatatttgagataaataatattcttctgtttgttttatgttgtagtataatacctatctgatcaaactggataatgtaaatatatttactgaagatcagcttctaatctaaatggttccagtggtaacataatggacatctgagacttatactcatgaggtctacctacagtccattcccatttaggggaagagaaaggagaggaaatggccaagaagtccataagaagtggacagtgctttaactttttcaagttttgctaacatattttatgtaagttattcaatacccccatattaaagagcagcagctattaaacaccaacatttattagctgctggaaagtaataaataacttcagctagtccccttcagtttccataaaattataaaaccaacaccatttgacgtgaaaaagcagtttttgaccctggtggagtagagaattctttcatcttttaaatgttataagacatgtttctcctcactgcaaagctcgtgattctctagcatgagtgatgaatgatgtaaatggcagaaactgcatctttcatgtcccaggaaatgtggtcttgaattgagtgcaccatttggattgagaatacaaaagccaacaatacagcagcttcatcatctcttaggaaaaatgttcccttcttttagaaatgtatgtcccagaaccaaccaatatacccattgagaagacaaaccatcgaggagaggttgacctggaggttcccctgtggcccacgcctagtgaaaatgatatcgtccatctccctagaggtaagcattgaaggcagctgagatctgctagttttctatgtggtctacttaggtgttttctaatttttaaaatttcctatgagtaacttttaaaatgacttgctgaagtaaattcaaataactattcccgggcagacctgcttggctgaaacatatttacaccacacattgataaaataagtcagcaggtaactggattaaatgcctccttcctggccctctgtgctcagagactttgtgatgacggaaataaatggaaataaatatgttcctagtcataagagcctggtatctggaacttctaagccatctctcaaacgtatgtatatataaactttgtaaggagagtaatcatgaattagtcactgtctcttgtagattccgcactgagcatttgtacattaggttaccctctacttctgggcagttttcacttcatgtgagctaaacttatcacctatgttgatttttctagtcaccaggtttactccatgcctttttatcttgctctatcctttcagtctgtgcgtaataaagatgttattttgtctcccaatagctgtcactatttccttttctataaaagtagacctcttcttgatcagtagtataaacttgctcttagccgtgactcagtactgcctcctgtgtcctccaaccatattttccaaatcattgctatataacttatatttcttttggaagaagcaatattcattgcttgagagagattaattgtctgttactctagatattctaaacgttatgcttggatcaaaccagatgaccagaaagtcaaattcctggacctagtgtttttggctctctgtataattgttctgagtgtgctttagcattatgcttacattcattcagtcagtaaatattagtgcctgctgtatgccagaccctgttctagaggctagacttcaacatactgtaagtacgactattcttatgactgaagacctgtgcattgcatagtatctatgttataaagcccctaaagagaaattttctcatgcatcaatagcaagaaaatgtatgcttctcctaggcaactgatttgttttaacctaaaagacattgtgaatcgtattaaagactgatagttgtttccgtttttggctttggctgctacaaagctcaaagctaactttgatggcttggttttagcacagaaacagaactggaagactgaattttgtaaacagacctcacttgcagcttcatttttctttcaccaagaccttccttaatttatatcttattcttcttgtatgacacatattcctaaaactgctttctatttgatttggaatatgggaaagtaaaattcattcttttattcattgtatatttaaaatctgaattcatcaataaaatgttactctttgacatttttcttgatgctggaaaatatgtttctataaagttttattgccatctgcactggctaaaatgattaggaatgttttctacctcccattcctccctgctcccaccacccctccagaacacacacagaagcatatcatttaaaatctgagttttaaaccacagtgttacataccacaaagctctgtcacttcatgagctgaatttccagaacaatttaagagtaactccttttgatactgtgtgtcatgtgtctttaactaaattgatttttaatgcatttagaaaacctgactacaatgatttatttgaaacaaaacagaatataaaaataaggaaactttagggagtgccccctattggtatgtgtttaaccttatttttgtctgcaacattcattgtaagagagatattttaaaagaacataaaggtcatcattcataagtgcaaaactaaatgtagtcacctatgcaatataattcattaaggcagaaaaatgatctaataggcctaagcaagattttcaacaagtttatgaaaagtaagacaatattgcttagagttcagtgaaccagagtatcaaccaaaagaccaacttcctgattgattagttttaatctaattagtcttagctattaacactaattaattaatagtaaaagaacatactttgttctagtctcctgtttgccaataaatcagctaatgtttctccttcgaaatctgagaagaccatgtatgttaacagtaatcaaaatattttcatggtctaattcactttttcaaaatctacctaagcaccttcttatttccttgattagctagagccggcatcatcttacccaattattaagattctcactctgatttttttttttttttttttttttttttaacattcatccctaagcgctctgctctctactaagagctctttggatcaacattagattttaatcacatttttagcctcaaaaaactgggaagcaataaaaccaagttgctgatctctatttgcaatgtcattaaaataatccttaacaattctggtttaggtaataaatgcttataattttttttctcctagatatgggtcacctccaggtagattacagagataacaggctgcacccaagtgaagattcttcactggactccattgcctcagttgtggttcccataattatatgcctctctattataatagcattcctattcatcaatcagaagaaacagtggataccactgctttgctggtatcgaacaccaactaaggtactgtcttgcaaaagttagtctcttgaatgatgaatctaggaaaacttacactcatattgaaattgcttgaaaccttgtgtcttaaccagtgaagtttttactttgctcttcatagcctcaaatccataccaggctatagtatgaatcaaatacatagtacttgcccagggctggactgatcacaaggtgaattatccattatccattggttaatgaagcctaaccttacatggatccagttttctcgatgtactctgaagttttcaaatgaacaaatactcctggatttattcctaaatcattgtttatattagacattaaaacgtgatcacctggcatttcttagtcatcagtcaacttagaattgggagagaaaaaaagtcccaaagggatggagataatactcaggagagggctggaagatcatgagggtatacaaaaggcaaaaggaacaggtcagtgcaccaaaggcaagcaccaagtggaaaggtcgcaaaagatgaagaggtggtggaaagtaatagtagacaaggtagggagaggcagatttcacactaagggagaaaagatgtatgtttgttttcagtacaaacataaagggcctctaaatctgcctattttgaaagacaagaaaaaactgtattaattaagggaaataaatcataatcccttccaactctaattctaccttttgccttgagttggtttattttaatcataaaccttaagaattggaaacagcctgaacaattatgtaatgtaatttaccatctggttaacccttccatgtaaaaattctgtcctgcggttatcctgcctccgatttttctttgaacaaatgtacattgggcacagcctctgtgctgggtcaggatacagttgccagtgtccaaagctgggaaacagacccgctcataaagtgtatggagtgactagcaacacacaggctggcccagcctatgatagtgttgtacagtctgagtggttagaagtcatccctttgtttttaaaatctgcctaccttccactcattcttcagcccccttgaaacacaaggtctgcacttcaaggatttgaaatcatttcaccagtcttttttttttttttttcagttccttcatctccctatttgacagtttcttgacatttcaccttaaaatacagtttgtcagtgtccctcataaaagtatagttggtactagaacaagatgtgataatctgcatacaggctatcaatcaatgaattgtgaaactgttatctcacctgagttaggtactaaatttctgttcatttgagataatgtaaagcaactaattttttgtggttttattcctcctctcattaaatagccttcttccttaaataatcagctagtatctgtggactgcaagaaaggaaccagagtccaggtggacagttcccagagaatgctaagaattgcagaaccagatgcaagattcagtggcttctacagcatgcaaaaacagaaccatctacaggcagacaatttctaccaaacagtgtgaagaaaggcaactaggatgaggtttcaaaagacggaagacgactaaatctgctctaaaaagtaaactagaatttgtgcacttgcttagtggattgtattggattgtgacttgatgtacagcgctaagaccttactgggatgggctctgtctacagcaatgtgcagaacaagcattcccacttttcctcaagataactgaccaagtgtttcttagaaccaaagtttttaaagttgctaagatatatttgcctgtaagatagctgtagagatatttggggtggggacagtgagtttggatggggaaatgggtgggagggtggtgttgggaagaaaaattggtcagcttggctcggggagaaacctggtaacataaaagcagttcagtggcccagaggttatttttttcctattgctctgaagactgcactggttgctgcaaagctcaggcctgaatgagcaggaaacaaaaaaggccttgcgacccagctgccataaccaccttagaactaccagacgagcacatcagaaccctttgacagccatcccaggtctaaagccacaagtttcttttctatacagtcacaactgcagtaggcagtgaggaagccagagaaatgcgatagcggcatttctctaaagcgggttattaaggatatatacagttacactttttgctgcttttattttcttccaagccaatcaatcagccagttcctagcagagtcagcacatgaacaagatctaagtcatttcttgatgtgagcactggagcttttttttttttacaacgtgacaggaagaggagggagagggtgacgaacaccaggcatttccaggggctatatttcactgtttgttgttgctttgttctgttatattgttggttgttcatagtttttgttgaagctctagcttaagaagaaactttttttaaaaagactgtttggggattctttttccttattatatactgattctacaaaatagaaactacttcattttaattgtatattattcaagcacctttgttgaagctcaaaaaaaatgatgcctctttaaactttagcaattataggagtatttatgtaactatcttatgcttcaaaaaacaaaagtatttgtgtgcatgtgtatataatatatatatatacatatatatttatacacatacaatttatgttttcctgttgaatgtatttttatgagattttaaccagaacaaaggcagataaacaggcattccatagcagtgcttttgatcacttacaaattttttgaataacacaaaatctcattctacctgcagtttaattggaaagatgtgtgtgtgagagtatgtatgtgtgtgtgtgtgtgtgtgtgtgtgcgcgcgcacgcacgccttgagcagtcagcattgcacctgctatggagaagggtattcctttattaaaatcttcctcatttggatttgctttcagttggttttcaatttgctcactggccagagacattgatggcagttcttatctgcatcactaatcagctcctggattttttttttttttttttcaaacaatggtttgaaacaactactggaatattgtccacaataagctggaagtttgttgtagtatgcctcaaatataactgactgtatactatagtggtaacttttcaaacagcccttagcacttttatactaattaacccatttgtgcattgagttttcttttaaaaatgcttgttgtgaaagacacagatacccagtatgcttaacgtgaaaagaaaatgtgttctgttttgtaaaggaactttcaagtattgttgtaaatacttggacagaggttgctgaactttaaaaaaaattaatttattattataatgacctaatttattaatctgaagattaaccatttttttgtcttagaatatcaaaaagaaaaagaaaaaggtgttctagctgtttgcatcaaaggaaaaaaagatttattatcaaggggcaatatttttatcttttccaaaataaatttgttaatgatacattacaaaaatagattgacatcagcctgattagtataaattttgttggtaattaatccattcctggcataaaaagtctttatcaaaaaaaattgtagatgcttgctttttgttttttcaatcatggccatattatgaaaatactaacaggatataggacaaggtgtaaatttttttattattattttaaagatatgatttatcctgagtgctgtatctattactcttttactttggttcctgttgtgctcttgtaaaagaaaaatataatttcctgaagaataaaatagatatatggcacttggagtgcatcatagttctacagtttgtttttgttttcttcaaaaaagctgtaagagaattatctgcaacttgattcttggcaggaaataaacattttgagttgaaatcacacagtgtaacttgcaaaaagattccatctctgagatccgaaagacttttaaggttatcagtccaatgaacccctggtgtaacaagaagtcccgtgcttttgtcattaggcgggtctttcccaaggtatccttgcaaaaagaaaagtgtctcccagagtacagagaatagcgatgctgtttttagggagacaagaaacctacctgctgtcagaaacgtgctcatagctggtatcaaaattaacttgctacgcacaggaggactgtggtgggaaatcctacagtggttcgatgctgaagaagaaagactttaccgagcacgatcaggggaagcctaactgcaaagagactttttgagctgacaggaaaaaataaataggtatattttcatacattttagaagcatcaatttaagaatgagctataaacagaccaatgttgaatctcctttaaaaaaatatatccccctaaggactttctactatatcatataccctttaaagctacatttcttcagtacaaggcgtcatttttacaaattcaaattaatttaaattattaatattactgtgtaagtacatgtatctggggaaagggccagtaagttccaaataagaacattaataaaacaaggaaaccatctcgagtttctcatacccctagagatgatggctgaaatgccaagcaggcattaaacttcaaaccgcgcccctgcctttgcagtcatggtgtctcagttgctgagtggagtgaggaatatgttagccctgtttgttttgctcacaggtgtttaagtggaattgtgaaagccgcctgtagcaggtcctatatagactcttaattcattcatgtcgtctatgggaggggtctgcatggctgtttttgaaatgtctcacagccccagaaaaagagcaggacttacttctgtcattccacagcagctcagcatactctaataaacgtcctcctcttccccttcgtagcattctgggactaatcagggtttcatctgctcacatattgtagcgatgggttctgtgtggaattaagggaaagaatctagcactgtaaggaaaaaaaaaatacaacacaaaactcccaaatataaggctctcaaacatgtatttttacttcttaaaaaatttattaaatgccattgatttgactggaaccagcaaaagtgctcatgatattgatgaatccataagtagctgtatctagaattcatacttaagaaaaacacacaggcatgaataaaataggacacagtaatgagaatgggcagttctgcagtgtacactttctcaagcacctcagaggacacacacttaaagtacaattcttcacagacacatgaagcagaacatttgaaaatcaaaacttaaatacaagattctaaaagtgaatggcaatttaatggttaaaatttgaccagtggtgaaacaagcagcaagctacaaaatccatcaccaccaacagtttcaatgttagcactaagtattaaaccaaagtaatgcatattctggttttgcttcttcaagaacagcccgtttattctgtttcaatctctctgaacaatactggtaggtaatagttacactgacaattctcacaaaaaaacagtgttggttcttgccatcactgaatttatagtataaatctcccaaggctttaatctagttcatcagtgcagtttagataagaaagccataaaaacaaatgggcatactgtcagttaatgagaaatacaactgcacatgcacaattaatattactctctcttaatctactaagagaacagtttattagtagatttaacaaaaaccatctctagaattcaaaatagtgcccatatttccgttggttctataatataaagaattagtgtagtcaagatctgttaatactgaatcaaacccaagttcaaatgtgctgagtttccaatagcaagaagggtaatggtagccagctctcagaataatgctgtcggaaatctagcttggagc

SEQ ID NO: 17394 - DNA, 145241 bp, Human
gttagggcccaaccagcaagtcccgttgctctccctcctcctgacgaggagcggagagggaaggggaggagcgagccggggcaggccgcgcacaccaggagcctcctcgtggagggggggagcggaggaaaggggtagctccgccacctctgctggcggcggcggcggcggcgaaagaagaagaaagtcagggcccgtacctaccgccacagactcagaaacgcccctgcccccatctccccggaaatagccccccgcccagccccgcacagtcgctgccccaaccgagagccgcagcccggtcgcccccgcctcgccccgccccgctgcccagccccgcgggccgcagagtgcgcgaggccctaggccgggagttgttgtcaggcccaggccacttccgaggcgcctgcggtgtgtcgccgccaccacaggaggacgacgtcgacgccgaggaggaggcggtggaggcgtgttgttgtctcgcccactcccctcccctgaacttgcacccaacgtcagggcgcgatggagtgaagcggcgacgaaggtggtacttccgcgttgcgctgcccgagccgagaaagccaaggccgctcccccaccccgggggcacttggaggactcgggactcccccgcaggtcacgcccggcgcatctggtgttttcgctgccgaggataggacgacgagcgcaatcgggagccgccgcccggattcctgcttccctggggcccggaggctgctgcgtaccccactgtgacctggaacccagggacccgagtcccgacccggattatcgtggcgcttttcccggccggctctggtgctcggtgtccctccgccgccgctcccgtttccggcgggggagatggccaggatctgacccgggaggaggccgcacccgcgccgcgctctgcggctggctctaggcgatgccgagcagctcggacacggcgctggggggaggcgggggcctgagctgggcggagaagaagttggaggaacgccgcaagcggaggatatcctgtcccctcagcagccgccgctgctgttgccgctcctgcagccgcagctcctgcaaccgccgccgcccccgccgcctctgctcttcctggctgctcccggcacggccgccgccgcagccgccgccgccgcggcctcctcctcttgcttcagcccgggcccccctctggaggtcaagcggctggcgagaggcaagaggcgcgcaggagggcggcagaagcggcgtcgcgggccccgcgccgggcaggaggcggagaagcgtcgggtcttctcgctgccccagccgcagcaggacggcggtggcggtgctagtagcggcgggggtgtgaccccgctggtggaatacgaggatgtgagctcccagtccgagcaggggctgctgctggggggggccagcgcggcaacggcggcgacggctgccgggggaacggggggcagcggcgggagtccggcctcctcctccggcacccagcggcgcggggaggggtcggagcgcaggccccgccgggaccgccgcagcagcagtggccgcagcaaggagcgccaccgcgagcaccggcggcgggatgggcagcgcggtggcagcgaggcctccaagtcccgcagccgccacagccacagcggcgaggaacgggccgaggtcgccaagagcggcagcagcagcagcagcggcggccgccggaaaagcgcttcggccacatccagcagcagtagcagccgcaaggaccgggactcgaaggcccaccgcagccggactaagtcgtccaaggagccgccttcggcctacaaggaaccgcccaaggcctaccgggaggacaagaccgagcctaaggcctacaggcggcggcggtccctcagcccactgggaggccgggacgacagcccggtgtcccacagggcctctcagagcctgaggagccgcaagtcccccagcccggcaggaggtggcagcagcccctattctcggcggctgccgcgctccccgagcccctacagtcgccgccgctcccccagctacagccgccacagctcctacgagcggggcggcgacgtgtcccctagtccctacagcagcagcagctggcgccgctctcgcagtccctacagccctgtgctcaggtgagttctgccgttctgcctgtgtgtgccttggctgcgctggccagatccccaggaggaagggaaagtggtgcccgggtcctcagaacgactcaggtccaccaccgagacgagacaacaccgcctgagcctcccaggaaggataggcgttttcgcgcgcgtgacacttttttagggggtcgaagggacaaagcaactgggcgaagggaacttttctcctagctgtggcagggaagatttctaaggaagaattaaaagtttcagacttgttgcattaatgtgttaacaggtttctctcagttgctctttgcttttctggtacaatttgggtaaacctagaggtggtttaagtcttaattttgaaagttctgtgaagaggtttcattgttgggaatttaggaatggactgcaacttaagatctagtattgtacaggggaataagaatcaggtactgatgtcagagttagatgtggattgcagatgtttcttatgattattacagaaatgggagaagcagcctttctgtaaagtttattcttttagtatgttaaaaaagcttaggtggaagccgatagttctgaatactgaagttaaaaaaggtatctatttagtgatattcttgtgtgggatagtttttacctgatctttcaaagtcataattatagaaggtagaaaaaatgacaagactgtggtttctttgttggtttgtgatgacacccagttgctaataacattataaatctgggtggtgtaacctagtgtaaccaagtgaatggctgagtacattcttatactattataagcctgtaactgcttactttaaaagctaagtagactttttcttagatatatacccgaaggataaaaacacaatataactagacctttaaatatcaggatctttgtccagaaatctttaaaaggtgtaatttaatttaatgaaattggagtaaaacttttctgtagctttcttgcctttttgttatataatattctttttaaaaagtgtgccttaaaatatacttatccactaagcaaagtgcattaaaaacaactttcgagtattttatgggttcttatattccttgagatgtttggacattccagaccttatagtgtagagtattgcaaaatgacatttgtatcagtttttcctcctgggtttcagtaatggcaagtggatgtacagtacctctaagtatgggttatgtggaatctcaacataatacgaatatgcatctgcaaaattagcagacctttttgaagtatcaccataataaatgtaaaggtgtgatgtttatagagatctgagcgtgagtttgtctttaagccaaaaaagttctataaattgcttcactcttaaagagtgttgaagcatacttaaaatgttagttgataccttagcgaagaattgaaaaactcattcatcaaaattagccattgtatcttgtaagactttgtatgttacttttaactataatactttgccaaagggtttgcagtttttgcagttgaatttgttttgcaaactggttggttgaagtttcagcacttgaacaatttaaagtgcttgatgcaattttaagaatggattttgtacttatcaggttttttagttgctggatacttcagcgagatcctttattgtataatagtggtatgtattttttatatacatatatgaaatatataatcgtggtatgtatgactaggactattcatatttagcaagtattttttgaccctgtattgtatgccatatactgttttaggtattgggatgtagcaggaaagaaaaagttacttgccctcatagagcttgcattctggaggaccgttcaacacataatcttttcatggtgtttacattgaccaccagtatttctaaagagttgaatttggaaggaactttagggtgtcttggctaacattcctgacagatggccatttggtatgtgcctgaaatacatctagaggtgggaagcacgttagttagaggcaacctgttcactagatttgggacttgagtgttttagcaagatccttgaagactcagtttcctaaactgtaacagggaaacacttgtttttctggattatttcaaggattaagtgaaaatttatctttttaaagcatgcagccttacagaaatatttaaggtcgttgaattattcaatatcccaaattgttagaattcttcatattgtgaccaaaatccaccttcgaaccattgctccaagtttaaccctttggaatggtacagagcacacgtgtatgctaaccctttaaaatataaagacagttgtcatgatttctgagtcttctagactaaaaaactcatacggttttcagatttttcacattatatctagtttgtcaaatgtccagcttaaaacatagggcctagaattaatagctaaaatagttgattggaaaaatctaaagattttaaaatataataagtgtattgttactttttaggaacggttaattgaactcacttgtacagattaatggaaaagttttatttattttcagaatttattacttgtggtaagtggcccatgttctttaatgaatggactgctgtgagttccatgaaggcaactgggctgtcttatccatcattgtatttctagtgctcagcactgtatcggcacaagtacagtcttaataaatgttgaataggtgtaaatgaagggatgctggagtttactgaacatacaaaatattaatgtgggctttgtattacaaacttcattcaaaatatttaatacagaccatgtgtaatgctgtaagaaacagtgtaatatttccccagcctatgcagaacttacatattaatgaattgtcagcgtagatattttcaaggaaatgcatacacattcaaaatagtattgaaatcgtggtatgaagatgaaaaacaattttaaataagctgaaaatagagatagggtttcaccatgttgcccaggctggtgtcaaactcctgggctcaaatgatccacctgctgcatcagcctcccaaagtccagggattacaggtgtgagccaccacatccagcctgaagctttttttgatgtcagataaataaatccttttcattttagtgatttccacttcacaacttgttctttgtcttcatttgaatcttcagtcctcggctcatgcatttcttttcatcagttccctcttagctttactttttcccctgtataatctgtttgccgtattttctttactacttgactgttggggtgtggaaggtcacgtaatcttgctgactggccctataataaatgtgagggtgtgctgaaaagaggggagggtaccgtttgtagtgttttactgtgtgccaggcattgataaatatttaacatatattgaccaccaaaatccatgtgatagttggaaacattcccattgatggattgggaaacgggagctctaaaaggttttaagcgatttgttccaaggtcagcttggattcaaaccctaggctgatttgaaagtacatgctcttaatattaaagagcatggattttggttacaatatgaaggtggattttggttacaatatgaagaattctaacagcagtctattcattaaagaacatgggccacttaccacttaaagcatatgctttattgaaatttagttggcattcaggggcgctggccacctcacataatgacctgttttggtgaaaaatcagcttctgcttgggtatttatgtgttgatttctgttccttggccattttatcagcattttgaagattttaaaagatgaatcttctaaagattctttcagcttatttgtgtttatttgtagtttttatgaacaattgggtttaaatcttgtggatgtttttcctactttgtctttacaaagattggctaaaaacatttcttgaagacattaattactcttagttattggtggtggttttccagaattattttgatctgaagttactgatgtcagattaaaatccgtgcaagaaattattatgtgtgttttgttctttctctaaacctatggaagttccattccaccaagaagcacagaagcattcattatggaataataagaacctaagaatctgaaaaagatgggtggactctaaatataaataagaaaaattattgttatatgtggtacctctgtaatggattatttagtgttttgtcctgaaaactatagttcaaaagtatatgaaatgaagatattccgtaatgaaaaaaaaactcaaaaaatatgccactgatttaatatatacttaatagaaataagtcatgaaaatccctaggtgaatggaattcttaaaatgcttttaaaaagtgtcaaaaaataggatactagaacaaatggagaaactctcagaagggaatggaagtttaggttaactgtcttaaatttccaaagctgtaatcattattttcattctcaaagtgatggccttgtgttttgctccttctctgaccaaacttcacctgacatttacatctactcagtccttatcacatttcttttccgctaacgctaatatttatttctttccatttctatcaccatttcaggttaattagctagacttcatgttactgtgaacattcttctcgtttcatccattcttctcagttcattctgtatcaggagagttttcttaatatctttgtttagctcatgtcactcccattatattagaattattattagaataaacctaaacttttttttttagggatagtgtctaggtcacttgcccaccctggagtgcagtgatgatgtgatcatggctcacagcagcttcgaactcctgggcccagaggatcctcctgcttcagcctcccgagtagctgggattacaggtgcatgccaccatgcctggctaatttttgtgttttttgtagtgatgggttttaccatgttgctctgacttgtcttgaactcctggcctcagacaatcctcccgcctgggcctcccaaagtgttgggattacaggcaagagcagctgtgcatggccaagtctaaacttcctaatgttccatcagttaatgccttttatgatctggctccattctatcacagttctgttttcaaagacatttttatttctatttttatacttgctgttctgttagcttaaatgataagagacactccaaactctcttttgctcttcatctccagctttgcatttaaaactcagctcaaaaatcccactgtcgtgtgtgtgtgtgtgtgtgtgtgtgtgtgtgtgtgtgttttggtagagatggtgttttactgtgttgctcaggctggtctcctggggttgaacaatcctcctgtccttgcctcccaaagtgttgggattacaggcatgagccagtgtgtccagccttaaatcccactatcttgagacctttttccattcatctagataaaagttagttttttttcctgtgcccccacagcactttatctttgttgtagagttttaaaaaattctgtttaatatctgcttagttggctggctgcctttgtgttttccctactagattgtaagctcctagaggacaaattacagagcttatttattggtggtttaatttaaatacattttttctctacagattagtgcaaaccagtctgcacagatgcgagttatatctgtaaacttgcttggtattttggtttacatacactctcatactctaggatagggcaggtaattgtttcgatttataaggagggaatttaagaacctccttctagcttctactttattagaatgagtagaggatgctgggagtcactttagtgtgaatggaataaattcagacctagtgtttatatttgccctctgttgtgctgatcaagataaattcttggtgcgtttgaattaatctttaaagagaaaattttctgagcagacattatgtcaaacttatttcccaactctgaaaaattgtagctatttttgaaaaaccagttggaagtgaatgttgcttaatattcacatataagataattttaattttttcctttattttggactttttttgtgtgaatatcattttgttgttgttattttggttttggttggctttgttttctataaatttataagctttgaagtgggtgttggaagcaaaagtaccaagctaaaatcagaagcattacttgtttgcagtgattttgttccttgaattcctgcacatttaaattgtggaagaacctagtgttttttatgtatttggaaagtaaaattgatgtacattagaggataaatataggtaaaactggaatgtaagtaaaatggaaatgaggttagtgagaggaaccgaaaatggtaaatgatctacacgcctccctgcttttctgtttgcattttcagttgcataggggcactttcactgggatattttattggcattccaaactcaatttacctaacattaaattatttcacctttcttagagtcattttttttctgttactgctctttattatttttcacctgtttgcaagcataatagaggctaatggtagaaattttccgttagtatagaaaagtataagagattaaaaggccccttaggtccagctacctgatgagatgatcactcatgacattttgataaatattcttctagacttttttatgcatatatgcacagggatgtatgatttttccataagcgggaacatgtaacaatgctgtcttgtagcctgtactccacagtacagcataccatttttattagtagctcctagtattctgttgtatggatatagcataaattgtttggctgaatccactttgataaattcttagttttgttttttttttaatttttgctatgtgtgtatatctaaagcaaatttttttttgtgtatttgttccattatctttagattgaatttcctggggataaaatttttgaggcaaaggtggtatatacatttgtaacattgatacactttcaaaatgcctttcagaaggcttttacaaatttacatttcccaacagtgtggaattacccatttcctgagtctcaccaacacttggagttgtcacatattccattattggttttttttgttgttttgtatttttagtagagatggggttttgccatgttggccaggctgatcttgaactcctgacctcaaatgatctgcccaccttggccttccaaagtgctgggattatagttgtgagcccctattggtgcctggcaccattatcgtttcattcatttgcatttctttgatatttaataaggtttaatatattttcatctgtttactggatattttaatttctttctttttttttttttgctcttgttgcccaggctggaatggtgcgatctcggctcaccgcaacctctgcctcccgggttcaagcgattctccttcttcagccttccgagtagctgggattacaggcatgcgccaccatgcccagctaattttgtatttttagtagagacgaggtttttccatgttggtcagactggtctcgaactcctggcctcaggtgatccacccgcctcagcctcccagagtgctgggattacaggcgtgagccaccgtgcctggcctttttctttcttttttttttttaattgagaccgggtctcactctgtcacccaggctggagtgcagtggcaccatctgctcactgcaacctccacctcccagctcaagtgatctctcacctcagcctcccgagtagctgggatcgcagatgcatgccagcatgcccagttaaattttttatttttggtagagacagcgtttcaccgtgttgccaaggctggtctcgaactcttgagctcaagcagtctgcctgccttggcctttcaaagtgcggggattacaggtgtgaaccactgcacctggccagatgttctaatttcttgatttttttttttttaaattaacttgcaagacctacttgtgtgttatagctactaacttgttttttttttttttgcggcattagcaagtatttttcgtgagcttgtcttttatcttttaaccttctttatgtaacgttttattttaggactaggtttttgatttgtctctgtgtgtgtgtgcacacgtgtgttttaagtggtagtagtttctcccaggtacctagtgtcaaactttagtagtacttttatctctccatagttgtaatgaacttcttgttctgtaaagttttttcttttttttttttttccagtggtcttttggtccatacatttatcttggaatgctttgttagttctgcttgcttttagatttctctttgagcccctcctgttctctgcattcagatttaaaataccactttcatttgatcattttttttttctataagatacttacagaatcaaatacttttttttttgagatggagtctcgctctgtcacccaggctggagtgcagtggcacgcagtgtcatgatctcggctcactgcaagctccgcttcccaggttcacactattctcctgcctcagcctcgcgagtagctgggactacaggcgcccgtcaccacgcttggctaattttttttgtgttttcagtagagacggggtttcatcattttacccaggatggtcttaatctcctgacctcgtgatccgcccgccttggcctctcaaagtgctgggattacaggcatgagccaccgcatctggccatcagatgcttttaaaattaatttatttatttaagatggagtctcactgttgtcgcccaggctgtagtgcagtggcgtgatctcggctcactgtaacaacctacgcctcctgggttcaagctgttcttcagctttagcctcctgagtagctggaattacaggcgcctgccaccatgcctggctaatttttgtacttttagtagagatgaggttttgccatgttggccaggctggtctcgaactcctgacctcaggtgatctgcccaccttggcctgtcaaagtgctgggattacaggcgtgagccaccgcacccggccaatttattttttattgacaaataattgtatatgtttatgtgtgtgatgttttggtgtttacctgtggagggcttcaatcaagataattaagaaatcagtcacatcacatacctattttggtggtgaaaacatttttaaaataattttttttttaacacagctcgaaacagccattgaagaaaacattttaactctactctttggctgggcacagtcgtcacgcctgtaatcccagcactttgggaggccaaggtggatggattacttgaggtcgggagttcaagaccagcctggccaacatggcgaaaccccgtctctactaaaaatacaaaacatagccaagcatggtggcgtgtgcctgtagaccccaactactcgggagactgaggcagcagaatagctcgaacttgggaggcagaggttgcagtgagccgagatctcgccacgacactccagcctgggcacaaagcaagactctgtctcaaacaaaaaaactactgttttgtcagtatcagaatatgcagtgcattattgtagtcaccattctgcccaatagatcgctaaaatttattacttctgtctatctgaaactttgtgtcttttgatcaacatctccctttccctatacactcctctcccctagaccctggtaaccaccattctactccctacttctatgagtttgaattttctagattccacatataagtgagatcatgcagtatttatcttcctgtcacaaatgacataatttacttctttttttttttttaattatactttaagttttagggtacatgtgcacaacgtgcaggttagttacatatgtatacatgtgccatgttggtgtgctgcacccattaactcatcatttaacattaggtatatctcctaatgctatccctcctccctccccctaccccacaacagtccccagagtgtgatgttccccttccagtgtccatgtgttctcattgttcaattcccacctatgagtgagaacatgcggtgtttggttttttgtccttgcaatagtttgctgagaatgatggtctccagcttcatccatatccctacaaaggacatgaactcatcattttttatggctgcatagtattccatggtgtatatgtgccacattttcttaatccagtctatcattgttggacatttgggttggttccaagtctttgctatcgtgaatagtgccgcaataaacatacatgtgcatgtgtctttatagcagcatgatttataatcctttgggtacatacccagtaatgggattgctgggtcaaatggtatttgtagttctagatccctgaggatttgccacagtgacttccacaatggttgaactagtttacagtccaccaacagtgtaaaagtgttcctatttctccacatcctctccagcacctgttgtttcctgactttttaatgatcaccattctaactggtgtgagatggtatctcattgaggttttgatttgcatttctctgatgaccagtgatgatgagcatcttttcatgtgtcttttggctgcataaatgtcttctttcgagaagtgtttgttcatatccttcgcccactttttgatggggttgtttttttcttgtaaatttgtttaagttcattgtagattctgaatattagccctttgtcacttgagtagattgcagaaattttctcccattttgtaggttgcctgttcactctgatggtagtttcttttgctgtgtggaagctgtttagtttaattagatcccgttcgtcaattttgacttctgttgccattgcttttggtgttttagacatgaagtccttgcccatgcctatgtcctgaatggtattgcctaggttttcttctaggcttttaggtctaacatttaagtctgtaatccatcttgaattaatttttgtataaggtgtaaggaaggaatccagtttcagctttctacataatgctagctagttttcccagcaccatttattaaatagggaatcctttccccatttcttgtttttgtcaggtttgtcaaagatcagatggttgtagatatgcggcattacttctgaggtctctgttctgttccattggtctatatctctgttttagtaccagtaccatgctgttttcgttactgtagccttgtagtatagtttgaagtcaggtagcgtgatgcctccagctttgtccttttggcttaggattgacttggcagtgtgggctcttttttggttccatatgaactttaaagtagttttttccaattctgtgaagaaagtcattggtagcttgatggggatggcattgaatctataaattaccttgggcagtatggccattttcatgatattgattcttcctacccatgagcttggaatgttcttccatttgtttgtgtcctcttttatttcattgagcagtagtttgtagttctccttgaagaggtccttcacatcccttgtaagttggattcctgggtattttactctctttaaagcaattgtgaatgggagttcactcatgatttggctctctgtttgtctgttattggtgtataagaatgcttgtgatttttgtacattgattttgtatcctgagactttgctgaagttgcctatcagcttaaggagattttgggctgagatgttggggttttctagatacacaatcatgtcatctgcaaacagggacaatttgactttctcttttcctaattgaataccctttatttccttctcctgcctgattgccctggccagaacttccaacactatgttgaatagtagtggtgagagagggcatccctgtcttgtgccagttttcaaagggaatgcttccagtttttgcccattcggtatgatattggctgtgggtttgtcatagctcttattattttgagatacgtcccatcaatacctaatttattgagagtttttagcatgaagcattgttgaattttgtcaaaggccttttctgcatctattgtgataatcatatggtttttgtcattggtgccgtttatatgctggattacgtttattgatttgcatatgttgaaccagccttgcatcccagggatgaagcccacttgatcatggtggataagctttttgatgtactgctggatttggtttgccagtattttattgaggatctttgtatcgatgttcatcagggatattggtctaaaattctattttttgttgtgtctctgcctggctttggtatcaggatgatgctggcctcataaaatgagttagggaggattccctctttttctattgattggaatagtttcagaaggaatggtaccagctcctccttgtacctctggtagaattcagctgtgaatccatgtggtcctggactttttttggttggtaagctattaattattgcctcaatttcagagcctgttattggtctattcagatattcagcttcttcctggtttagtcttgggagggtgtatgtgtccaggaatttattcatttcttctagagattttctactttatttgcatagaggtgtttatagtattccctgatggtagtttgtatttctgtgggatcagtggtgatatcccctttatcattttttattgcatctatttgattcttctctcttttttctttattagtcttgctagcggtctgtcaattttgttgatcttttaaaaaaaccagctcctggattcattgatttttttttttttgaagggatttttgtgtctctatttccttcagttctgctctgatcttagttatttcttgccttctgctagcttttgaatgtgtttgctcttgcttctctagttcagttgtaatgttagggtgtcaattttagatctttcctgctttctcttgtgggctttagtgcttataaatttccctctacacactgctttgaatgtgtcccagagattctggtatgttgtgtctttgttctcgttggtttcaaagaacatctttatttctgccttcatttcgttatgtatccagtagtcattcagcagcaggttgttcagtttccatgtagttgagcggtttggagtgagtttcttaatcctgagttctagtttgattgcactgtggtctgagagacagtttgttataatttctgttcttttacatttgctgaggagtgctttacttccaagtatgtggtcaattttggaataggtgtggtgtggtgctgaaaagaatgtatattctgttgatttggggtggagagttctgtagatgtctattaggttagcttggtgcagagctgagttcaattcctggatatccttgttaactttctgtctcgttgatctgtctaatgttgacagtggggtgttaaagtctcccattatttttgtgtgggagtctctctttgtaggtctctaaggacttgctttataaatctgggtgctcctgtattgggtgcatatatatttaggatagttagctcttgttgaattgatccctttaccattatgtaatggccttctttgtttcttttgatctttgttggcttaaagtctgttttatctgagactaggattgcgaccactgcctttttttgttttccatttgcttggtagatcttcctccatctctttattttgagcctatgtgtgtctctgcacgtgagatgggtttcctgaatacagcatgctgatgggtcttgactctttatccaatttgcccatctgtgtcttttaattggagcatttagcccatttacatttaaggttattattgttgtgtgtgaatttgatcctgtcattatgatgttagctggttattttgctcattagttgatgcagtttcttcctagcctcaatggtctttacaatttggtatgtttttgcagtggctcttaccggttgttcctttccatgtttagtgcttccttcaggagctcttgtagggcaggcctggtggtgacaaaatctctcagcatttgcttgtctgttaaggattttatttctccttcacttatgaagcttagtttggctggatatgaaattctggggtgaaaattcttttctttaagaatgttgaatattggcccccactctcttctggcttgtagagtatctgctgagagatcagctgttagtctgatgggcttccctttgtgggtaacccgacctttctctctggctgcccttaacattttttccttcatttcaactttggtgaatctgacaattacgtgtcttggagtagctcttctcgaggagcatctttgtggcgttctctgcatttcctgaatctgaatgttggcctaccttgctagattagggaagttctcctggataatatcctgcagagtgttttccaacttggttccattctccctgtcactttcaggtacaccaatcagatgtagatttggtcttttcacatggttccatatttcttggaggctttgttcgtttctttttattcttttttctctaaacttctcttcttgcttcatttcatcttccatcactgataccctttcttccagttgatcgaatcagctactgaggcttgtgcattcatcacgtagttcttgtgccttgttttcagctccatcaggtcctttaaggacttctgtgcgttggttattctagttagccattcatctaattttttttcaaggtttttaacttctttgccatgggttcgaatttcctcctttagctcggagtagtttgattgtctgaatgaatccttcttctctgaactcgtcgaagtcattctctgtccagctttgttccgttgctggtgaggagctgcgttcctttggaggaggagaggcgctctgatttttagatttttcagtttttccgctctgtttttccccatctttgtggttttatctacctttggtctttgatgatggtgatgtacagatggggttttggtgtggatgtcctttctgcttgttagctttccttctaacagtcaggaccctcagctgcaggtccgttggagtttgctggaggtccactccagaccctgtttgcctgggtatcagcagcggaggctgcagaccagcggatattgttgaacagtaaatgttgctgcctgatcgttcctctgtaagttttgtgtcagaggagtacccggccgtgtgaggtgtcagtctgcccctactcgggggtgcctcccagttaggctactcggggttcagggacccacttgaggaggccggctgtctgttctcagatctccagctgcgtgctgggagaaccacaatttacttctttttaaagctaagccgagtgcagtggcacacgcctgtaatcccagtacttgggagcctgaggtgggcagatcgcttgagctcaggagtttgagactagccctggcaacgtggtgaaatctcttctctacaaatacagaaaaatcagcccagcatggtggcatgtacctgtagttccagatacttgtgaggcagaactgggagaattgcatgagccctggaggtaaaggctacagtaagctgagatcgcgccacgccactgcactccagcctgggcaacagagtgagaccctgtctcaaaaacaaaataaaacaaaaaacaaacctgaaccacattaaaaaaaaaaaaatccgttcatctaacaatggacacctaggttgcttccatatctgagctattgtgaataatgctgcaatgaacatgggagtggagacatctcctaagcatactgatttcagttcctttgggtatatacccagaagtgggatcatgtggtaatcttgtttttacttttttgaggaacctccataccattatccatgatggctatagtaatttacattcataccagcagtgcacaagggtctccttttctgtatacacttgccaacacttgttatctttcatttttttgatgctagccattctaacaggtgggaggtggtatctcatagtggttttagtttgcatttccttggtgattattgatgatgatgagcattttttcatgtatctgttggccatttgtatgtcctttttaaaaaaaaaaattgagatgggatcttgctatgttgcccaggctggtctcaaactcctgggctcaaggagtcttcccacctcacccacttcagcctcccaagtagctgggattcaagcactaatcaccaaatccaactgtattccctcttttgaggaatgtctatttaggtcctttgcccgtttttgaaattgggttattttctttctgttgatttgagttgctaatatattttgaatattaatgtgttatcagatatgtggtttgtaggtattttctccttatccacaggttgtcactttacttcattgtttcctttgctttgcagaggctttttaatttgattccatccctttgtttatttttgtttttgttccctgtacttttgggtttataaccacgaaacctttgcccaaactaatgtcatggagcttttcttctcctttctactgtataaggtgtgagatgagagtctattttcattattctccatgtggatatccagttttcccacccctgtttatttttaagacacagggtcttgctgtgttgccaaggctggtcttggaactcctaggttcaagcagtcctcccgcctagcctctgcagtagctgggactacagacatgcaccactgtgcctcactcccatcaccatttattgaagaggctgtccttttcttactgtatgctcttggctactttgccaaaaatcagttgactataaatgggtttatttctgggttctctattgtgttccttcagttaatgtctctgtttgtatgccagtaccatactctttggattaacatagctttggaataaactttgaagtcaggtagtgggatacctccagccttgttctttttgctcaggattgctttggccatttgggatcttttgagggtttgagtattccactgaatcagagtcttgaatggggcatttaagacccccaacacagactgaaccaaactactcttacttcttaccgtatatcctgatcacaatacaaactggactgtttactattttcttatatcttagtttgtatccttccttcagtttgccagtctggcttgctcattctttcaaccttagttcaggtgggtttttttgtttgtttgtttgtttgtttgttttgagatggagcctcgctctgtggctggagtgcagtggtgtgatctcagctaactgcaacctctacctcccaggttcaagcgattcccctgtctcagcctcccaagtagttgggattacaggcacacaccaccacgcctggctagttgtttttgtatttttagtagagacagggtttcaccatgttggccagctggtctcgaactcctcacctcaggtgatccacctgcctcagcctcccaaagtgctgggattacagttatgagctacggcacctagcctcaggtgttatttttatctatgaagtcttcattaatctcgttcagaagtgatttttaaaaatacctttagaactgagatcactttgtgagtacttattacatccagtttacccagttggtaggcatttgagttatttccagtttttggctgttatgagcaaagctactgaacatttgagtacaggtcttttgtttttgtttctcttgaataagttaggagagggtttgctgtgttgttgtatgggaagcgaatgcttgacttcctacagtcccatggtgtttttcaaaatgtctttgccatttgcattccagtcagtagagtatgggattccagatgcctcacctcctcaataagacttatttttttttttgtcagtctttgattttagccattctagtggatgtgtattggtatctcattgtggttttatttgcaattccctaatgataagtaatgttgagtatacttccatatgtttatttgcccttcctattttttgctaagtgtctcaaaatgttcattcttcatgaattgggttgttgtcttactaaagttgtaagaattctgtgtatatgctagatacaaataaatgttttgcaaacgttttttcctcagtctgtggctcactttccctaacagtaatttccaagagcaaacgttttaaattttaatgaaaaaccagtttagcatttgtgtgatttatgctttttttttttttttttgagacagcgtgtctcactctgtcgcccaggcatgttctcagctcactgcaacctccgcctcctgggttcaagcgattctcgtgtctcagcctcctgagtggctgggattataggcatgtgccatcacgcccagctaaattttgtatttttagtagagacagggtttcaccatgttggccaggctggtctcaaactcctgacctcaacctgcttctgcctcccaaagtgctgggattacaggcgtgagccagccactgtgttcggccagatttatgcattttatgtccaaaaaaatttttgcctaacccacagtaacagatattttctccttaggcttataatgtgcatgtttctcagtctacttttatgtataatgttaacattatgatagcatacttacattttcatcttgtcttttgtactgttgtcatcttttttttttttgagacggagtcttacttcttcgtctagactggagtgcaatggcatgatcttggctcactgcaacctccgcctcccaggttcaagcaattctcttgcctcagcctccccagtagctgggattacaggcatgtgccaccacgcccagctaatttttgtatttttagtagagctgggatttcaccctgttggccaggctggtcttgaactcctgacctcaagtgatccacccacttcagcctcccaaagtgctgggattacaggcatgagccactgcgcctggcctgttgtcatctgttttatgtctgtttgcatggtgtatgtgtgttaaatacagacataaaatttaaaatgagaagaggcacttatatttactcaaatgtttaccttttcaaatgcttttcctttttacagatccaactttccatgtagtatcattttcctctggctggaggaatggctttgaacattttttattatgtaggtctgctttttctatgtctgataaagtctccattttgaaagattgttttactgggtgtggaatcctaaactgaaattttttccttaatattttgacttgttgcatttctagctgataaatttctgtaatattttggttttgcttcaaccattggatttcaagtcctgtgactttttaaatatttgtggttcttaagcacctagtacagcatttgatagtaggtacctagcaagtgagattaaattgcctgtcttgttttataattttattttctagggctgggtgtggtggctcatgcctgtaatcccagcagtttgggaggctagggcagcagatcaactgaggccaggagttcaagactagcctggccaacatgacaaaaccccatctctactaagggtacaaaaactagctgggtgtggtgatgtgcacctgtaatcccagctactcggaaggctgaagtaggagaatcacttgagcccaggaggcggaggttgccatgagccaagatcttgccactacactccagcctgggcaacagagtaagactcggtctcaaaaaaacaaaacaaaaaacaaaaaaaacactttgtattttctagcaaactattccttcagcataaattgctttggattaaaaaaaaaaagaggtccaggctgggtgtggtggctcacgcctgtaatcgcagcactttgggaggccaaggcaggcagatcacgaggtcaggagttcgagaccagcctggccaatatggtgaaactctgtctttactaaaaatacaaaaattagccggacgtggtggtgggcgcctatagtcccagctacttgggaggctgaggcagaagaatcacttgaacctgggaggtggagcttgcaatgagctgagattgcaccactgcctgggcaacagagcaagactccatctcaaaaagacaaaaaatgaaaaacaaaaaaaacaaaaaaaggtccagccccacacggttaaaaaaattctgttgatattaataaggtctggtaatacactttgaacaaattcttgatggctacagagagactaatcaaagtatgtgcttttgtgcatgtcaagtactgagctcccttctactcttctcacctgcttttcattttctgtcttcaaaaatacatatcaaggcatggttcagggaaacatgaagacaaacacagaatttatgctcagtggactagaacatgtttgcttgagcaaatctgcaaaaagtcagccacgtgtctttttgttgttgttgtcgttacttttaatatggcataagaaccataaaggaagtgtatttttagaataaacacaaaacatttcagttttatgttatcttttctagttttaaaaataacatgtttattgaaatgtatttcacatactgtacagttactgttttaaactataatttattagtctttagtctcttcatagctttgtgtaaccactaatttgagaatatttcagtcactccagagagaaactccatggctatttagcagtcactccccattcccacattccacagttttggcaaccaacagttggtgatttctttctgtctttgtagatttacctatgctggatatttcatttcagtggaatcatataatgtatgatcttttatggctggattctttcactaaagcataatgttttcaaggtttatctgtgttgtagtatatggatcaatattccttttattggccaaatatcccattgtatggttatgccacattttatcattagtcatggacctttgggttaactttttggctatttttttaatgctgctatgaacatttgtgtacaagtttttgcatgagcatttgtttttctcttgagcatatatctaggagtagaattgctgggtcatatgataattctatgtttaagattttaaagagctgtcaagctgttttttaaagtagctgcatcatttttatattcatatcagcaacatatgagggttccagtttcttcacatcctcaacaagagttgtctttttgattgtagccatcttggtatttgcagtgggatcacattttggtttagatttgcatttctctaatgacaaataaagttgagcatcttttcatgtgtttttgaccatttgagaaatggccaaaatctttttttgagaaatgtctacatgaatctcttgtccacccccactaccccctcttttttttgagacagggtctcactctgttgcccaggctaaagtgcagtggcacaattttggctcactgcagcctccatctctaggactcaaacaatttccctatcttagcctcctgagcagctgggaccacaggtacacgccaccacacctggctaattttttcgtatttttgtatagatgaggttttgccgtgctgcccagtctggtctcaaactcaagctcaagcaatcctcccaccttggcctccccaaatgctgggattatgggcatgagacaccatgcctggccttctttgcccatttttaaattgggctgtcgtcttattataggatcttaagagttttttatactgtctattctagatgtaagtcctttatcagatacatgatttacaaataatttctttcattctatcactttgttgatggtgtcttttaaagcacaaaagtattttattttgatggagtccaatttattatttattgcttgtgttttttggtctcaaatctaagaaggctttgcctaatctgtgttcacaaagattttctgcattttcttctaaaaattttatagttatagctcctactttgatccattttcagttagttttttgtatggtgaaaggaagaggtctagcttcattcttttgtgtgtggatatacagttgtcccagcaccatttgttgaaaagagtattccttttccattgaattgtcttagcacccttgttgaaaatcaactgatcacaaatgttaggatttatttatgtactctgaattctgttccattgatttatgtatccgtccgtatgccagtaccacacagtcttgcttactctgattttgcagtaatttttgaaatcaggaagtgtgaatcttccaacttaggtcttttttaagattgttttgactgtttgggttcttggcattttcaaatgaattttagaatcagcttgccagttagttcaaaaaagcagctaggattttgatagggagtacattgattttaaaaattttttgtttcatcactacagaactgcaatacattgactttttagattaatttggggagtattatcttgttaattttttttttttctttttgagacagggtttcactatgttgctcagggtggtcttgaactcctaggctcaagcgctcctcctgccttggcctcccaaggtgttgggatcataggcatgagccagcgcgcctggccagggagtattaccttttaacaatttaagtcatctaatacgtgaacacgggatgtctttccttttatttagattttccttaatattttttagtgtgttttgtagttttcagggtataagccttgcactttttaaacttttaggtatttcatccttttaaaggctattgcaatgggattgttttctttttttcttttttttttttgtttttgttttttgagatgaagtctcgctgtgtcacccaggctggagtgcagtggcacggtcttggctcactgcaactctgcctcctgggttcaagtgattctcctgcctcagcctcctatgtagctgggattacaggtgagtgccaccatggctggctaatttttgtatttttagtagaaacagggttttgccatgttggtcaggctggtctcaaactcctgacctcaggtgatccacccaccttgacctcccaaagtactgggattacaggcgtgagccacagtgcccagccggaattccttttatttcttatccttgactaattacaatggctagaacctcaaatacaatgttgaacagaggaatgagaagggactttcttgtcttgttcctcatttagtctttattcgcaaagtagttagctgcagattcgtcataaatggctagttttattttttaataaaaataatgactttgattccaagtcattgcagaagtcaggaaaaaaaaaagactttgtttctctcaaagtcttaagctctggtgtaaaaaaaattctgggttgggcatggtggctcacacctgttatcccagcactttgggaggccgaggcaggagggtcacttgaacccaagagtttgagattagcctgggaaacatggcaaaaacttgtctctacagaaaatacaaaaatttgccgggcctggtggtgtgcacttgtcccatctacttgaggggctgaggcaggagaatcgctttgagcctgggaggttgaggctgcagtgagccaagattgcaccactgcactccagcctgggcaacagagtgagaccctgtctcaaagcaaaacaaaaaaaacccctcaaataccttgtttgacccctatatgtgagcatatattaatataagtattcattactattctaggggccatgaaaaaaggaaatctcctattttgtagtatgtgtgtaatgattgccacattggtttctcatataccatgcgtacagaaacatttgaacagtgttttataatgaataatgtatgcattaatgttgaaatgatgagagagagcccgccatgtgatgatctaagcatcccaggaaaagaaaatgatgcatgcttaggcaccaagtcaagaagaagcttgaccttctgcaaaagcagaaaggagaccagcatggctggagtctggtaaataaagaagggtataataaagatggaaggcggtttaggccttgtgagtcacaacacagagttttatttttattttaaatgcagttggaaaccactacagagttttaagcaaggacatggcataatccaatttatgtttttaaaagacaaagacataaaatacaagccaacctgtaacaagtactgtgtgatcagcaaatagggaagtgatagagatgagactttagcttgacccatgcaaaatagataagaattaaacaggatcacacctgtactcccagcactttgggaggccgagatgggcggatcacctgaggtcaggagtttgagaccagcctaacatggtgaaaccccgtctctactaaaaatacaaaatttagctgggtgtagtggtgggtgccgtaatcccagctacttgggaggctaaggcaggagaatcacttgaacccgggaggcggaggttgcagtgagccgagatcatgccattgcactccagcctgggcaacagagcgagattccgtctctctctctctctctctctctctctctctctctcacacacacacacacacacacacacacacacacacagaaacaaatggaggagaaagagatagtgtggtagcaataaatagtgcttggctttgaagtgaaagacttgggtttgaatattgactctgcctcttcttagttcccccatctgctttctctataccttggttgcacatgaggagcaaatcaaatgaaaaatgcttataaatgtgaacctgtgagggttagtgtggtatacagtcatgtccccagttttccatggggcatatattctaatactcccagcggttgtctgaaaccaccaaaatagtactccactctaaatatactatgtttttttctatacatacatacctgtgataaagtttaatttataaattaggcacagtaagagattaacaacaataataaaatagaacaattataacaataccctaaaataaaagttatgtgaatgtagggtctctctcaacatatcttattataccgtaccttgcataagagaaaccatggaaagtgaaattgaggacgaggggactgctgtacggtatttgttttattcagtgaataaaacactgaattatgctaggggctgtggagtgatacaacaatgaattagactcagtttctgctcctcaaagagggtgcagtctgatagacaatgtggttgatatctaaaatgtgaagttaagagttatcataagaagggtgcagataaaatgctatgggagttcatagaatggagaccgtgctgcttgtttggatttggcttctttcttcataaggctttatgaagtcctttatgctagtccttgagagatggataagccttgaatagaagatggagggcaagatgatattctcactaggccagtatgtgggaatataaaggcatggaagtattgggcaaatttagtacttgataagcaaaggtaggttaggaccagacaaattatgcagtaccttgatactaggctgctgtgaattcttttcaataggaatactatcagcagtgtctttaattgtgtaaatatttattgagcatctaccactgctaggtttatgatagaagtcaaggcttgaggatagaatatctcagtttagttggggaagatagattatctgattatttttattctgagatataaacagaattgtgatgggatcgtaggacaagtaccagctctagctgactggcgtaataagagagggctttataaaggtggtaaacactgtgctgagatacgaagtatccttttgtttcctacataaaggaggtgaagagaggaatatgagagaaacattctaggcctgacacttcctatattttgtgatggctggacaaggactttatatgcaagtcaagcagggccgaaggctttggggtaactgaaagattattcaagtgcagagttaattggaaagggtggagactcgaggtgggaacctggtaaggagacttgcactgggcccagtgtgtgatgatgtagtacctaatgtggaatagtagctatggggataaagagcatggaaaaatggagagatgcttgagatgtagaattggtggagcttggaaaccaaatagatctgtgagaagagataaaagagatcatgtggaatgtagaataatttccaggtttctgctgttttagagggtgccactgcctcagaatagggtgtatttaaggagaaggagggtggatttgaagaggaagcttaatagttttagctgtattgtgttgaagatacatgtcagagttggaagtagagaggatgatttgcgggggtgatgggggacgaattgacaacatttaggtaatcatttaagccacacatagcataaattaaacttgtgggagaatgaatataggaaggaagaaaaacctcaaggtgcggaaacagccatagaagtaagaaaatcatgaagacgaaaggtagtagaaatagctaggaagtgctccaaataattgcagcagagagagacttttaaggttgtagccaacattatcacagacagtgacgtttttttctttttctttttttgaaaggtaggtcattggttgcttcagaggtgaccagttgcagaatggatgtatgtataagccagattgtagtgatttgaggattgaaaggacaaaagagattttggccgtaactggaaggacagataaagataatatcagtatgtcatcattttctctttgttttgttttcttgtctgtttttaaatatcttagagatttgagtaatttattccttcaggggaattaacaaatgaacagcaaaggttaacatcacaattaatagagtaagccagctattgtcatagagtagcctagcatagtgcatctcagactttaatggatatcttgttaaaatgcagattgtggttcagtaggtctgggctggagtctgagacacagcatttctgacaagctcacaattggtgctgatgctgcctgtctatggactacactctaagaagtaaggctctagagagtatgagattgatgcattataggggagttagccttagatagaaagaggaacacctcctttcttaattgaggtggagtgtacggtggatgaaggcacaggaaatacagattaaatttgcaggcaagagacatgcctggtagtctttgtttttttctgtgaaacaataagtaaagctatgctatgagaagactaggaatgggattgtgtgagcttgatgaaagttgtgaaagtttggaatagctactaagaggaggaaaatgagtgaatttgggacatgtaataatcgctgaacagtgaggattagtttggttatggtgtctgtagaaatggagcagacacagactagtaataaagtaaaaaagactagtaacgtagatttttttctttcttttttttcttttttttttttttttgagacagagttttcgctcttgttgcccaggctggagtgcaatggcatgatctcggttcaccgcaacctccgcctcccaggttcaagcgattctcctgcctcagcctcccaagtggctgggattacaggcatgcgccaccacacccgtctgattttgtatttttagtagagacagggtttctccatgttggtcaggttggtctcgaacttctgccctcaggtgatctgcccatctcggcttcccaaagtgctgtgattacaggtctgagccaccacacgtggccaagagattgcttatttttttaagatgatatggtactctagggaagtggtaatgaggtctaaagtagaacagtgtcctcgagaatggaagaggaggatgtggtaggccgaataatactcacccaacaccacaccccctccaggtgccatgccctaatcttttcaatctctgactgttacaccttacattttaagaggaacttcgtagatatgattaaattaagtatgttgatatggcggggttattctgggttatctggatgggtcctgtgtaatcacaaggatttttataaaagagaggctgtagggtctagtcagagaactcacgtgatgacaggaataggagagagaaaatgtcatgatgaaagtagaggcccaggtgatgtaaggttttgagccaaggaatgtagacagcctgtggaagctggaaaaggcaagggaacattttcccaagagactccagaaggaacaaagctctggtgacatgttgattttagttcactgagactgattttggacttctgacatgcagaactgcaagaaaataaatttgtgttgttctaaactgctgactttgtggagttttctgttacaacaacgatcagacacattcagagggtatggatataagggaatagtatagagttagaatcagtaaaatgagacaattaagaggttgtggtatgggaactgggaaactagatttctagcctgggtaaatgagtggagagtagtgaaattaaaaatagagaatggtaaggagtagatgttacaggagggtatatttgctttgcaagtcataatttcaggaactggtgagaatagtattttgcgtctagtaatatagattagagtggaagaaaatttgaaacaaggagatgaatttaagaggctaccacagtgctgttacatatagttaatagagctgttataataacgttacatgacaaaatacacaggatcatcactttatatagtgattttcagtttgggagtcatattcatacctttttgggggggttaataagtttttgaaatggacacagctgctattagcatgagaaataagcagagtggaaacattggcctcaaagatgttgtggatagcagctactgtattgggcatcatatgtatagaacatttctgtcatccagaaagttccattgagtgatgctgctctgtgttattttcaacagtggaggactggatattatcagtattacagtaaaatttttaggacacagtatttgctaattagaaataattttcagaagacctagactcctggagaaactgtgagataatagtcaagtgaacaatatacattgctctccaaggaacactaaatagtctaacaacgagcactaaccagttgggtttcaggatactgggtttttattctggtactactttgtgttgtgtgtatttgggaaaacctgttagaaacatagaaagttctcttcttaaagaggtcctgtagcctcttaaaaacatcacaagcaagaaacaggtaatatgtattcattaatttctacaacagtgtcggaatattaggaaaacatttttagaaagaaaaatcttggctgggtgcagtggctcatgcctgtaaccctaggccaaagtggacagatcacttgagtccaggagtttgagatcagcctggacaatatggcgaaacccctatccctgcaaaacatacaaaaattagtcgagtgtggtggtgcgcgcctgtagtccccgctacttttggggggtggaggtgggacgatcacttgaccccagaggtcaaggctgcagtgagccttgtttgcgccactgcactccagcctgtgcgaaaaagtgagagaccctgtcttaaaaaaaaaaaaaattatctattaaacaaggaggttggacctgctacctacctccatttcagttcttttagtaaaacattatcatgccataattcattatatagttttaaagatgcacttctctcttattctcataactttttatggctgaaatgttaatcattagtaaaaatggcctaaactgaaatttgtttagttttaggttcccaaaccatgtttgttataaacagtaaatatatttttggaatttattagcaaatcacaatatctgagagaatggaaacttactaagacgaaataaatagtttaaggaaggaacttttgtagagaaataaaagagttggagaggaacggaagttgtatgtagaagaattcagttgatatagtgatcaaatactataaaaagtagcttccaaaatatctttttttttttttttttgagacggagtctcgctctgtcacccaggctggagtgcagcggcacaatctcggctcactgcaagctctgcctcccgggttcatgccattctcctgcctcagcctcccaaatagctgggaccacaggcgcccgccactacgcccggctaatttttttttttttcactattgtgtattttttcttttttcttctttttttctttttttttaattattattattatactttaagttttagggtacatgtgcacaatgtgcaggttagttacatatgtatacatgtgccatgctggtgtgctgtacccattaactcgtcatttagcattaggtatatctcctaatgctatccctccccgctccccctaccccacaacagtccccagagtgtgatgttccccttcctgtgtccatgtgttctcattgttcaattcccacttatgagtgagaacatgcggtgtttggttttttgtccttgtgatagtttactgagaatgatgatttccagtttcatccatgtccctacaaaggacatgaactcatcattttttatggctgcatagcattccatggtgtatatgtgccacattttcttaatccagtctatcattgttggacatttgggttggttccaagtctttgctattgtgaatagtgccgcagtaaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcacaccaacagtgtaaaagtgttcctatttctccacatcctctccagcacctgttgtttcctgacttttcaatgattgccattctaactggtgtgagatggtatctcattgtggttttgatttgcatttctctgatggccagtgatgatgagcattttttcatgtgtcttctggctgcataaatgtcttcttttgagaattgtctgttcatatcctctgcccactttttgatggggttgtttgtttttttcttgtaaatttgtttgagttcattgtagattctgggtattagccctttgtcagatgagtaggttgtgaaaattttctcccatgttgtaggttgcctgttcactctgatggttgtttcttttgctgtgcagaagctctttagtttaattagatcccatttgtcaattttggcttttgttgccattgcttttggtgttttattagacatgaagtccttgcccatgcctatgtcctgaatggtaatgcctaggttttcttctagggtttttatggttttaggtataacgtttaagtctttaatccatcttgaattaatttttatataaggtttaaggaagggatccagtttcagctttctacatatggctagccagttttcccagcaccatttattaaatagggaatcctttccccattgcttgttttttcagtagagatggggtttcaccatgttagccaggatggtcttgatctcctgacctcgtgatccgcccacctcagcctcccaaagtgctgggattacaggcgtgagcaactgcgcccggccccaaaatatctttatatagaacaaaagttttctgagtctttatctctgttattcagattctgtctaaaagagattaatagttcagaagaatgaattgtgttgggattttacctattatctttgtatctcttttcttagataagattcactgattgtaaatttcaattaaatatagtttatgtgtctgaatgaaattgatgaccagaatcttgccagtgtaggaaaagttgatttcctacactgctttcttctgctgcttacctttctgctactcatcagtatctgatcaggggatagaaacatgacgtatatcagacttgtttggagctccaacaaaatctgaagggagaggaaattaaaaatgtggctgagtatttcatgttatgacacttttggttcctatattaaagttaaccaagttatttcacaaccagcttacaatcacttcatatttagccaaacatttcttctcatttctatgtataattataagcttattgatattaaagtgtgggtttttatgaaatgcttcctcaatactgaaccttagttgacccaaagcacatacttgtttttgaaagaggggggtagatgttgaatttgtgtttgagtttatcctaaacctaatcatcattttgtttttgtcctagaattagaatgtttctaaacacttccctccacactgtattaatgtcaactaagaacggaaattttcagtgtccaggcacggtggctcatgcctgtaatcccagcactttgcgatgccaaggcaggaggatccctggagcccaggagttcaagaccagcttgggcagcagagtgagaccctgtctctacaaagttagctgggcatggtggcgcacacctgttgtcccagctactcaggaagctgaggtggaggattgctttagcccaagaagtcgaggctgcagtgagctgtgggtagtatctctgcactccagcctgggtgacagtgagaccctgtttcaaaaaaaaaaaaaaaattatctgcctatttattattttttttgaattaaaaaaattcacgaaataaaaatttaaaaaaattttgtgggtgcatagtagatgtatatatttatgggttacatgagatattttgatacaggcatgcatgcatattagtcatgtcagggtaaatggggcatccttttatcctttgtgttacaagcatttatcctttgtgttacagacaatccaactatcctcttatggttttttgtaaatgtacacttaaattatttttgactgttggctgggtgtggtggttcacacctgtaatcccagcactttgggaggccgaggcaggcagatcacctgaggtcaggagttcgagaccagcctggctaacatggtgaaaccttgtctctactaaaaatacaaatactagccaggcatggtgcaggcatgcctgtagtatcagctatcaggaggctgaggcaggagaatcgcttgaacccaggaggcaggataatcgcttgaacctggtaggcaaaggctgcaatgagccgagattgcaccactgcactccagccagggctggagcgagactctgactaaaaacaaaaaaaaaaagaaaaaaaatgtgactatagtcagcctattgtgctagcaaatagtaggtcaccttcattctttgtattttttgtgcccattaaccctcccccgaccctccaccatgtcactacccctccagcctctggtaaccgtccttctactctctatctccatgagttgaattgttttaatttttagctcccacaaataagtgagaacatgcaaagtttgcctttctgtgcctcacttattttacgtaacatgatgacctctagttccatccatgctgttgcaagtgacgggatctcattttctttttatggctgaatagtactagattgtttatatgtaccacattttctttatccattcatctgttgatggacacttaggttacttccaaatcttggctaatgtgaatagtgctgcaataaacatgggagtgcaggtatctctttagtattattgatttcctttctttggggtatgtacctaggagtgggattgccgaattataagatagctctagttttagctttttgaggaacctccaaactgttcttcacagtggttatactaatttacattcccatctacagtgtacaagggttcccttttctccacattctcgccagctagctccttggcagtgtgttaatgtgttaacctgcctactttagagttaaaaaaaatgctgagtttcagacctgagttgtagataaaaatagaatccaactcagatcttataagagactttaatgcagggactacagaggtgccgtggattaagggaacccataaggcatgtttttactagcagcagagaagcccaaagggccaggaaaaatacagtgttattggagtctcttgagagctgtgaagagggtgcctcacagcaaccatggcggtggagggatgcagcttcttccagaaaatgtggccatgaggagggagggagctaggaagaaataatccagcctttctctgcctccttctgtcagtggcagaacagccctggaactcagaaggcatatctgttggggtcagcatcattgggcacagagtagggcagaaaggtattgggagatagggcagttgtagtaagataataagcaacacaactactaatgagttcaggtgttgacttcaggtaacgtaatattttacccaatttcttatctgttaactatgcatactttactgggttgatgagggcattaaatgagataatgtgaaagtactatcataatgtctttgtcttgtgagtatattttaaaagtcttggtaatgcatggatttgaaaacctcagcttcctttcacttggtactgtgttaaatttgtgggaactttgcttgccactatacttttaaatatatgttttccaataatttttgagaagtgaatggcctcattattatcaagtagtttccaagatttagtttgtcattgttttatagagccagaagcctgaaaacctaagtcctagttcagactatactactatttgtggcatagttctttgtgggaattatttttactttgcctctctgtgcttttcctttctaagaaattgagtaataatacttaactagtaaatgtttaatattatggtaaaataatagttgtcaagtactttgaagacttaaatgatatgtatattaacttttttactctcattcattttgaaaagtatcagagcctcagattaagagtgattggatagtttttactttgttgcattttctgtgtgaaattatgtagctcataagctattatcttgtatatgtgtgtttacgtgagtaaagtgattatgcttatgtctattttagttactgtgtgtgaatgtaattttttaatttttttgaatggagccctccgcctcccaggttcaagtaattctcctgccctagcctcctgagtggctgggactacaggcgtgtgccaccatgccgggctaatttttatagttttagtagagacggggtttcattcactatgttggccaggctggtctcgaactcctgacctcgtgatccgcccgccttggcctcccaaagtgctgtgattacaggcgtgagacatcacgcctggctgtaaattttcttaaaactatctttctgaaacgaactctaagagactctacttattgcccagtagtaagtcttgtctttttcactcttgccatagacagagcactgcttacttctgaacttacagttgaggaaggtacttttgagatgtggcaactgtctcctggtaaaagatttgtcagactttaccctgctgctactactaccattgatgtagccttattgcctacttcttttttctgagacagcagtgatgccttgtcacatttttcgtcctaatttttacatttgtagaccagagcgagatcagggcaatccattttgaagaaaactatgatcaccaaataatactctactttaaagaaatttttatttttcaaaacttcaaaaatgtaactttgaaattaagtaaatttctattttatttcataaacttgaattagcactgtctttgtaaattccaaactgaacctttctcaattactgattaaatcttaattatttctcaccagacggtctggaaaatcccgaagcagaagcccgtattcatctaggcattcaagatctcgtagcaggcacagattgtctagatccagaagtcgtcattctagtatttctcctagcacactaactctgaagagtagcctggcagctgaattgaacaagaataaaaaagcacgagcagcagaggcagcaagagccgcagaagcagcgaaagctgcagaagcaactaaggctgctgaggctgctgccaaggctgcaaaagcttcaaacacttctacacctaccaaggggaacacggaaactagtgccagtgcatcacaaacaaaccatgtgaaggatgtgaagaaaattaaaattgaacatgcaccttctccctcaagtggtggaactttaaaaaatgacaaagcaaaaacaaagccacctcttcaggtaacgaaggtggaaaataatttgattgtagataaagccaccaagaaagcagtcatagttggaaaggagagtaaatctgctgctacaaaggaggaatcagtatctcttaaagagaaaaccaaaccacttacaccaagcataggagccaaggagaaggagcaacatgtagctttagtcacctctacattaccaccgttacctttgcctcccatgctgcctgaagataaagaagctgataggtaagtgcaaaaagtatttgtcaataactgttcaaagaaaaaatgtaagtctgaagtgagaaatgagttgacctcccctaaccccctcgaaacaactttagtgaaaaagactacaagtgaatgaattttcttgattatatgcatcttaaaatgaagcacattgcatacaagatggcaaaattaaagtttatactaagacattcagggaaaaattgccattgtcttgggatacaatgaatatttcaatatgattttgggtattagaaatgccagtattctctttggtttagttttccttgatgatgtaatcagagacagaatattttatgaataagttggccctagttaatatacatctcacaagcatttgtctcatttatttctaagtttcttcagtggccttgtaaatttatcactgtcagtgattttgttatcactttttagtttagtcttttcttaactcttttaattaaaaaaaaatttttttagcctgtcttgcagttgggattaatcacattatattatagaaaactcataatgtggccaggcctggtggctcaagcctgtaatcccagcactttgggaggccgaggcgggtggatcacctgaggtcaggagttcaagaccagcctggccaacatggtgaaaccccgtctctactaaaaatacaaaaaacttagctgggcgcagtggcaggtgcctgtaatcccagctactagggaggctgaggcaggagagtcacttgaacctgggaggtggaggttgcagtgagccgagattgcgccactgcactccagcctgggtgacacagtaagaccgtgtctcaccaaaaaaaaaaaaaaaaaaaaaaaaagagaaaattcataatgtgattatgctttcctttaagatgtttaaaaatttctattatgaacagtgagggtatggcttattttttattgagaaacatattcttaagaggcagtaaaaatacagctaagaatgtttcttttttgtatcctagtgtagaaaaattagacttgtgtggtttatctgcctgttacaccacctagctgtttttatttttatgaagaaattagagcttccaccccctcccactccccattaaaaagcaactatatgagtagttttcctagctgatttttttttttttaatagattttgaagtcagatggataaaaatgccatgtggacaagtgcttactttggcattatgaaaattttataatttaacacaaacaaaagtgaaataataattcttgagtttcatgccctttgaggtgcctttttaaaaataatcaaaatgttgttgggagaccccatccaatttaatcgggtgttatttaattatactactataattgttgtatttgcaggtttgactgttctcagggaacgctgaaggttcataacagtagtgatttgtaattgtgaggcttgagtgtggaattgaattacttcattagagagtaaccagttactgagaatccatgtttcattgagactggtgtttctctactttatccttttttttttttttttgagacggagtcttgctcttttgccgaggctggagtgcagtggcgctctctcggctcactgcaagctctgcctcccgggttcatgccgttcttctgcctcagcctcccgagtaggtgggactacaggcgcccgccaccaagcccggctaattttttgtatttttagtagagacggggggcttcaccatgttagccaggatggtctcgatctcctgacctcacgatccacttgccttggcctcccaaagtgttgggattacaggcgtgagccactgcgcccaacctactttattcttcatgtatgctttaggagtaaatttttactaggttattttcaagaactcttacgtatacatgtgagtgcttaatgaggatattccttatgcatctgtctttaattagttggtggcacatttaattcttgttcattactttttttttttgattcaccttttctgtctcctctccttttccccctttttgttgtctcttctttctttgaatgtgtttgtatgtttaatggatacggaagtttctaaagattcatgagcacttctactacatgtctgtgtggccaaagattaactcatcaccaatggaactttccttattttgatgtctataatttacctaaatgtatgtactaactacatatgaggaagagacttgatattgttttactttttataaaagtttttaggtgattaaataaaaatgtattgtaaaaagaaatggttagaagtgattacttttggaaataaatgggcgctgaagggaatggatggcacaggagacttattttatatttactatttataatactgttagaagtacaataacatttgttagtgggctgtagtagaaagcttagtttttagtgccagttgtacctcttactactctcatgagttaatctttctgtgccccagtccatagttctattcatgggtgaaaatatttacagtttaacctcacagattagttgtaaagattaaattagttgatggactgaattttgcaagctgtaaagtgttatgcatctcagttattgtaattagtcatagtataaatcagcactgctggaaatactacagatatttaaaactgctttagattattgaaaaaaagtaaaaattacaaaatatgatttacattgtataatatataaaccattatatgtgtaacatgtagatccggtgtgtaacgaatagacctagtgcttcatttgaaaaggattggtttttgtaaaagaggaactattggttggttttccatccccttttataatgaagggggaccacccccaggccatttttttcatgtatctgaaagtaatgctcttggtaattttgtttacaagtttctttttagtaaccattgtatactttttgttttttgctgaacagctattagttgaaagtggtttataaactatttctcttgaggtaaagaaacaatcttttctgttacaacatactttaggaaacccgaatatgggaggtatctttatttacttgttactcactgtaaatgtaaagatcactttaaagaagagtgagtaatggtctgcataatctcattgctgtatcttaaggaaagcttttgatctttgctttctttgagcatgcctgtatctatattcctggttgactttcactgttgtatccacaaatacattagcaaaagtgtgtgtgtgtgtgtgtgtgtgtgtgtgtgtgtgttttggatggcctcttgattttgcaaacctgtactccacttgcttttgctgttttattatatgtccaagtaaattctccccttccctcataaattttttatttttaaaatattcaagcacttagaaaaattgaaataataatacagttagcatctgtgtaactactggaactactggatggaagttatccatctagattaacgaagtgttaacattttgttttatatgctccatctcagcaggtgtggtggctcacagttgtaatcccaaagtgtaataagcactttgggaagccaaggtgggcagatggctgaatccaggagtttgagaggagcctcggcaacatggtgaaaccccatctcttcaaaaaatacaaaaattagcctgctgtggtggtgcaggcctgtagtcccagctacttgggaggctgaggtgggagcatcacctgagcccaagaggtcgaggatgcagtgagctgtgattgcaccactgcactcctgcctgggtgacagagtgagaccctgtctcaaaaaaaggaaaaaattatacacacacacacacacacgcacacacacacacaaggcacacacgctccatctctagttgtttaagagaactaatgagggggtgtgtgtgtgtgtgtgtgtgtgtgtgtgtgtgtgtgtgtatacacttctccccgagatgaagtcttgccctgttgcccaggctggaatgcagtggcgccatctaggctcactgcaacctccgcctcctgggttcaagcagttcccctgcctcagcttccggagtagctggggttacaggcgcacaccagcatgcccagctaaattttgtatttttagttgagatggggtttcaccgtgttggccaggctggtctcaaacccctgaccttgtgatcctcctgcctcggcctcccaaaatgttgggattacaggcatgagccaccgctcccagctgtgtatacttttctttttactatactgtaaatacttaagtcatctcccaagaataaggtcagtctcctgcttgatcacagtatcattgtgataacaaggaaatcaacagtagttaatctaacagaaataaataataatatcatccactatatataatcaataatcagtactccccccctaccccctgcccccagccctatgactttttgaagagtctaggccagtaatcttacagaatgtctcacctttggatttatctgattatttcttcttggtatcgtttaacttgttcttctctaacccctttatttcccataatctggaaattacttgtgctttgtttatataaagaatacacagttttttagccagaatatttaagaggtgattttatgtactttatgctgttgttacaggaggaccaaaatatcagattgttttactctactagtagtgatgtgatcacttggttaaggtgatgagcaacgttaaggtctctccatatatgagggtgcattttcctctttgcaattagaagtgagctgtagggtaatatttttggcagtgattgaatatcctttttcccaacaacctatcacctaatggtttagcaaccgttaatggtatttgtctaattcagttactgtagtagggactgcacatggtgatttttttttccattgctgctgcacaaattaaaaatggttattttctaattctgccattccttttaacattagctggccttgttttgtaaatacgtgtttccccatatcccatttaatcattctactctcatggatttttatttattttctgtgttacaaatagtaatagccactactcttttttaccctcacattgtccgaaatttggccagtggaagctcctataagctgactcctttattcttttgacatgacctcgtttgtttttttgtgtttccttgctttctagttaaaggtatatgttaggttcactttgaattttgcttcattctcaaaattacagtctgttttcccacaaaatcatgagatagatggtaatctgtgtgttttcacagaatgtagttgttttattattatttttaaaattagaatcataccatggataatgtttcttgacttgctttttcatttaatatgttagagatctttccatgttggtatagatgggcccaatattcttattacaggaatggatgtatcgtgttcttctgttgattaatggatacttaggtttataattatttgctattaaactctccttatatattaatattttgtgtatatttaggtaatttttataggatagttacatgtcaaagtatacacattaaaaatttgatacaaactgtcacattatgtcttagtaaggctgtgtaacaatttatgcacccagatgtatgaaattgccttaacagttttggatagtgtcaattttgacagtctttaaaatatgtaattaattttgcatttttctgataataaggtatggtattttcttgaatgtttattggttgtttattatttttctggtgaattgcttgcttgtattctgtgctggattttccttaaagttgtttccctttttcgaattgatgtttagtagatatgttagggatgttgacctttgcttctcagagtctgttgcttatttttgacatttgttttgcttttggttatatgaatgttttccatttttatctagtcaaatctattattctctttcctttaaaacttctaggtttataaaatttaaaaaggttaagtcagatctgatagaagtttggttttggttattgtgtaaagaagtgttctgattcttcactccccccaacccagtgttgttactggtaccgtttattgtataattcatctcactaatttccatatataaaaattcttacatatatctgtttctctactttcttttcttttaacatattgtatttgtcagtatcttaactgttgtagtgtctttagatacattctatattggctcccaaactcaaatttctattttaggggcagacagtaatataaaaatgaaggggatggagtaaattagtgatgcgtaaatggctctgctgttgagcctcaacatcaatgttgctctacaagaatttaagcttgtcttagaacttttgcttttttaaaagaggaagcctagaacctgaatattatgtaaatctttggatttaaaattacaattcatagttctttataaaacattggatagactgagtaatatatatcctttgacttcagccaccgtttggcttttagttctggatctctgaataggttgacagggcaaatgccacttaatttttctttttgagaaacttcttggcagttcttttgccgttattcttagacaaattttataatcaggttgtcaagttgtatttaaaaaaaaaaacaactcttccttgaattttttttggaactctattaaatctaatacagtcataatttggagacagctttataatattagtttcccatattaaaacatggtttcttttcattcgttcagatctaattttatttcttcagtcaaatgttttatttttttctgttgctggtgtgtatttctttttaaggcattttatttttgttgctggggtgtatagaagtgtttttaaaaagcgcattttctattttattattgcaaatattcaataaaaatgttttaaattatgtaacattgttcttggaaagtaatattcgataatacactggacatttaatatagatagtcttttaagttttaaattataagtgaaattaagactttagttttttgctctaaaaaatgttgatttgaatcttcaaataagaactcttgactaaagcctcattacaagttagagactatagtttcctaaataagttattctaaataggcctattttcagttggcattcaggtgataccttttctagaaagaagcctttactgtatttcagacctgatttagccaccctttagctacttcattactctaggaatctgtttgtgtaacactttatcctacttcctacctgtcttccagactgtaagctctttttgaaagaaactatagcttaatgtgtttgttgttaaatttccagtgccttacaaatacctagcacatggaagctcacaaccaatatttgctgaatggagggagaggcaaattgagaagtgggctgtgtaatatattactttaaaaataaaactgcaggcctggcatggtggctcacgcctgtaatcccagctctctgggaggccgaggcaggtggatcatctgaggtcgggagtacaagaccagcctggccaacatggtgaaaccccatctctactagaaatacaaaaaaattagccgggcatggtggcacgcacctgtagtcccagctactcaggaggctgaggcaggagaatcgcttgaactcgggagatggaggttgcactccgtctggatcatgccactgcactccagcctgggtgacaaagcaagactgtcttaaagaaacaaaacaaaactacaaaccaatttgttttaaagcatgttttttctctgttaaagaaccttccagtgagtaacacaggacataaatttactatgataattaagtcgtttttatcagatggtattattaagttgtttttatcaagtggtattaaaggattcatttgttttacagtattattcaacacgaataggaggataattacaattacattatttacattgataatatcttcagtaatttctgatcacagcagtgtagttgcaataaattttttcattatgggactcaactgctatgaaagtatgtgaagtccaaattttattatcattatgagattctctttcaacatgtcacattatattagatgacagactttgtcatatcagggaaatttaaaataaattgccaagttaagatatactttaaaactcagagctctttatgcattcataaaaagtacaaagctaatggagtttaaatttcagctgtaattctagaaagctggaatcttaaaaaaattagaagaataattgtccaatttagaaaaattaattaaccctgaaaagggtcaaagctgaattagctgttgcttgtggttatttaaatgggcaagataaatattatcatgtgctttcttttatttcttacggtaaaatgttttgtgtctctaccagaatcaaactaaatgctttgcagctgagcgttgtgaggccaaggcgggcggatcacttgaggttgggagttcaagaccagcctggccaacatggtgaaaccccgtctctattaaaaatacaaaaattagctggttgtggtggcgggcacctgtaatcccagctatttgggaggcttgagacaagataatcgcttgaacccaggaggtggaggttgcagtgagccaggatcttgccactgcactccagcttgggtgacagtgagattccatctcaaaaaaaaaaaaaaaaaaaaaaaaaagaaaaatgctttgcaaaactgagtttttatgcaaagcatgtttagttgattttcaattttaatgtacagttttatagttaattctgtatcgttttaaaaaataaactttatttttataacagtcttacatttatagaaaaattatgaagatactacagggaccctgaataccccgtacccagtttctttactgttaatatcttacatcagtatggtacattcgttaacaattaatcaatattgatacaaagttatcattaaagttcctactttatacagatttccttagtttttacctaattctatatcatttttactccaaattttgcattatacagttgagtatagtgtattactttagctggaaagaaacttggacaatagtcttataatgtgaaatactgttgaatattcatgactattgctacttaaatgtaagtcataagcatatttttattagtcaacaaaatttttgttttatttgtctgacttctttcactttcagcttacgaggaaatatttcagtaaaagcagttaaaaaagaagtagaaaagaaactccgatgtcttcttgctgatttaccgctgccccctgagctaccaggaggagatgatctttcaaagagtccagaggaaaagaaaacagcaacacagttacatagtaaaaggaggcctaagtatgtgcttgctttctacctgctcttaaattgaccagcagtgattctgggtcatcagaagttcataaaacactaaattaaggtttaaaataaaaaatgtacttattctttcaacttaaatatatgaattctattagagttttgaaaaaaatcataattgcttgcattcctattcacaatgactaataaaaccaaatttaattttctctcgtaatttgtaatgtattaatttcctggggtattgtatatgttaaagatactttctgttattaagagattgaaataacacaaacactgaaattgggcagagtagaagtcagcatttagtgagaccaaataaaattagtaatgggcaagctgctgtttcctttgcttttagctccattttctcccataaacaaatatattcttcactttgcaagagatggagtagaagaagttttgaaatttgtatcctaaattagcttcaagtaagtgcctaaagagacctctttcccttaaaacctgttaatcagttaaaggcggggaacactggtgcctttttttttttttttttaacttcttaaccaagggacagtgaagactttaagttagatctgattttagaattgcagttgaggtagtgcctagtgtgtgaatttgaggtcattttctaaactggccgggcacagtggctcatgcctgtaatcccagcactttgggaggcccaggtgggagaatcacttgagtccaggagtttgataccagcctgagcaacacagggagaccccatctctaccaaaaaaaaaaaaaaaaaaaaaaaaaaaaagccgggtgtggtggtgcatgcctgtggttccagctactcaggaggctaaggcaggaggatcaccagagccaaagaggtcaaggctgtaatgagctgtgatcgtgtgccactgtactccagcctgggcgacaaggcaagaccctgtttcaaaaaaataagataaaataaaatagctaaaaaatactctcttcttgagcactgtagttttattcttttacttgaatttctgtgatttactataatattaaaatactacaaaattatgtatctttttgaagaatgtaagatttttgtcctacctgtccatttgtatctgcttaaacgtggcttcctgagagttggttatattaatatcttttgtactctcttagactgaaaaatcttttttttttgatgtttttcagatgatttcatccagtcataagtctaaatttgtcaataagttttatagttagatttttgttcacattctttatcaaactcttgtttcgtaaaagtagattatatatattattgttaatggatgcaaaataaaactttctggagattggttagagaattttgactctactagtgttggtttcatcttctcactgaaaaattatattttatttctgaaaagccttcatacaagctctactactttttttctcagtttaaatacttgtctacagaagaagagtcagtatgtagaaatgatacctcagtttttacgataacttacaataccaaatcagtgttacttgtttgggatagatgatgataaatactgcaagggtagggaaaaataaagaatatacaattgggtggcgagtagatattgagttattagacagtttattcaatttgcttgattgtatataaaaactttagaactatatttgatagaatatgtgggcctcgctatggtgaaaccaaagaaaaagatattgactggggaaaacgctgcgtggataaatttgatatcatcggaattattggagaaggtacttacggacaagtttacaaagccagggataaagacactggtaagaatgccaagttctggggatctttgggcctacggaatgtacttagtttgtgtttctcttctgatgtttggcttcagaaattttccaaaaaattaaattcaattttattgtgcttttgtttcatcttgtttttttattctatatatgcattttgtaagatatgagtacatgtaagtgggtctgtatatgtgtatattttaaaaagtgttcctttagtatttgtgatatactgtatggtaggatttagtttttctttcctcttttatggtgaataattcttatactgttattaatcagagggaaaggtatcttgacctgaattaattttagtagtaaattttttttgtcataagccttacacaacactttcatttagccttcagttttttttcctgcagtaactatccttggaggccagttttagcagcttaatctttcagaacataatcaggaattcagagaaagttttaaaaggcttcacaggagagcaaaaagtagctgtgtcagaagctatgtattttacttaataatgcatagagctagtattttatctttctttactcataactgcttattgaaataaaccaataggccgggcgtgattgctcatgcctataatcctagcactttgggaggctgagacaggcagatcacctaaggccaggagttcgagaccagcctggccaacatgaagaaaccctgtctctaccaaagacacaaaagttagccgggcatagtggcacatgcctgtaaacccagctactcgggaggcttgaggcttgaacccagggagtggaggttgtagtgagctgagatcacaccactgcactccagcctgagcgacagagcgagactccatctcagaaaataataaaataaaaacacaaaaattagccaggtgtggtggtgggcacctataatcccagctacttgggaggctgaggcaggagaattgcttgaaccttggaggtggaggttgcagtgagccgagattggaccactgcactccagtcagggccacagaacgagactccgtctcaaagaaagaaacaaatagattaaaatagcacagctattagaggccatatagtatatgggagatgaccttacggttagaaactactgagggcaattactgcatagagtaataattggtgtttataatgatgtgttatcaaaaagattaaatgacaacttttaaaactgttaagtaaaacggactcatacacaatatagaaggcattccataaaaattaatagaataagtttaatgattaaaagaatatgcttccttcttttagaaaatttgtaagaacattttttttctccaaggaagtggaatgaacaaacctttattatagtgaattttttcttgtaataggcttcgtgtatgtgtgtatatttcattttctatttggatcatttctgatacaaagctgactcatacttaaattatgtggcaatttagtgtagtggggaagaacatatatttttgagacaagtaactggattttgaattccagttttactgctaggtaactggccaggtttggtcaagtaatatgtctgagcgtatttttttcactgatagagtttttcttctctgttcagagaaatttttatgcatacataagcatattggctatatttgtctttccctcgtttacttaaaaaaaataaaaatgacagtgtgatatacccagtcttcagcatcttttttttttttttttgagacggagtcttgcactgttgccagggctggagtgcagagtgcagtggcgtgtcgtgatcttggctcactgcaacctccacctcccgggttcaagtgattctcctgcctcaaacacccaggtagctgaggttacaggcgcccagctaattttttgtatttttagtagagttggggtttcactatgttggccaggctgatctcgaactcctgacctcgtgatctgccctcctcagcctcccaaagtgctgggattacaggtgtgaactaccacgcctggcctagcatctttctgttttctttttattttttcccaagtgaatgtaaaagcatcttagttttttcactaaatatataaatggggagcatagtatatttggacttacctcattctttctaatggttgtatagtattccctggtttatgtaaatattccataatttgtttaatgacagacttaattttttgaactataaatattatttggtatattggaaactgaaacatactttgtggttctatttttgagaaataagaacagaattgaattaaaatacatttaaagttaagaaaaatgtcatctgcttttgttaactggtaacctgattttattaaattccttaataggagaaatggtagccttaaaaaaagtacgtctggataatgaaaaggaaggctttccaattacagcaattcgagaaattaaaattctccggcagcttacccatcagagtattatcaatatgaaggaaatagtgactgataaagaagatgctttggatttcaagaaggacaaaggtatgtgtgcatatttaaataacgaattttttgtattcatgattgatgttgctaacttggaaattttttttatagatgtgactatttgagtaattacaaactattgctctaatcgtgaaactatatttttaagtttggtagagttgaataatgaattgatttactttagtggtttttgagtaaacttcgtaaagggtatttgccaatattacacataaagtattcactagtaatatatgttttattgggcatcagtgtatagtttttagtattcattttttagtagttgaaaaaccagttcatagtagtagtatttttaccctacatttttatgttacaaatgccttaacatataaggaaactttacagtaggcatatgtattatttctgaaagtgtggaggcaaaaatcatacttgaaattgcctttaataatctatagtggggtatgtatatatgtatagttattatttagcagagaagctgacaaaaaattagcctgcttattaaagtagttattatagggcatatgatgggtgaaagcagtgctctactgttggtatgttttacatcttcgtaagattttagatttaaatcttcataaaatcttaaatcttatattttagatgtaaatataggatctttatataaatcttacatttaaatctttatgagattttagaaccaaagtttactgactgtattctgaggtttgcaaacagcaaaactttttctcaaactaaatctaacataaagcagacacagtgtctcacatctataagccaaacactttgggagtccagggtgtgaggatcacttgagcccaggagctcaagaccagcctaggtaacataacgagagcccatctctacaaaaaaaaaaaaaaaacaaccagaaaattggccctgcttggtggtacatgcctttggttccatttactcaggaggctgaggcaggaggatctcttgagtgcaggagatagaggcttcagtgagctgtgattgcaccctgcactccaacctcggtgacagagcaagaccttatctctaaaaacgaaaagaaaaagattaaagtaggtatgttctgattgaacatggtacttaggctcctgtcttccccagctacacacacacacacacacacacacacacacacacacacacacacacacacacactctctctctctctctctcttactctgttgagggacacaattcaaaatgattgataaactacatggtagttattttgcataaaggaactgtttgaaagtacaatatggagttcagaatcatcattttaattgatgtcacttctgttactttttgtccctagtaaagctttcatttctcagcctgacttttaccctggtttgtctttttaactttatttttcattactacttattgtgtggttgatggggtactggtgtgacttaaattagaatgtctgggtcttgagacttagtgtattagtggtgtggccttattagcaagacttttagcccttttgagtctgttatcccttcatccataaaagggaaacattgtctttcatagttagaattaagacttttaaacatgaaagtttgtgcaaatgctgtttgttttgcattaacctcaggctctagccaaatcagtgtatttgattttcctccagcataccagggacgtcctgcttttttgatctgtgagatcacctccctgcctacttctccaatcccatctatgccattttgattgcccaccaagcttgacagacacacacatacccacacactcattcacacatgcacgcatgcacaatttgaaaggctaatttctcacgcctgaggtctcagcctgaatgttgctttattcattagtgaggccttacctgatcagtcttcccactttctactacgtatagacacagacaatttaatgtttcctaataagtgggaataattataatggtttgttacttgtttctgtacagatagctgggaaccatacctgttttcttcactgttgtgcctcctacctagctcagtggctggaccatagaatgtgctgaatgactaattgttgaatgaatatatgagctctattttttttaataatcctatttatactttaatacttaaacagtactacttgtgaatatattaatagtcttcctggtattataattatggtcataatttattttctttatcaggttataaattcccagagcctttgtattttgctttgtttttagttttgtttctcctcagtgcctagcgctgcatttcagaaatcatagatttttgtgttatttgcacccttcatcatctttcttcctaccataatcctgtttgtaattctatgcatcatgataaataagaatgtgttctactatgtgagaagttacatgtaggtacctagaattacttaaatgcattagagaatgtgagaggttataaaatttaaaacataattatttcttaaatgaatctaataattttgatgggaactatgatgaagcaacatgattttccgaaaagggaactagatttgaagtctaatcctgagcatgctagctgtatgacattacactaattgtgattgccatgctgtgtggtattaaactaaatttgattgtctagttagagcataaagacagttcagtaacactggttaaatgttatgggctaatctaaaatgagtgtattagaacatataaacattaaaaagcaaaagttaaacaatgtaaatatgcaaattagaaacaatacaaaaatcaagtaaaaatattaacttttaaaaatataaacatttgcactgttataactaactaagctattagttgtgtaagagaaacatcataaatgcctggcatagtggcttaaacctgtaatcccagcacttagggaaggccgaggtaggtggatcacccgactgaggtcaagagttgtttgagaccagcctggccaacatggtgaaacccatctcaactaaaaatacaaaaattagccaggcatggtggtgcatgcctatagtcccagctactcaggaggctgaagcaggagaattgtttgaacctgggaggtggaggttgcagtgagccgagattgcaccattgcactccagcctaagtgacagagcgagactcttgtctcaaaaaaaaaaaaaaggaaaacatcataaatatatttttttaaaacttagctttacttaaaaatgagaaaaagttaatcacgaaggttattaatttcaattaattatttaaagtgaatttttttttttttttgagacccaagtcttgctctgttgcccaggctggagtgcagtggcatggtctcagctcattgcaatctctgcctctcagattcaagctattctcgtgcctcagccttccaagtagccagcattacaggtgtgtgtcactacacccatctaatttttaatttttatgtttttagtagagacagggtttcgctatgttggccaggctggtctggaactcctgacctcaagtgatctgcctgccttggccgcccaaagtgcttagattacaggcgtgagcccctgtgccctgccaaaagtgaaattttattgcgtcttaaaaaaggaattattcttaagaaacagagggttaagtggtatcaccaagtcatgggtatatttttgtgcagaaacttgcagatgctgaagaagatttttcttgttttttgttttgttttttctttgagacagggtctcattctgtcacccaagctagcgtgcggtggcatgcaatcagggcttactgcagccttgacctcaggcagtcctcctgcctcagcctcccaagtagctgggaccacacacgcatgacagcgtgcctggctaattttttaaaaagtgatttgtagagatgaggcttgtcatgttccccaaggccggcgtcaaactcctggctcaattgatcctcctgccttggcctcccaaagtgctgggactggcgtgagtcatcacacttggcctgaagaaactttttctaaactaattgggtgaatggacaggggataaactgattctgaaatttcctcctaacgctttcatctgcatatagtttcatctcttttaatcactttgaggggaactttgaacctttttgtctgatttttaatcttttattgttagcaaggtggggttttgggatcagagagagcctttcgtgttcctctaggtactcagtttcttcatgtatggaaggagagtgggatgcagttacttacattagtttcagtatttatgttcatatttgactgttcaaaaagtctttgaactgttgggtgtttatactgcaacagattatggatggagatgcatttgctgaaaataaaagaattattttgcaacataagcttttctttgttactttcttcctttcactgaggattacaaagttgtagaaaaatactttctgaatgagtaaaataatatttaattaaatattaaacattttagtgctgtttataattctctgggtaggctgagtgtggtggctaacacctgtaatcccagcactttggttggctgaggcgggcggatcaccagaggtcaggagttccagaccagcctggccaagaggccagctgggtgtggggacacacgcctgtaatcccagctactatggaggctgaggcaggagaatcgcttgaacccgggaggcagaggttgcagtgagccgagattgcgccactgcactccagcctgggcgacagagtgagactgtgtctcaaattatcttgctagagaagatttttatgctgtatgaagtaaaaactcgagtcattgatctttatttcaagatgtaaatatttcagtattcagattaaaaaaattcctaaactgaaatgtaccagtctctgctggtaagacctacacattaacattctttttcctcttctgccctaccctcaaaaaggtactaactctgcatagtaacagtactacacagaggggtagaatcctaaaactatgaatctgtgaccttataccttaactgtaaatttcacataaaatcttcctacttaacagtgttttggtacttaaacttaacatggtatcctggacacccaaacatcagtattataattactatcccgtaattaatttagctataatacttggaatattagtgtttttataatgagggaatttgagcactctagtgtggaattttcctaaaaatcaagaagacagtattctatagcaaatgcttgtggcaacatgtcactgtttggtccggggaagaagtcctcacatgtcactccctgtgtactctctgattcccaaacagtgttaggtgctcctgtatacttgaattgcatgtcatacgtaattctgtaatagtactttcatataacttgtatttttgctttggtttgtttttgttttgagacggagtctcgctctgtcacccaggctggagtgcagtggtatgatcttggctcactgcgacctctgcctcccgggttcaagtgattctcctgtctcagcccctgaatagctgggattacagatgtccgccaccacacccagctaatttttttctatttttagtagagacggggtttcaccatgttggccagcctggttttgaactcttgacctcaagtgatccacccacctcggcctcccaaagtgcaaggattacaggcatgaaccaccgcgcccagccataacttgtattttcatataacttgtcatgttttcatatcttattcttactgtatttctgagagcagggactcaattttattctttgtgttcattgtgtgcagcacacagttgattatcattaaattttgagtaagtgaatgaatgaaatggagaggtaggaatgttctgtggaataggtggaatgttaaaggtgggtgcagtttggataggtatagtggagggcattctaattattagtgtcatgacttgtttttacaagacaatgaaagatcggcatatctcctaaagaatacctagcttccaaattatttaccttgtgtttttctaggtctgaatttatattcccgcagtttagaactgctgatatctcctgaggtttgagaagaaagcaacattgatttgttcattctttctttccacaaatgtttattgtgctagtttctagatagatctgggctggccagtgcagtagccactagccacatgtagctatttaagttaattagtattacataaaatcaaaagtttagttctttaactgcactattcatgttccaagtgctctgtagctacgtgtagctactggctacattttggacaatgaagttacagaacattttcatcatcttagcattgaataatgtccatctaaatactggggatattaaacaaacaaacatctggtccctgactcaacctagtttctggaaccagaagaatcagcaaacactgccagaactgaatcagactaatacatgaatgacaaacctgtttctgcctagagatttttctttattgttagttaatctgtaattgttggaatttcagttgaaggtgttgagtttcaaaagaagtgaaaaaacttaaacagtaactcactgtggaacctacccaataagtcagggagctttgctaaggagtctgttcttagcaactgtaaactatgtatctttttttcccctcctaaaaagagaaatgaacttgcagggtttttttaattgaaaataacatgttcctgtaacagtgcggcttccagcagcatgttaaggcagggttgaaagtcactcataagttactttatcatgttattcattatgttatgtaaaagataaaacttacaaaatagtctgcgttctacattttatttttatctggaattttatgtcaaatttacaattaaggtataaggtcaggcattcatagttttaggattctgcccctttgttggcatagtactgttactgtgtagagttagtacctttttgggggtggggcagaagaggagaaagaagaatgttaatgtgtaggttttctttacttgatgataaaataaatatttgtcatatatttgaaaaacaaagtgtaaaagagaaaataagatgacccagataatgtcactatcatcatttgtctatattttcctctagtgtctcttttctcacatctgtatgattattgattaccaaatggaaggttctgcttcttttattgtcttatttaataaaatgcttttgtaatggcataatgtcacttgggtgaaatgtagcctgaactatattttattcctccattttgcatatttaagttcctttaggcatttcattatagttccttctattgaagttttatgcttggatattctagcaggtacctgccactattcatatgcctttagttaaagcagaggcttcatgtgctaagaaaagtcctaatcaattctgaattactggtttggttaggaatgaagaattgaggacaaaagtcttacataatgagcagctgttgcatcaatcctagcagtcagtgggtcatagatactagaaccagatttccttccattctgaatgtccttaggggtaaacatttctttttttaacatttgattatttccttaaatagatcaataggaattgaattgatagaccgaagtttttaaattctgaaacttcttgacatatattaccaagttgttttccagaaaaaaggtgccaatttatactcccaaatccagggtacactcagcaacctagaagtagaagggaactgcctcaacctgataaaggacatcttatgaaaaacagggatatctgcttctaccacctgtattcagcattgtactagaggttcttgccagggcaattagtcaagaaactgaaataaaaagtgtccaaatgggaaaggaagaagtaaaactgtctttagtttgtgtgtgtgtatatttatgcatgagaaaatcctgtggaatccaccaaaacagtggacgccaacctttttgacaccagggactggtttcatgccatttttccacagactgtgggggaggtggggatggttttggggtgattcaagcacgttagatttatcgtgtactttatttttattattatcgtaatataataaaataattaacaactcaccataatgttgaatcactgggagccctgagcttgttttcctgcaactagatggtcccatctcagggcaatgggagacagtgacagatcatcaggcatcagattcttgtaagtagtgtgcaacctagatccctcacatgcacagttcatactagagtttgtgctcctatgagaatctgatgctgctgctgatctgacagaaggcggagctcaggcagtaatgcgagcagtggggagtgactgtaaatacagatggaggaccaggcgtggtggctcacacctgtaatcccagcaccttgggaggccaaggcaggcagatcacttgaggtcaggaattccagaccagcctgaacaacatggggaaaccccgtctctactaaaaatacaaaaattagctgggcatggtggcatgcacctgtaatcccagctacttgggatgcataggcagatttcacttgaaactgggagacagaggttgtagtgagctgaaatcatgcgtctgtactccagcctgggtgacagagggagactccatctcaaaacaaaacaaaaaacagttggaacttcgctcacctgccgctcatctgctgtgcggcctggttcctaacaggccacaggccagtactaggattggggacccctgcactaaaaaactgttagaactaataagtaagttcagcaaagtggcagcataaaagatgcagaaattgattgttctgtatacaagtaatgaacaaagtagaattaagaaaacaatttaaaaaggccttaaagagaataaaatatctagaaataaattgataaaagaagtgcaagacatgtatcttgaatactagaaaacataattgaaagaaattgaagacaatgaaaaggcattccatgttcatcgattagaaaattcagtattattaagatggcagtacttctcaaagtgatctacatattcaacacaattcctatcaaatctcagctgacttcagaatctgacaagctgattctgagattcatatgcaaattcaaaggagctagaataaccaaaagaatcttagaagaacaaagttggaaccctcacaattttcaattttaaatcttcctacaggctgggcacgtttgctcatgcccataatcccaaccccttggaggccgaggcaggaggatcagttgagtccaggagcttgagaccatcctgggccacatagtgagaccctgtctctatttttataaatttacataaatcaaaatcttcctacaaagctagagtgctcaagattgtgtggtactggcattatgataaacgtatagatcaataatagaattgagagtctagaaattaattccacacattttataagctcaactgattttcgacaaggtggcaggatgattcagagggaaagaatagcttttcagcaactggtgctgggataactggatatccacacacagaagaattaagttggaccccttcatacctcatacaataattaacttaaaatggatcagtgacttaaatgtaagcactaaaaccataaacctattagaagaaaaggtaggagtaagactttatgatcttggattgggcagatgcttattagatatgacaccaaaagcaggggcaacaaaagaaaaaaaatagataaattgaacttcatcaaaattacttttgtcctttaggtggatactatcatcagcatgagaagacaacacttagaacggggaagatatttgtatattgtatatcttataaggaacttgtatcttaaatgtataaataactcttagaactaaataatgaaaaaagacaacgtgattaaaaagtgggcaagggatctgaacatatatttctccaaagaagatatgcagatggccaataagcacatgaaaagatgttcaacaacttagttattagggaagtgcaaatcaaaaccacagtgagttaccactttatatccattaagatggctattataaaaaacaaaacaccaccaccaacaacaaaaaaaaccctaggaaataagtgttgtccaggatgtggagaagttggaacccttactctttgctacagagagagtacaatggtgcagttgctttggaaaacagtatggcctttcccccaaaaatcaaaaatagaattctagaaattctactactggatctccaaaagaattgtcattaggtgtggtggctcatagctataatcccagcactttgggaggaggccaaggtgggaggataacctgaggccaggagttcaagaccagcctgggcaacatagcaagaccacatctcctcagaaaattaaaaaatttaaccaggtgaggtggcacatgcctgtagtcccagctactcaggaggctgaggtgggaggattgcttgagcccaggagtttgaagctgcagtgagctatgatcactccattgcacttcagcctgggtgacagagtgagatgttgtcaaataaaacatttaaaagataataaaaaatctgaaggccgggtgcagtggctcacgcctgtaaccccagcactttgggaggctgaggtgggcggatcacctgaggtcagttcaagactagcctggccaaaatggtgcaaccccgtctctactaaaaatacaaaaatcagctgggcgcagtggtgggcgcctgtaatcccagctacttgggaggctgaggcaggataattacttgaacccgggaggcggaggttgcagtgaaccaagattgcaccactgcactccagcctgggcgaccaagtgagactctgtgtcaaaaaaaaaaaaaaaaagggaaacagcatttccaagagatttgttaagctcatgttcatagcagcattattcacagtagccgcaaggtggaagcaacccaagtgtccttggatggaagaattgataagcaaaatgtggtgtgtacctacaattaagtactgttaagccttgaaaatgaaggaaatttttacacatgcttacaacatagatatatcttcaggacatgccaagtgaaataagccagtcacaaagataatatatgtgtgattctacttatgtgaggtacctacagtagtcaaattcatagggacagaaagtagaatgatggttactaggggcttaagagagagaggaatggggagttactgtttaatgagtttcagttttgcaagattaaaagagttgtggagaggggtggtagtcatggttgcacaacagtatgaatatgctaatgccactgaactgtacattttaaaatggttaagattatgttgtgtgtatttcgccacaatttaaaaaaattaaacgagatgaagtaatacatgctactatttgggtaaaccaagaaaacgtgctaagtgaaagaaagctagtcacaacagactatgtattatatgattccatttatatgaaatatctagaataggtgccaaatattatcagaatatagattggtgattgccagagacatggggaggggattggaaatggagaatgactgctaatgcgtgtgaggtttctttctagggtcatgaaaatgttctaaaattcattgtagtgatgatggttgcagaactccaagtacactcaaaccaattgaacactttaagtggttgaatgtatgatatgtgaattatatctcaataaagctgttatttaaggaaaaaaacgataactagctcctatgaattctgtgtttaatgaaaatagagtccaaattgagagggatagacgggtgaggggtgtctctgttataaaagatgagactgtaaaggtgctagacgtttgaatactatgccaaggaaccaaaatatcaaaaaacttctacttttttcaaaaaataatacagtgcttattgtacatttcaaccagcatttatagtaattttatctttgggcatttgataggcaaaaaatgctgtcttgtctttttttttttttttttttttttttttgagacaagcatttcactctattgcccaggctggagtgcagtggtgcggtcttggctcactgcagtctccgactcccgggttcaagcgatttttctgcctcagcctcctgagtagctgagactacaggcaagtgctgccacgcccagctaatttttgtatttttaatggaaacggggtttcaccatgttggtcaggctggtctcgaactcctgacctcgtgatctgcccgcctcagcctcccaaagtgctgggattacaggtgtgagccactgcccccagcctgtcttgtctttttaatacacattttttaatttctgtggagcttgaatagtttcttatacttagaggccatgtgtatttctctctctttttttttttttttttttgagatggccttgccctgtcacccaggctggagtacagtggcacaatcatctcagctcactgcagccttgacctcatgtgctcaagtgatccacctacctcagcctcccgaggagctgggatgacaggcacattccagcacacctggctcatttttgtaattttttgtagagatgtggtttcaacatgttgccgaggccagtctcgaactcctgggctcaagtgatccacctgccttggcctcccaaaatgctgggattacaggcgtgtgccactgtgtccagcccatttatatttctttaaccatacattttcatgtttaggtcctttgctcttttttaactagggtattagtgtttttcttaattgattataattgtatgttttacatagtaataatgttcatcttttgagtaacattgaaagctgttcaggcatctggttttctggctctcagtgtttttcttatgttagtgatcaataaatttttttgaggggtgagttgaattgagaagaaaaatatgtataaaatagattgtagtctgtttcagaataatcaaataattagtagaagatgatagaggaatgtgttttagttaagatacaccaaataatgtcttaaaggaaaaaagctcaaatcttaatttggaatgactttcttctctgggtttcaaggaaatgtagagttagtaccacgttttgaaatttaaagaacatagaacagaatgtgttagatgcacatcaggagatgacacatggcaaagggactgttaggagtttaatggaaagggaaactgtgggcaagtagggaagggagttggataggaatggaaagtagggtggggagtacatttcccatgtcactatttcctgaacagtgcagtagagcactagaaatatgtgctcttggaacaggtggtataaggtaatagtgatggtaatatgtataatgggttaagagcatgaattagaatcctatactctgttttcttcatctgcaaaatggggtaataatgactaactcacaggtttgttgtaattatttagtgatatagtgcatgtgaaggacttcacatagaatatggcacatagtaagcacacatcagtaaagtttagcttggtagtagattgattttgagggcagaattagattattaatacaataattattaggcaggtaggatggaattttggaagaaataaaaattttagttttagtcctctagtgaaattttattatgtggagatcagacctcaggaatggagttgatccagaagtttaaaaaaaaattttttttctgaaagcttagaagcagtctctaattgtgaagagtttcagtcacatctgactagctgtgagtaattggttaacccaccagaaagaaaaaaacgagtcattggttgcgatcaaacccaaactggcagtgaaaggaagactgacaagtgaaactcaagagcagataataagggaaatgcaaagagcagatgccttggtacaggttagaaatggagggtagaagaggaagttaaggagcagatactgttgagattgagataactatagccaacaagaacagatagaattctgcagttaaattctgcactgggagaaatgccagcagtgaagggtggaagtggcagagtgccatttagagcacattaagctaaaagatacttgttacgttgctgtgcagtttttggtacctcttggaggaagctaatgattaactgctgtttcttcattgtgaaaagtagaggacaatgaggctgggggattgttttacttttgccacacagtagttatgtcaacgtgggcaaattatttattgtctctgagcttgagtgttacaagaagatcattatactttttgggttgttgtgagacctaagtgagacaatatgtgaagtattttcaccattcttcatgattaccattagagtctacctatatgtactagatgtcactgttactatgccatgtgataggagagactttatatagtagttgatccatcatacagttaccatataaaacttccaggtttcttacttgttttggtttgtgtttagaattttgttgaaagtcagatgttaaagtttgggagtaccaggtgttatgtatttatagaaatacatcatctgatgttgagaaatatgaactgtggcataacttttaaacaaggaggcatagttcttctttatacctcattaaagatttactataaaagtacataaggtggggcaaaaagaagaaaataatttctggtaaatgtaagaaaaaagaaaaaatatccagcctcactataataaaagaaatgtaatttaaacgatacaaactttttatctctcaaaagtggtagtgttttaaaaaatttttctcgtttgtttttttagaattataaaattatatttggtttagttaaaacaatggaaatatggaaataaaaagcataaatggatagaatgggaatatgcatatgtagcagataagaataccatggccagtgatgaagagacaccagagtcacgttttttcagtttccacaaattttttgtgcaaaacaagcatgtgcattattctattcatgaattttttcaaaattgaggcattaatatgcaatattctgcaaaatagatatttttatatgccatgatatagccacttaaaaaacagagatagtattctgtaattctataatttggatatattttgtattttattaggcttgcccatatagatgaatatttcggttattggtttttagcgtcttccaacagtgctttaccaaacatcgttaagtgtaaatctatgtgtatttgtttgggactttcataggatacattcataaaactggaattgctagttagatgatacaattcttttgtatattaatagttatagctaaattaacttataaggaagtttattcaatttttttacattctaataaaattttgtgggaataggtactttactgaagcacagtatattattgattttatggttttgcccatctgataagagaaagtaatacctttttccctatttgtgaagtcaaacctttttttccataatttttgccatttcttctgtgaatttgcctgttcctttgacattttctactgatttagagagatactaaaatacagatattaatgttttatgtgtttcatatgtcagataattttcccatttatattgcttgccctttgtttttctttgttattttaaatctttaaatatggtcacatctgtctgtttggtggcttttttttaattttggaagggtggtttctctcatgcttaggaaggctgaatccttggcagaataataggaatttttttatattaaaaaaaattctattatagtttgaaaaagtattcaggtatcttaatcttttatttttatcttacagtgttctgccatctttagcctgtatgaaattcccacgttctttttttttttaaaattcccacatgttctgaggattcctgtttcactgatgtttttgtatgtcctgccaccatattatatcgctttaattatcaccaccctatagcatattttaatttctggtggataaagatcgccttctctttcccctttaaaaaaaaagattttatttttgtgcattttagatggatatgaggtctgaaaacatactgatggaaatttggctggaattacattgatgttagtgtgggaggaagaatgctttttaaaaaattggtcagggtgtgggatcattgacaagcatattaatgtaatgctggagagtaaaaattgttagagagtaattagggatgtagtatagaacctggtgtgtgctaaatactagataaacattttatgttactattataataatcattatttcttaaaatataatgtgttctttaactctgcaattgtatttttggaaacataagggaagtagtcatacccaagagaaaacaagtcattatatcagaaagacacgtgcatgtgtgtgtttattgcagcacaattcacaattgcaaagatatggaaccaacctaagtgcccatcagctgaggagtggataaagaaaatgtggtttgtatacaccatggaatactactcagccataaaaaagaatgagagtgtcttttgctgcaacttggatggaactggaggccattattctaagtgaagtaactcaggaatggaaaaccaaatactgttatgttctcacttataagtgggagctaagctgtgggtatgcaaatacattcaaagtggtataaaggatgctggagactcagaaagggggagagtgggaggcagggtacagtgtacactactcgggtgacaggggcactaaaatttcatacttcaccgctatacaattcatccatgtaaccaaaaaccacttgtacccctaaagctattaaaattgaaaaaaaattttaaagtaatcaggactagatatagctacaagaatgttcttcattgtattgtttataataacaaaacgttagcatcaacataaatatctcaacaatagagaattgttgaacagaactatggtatattattactagagaatgctatgtggttatatacattgtgtaaaagttaaattataaggaaggttattcatactgtttacaaaggactaggtaaagtttcatccaaagttttgttaaaatttattccaggaacacaagaaaacttttgagggtggtggatatatttactgtcttaatagtagccacagtcttaatgggtacatacctatgtgaaaactatttaagtcattccctctaaatatgtgcagcttattattgtcacttaacacatcgaagctgtaaaagaaaattttctgttaaaatgtaacaaacttaagctaaaattcagtttattcctttaagaaagaaccaacaggatgtatatttacatatgtgtagagagatttatattaaggaattaggtcacacaattgtaggggctggcaagtctgaaatttgtaggggtggccagcagtcttgagtctgaaggtaatctggaatcagaattttttcctttttggtggacctcattcttttctttcaaggcctcaactgcttggatgaagcccacccacattgtgagggttcatcttttctccccaaagtcttctgatttaaacgttaatcgtatgtaagaaataccttcatagcaacatgtaggctggttttgaccaagcaactgggcactatagcctagccaagttggcacatgaaattaaccttcaaactgtaacaagttgattttggcagaatgacaaaatacctaactgagagacttttaaaccgtatgggaatctgttagcttacatgagaagagacccagagataagggcagggtttagggttggttgatttagtggcataaagatgttatcagaaactcagtgtatgccataatgcatgatgcttcattctcacgctcaagaatttggataacaggaactgaatgatttttgcactttcatgaagtttttttgttatttgtctctggctttaaatgtgttttctgaaagtgaattggaattttacaatatgttctagatttaatataaataataaactttcaactttattttattttttttgagaccgggtcttgctctgtcacctaggctggagtgcagtgtcacaatcttggctcactgcaaccttcagctcctgggctcaagggattctcctgcttcagcttcccaagtagctgggactacaggtgcatgccaccatgcccagctactttttgtattttcagtagagatggggtttctctgtgttgcccaaactggtctccaactcctaggctcaaacaatcctcccacctcctcccggcaaagctctgggattacaggtgtgagccgctgcacccggcccaaattgttttatcgcctcatgttactaatgcagcagccactttaccaaccaggattcctttattgctactttcatactcctttactcttcagttttgaagctcttcctttccctcctgctgttcccccaatgtatttcgttgcctaagaaaggctaaactggcatgctactcctaaaatgttaacagtgattgcatttgtcttagaatgttattgaggttacacatacttcttgcaacatttccaactcttataacagacactacattaaatgatggcagttcaatggaatattcataattaagctaaataaaagttgcttaaacataaatatgcttttaatggtaatattatagctataggtgaaatgctttgtaggtaaaatttttaaaaagcaaggtagcttttaaggaatagattgctttaaatatattaaaaagtaggggtgggcacggtggctcacgcccataatcccagcactttgggaggccaaggtgggtggatcacaaggtcaagagatggagaccatcctggccaacatggtgaaacaccatctctaccaaaaatacaaaaattagcagggcgtggtagtgggtgcctgtagtcccagctacttgggaggctgaggcaggagaatcacttgaacgcaggaggcagaggttgcagtgagcgagattccatctcaaagcaaacaaacgtatacagacacacacacacacacacacacacacacacacacacacacacacacacataaagttttaagtctgaaattcccaaagatcagttcatacgctttcttagaaatagtaattttgactgggcgcggtggctcacgcctgtaatcccagcactttgggaggctgaggcgggtggatcacttgaggtcaggagtttgagaccagcctgaccaacatggtgaaaccccatctctactaaaaatacaaaaattagccggcttcgtgttgcatgcctgtagttccagctacttgggaggctgaggcaggagaatcgcttgaatccaagaggtgtaggttgcggtgagctgagatcctgccaccgcactccagcctgggtgatagagactgtctcaaaaaaaaggaaataataatttgtctgttttaacttgataattttcttacacataaaactccaaaaaatttttgaaaatatcactaaaaaagtagaaccaacatacttttttttgaaaactagttagaaacttaacaaatctaaaaaagtagtgttttatttaattaaaatatatatgtataatgcttactgtgggctagacactgctttaagctaattagaaatattcagttaatcatcataacaaatctatgaaggatagagaaggaaatgaggtacaggggtataggaaaagttagaatttttgtcatgcactaaatatgtgaaaaatagcaactaaaatttttcttttcaagcagatagttatttctgttggtttgattttaacaggatgtagagaatctcattatttatcaaggtatatttatgggaaaatgtgtttggaactcagattttgaggcaagatgcacacctgttcccactcccagttgtagtgtcattaaatggatttttactctttatattcctaccacctttcacgttgagggcgagtatttacttaggcagctcactatcactagtggccttaaggcctgaaatttggaatggaaaagagccaggaggtcttaagttttcagcattcgaaggtttgaggaccagagttttcttagggcctctttttggtgtaaacacctctgggtttgagatatatatttggtttcatgtcagcacagtgaccagatctttctcttttgccatttcagggattgatctagtttttcttttcattgctactgcccccatcagccacaaacttcttgtaatgtgcatgtatcaatttttaggtttcctaccactgatactaacgagaaatggaatagtataggttccttctcttccaatactcatactacaccttctaccttcaggcatagttttttcatatgtcttctacaggtcatggctttggggtaaatagaaatgttgaaataagatccctgaatacttttaaaagaaatattgtaacaaatatttgttgagcaccaattatataccaaacattgttctaggtgtttggaatagacaaggtagaccctatgttgtgtcataatggctgaggattggggctggggtggggttaggggaatagaggaagtatctttttttttttttttcctctctgtcccaattgaaccagggtcaaagcagagtagaggaatgtcctgatctacctccatcgatactgtatgacttgggactctaatgttaggttaatttgcttactcctgttaaaactagaattgttttctagcaattacagattaaaggtagatccataggaagaaagttttttttcttttcgtcttcttttttttttttttgcagttaggcagaaatggttttgaatttcatatgaatgtcctgaaaactttgcaaatagtctgattcttttacttgttttctcaagtaaagatcaatgcaattgttgcagcccttagttttacagtcagaactgttaaatcttgtttctgaaattatcttccttagttatttctgttgttgaatttgagaaagcagagttctagtacaacttatacttaactttttttttttttttttgagacagagtcttactctgttgaccaggctgcagtgcagtgacgctatctcggcttaccacaacctctgcctcccaggttcaagagattctcatgtctcagtctcctgagtaactgggactacaggtgtatgccatcatgcccagctaatttttgtgtttctggtagaggagatgaactcctggcctcaagtgatttgcccaccttgtcctcccaaagtgttgcgattataggcatgagccaccgtgccctgcaaacttctgattatacattttcataaggtattcgtggttgaaataggtgattttctgagactttgatcgggaagtttatacctctgatattttgtcttctggtgtcacacctgccctagccttcaaccttggattgatctctttttttttttttgagactgagtctcgctctgtcacccgggctggagtgcagtggcatgatctcggctcactgcaagctccgcctcctgggttcacgccattctcctgcctcagccttcagagtggctgggactgcaggcgcccgccaccacgcctggctaattttttgtatttttaatagagacggggtttcaccatgttagccaggatggtctcgtgatccgcccgcctcggcctcccaaagtgctgagattacaggcgtgagccaccacgcccggccctggattgatctcttaatactaaaactgctggagaagaatcattacagccatctaggttattttcttctcagatttatggtcaacaaagataggatttcagggctaccaaagtatccttttatttgtccttagtcagctctgtcttccattctgcaaagcaaagattcttgttcaacttctatttcttttctcttaaatagaagatattgcttcattttctgcagggaaagtaacaccagccaagaactcactctcagcttttaactttccatgtatttacctcactctgtacccgttttactcatttatctcagaggaagtaatatttctctttcctacttgaagcagattccctcaagttcctaggtactttgacgtgtgtgtgttacctcttctgtattttcaactgcttccctctccactcactccttaccttcagcgctaaccctacccacatatttcctgtattaaaacaaaaaaacccttctctaatttgagtctgctttatggatcattactctgtacactacttctttttgttgtcagactttgtgaaagagtaatcagtagatgccagttgtactgcctcgctttgtcattcacccattggtctgaattttctcgccactttataaagataaggacagtagtaatttcttgctaaaagtaataacaatttctcaggttttcttagttgacttggccagcgtttattatgttgacttgctcttaaaaattctaccttttctgaaagagttctattcaggttggctttctctctctctggctgttgcttcatagtctttcttagtggtgtctacttggtggtggtcttcttccaagatatctgtagctctgtgtttttttttttttttttttttttttttttcctgagacagagtcttgctcttttgtccaggctggagtgcagtggcatgatctctgctcactgcagcctccgcctcccgggttcgagcgattcccctgcgtctacctcctgagtagctgggattacacgtgtgcgccagcacgcctggctaatttttgtatttttagtaaagatggggtttcaccatgttagccaggctggtctctaactcctgacctcaagtgattcgcccgccttggcctcccaaagtgctgggattacaagtgtgagccaccgcacccagctgtagctctgtggttttttaatcatcatatctctgtgccattaccttatgaaaacattcccagatcttagcttcagatagctacagctattcactaggtatctcaatgttcatatttcacaaaggtatctcaaactcatgctcctgatccctatcagcctgcttgctcttagtcctgctttaaatctcagcttaagtatctcttcctgatagctgaatcaggttttatcttttgggataccactgcatttttaagcctatcaaagcattataatactacagttactttacttacatatttatctgcagtggtattaataaatttccagcctcctgatgtgaacaagtcttacttgtctttgtacttgtaatcaataaacttctgttgttttgttgaatagtctcacaaagaaaaaattccaaaataattggtagagtttatataaaattataatttaaaaattatttaaattatatttgtaaatgtaaacttgtagttttttgatccactttcaccattgctattccttgtatctactttcaacctttgccaacttactagtcttaacaggtaggatctatattaattcagataatttctagaattggtaattaaaagttgattgggcatttacagcctttttcttgagatgggattttcttccattaggaataatcttattgaagaattttaaaacacatttttataaatagtgctaccttgctttccataatgttttggtcatgtgtgaaattttattttggaattagtaataagtgaaaactttggtttcatctaaaccaatgtgccattgaatttattgttttattggtattgtttcccccttcttgccttatatgaacacttagagaagaaaattaagaaaatcaaatgctttattctctcttagttttaataccagttctgctaacaggtatttttctatgtgaagcaattttttttgttgccaaagtaagccaaggtttagattctaactgtgtgaagtagtggataaggacactcagggttagttcttggttctatctggctgtctttccttgcacccctgaccccttttgctctgattctttctaacccatggttagcagtctcaaaagcactagtggcatctcttttaagtactaaacatgtggggagagtatttcagtagaattggttatggccactatatcttttctagagaacaaaagtacctcaccgttgaaattaaaagagaaataaattctgtgtaagtataccatttaggccagatgcagtggcacatgcctgtaatcccagcactttgggaggccaaggcaggaggatctcttgagctcaggagtttgagacctgcctggacaacatagctagaccctatctctaaaacaataaaatacattagctgagcatggtggcacatgcctgtagtcccagctacttggggggctgaggtaggaggatcccttgcttgagcccaggaggtcaaggctttagtgagctgcgattgcagcactgcactccagcctggacaacagaatgagaccctgcctcagaaataaataaataacaatctaccatttaaaaataatctgaatatgtttttcttactctttccttaaataacctcataaataaccataaaatttattcactttgtctacaaggtacttaaagcagtttttgttctggtttttccttgaaatagccaaaacatgctgttggaaaggcagatggtagattaagcagatttcatagacctttgcggtgattgtcattcatttcctttccagccttcattttaaaatgaaaatactaggagaaaattgggaaataatccgaataataaaatactgtggtgtagttaaagttgtagtctggaactgtttgcttcaagatatttcattagcttttttgaacaacaaacaatttcaagttatatatagacttagctggtttctcttcaagctattagctggttagggagatgattcgcacctttctgataaataatgctaaccgtgtatgtaaattttaaatgttctaaaaaccccatttaaactaaaaagacaagcgaaattattttaatattatcttttattaggctgagtgcagtggctcatgcttgtaatcccagcattttgggagcccgaggcgggtggatcgctggaggtcaggagttcgagaccagcctggccaccatggtgaaaccccgtctctactaaaaatacagaacatttgctggacgtggtggcgtgtgcctgtaatcccagttactcaggaggctgaggcaggagagtctcgagcccagcaggcgaaggttacagtaagctgagattgtgccactgcactccagcctagatgacagagtgagactctgtctcacacaaacacacaaacaaacaaaaaaacttttatttaaccccagatataaaaattatttagctactttagattttttggtactaaatcttcacaatccactttgtattgtacactcacagcatattttatctcagctgggtctaaccacatttcaactgtgcaatagccacatgttaagactaaagccttccgaatggacaacttagttctaaacagcttggtatttgccctactttgggagagatatggtatttgacatgttttggggccacccaccactggtttaccttactttctataacacccttgggctttttttttttttttttttttttgaggattcaccttttttctgttctcagtctgtgtagctgtgaagcctgctctgtttctacgggtacatgactcagattgggcagttggagccttacagttctcttacgaggttgagacttaacgctgagatttcctatacagagtgaggtcctcttacctgtgcagtgtgagtgtgagggtaatcatcttgagacaggataggttctgagaatagagcaagcactgagaaatggagagaaggaacgtaggcccttgccataggattttgatagctctgttttttccataattacagtagaagctcagaagattgagaaattaaccttgtttttttttttttttaaattagtgtacattgggttttctgtcacttgcaagagtgacattccaagtaaataagtatggattagggaggttcagtatggtgttagaatgccccagcagctgaaggtcgttctcttgttgatcagagtgggggttttcaccaggtagaagtcagatcctttgtgattcccaggatctcagatgcttgaattgactttttttttttttttttttgagatggagtctcactctgtcgccaggctggagtgcagtggcctgatctaggctcactacaagctccgcctcccaggttcacgtcattctgctgcctcagcctcctgagtagctgggacgacaggcacctgccaccatgcttggctaattttttgtatttttagtagagacgaggtttcaccatgttggccaggatggtcttaatctcttgacctcatgatctgcccgccttggcctcccaaagtgctgggattacaggtgtgagccaccacgcccagcctgagttgactttttaccagggtttttacagacctgttggtgggcagatacttaactatctactcaatgaaaaggatcagaaatgcaaataacacaattatttattcccctgatggtggtctcactgagtcttatttgctttgcctgtgagtttagaacttattgtttccaacttttattgaattttaaatctcttgtcttttagggactttttaactataaattccttaatatttttcttttcaaaataaagttcctctgtaagaagtataaatgagtttactatgaccacagtaatgcaaatatatataaatatatataataatgcaaatatacataaagagaaaattaatttcccattttcttttgccactttttgccaaatccagtgttaacagcttagtatatatcattgatactatattacaaaaaaaggaaaacagaaatggaaaaatatattagatatatggttgacccttgaacatcatgggtttgagctgcatgggttcacttatatgcagatttttaaaataaatatattggaaaatttttttttttggagatttgcaacaatttgagaaaactcagatgaaccatgtagcctagaattttaaaaaattaagaaaaaggctggggcgtggtggctcacacctgtaatcccagcactttgggaggccgaggcaagtggatcacttgaggtcaggagttcaagaccagcctggccaacatggcgaaaccccatctctaccaaaaaatacaaaaatcattcgatcgtggtgatggacgcctgtagccccagctacttgggaggctgaggcaggagaatcacttgaaccgggaggcagaagttgcagtgagccgagatcgtgccactgcacaccagcctaggtgacagcaagactgtgtggaaaaaaaaaaaatttagtccgggtgcagtggctcacccccgtaatcccagcactttgggaggctgaggtgggcggatcacaaggtcaagagattgagatcatcctggccaacatggtgaaaccccgtctctactaaaaatacaaaaattagctgggcgtgatggcgcgcgcctgtagtttcagtttctcgggaggctgagagagagagagagagagagaaaagattctttttttttttcttttttttgagacagcgtctcgctctgttgcccaggctggagtacagtgctgtgatcttggctcaccacaacctctgcctcccgggttcaagcgattctcctgcctcagcctcccgcgtagctgggactacaggcttgcaccaccgtgccctgctaattttttgtagttttagtagagacggagtttcactatgctggccaggctggtctcgaactcctgacgttgtgatacgcctgccttggcctcccaaagtactgggattgcaggcatgagtcactgcgcctggcctagattagattcttactgtctgaagtagtggataaggacactcagggtcatttcttgattctatctggctgtctttcattgcatcccctaccccttttgctctgattctttctaacccatgtttagcggtctcaaaagcactagtagcatctcttttaagtactaaccatgtggggagagtatttcagtagtagtagttatagccactatacactatatcttttctagagaacagaagtacctcaccattgaaattagaagagaaaattatatatatatatatgtgtgtgtgtgtatatgtgtgtgtgtgtatatatatatagagagagagagagagagaaagtcattcagtcagtctggcatgcaaagacagagaatctgagagtgacacaaaaataaacaatagtttttctgctttaaaagtccagtgttcatccttccccacccctgcaactctggcaaccactgattttttttttttttttttttttttttgagataagagtcttggtctgacacccaggctggagtgcagttgtgccatttcagctcactgcaacctcagcctcctgagcagctgggattacaggtgcgcaccaccatgcctggctaatttgtatttttaatacagacagggttttgctgtgttggccaggctggtatgcaacttctgacctcaagtgatctgtctgccttggcctcccaaagtgctgggattacaggtgtgagttactgcatgctgtcactgatttttttttttaaactttatccatagttttgccttttcagaatgtcatgtagttggaatcatacaatacgtagactattcagattggcttcttttacttaacagtatgcacctaaagttcctccttgtctttctgtggctttataactcagttattttttcactcaaaatattccattgtatgggtgtaccacagttcgttgaaccattcacccactgaaggatattttgggtacttccaagtcttgacagttatgaataaatatttgtatgcaggtttttgtgttaatttcagctcctttgggtaaacaccagggattgatggattatatatggtaagagaatgtttaccttttaagaaactgccaaactgtcttccgtagtgtctgcataagcaataaatgaaagtttgtgttgtttcacatttttaccagcatttggtgttgtcagtgttttggatttttcaattctaatagatatgtagtggtatcttattgttgttttaatttgccgttctctgatgaaatatgatgttaaggccgggtgtggtggctcatgcctgtaatcccagcactttgggaggccaaggtgggcggatcacttgaggtcaggagttcaagaccagcccggccaacatggtgaaacctggtcactactaaaaatacaaaaaataacttgacgtggtggcacgtgcctgcagaccccgctacttgggaggctgaggcaggagatttgcttcaacctagggggcagaggctgcagtgagccgagatcatgccactgcactccatcctgggcaacagagtgagactctgtctcgaaaaaaagaaaagaaatatgatattaagcattttttcacttgcttatttgccattggtatatcatctttggtgagatgtctgttcaaatgttttgccttctttttaattgggctgtttgttttcttttctcttttattttggagacaggatctcgctctgtcatccacgctggagtgtggtggcacaatcatggcttactgtagcctcaaactcccagtctcaagtgatcctcccgcctcagcctcctgagtagccgggactgcaggcactcaccaccaagctcggctaatttattattattattgttattattattattattattattattattattattgggagaaatggggtcttgttatgttgcccagggtagtctccaactcctgccttcaagctatcctcctgcctcggcctcccaaagtgctaggattatagacgtgagccaccatgcctagtggataccaatctcccagtctgacttgtcttttcgttttcttagcagtgtcttttgaagagcagaagttgttcttcggttgttttgttttgtttcaggtcctgctctgtcacccaggcctggagtgcagtggtgtgactttggttcactgcagcctcttccccacaggctcaagccgtcttcccacctcagcctcctgagtagctgggaccaaaggcgcatgccactgcacctggctaatttttgtatggttttaaaaatattttttggagagacagggttttgccacgttgcccagactggtttcgaactcctgggttcaagcaatccgtatgccttgttctcccaaagtgctgggattataggcatgagccactgcaccctgccaaagagcagaagttttaaattttaacgctatccaacatattagtttcttcttttcacatattgtgattttggtgtcttgtataaaacgtcattgccaaactcaagatcacctagattttcttctgtgttctagaaatttagttttgcagtttacactcaagtctatgatccattttgagttaatttttgtgaaaggtataaggtttgtgtctaaatttcattttgttcacttgttggtgtccccttgtttaagcagcagttgctgaaaagactatcctttctccattgaagtgctttaactccattatcaaagatcagttgactgtttttttaatggatgcatttctgagcttttgtattgtgttttattagtctagttatgttttttttttcccactgataccatactgtattaattactgtagctttatggtcagtcttaaagttggatagtgtcagccctctaactttgctctcataaaatgttttcttgctactctgaatcttttactatctatataaacgttagaatcaatttgttgataatccacacaataacttgctgggattttgattgggattgctttaaatgcatacagcaagttgggaaagaactgacgtcttgacagtgtggagtctgtctatgtgcatggcatttctcttcattcttttgatttctttcattagagttttattgttttcctcatatagagtacttgggattatatgtgtgagccaccatgtttggctaatttctgtatttttagtagagatggggtctcaccatgttggcctggctgatctcgaactcttgacctcaggtgatctgcccacctcagcttcccaaagtgctgggattacaggcatgagccaccatgcctggcctgaacattgtcctttgattctttcttagagtttccatttctctgcttttgcattttgcccaccttttttccattagagctctaggaatattaattagagctttaaaaaaattagtagtctgataatgccagtatttctgctatatctgagtctgactctgatgcttgtttcttcaaactgtgttttagcatgctttaaaatttttcattgaaagtcagagatagtacgtggtgtagaaggaactgaggtaaataggcctttagtgtaaggttttgtgtttatctggctaggggttaggctatgttcactgtttgctgtacctgtaagtatcagaggccaaaatttcctctagtgttcatgtttttgtcttccctgttgtcttttggtttctttggaatttcttcttaaataaggtctgaggtgtgcagtttgtttagttgtattctccacttagtatacaggagccatatttgtatagtggtaaggtgtagagggagggaagtgttctatagcctaaagatttgttctcagtcttttagtgaacctgtgtccctggtctgtagtctctacaagtacttctaagttttggtttttccctgcagtgagacaggagtgctagaggatgctggtattgggtatttcattaccctaagtctaaggctagaatgctctggagttgaatatttcccttctagattggtaaggctctggtggaaccctggtaggttagtctctgataattaatttctcttgaagtcaggccttgttaaggacagaatgctctgggcatatttcatcataactacatatttttttctgatcttcgctatgataatctggcagggcttctggttgttaaaaactgacaaaatgtggaggcctctcagacagggtcctgctgtagtttttaattaaaacttgttcacactgaacctccagcttggtttaggctttcctaccttggtaatggttcccaaggagctttctgcagttgtaagttgtggttctctgtatcctgaacctgcctgcctctctctctaattttgggggcagtggtttgccctgtgactccaatttctgcaatggctttacgaagagttgttgcttttcacctttgcttttcttttgttttgagtatggaatggcagtttttaactccttaaattccagaccagaaaccggtcatctgcagggctaattttttttctatattttacttttcttattaaagattataacatatctctagctgcataatatactacaatatggatatactagatttattcaacctttgtttattgatggacattcaagttttctcagcttttttacattataaatagtactgctaaaaatattcctgtacatgtatatttgcatactagtgctgttatttctttacatttactcttaaaagtgggatagctaagtcaaaggatatttgtgtttttaataatacatattgtctgattactttgcccaaacatagcagtgtatgagtttcctttctttggctattactggatgttgtcagtctggtagaagagaatggtatctcatcattgctttgattagtactttcttgaaaactggtgaggtatggagcatcttacatatgtttattaacattataatttcctctctggattctttatttgtggacattgacatttactttcagttgggttatttgctgttccccttattcatctgttaggcacaattgataatatttcttaaaattatacttctagaaaaatttagaaaattgcagcataagagaaagtaaaaatcacttatctgttcacacagataaactcttagagttttgatactaatatttttctaaggatatgtatatatatcagctttcctaccataatgaaattttatgtggcatgttatagttccacaactacattacatatgattttattaatttttaaatacaatatcggaaaaatatgaagcaatataaaaatgtttttaaaaatgcaggtcatgacctactcaattgattgcatgacccacagtttgaaaaacatcgccttaaaccagggtttcccagcccccaggccatggacaggtactggtctgtggctggttaggaactgggccgcacagtaggaggtgagtggaaggtgagcgagtgaagcttcatctgtatttgcagtggctccccatagctcccataactgcctgagctcttcctgctgtcagatcagtgacagcattagattctcataggagcacaaaccctattgtgaactgcacatgcaagggatctaggttgtgtactccttatgagaatctaatgtctgatgatctgtcactgtctcccatcatccccagatgggaccatctagttgcaggaaaaccagctcagggcccccactgattgtacattatggtgagttgtataactatttcattatatgttacagtgtaataacaatagaaataaagtgtacaagaaatgtaatgtacttgaatcatcccaaaaccatccctccacccacccgtccccccatccccccatccccagtccatggaaaaattgtcttccatgaaactggtccctgatgccaagaaggttgggaatcgctgctttaaactacataaatatataaccttggcttccacccgtaatccagcactttgggaggctaaggcaggaggatagcttgagcccccaggagtttgagaccagcctgggtgatatagtaagacctcgtctctataaaaaattacagaaattagcaaagtgtggtggcacacacctttagtcccagctgctggggtggctgaggcaggaggaggagcacttgagcctaggaagtggtggcaagattgtaccactgcactccagcctgggcaacagagtgagaccctgtctcaaaataaataaataaattacacacacacacacacacacacatataaaaccttgataaaaagtgaaaaccagttttaaaatataggaacatgaaatttatctcttaattcaatttaataatttcaaagccttctaaaattttatttacatttttaagagactcattattactaaaatattcaaacatctaaaagtagatgaggtcaggagtttgagaccagcctggccaacatggcgaaaccctgtctctaccaaaagtacaacaattagccaggtgtggtggcaggtacctgtaatcccagctactctggaggctgaggcaggagaattgcctgaacctgggaggtggaggctgcagtgagttgagatcgtgcactgtactccagtctgggtgacagcgcgagactccgtctcaaaaaaaattaaattaaattacattaaaatataaaaataaaagtagaggaaatagtataatgaaccccagtgtccccatctttcacttttatagttaacacattttgctaaatttacttatccctgtcaacttaaaaaaaaaaacaaaaaactcctggattatttttaagtgaatctcaggctcattgtattataaaagttagtctttgattatggagagacaatagataatgaaattgtagttacatttaaaaagaaaagagaccttatagttaacaaaatcagccataattttatgtcatctaatgatatacattcacgtttacccagttgtctcaaaaatgttttttatagctgctttgtttgaacctggatacaaacaagatggcatgttattcatattaattaatattttaagtctcataatttatagtagctcttcttgccttttaaacattttattccatttatttattggagagtagactgcattttcaatttggccaaatgcttcctttgggtgttagttagcttgttcttctatccctcttttttcctctaaatagtaattaaatccagaagtttatttagatacaaattcaattctttggcagttgtacttaaaagattatggtagaagctactatatcttgaagtttctgtgggcaggaatttgggagaatcttggcttggcagttttggtttggggtctctcataagattgcagtgagatgttagctagggttgtcgttagaaggcttgactggggttagagaatccacttccaagatggctcccctcacatggctagcaagttgttctcttgatgggaggtctcacttattctttacatgggccttccacaaagttgcttaaatatcctgacagccttggtggctggcttctcccaggttgaatgatctaaaaaagtaaggtagacgctgcattgtctttatgacctagacttggaagtcacatcattcactctccaatattctgttggtcacacagaccgtccttgaatcactgtggcgtggcatggatgccagatagtgaggatcatttaggaccattttggaggcttgctactgtagatgatttcagtttcaatttcagagtacaggatttatacatctttgaccttatctttcttgtaaactaaaagccctggttcctaaaatattaacatagcttgctttgttctaccatatacatgtaataatttcaaagtaacaatgctgatattaattactaaaaagactactgaatgcagtttaagatttcttagtgattctttttgtccttaaaatataccccccagctgtatatagtcagtatactctattgtagacagtttatgcaaccaatttgataaacataaatccacctaaatgtggatatgtttccagttttttagggattgctttttttccctttttgatttaataatgtattttaattatataaaacatttacttggtttcaaactctaaactataaaacaggtacattcagaatagtgtcacttccattcttctttttcttgttctctcccttacccatgggtaactattttaaatgtttgtttcatcctccaatgtttcttttgtacatattcacattcctttttttatatataaaaaaaggtagcaatgttgtaagtgctctgctgtacctttttcttttcatttaaccatatatgctgaagtttactccatgttagtagacaaaaatcattttgttagtagacaaaaatcacgcattgcttagaggcactgcactgtgtgggtatgctatagtttattcagctagtttcctaatgatagatattttcattgtgtaaataatgctgcattgaatagccctatgcatacatcattttgtattttggccagtgaatttttggtacaagttcctagaattgggattgttaagtcaaagggaaatactgaatgtgatttagctagatattgccaaatttctcttcagagggcttttttttgtgttatttctactaccaatgtatgaaagtgtttcttacagctttgtcagtagactctggagttctacttttagatttttgtcaatttagtatcttggtcaagttttagtttgggaaattaattaatttatatttattttgagacggagtttcgctcttgttgcccaggctggagtgcaatggcatgatcttggcttaccgcagcctctgcctcctgggttcaagcgattctcttgtctcagcctcccaagtagttgggattacagtcatgcaccaccatgcctggctaattttatatttttagcagaaacggggtttcttcgtgttagttagtctggtctcgatcgcccgacctcaggtgatctgcccacctcagcgtcccaaagtgctgggattataggcgtgagccactgtgcctggccacaaatttttattgtgagcaagattaagctactttgcattcacttaggggcgcttcgctcttttttcggatgagctaattgtctctctttctcacttttttgtaaggtcgttgatcttttctccccctaatttagagtttttaactttgcattcacttaggggcactttgctcttttttcggatgagctaattgtctctttttctcactttctgtaaggtcgttgatcttttttccccctaatttagagagtttttattttatttatatatacagatagagagagagagagtgtcttgctttgttgcccaggctggagtgcaggagtgcagtggcacgattgtgactcactgcaacctccgcctcctggcttaagtgattctcctgcttcagcctcccaagtagccaggattacaggtgcccacgaccatgcccggctaatttttttttttttttttttttttgcgacagagtgtcgcccaggcgggaatgcagtggcaggatctcagctcactgcaacctccacttcctgcattcaagtgattctcatgcctcagcctcctgaatagctgggattataggcatgaaccaccatgcccggctaatttttgtatttttagtagagagagagtttcaccatgttggccaggctggtctcgaactcctgacctcaagtgatccacctgcctcagcctcccaaagtactgggattacaggcgtgagccaccgtgcctggactgtagttgatactaataatcactctgcagtgtaagttgcagctaatttttttccaggttgctatattcttttaattttgcttgtggtatttttagccatgcagaggatttttatttttacatagtcgtatttgtcatatttattatttcttggtataaattatttcttgattcctagttggaactttttttctactcttaggttattaaggaattctgtgtttttttaaaagtacttttatagttctttaaaaaaatttagataactgattcatttgctttttttttttttttgagattgagttttgctcatgttgttcatccaggatggattgcaatggcacaatctcagctcactgcaacctctgtctcccagattcaagcgattctcctgcctctgcctccccagtagctgggattacaggcacccaccaccacacctggctaattttttgtaattttgtagattcatttgctttttatgctggtgtatagtgtgagagacagacaagttttatctttttctggctattcagttatcccaataccaccaattaaaaagtccatcttttccacactgaattgatatgccatctttatcatatagtaaaggtccatatgtatgtggatatatttctgaattttctgttttatttcatgtttatttaccagtatcacactttttaacgatggaaatgtatactggtttaatatctgatagtgtgtacacataccccctttctctttcaggtgttactttgctattcttaattatttttctacgtggatatacattacagaaaaacaaccaataagtattgtgaaaaattgggctgtgtctaatttataaactaacatagggataattaacatctttatcatgtttagccctgctatccatttgctcatgtgtacttttctgtcttgtaagagtgtttatagtttaaaggatttctcacatttcttatgtgagctttttaaatttaattaattgattagctattactaatggggtcttccattttatattttaactggtggttgatgttagtgactattatatgtaatattctacttttttaacctgtttaactgtaataatttttttgttgtcattgagtgtttatggctctccggaggccaaaaacttgttatctgcatttaaagatagttttagctttcctatgtcaattcttaaatctcgaattaagtgctgtttaatggaaatagaatgtgagccattgcattttaatttaaaatcatctggtaacttcattttaaaaaaagaaaggttgaaattaataacgtatttaacccaggcacagtggctcgtgcctgtaatcccagctctttgaggggctgaggtgggtggatcacctgaggttaggagttcaagaccagcctggccaacattgtgaaaccccatctctactaaaaatacaaaaattagccaggagtggtggtgcacaccagtaatcccagctgcttgggaggctgaggcatgagaatcacttgaacccaggaggcggaggttgcagtgagccaagatcgtgccactgcactccagcctgggcaacagagtgagactctgtctcaaaaaaaccaactaaacaaataatacatttaacccaatgtatctaatagattatttcagtatgtaatcaagaccacaaattattgagatattttatattcttttattttgtactgtcttcaaaattcagtatgtgttttgcactcatagcatttttatttttaatttttttctatatacttttaataattctcaaagtcataccagaactcgtagcattttttaactagccacatttcaagagctcattagccacatgtggctagtggctagtagctactgtattggaccatgcaactcttaatgctgtcttttatctttctgtgttacataatgccaccaatataatgttaaataacagcagagatagcggtatgtgtatatttgataactgacttccttttactcagcatgctcagtacatttccacatcaataattacatctctacaacatttttcaaagttacatggagtggcataagatataccagaagaacttttttgacatattgttttgtttttaagtgttttattattacattgctttagtgatcatgcttacagctaaatctttgcagtcttgccacgtgaaagagtatgcaatttaaaagtgttatacagttgctttgatttgtatattttgtttagtaatgagattaaatatttttcgtgtgttttttggacataggcattcttttgcatattgacagttcatttgatttcttattttctgttgtgggattggtatttttttgtattgattctttttttgttgttgtagttgtttgagatcttggtctgtctcccaggctggcgcgatctcggctcactgcaacctccgcctctcgggttcaagtgattctcctcgtcagcctcccgagtagctgggattacaggcttgtaccaccaagcccagctaatttttttgtatttttagtagagacggggtttcaccatgttggccaggctggtctcgaactcctgagctgaagtgatccgcccacctcggcctcccaaagtgctgggataacagtcgtgagccaccacacccagccgtttttgtattgatttgtaagatctcattttatattaaggatattaatctagtatatgttatagatacttctccagtttgtccttttcttttctttctttttttttttttttttttttgacagggttcactctatcacccgggctggagtgcagtggcgcaatcacagctaactgcaaccttgacctcccaggcttaggtgatcctcccacctcagcctcccaagtagctgggattacaggcatgtgccccacatccagctgttttttttgtattttagcagagacggggttttaccatgttgtccaggctagtctcaaaacttacggcctcaagcgatccacccacctcggcctccgaaagtgttgggattacaggtgtgagccaccgtgctccagccctcctttttttttttttgagactgggtctgtctccttctgtcacccaggctggaatgcagtggccctgcagccacagtctccaaactctggggctcaagtagtcctcctgcctcagccccccaagtagctagaattacaggtgtgcactaccacacctggctaatttttaaatttctgtagagacaggatctctccatgtcgccccaggctagtctcaaacccctggcctcaagcagtcctctcgccccgatctcccaaagtgcttggattactggcgtgagctaccatgcgcagccatcatttgccttttatctctcttccatattgtttccttaggcagtacttctacattttcatttaatgaattgaaatctgttggctttttattgcatttttctttgatgtaactgtccacctccttgtgggattatacatttgtcaaaacactattttatctattctttcttcactgacttaaattggctatttttataattattagatatataactgggatttgttttctggtgtgtattatttccactgttctgtcagtccctatggtatgacacaggtcagattaatttctagtagggcaagtgtttattttcagaaatgttttggctagtactctggtttgttttcttcaaggataattttagaattattttgtcaagttaagtctcctcgctcctggtgacaaaagagaaaaaccattggtccttttattgaaattgctttaaaatacagagttttatatgtgcgtggtacctcaaacctgtaatctgccactttgggagccaaggtgggaggatctcttgagtcggggaattcaagactaacctgggtaacatagagagaccccatctctaccagaaataaaacaaacagaaaaattagccagatgtggtggtgggagcccatgaccccaactatacttggaaggctgaggtaggaagatcacttgagctcagaggtcagggatatagtgagttgtgatggtgccactgtactccagtctgggtgacagagtgagtgagaccctgtctcaaaaaaaaaaaagaaaagaaaaatacagagttttacaatttggtgtttattaatgaattttgtataattttttttttttttttgagatggaatcttgctctgttgcacaggctggagtgcagtggcaccacctcggctcactgcaacctccacctccctggttcaagtgattcttctgcctcagcctctggagcagctgggattacaggtgcacgccaccatgcctggctagtttttgtatttttagtagagatggggtttcactatgttggccaggctggtctctaactcctgacctcaggtgatccgcccactttggcctctcaaagtgctgggattataggtgtgagccaccacgcctggctcagttttgtataattcttgttaaagtttagtcctggtcattagtagtaatttttttctattgtgaagtcatttaaattttattttctagtgaattgtttcttcatatatgaagtcttttgcttttttttttttcttctttgagacaaagtctggctctgttgcccaggctggagtacagtggctcaatctcagcttactgcaacctctgcctcctgggctcaagccatcctcctacttcagtcccccgagtagctgggattaagataacacaccaccacgccaggctaatttttgtagtttttgtagagacagggtttcgacatgttgcccaggctggtttcatgttcctgacctcagatgatccacctgcctcagcctcccaaagtgctgggattataggcatgagccacagcgcccggctgtcttttgctttttgagtattgatttttctttttttgagacggagtctcgctctgtcacccaggctagagtgcagtagcgtgatctcggctcactgcaagctctgcctcccgggttcatgccattctcctgcctcagcctcccgagtagctggaactacaggcatccaccaccatgccaggctaattttttgtatatttattagagacggggtttcactgtgtcaaccaggatggtcttgatctcctgacctcatgatccgcccaccttggcctcccaaagccctgggattacaggcatgagccactggcaatttttgtttttaatctcatacataatatctagcctttcctattaaatatgacattggttgttggtttcagggaggtaccataataaacttttaagaaagactccttctgttgcaagtttaccgagagttctttgctctgttttaaaaattaggaacttatctgaaccaagttcagatgctttttttgtcttcgtgttagtttttctgcttttcacaaatgtaatgaattatatttctcattcagtttgtgtgtaagtttcttttaggatttctaaatctctcgtaagtacgtttgtatagtttgtgtgtgtgtgctatgtgctattttaggttttggtagcaggactaagctgttttttataaaataaagttgtaatttcaaattatattgtttttcctcaaattcttgcttttaggtactctggagctgtataaacagaattaaattacatgtttattgaggcatttagaagtcgcctaacatctttcttggcctgtactctttttttttttttttttaattaaaagcagttcttttaccaacttttaattttttgataaactatattgactttattcagcttctaagagacaatttgacgtctaaaacattaatcacacctagaaactatacaatatggagaacagcagggtgatttttttttttttttaaatcataactgtttttttgcggggagaagaaaatagattagatgttttccttgggatttatttattaatattattaagtccagagagaaagatgaatgttattaaagtaacaaagtaacacttcttttcaaggattaattcttcctctaccagccttttattgttaaaaattgtgaatttatggaaaggttgtaggaataagtttctaatgtattaattattctcattcttaggtgcattttatctggtgtttgaatatatggaccatgatctgatgggactactggaatcaggcttggttcattttaatgaaaatcacataaagtcatttatgagacagctcatggagggtctggattattgtcataagaagaactttttgcatagagatattaaatgttccaatatccttctaaataataggtatgggtatgaactttatatatatttaaaatgagttttaccatggacatgtacatggagagaatagactggaaaccgtagcggcggggaatgtcgggggtggtgagcgttgaaagttacctattaggtacagtgtccaacgtttgggtgatgggtaccccagaagcctaacccctactattacacttgtaatacccatgtcaccaacaaacacatgtacccccgaatctaaaatttttaaaataaagatacggtgttacatgatgttgcaccttgattatgttaaaaaagatttaaaatttagtttactttatacaaactatgtaaaaataatcaggccagccacagtggctcacgcctgtaatcccagcaccttgagaagtagagacgggcggatcacttgagaccaggagttcatgaccagcctggccaacgttgatgaaaccctgtctctaccaaaaaaatagaaaagttagcctagcgtggtggagcatgcctgtgatgccagctacacaggaggctgaggcatgagaattgcttgaatctaggaggtggaggttgcagtgagctgagatcatgccactgtactccagcctaggtgacacagcgagactctggctcaaaaataaaaataaaaataatcaacaatattataacttgggatacctcaaaagttgtgttacatagctgttagtggccgggtggggcagctcagcctgtaatcccaacactttgggaggatgaggcagatggatcacttgaggccaggagttcaagaccagcctggccaacatggtgaaaccctgtctctactaaaaatacaaaaataaacccggtgtggtggcacacacccgtaatcccagctgctagaaagcctgaggaacgagaatcgcttgaatcccagaagtggagttgagtggagtcagtgagctgagatagtgccactgcactccagcctgggtgacaaagcaagcaagactcggtctcaaaaaaaaaaaaaaaaaaaaaaatctaataatagtctgtaatgcatataaaataatacttagttgacttttctgtttgctattattccaagtaatgtgaatggatcatctgataagcaatgtaacttcagctttaggttaagaatagattttagaaaattttaaaaaagcagtcacagttgtaaagtgaacttcttggaagtgtgtacacacacatacacattcacatatttaaaacttatgtaaataagcttagatttgtaacatcttatatttgaaccctgataattctcttgtaattggtactgtttgttaatttaaataaggcatggctggttctcattttaattaatagacagtgttctatgcacctagcccctctaaaactggagaattaaacaaattaaaagtgatgtcacttcgttcttgagcactgttaccttgaacaagaaatttgtcttactgctaagtaataaaaaggatctcattttattttcattgaagtatgcttttctaaataggaactgaatagtaataaaatactattctaatattataatacagtaattataataatcatattactataataattttaagactatccaaggatagtttactttcttgttttgtgaatttatccactacttgcctttccctgtattaccttgatgatattgcagtgtgagcagagttaaagtttacataggttttttttttttaatcagttctaggcatagaatataaatgtgtattgtcaattaagagtaaattaataccttttgttcattttgtcttatttccaccagagggcagataaaacttgcagactttggacttgctcgattgtatagctcagaagaaaggtaagcataccttcaaatgaatattgtagatactagagtttagtattagaagctatactaagaataccttattgatagttttattttttaaaagagaagtttacttttcatggttagtacataaaacattgaaattttataccatattgggttgattattgtaattacaatattttatacattatctcaatttaaaaattgatcttcaacaggtaaaaatgatttttttaaatgaacatctttaagtgtaactgaagtgaacttaaatttctaatgcgtattcagatattaaatattcttaatgaaaaccttttaaattgcatttttaaacttataaactttggtttcattattattttagacagattttattgttatatctacagttctttgtttttttaactccctagaaccctttatttaaaccaactgttgggaggatgttcactgtataagacacaaaaatgtagaacttttctggctaaagttggattatatacccaacttggctttctttgtgcctggtggtagtgaaatatgatttgtcttattaaaactaatatgggatttcaaaataaaatatttttgtgcaatagtaggttttatgtaaataaaatacggaattaatttggcttaataaatctttagtccatttaccccattccttttttgtctttatttccatatgtgtatatatatatctgaaataatatagttaaagaattttaaaattattttatgacaattttgtcatttctttaatatcaccataatttaatataatgaaacatcagttgattgcagtcttaggaatagatgtttactttcatttaatctttgctttttttggttaaagcaataaacaaaaactctcgtttgaatttttcagagtaaaaagtcttattttgttaaatcttgcagcgcctgtgacataattctggaaagtattttccttatatagtgttctagagtagaggtttataagtgatatgttttggatctattcaagttccatgaaacccctcagaaagtgtgcagtgggccaggcgcagtggctcatgcttgtacaaatcccagcactttgggaggcagaggcaggcggatcacttgagggtcagcacttggagaccagcctggccaacatggtgaaaccccatctctactaaaaatagctgggcttggtggtgcacgcctataatcccagctacttgggaggctgaggcacaagaatcacttaaacctgggaggcggaggttgcagtgagccgagatcacaccactgtactccagcaagactgtctccaaaaaaaaaaaaaaaaaaaaaaaaaaaggaagggaggagagagggaaggaggaaggaaggaaagagagacagagagagagaaaggaaagaaagtgttctgtggatggggttttgtgattggacctccagtcctctgtaccaactttcaccagagttacttggtttttatttgttttaactactacacttaaaattaacattttattttaggaaagggttgtatgagtgtttttttttttttgaagtttaaaactgttttaaagctcaaaagctatgtccctcattttgcatttgagcgaattgagacccagaaagggctgagttagtttccttttttaattttgaaatatgtatacattgtgaaatggctacattgagctaattactatgcattaccccacattttttttgtgtgtgccaacacttaaaaatctactctcaacaattttcaagaatacattgttattaagtgtagctgccaagttgtacaataaatctcttgaatttacttttgtctaactgaacttttatatccttaggccagcatcttccccccatactccctatgccccgtatctggtaactaccagctctactctctacctctatgagttgaggttttttagatttcacgtataagtgaaatgatgagttatttgtctttatgtgcctgccttattccacttaacacaatgcgcttcacgttcatccatgttgtcataaatgacaggatttccttgttttttaaagacttgaatagtatttcattgtgcgtatatgccacattttcctttttttgttttgttttgtttttttttgagacagagtctcactctgtcgcccaggctggagtgcagtggtgcaatctcagctcactacagcctccacctccggggtccaagtgattctcctgcctcagcctaccgatagctgggattacaggccacattttctttatccgtccatctcttagtggacgcttaacgttgattccctatcctggctattgtgaagggttgagtgactttaaagatcaaaaaatgttagcagagccaagggtgtatagttaagttttcaattcgcaattttttattctttctgtcatatataatagtgcctcttggtagaagttgaaaggaaaaattggtctgaactgtacttaatccaaaacttaacttgaagtatatttttttcttctgctgtttaagaagcatatgtattttattttatttgagacagtctcactctgtcgcctaggctggagtgcagtggcgtgatctcagctcactgcaacctccgcctcccgggttctagcgattctccagcttcagccttccgagtagctgggactgcagatgtgcaccaccatgcccagctaatttttgtattttttagtagagacaggatttcgccatgttggccaggctggtctcgaactcgtgaccacaagtgatctgcctgccttggcctcccaaagtgctgggattataggcatgagccaccatgcccagctgagaagcatatatatgactaaattaatgtggctattattttgggcaagttctggttaattaagaattctatctgctaagctggttgagatttcactgtagttagattttgcttaatataagtttgtgtctgttgttaattatgtaaatcctttcctatggaatggaaaacagctaattaccattttaatctaatagattcttgttatgcagatatttgtgcacatttggaatagatatgtttcagaaaagctgattataaagccaaattttatattatgaggcttaattttcccattgattttcattttaaaatataatttgggttccattggagtgccggggtgtggtgtgttcactgggccatggtccctgttgccctgctggattgatgtagaaattttgagtttagagaaccagagttttaaagtcccataactttgcatcttcaggtaatgtatactgaatttttctgctcagttaaatgtataagaggaaaattcagtctgtcattttgttttaagagcaaatatcctatcattatggggtttatatactcctttaaaacttctcttttttttttttaagagaataattctgatttcttcagaatctcctggagaggtagtattaatataatggaatacctttaaaatacatatgttgctctagtgaaccttaataactgtgattttaaaagaaatctacctttaacagatttattgtattgtctcaaattttctagatattttttgagataaatatgtaacaaatgatttttcattcatatttctgcttcattataaacagagagccaggtagggccttactgtaatactcatgcaagtataaagtcactttgaagtgtttttattttctaagtagttaatatagatcgaataactgaattgttcaagaattttgtgtaaggttttttgtttgtaaatagagcagttttcagcttacaactgtaatagcatcaaccacagctctcattagattttggatgttccttttttgaatttgaggaaagctgggtggagttacagctagtacttgggggtctgtgaccaatgtggatctgctcttcatgtgcctattgaagaaagaaagagaaccactggattaaaattagaggggaaaatgatttcttaaatttcagtcattttctcattttgaacattgggatttatactttgtcccattctgcattgggaattttaaaacttgagaatagagatttttgccccatttcttcattaactgttcatcttttagtatatggttttttaagtatagtttttctgacagctacaatgtttccctcttcttagtttttattttaccaagtcattgctccagtggttttcaaaaggatggagtatctttctctctttatgtgaccgtcctgtatgaaaaaaagttttccatattaattgaaactagcctcattttctagagaagaaactataatgtgacactttatttgtttatttatatttatgagacggagtctcactctgtcactcaagctgcagtgcactggtgtgatctcggctcactgcaacctccgcctcctaggtttaagcgattctcctgcctcagcctcctgagtagatgggattacaggcacctgccaccacgcccagctaatttttgtgtttttagtagagacggggtttcaccatgttggccaggctggcctcgaactcctgacctcaagtgatctacccacctctgcctcccaaagtgctaggattacaggtgtgagccactgtgcccagccctgaaaaacgtatctttaataatattactatgatcaaaatgaaagttttttaaacaataaccagaaagcatactacatttccatatgatgatccagtaaggagagagaagggaaaaatgaaaagggccttagagcattagctcactaataccaccctcccaaaacgcacacacctttttgaaggcagtatcgccatctagtggcttttcagaacattgttattgaaagcaaaactaaattttcctaaagttgaaggtattaatgagagaggaagatagtattaccatattttattcttttgtgttttatgttccctaaaacattgactgcattcatgataagtgcttggttgatgctgatctgggagaaggtgatcttcatctggaggatcctcctgatgcagatgagtgcagggagctttggggattctaggtaatgaaaaggatcttctgagaatcactagacaagattggaaccatggtaataaaaaaattactaataacagatgaatgacaataaataatatgattaaacaagcttcaggaaaggagatctcatttagatcattgacttttaactgtaagatcaagattaaattgttctcccttcaactctaatggagtagtcttcatttttgagcatataaagtggaaagaattcccccctccttctgttgggggtatatcatccgagacattactgctgaatacttacaaaactgaattccaatccttgatctttcttctggtctccagaccttttgtttattggaaatctctacccaggtgatttgggtaccctaaattaaaccttgttacaaaacctatctatttcattccccagaaaaatgtctactccttttcctttatttcccgttttagttaaaggtttccagtcacctcatataggccattgtaaatagaattgtattggtttttctgtcctctggtctttctcccttatggtcttctcttctgccattccagcccccctgataatagcaatgttgaactatttgtagttccctaaacttgctgtgctcttgaatgcctttgtgaatctacataagctgtttcttttgtatgtaattatacttctcacctgagtttgacaaattttttttttctttcagtgtgcaattcaggccctaccgcctttgaaatctgtcctgaatcccacaggcatcattgggcacatcttcttttatgtgtttagagtatattattcattctatgtattatttatagtacatgattataatttatattaccaccatttttcttttttttttttaagaaaaagaagggaaaaggaaagaacaaacttaactaacgtttgtgtacatcactttattatacatagtttcctttcacaagaattattttaaaagaaagttgagatggatgatgtaggtatcattcttatgtacattttaaagttacagaagtttagaaaatttaagtgcatttgcaagatcacacaaccaataagtagtagagctcaggatcttttgacagaaagattattttcattatatgggagtgcttctctggtaagactctgaattcagccttgattacctagaagtatcttccaggtagagaactctaggggcctctcaagtctgctttagaggtaccattaggctgatggcaatttttagagttcttttttagtaaagggtctgctgaattttgctttttgtctttgcatcctccaaatatatttttgacaaatgagttatgctgtaggtttaatcttccagcagattaggaagttatgtgatatttctacttttgaatctccctttgtcatattggatttaattatattttaagcagtttgaaagctcttgaaatatctaatgagaaatctataaacaaaaaatattttgatagcaacaaatatttaaaattacctgtaatttttcccatgaaagttatattaaagtctgatgacttttttttttttgagatggagtttcgctcttgtctcccaagctggagtgcaatggcgcagtctcggctcaacccaacctctgtctcctgagttcaagcgattctcctgcctcagtctcccaagtagctgggattacaggcacctgccaccacacccagcgaatttttgtaattttagtagagatgggatttcactgtgttgtccaggctggtcttgaactcctgacctcaggtgatccacccaccttggccttccaaagtgctgggattacaggggtcagccacggcacctggcctgactttaaattttaatacttggttaatcacttaaggtttaaggaaaaacaaaagaattgtttgattttgttttctaatgtgttactttcctggcagacaaagaaatagtgtctgccttcttttaaaaaatattaatgagatttacaaatgaaagtatttagcagaaggactggccttggtgtctcttgcctgtaatcctagcactttggaaggccaagatgtggagattacttgagcctagaagttcgagtccagcctgggcaacatagtgagatctctattttaaaaaaagtagaaattgaaatgcacagtagttaacgttgagaccattatttttgggtctttacaaagtttagtttcttgccatccaataacaacttattgaagttactaaattttgttttccaatttaatggcagaaggactgtgtgtgtgtgtgtgtgtgtgtgtgtgtgtgtgtgtgtgttttcctgggttattgagtttattgcttggaattgatctaattatgtaaagtggagtggttcatttcatttttagatttttcttttttgtatgtacacatttatttgataacatctaagaagtcgactatatgtttttcagtcctgtttctttttcattgtgagttaatttgctttttgtgcaaatactgggtatagacacaccacaagaatgtaatttgttttttaatccatgaaagaaaaaagcatcgtatatgtagtgtcacatcagtttgcttcttctttgtgtgatctaaacaagatcatctctacgatgttgacagttggtagccaaatctaatagcgcaagtttgaaattcatttttgaggattctggattttttttttttttttttttgagacagagtctttcttgctctgtcaaccaggctggggtgcagtggtgtcatctaggttcactgcaacctctgcctcctgggttcaagcaattctcatgcctcagccttctcagcagctgggattacaggcatgcaccgtgatacctggctaatttgttttgtatttttagtagaggtggggtttcaccatgttggccaggctggttccgaactcctgggctcaagcaatccttaggcctctgcctctcaaagtgctgggattacaggcatgagccaccacgcccggatggattttcttttatttgtctgtctttggataatgtattttcatattacaacgtgctttaattttcctgggctttaaatttcctggaaccaaaacatagtttcagtctcttttacttttgtctttacatttgtaaacggttaacgggatttaatattagcatcctaatcgtaacgtggatttttgtttgatagtatactatattactgaattgggtgatacctgaaattgtccttattctcttctgactccacctacgttggaacttgcttttatgattaaatacttctgtctgcacactttctcaatatttgcttctttttcattagagaggtagaaagtgaggcatggtacctattatgcaaaatttttgagtaaatcaggtgtttttccttgtccttagtaacggtcattttcatttgtcttttgtcattgttaccttttaaaagctttttaaaaaatagtttattaaaaatatttaaaatacaattaaagtaccactaacttctttaaagttttcttgccagctctgttctctccctggctttatcccctttctctggaaaatgaacatttgctcacccgcctcagggaactgaaggtttagtgtgattggaacaaaaaccaaatgataatggattttataggccttgtgtaggtattctctagatggaagcaatgtgtactatagccataacatattcatgtttcatttcacgctatcactttgactgcactttggaaagtggtttggccttatacgtctggaagcaagaacaatcacttaagaaagctgttgcagtaaatctaaataggatgattatagctagaaccaaggaatgggcacaggtagtggaaagacagattaattatatcataaggatgtagacttgttagaccttgatggttgaatgtgttgtgagatacatccctgcctccaccccctactgtaaggtttctgcttaagcaactggatgaatgatttgttggttaggatagtctaaacttttgtaacaaagagaaccacaaaagttagtggcttaaagaatgagaagtttatatatgtatttctcacttaataatcttgagtggtggctgggcgtggtggctcacgcctgtaatcccagcactttgggaggccaaggcagatggatcacctgaggtcaggagttcaagaccagcctggccaatatggtgaaaccgcatctctactaaaactacaaaaattagctgtgtgtggtggcagatgcctgtaatcccagctacttgggaggctgaggcaggagaatcgcttgaacccaggaggtggaggttgcagtgagccgagatcacgccactgcactccagcctaggtgacaagagcaaaactgtctcaaaagaaaaaaaaaattttgagcagttgttgcttacccctgtgcacaattaagattatttaaccataccaccaagtcaaatggtgactgcttcaatacagctattcagagaagaagactggaagatctgtcatcttctacacatgccttccaatgctggtgccagaggtgagaaaagaggagggaggagagtaatgagccaggcctagaaatggcacttatcacacgtgcttatgttccactggagagcacttggtcatgtggccacacctaactgcagtgaggatgggaaatgtagcagagctggacagctgccatagaagggaggagtaacagatttttagagggcagctatgagtatctgccacgaatggtgaggctgtttgctgagacagtaaagaagaacagagatgcattttttagcaaaaggtaataatgtaggtacttataggacttctaaatttgcttgtgtaataagaatgggcaagtaagacagctgatcttagatgacagcatcagttgggaaaaaattggttttgtttctctatagcactgtgatgatagaggaatttaaaagttatttttcttggaagatatcaaaaggagaaaaacaggagttcaaatagggggaaagaacatgagagaaaagattgtgtttattgttatgtagttatgttatatgaaagtattaataagttaggcaatgcatatgtagggtgaggaatttaaaatagctgagtgctacaaagcaaataaaataacgactatagtgtcaaagtaggggtggtagtggataattgggtaattttcattaggggagttaagaaggcctcttttaggaagtaaattggagctaagaccagagtgatgagaaagggaaaacttaatgaagacctgggccaagaacattccaagtacaaaggagaaggaactcagtacggcctgggaacagacttgggaggtttaaggtcaaaggttgcccagtgtaataggaggtaagatccttgctgtacagtcttatcaactgaagtaaagtttaaattttatttgattgcagtgggaaatcactgggcagttttaagcaagcagttgatacctggttttatgcttaataaaaaaactgaaaagaagttaagggtagctgggcatggtggtgcatgcctgtaatccaagctactccagaggcaggagaattgcttgaatccaggaggcagaggttgcagtgagccaagattgcaccactgaattccattcagggcaacagagcgagactctgtctcaaaaaaaataaataaaataataaaaacaaaaacgggcagggcgggcgggggggtgcaattagagatggaagccaggaaaccagttaagatattgttgtggtcataccagtgaaaagaataatggcttggactaggtatttggattggggatctattttggatgtagaattggcagaagttgtttggaaatttgagggaaagatgaatcaagaatgacacttggatttttgacattaaaagctgggtaggtgttagaaaatagatcccagatttcttttgtaggtttgatagatttttctgcaatggattgtgaatgtcttaaagatgacatggcattttgtgtatatgatgaatttagtttactgaagactctctttgtctcaaaacagtatgaattatagtataaaagaagtacatgggggggttgccttcaagcaggaagaaagaagtacagactttatcatatgttgttggaaaaatgaaacattttagagctggtttaggtatttcattttatatgatttttttcacttagaatggtctttaacaaaggcagcaaccctgctttataaattttaactgagattatctagaacccccaaatacttcaaggatctaggattttgttctgtttttctatatatatctagaccagtaggaggtggaaaacgtgccagccaaggggcacactccttatcacactgcttggtttgttgtggatacggtgcagcttatcaggccttaaggtagggaaggccataaccgtatctcatcttccctgccctccatctctggaattcctgggattgctttttgttttttgttttgttttgttttgttttttgagacagagtctcgctctgtcacccgggctggagtgcagtggcacgatgtcagctcactgcaacctctgcctccagggtttaagcaattctctgcctcagcctcccaattagctgggattacagatgcatgccaccacgcctggctaatttttgtattttcagtagagatggagttttaccatcttggccaggctggtcttgaatgcctgacctcgtgatccacccacctcggcctcccaaagtgctgggattacaggcatgagccactgcacccagccttcttgggattgttcagaggcaaagtattggaatctatcaatgaacagatagtctttgatctctactccgttgacacttccttgaatgtaaaaataatttttagagtgtggtactttttgttttataaaaagtatgtatcagtctgaatgtttgtttgcttcataaatcaaaacatttccatatttttgaaattacatcagtgttttaaaattcaacttcctagattaaattttacagttgaatgttttgtctcagtattttgcctagttcttatttcttgtctaacagaaactaagcatttggaaaggccattaattagtacacgttaaatatttttctgtacagttagaaatatatttcatgtggttttgtgtttatttttgaaaatttactattttcacgtctgaattaataaaacattatagcaattaataaaaagtatattctagtttgctaaggtgactgctaaatattgcattagatgatgctacatattgcttagaatttgatatacaatatataaaataatcttttacttattcctttttagtcacctgaatttgtttagtttctctacgattcaacatacttttaatttttaagattttttaaaaaatacaagacactaaaaatattttttaaagtaaaataaaaattaactatttgtagatagatttatataaatttaaacatttccttgagcctagttatccagttgcacttttataacaccattgtataggtttgatatactcatagatccttgatgtgtttgagaaactagttgtcataatttttacaaattttgttcttccacccagtaaatcatgtgtcatctaaagttagagggcaatatacattaaggtgcctgacctgtgcccagcattgtttgggctttgtgtgtggggttcataataaagaatgttacgaggttttttaactttctgggaaaatacaaaatagggagttaagacaggtaagtatgatgtaaatttaagaatgtgaagataaatatattattaatagagattagactttatgaatatgcatcttttactgtgttgtaaaggaagtatagcacttgaatgagaaaaatagggaaaggattttattaaaaggggataaggcagctgggcacagtggctcacgcctataatcccagcactttgggaggccgaggtgcgcagatcacctgaggtcaggaatttgagaccagcctggccaacatggcaaaaccctgtctctactaaaagtacaaaaattagccaggagtggtggcgggtgcctgtaatcccagctactcaggaggctgaggcaggacaatcgcttgaacccgggaggcggaggttgcagtgagctgagattgcgccactgtactccagcctgggcgacaagagtgagactccagcgcaaaaaaaaaaaagggcgggggggctaaagcataaagaggtgagcataattttaaagaattactaagttcagtttaactagagtagctaaaatttgaaagacttgctcattatgtgaagataagtgattccagtaaacaagcaaaaatcactgagaaaagtacattaataatgttagaaaaacctaatcttaatttactattaaaaatattcatcttattctgtcctcttttcacagtttttaccaaagtcaaatgtttttgctagctttggagcactgttaactatagtcctatctgtggtaatgctataatgcccaaattgatagttttataatgctagtgcttaagttatttggagaaatttggctggatgggggcagagcaggtcaggcagatcttacactgcctggaactgcaaatctataggtggcaagagggaattgctttctaaattgaatgctccatttccttaacaagactggtccaggaccaagccaagcttaggtaaatgggcttggaatacagcctttctggggaatttgctatggcttttgagtccttgtgatttggaaaacatctggatataaagagatgtttatagctgatctgaatatatatgtgatctccctgaagtaagtaactacagatcagccgaagaacctcctctgactacttaggattctcttcaagcgtgtcaatcagctagaacgtgaccattctctgagcgttgaacactttacattgccagataatttgtgctgttttcgtcaaacctgaccctaatataacttgactaaataatcttgtctgtggcaaataaagaggtagcagtatatttatgtcctcttttcggaaggtgataaaggaattatttgataaagtacgatatgtattgctactttgcagagtagacctcaagtagatacttgagtagacactctgcatttgtgtgcttttttctattcacacactacagtgggtatgtgaatcagtgaaaaattgccaaaaatatgatcaattgaaaacttttgttaggtggtctttatttgaactatatcttgtcatccattagtaatttagcaagatttgatcagaaccagtcaacgctctttaaatcagttaatcccattaaaggtttttatggaaaggaaaaacagtgctcaacaattgagttgatactaaagctttgctttgaccaaattgcagttaataccagtaaactactttttttttttgagacggagtcttgctctgtcacccagactggagtgcagtgacgctatcttggctcactgcaagctctgcctcccgggttcacatcattctcctgcctcagcttcctgagtagctggggctataggcacccgtcaccacgcctggttaatttttttttagtacagatggggtttcaccgtgttagccaggatggtctcgatctcctgacctcgtgatctgccagcctcggcctcccagagtgctgggattacaggcgtgagccaccgtgcccagcctatcagtcaactactttttgtttttatcttcatatattaagggaatttttagttaaacaggttgccctcacatacattttatgatcttatattagatacctttggatgtctgtattttttagtaggcagatgaaagtgtttttagttaggattatagggattgctttagtaaaataatatttcctcagagaatctgtcttactccaacaaatactaactctaaagactgttttctgtgttttttagtcggccgtatactaacaaggtaattactttatggtaccgtccacctgaactgctactgggagaagaacgatacacaccagccattgatgtatggagctgtgggtaagatagccttatttactggtttattttacttgaaacttttggtagtgaattaaaatagatcatttggtaatgacgggtattttttccattagctgtatccttggcgaactcttcactaaaaaacctatatttcaagcaaatcaggaacttgcacaactagaattaataaggtaagctgctgattataatattggtgggaattgggagagtgtcatactccacaggaaatttaaactctcccaagtttgtcttttcaggaagagaacaacatggttctctggagggcttatgactgctaaatggaggacaaactgaaatgtaggcactttgatacttgttccagtgaaattaaggatatcaaagcccctgggtgggtgcatgtgtatgtgtacatgcgtgcgtgcatgtgtgcgtttttttaagtcaaaggacttgaggcccaaaagataagactggcaaggaagagtaaatgtaggagagaatgaatgctagatacatattttttaattatgaaagaaatgaaaaattcatgttttggggtattgtttaaaaatactcttgtaaatacacataaaaatatgtgtctatatatgtgtgtatacacactaaaatacatgcatataccccctagcgtagaccttcattatttggagcctatcataggacctagttcataagcaattactcatacattttagtcgcttttctctttatcttttattttattttattattttatttttttgagatagagtctcactctgtcacctaggctggagtgcagtggcatgatctccactcactgcaacttctgcctcctgggttcaagcaattctcctgcctcagcctcccgagtagctcagattacgggtgcccaccaccatgcccagctaatttttgtatttgtagcagagacggggtttcaccatgtcggccaggctggtcttgaacttccaacctcaggtgactgccccccgcctcgttctcccaaagtgctgtgattacaggcatgagccacctcatccagcccgtcttatattttaaaataattttaattttaaaaatgggctttggccaggcacggtttctcacgcccgtaatcccagcactttgggaggcctaggtgggtggatcacctgaggttgggagtttgagaccagcctgaccaacatggagaaaccctgtctctactaaaaatacaaaattagcccggcgtggtggcccacgcctataatcccaactacttgggaggctgaggcaggagaatcatttgaacccaggaggcgaaggttgctgtgagccgagattgtgccacggcactccagcctgggcaacaagagcgaaattatgtctcaaaaaaaaaaaaaaaaaaaggtgggggggcttcagtttcatatgtaataatgtaaacgtgcaacttataaaatttccatgaaagtttcaaaatatatatgaagttttttaggaaagatattgatagggggtacagatttacagaattttactttaccaactgaacaaaatgaacataaagcaacaaatagtaaccagagaaggacctcaacatcatatcataaacagacaaattgaatcaaactaaaaatcttactattgccctttttggtggttaggcaaggtttttactatagggtacagcagggaaagatgagtgccctagttagagcctgcttcttctctggggataacttggctatagtcagaagtacccgaagccagaaactagtagtgcttcaactccaaagcagccagttgcctcacttttaataacattatgaaaaagaagaagggaagggaaggagttcacctgaaacatagaaaacttttatgttactttttttttttttttttcctgttttttgagacagtatctcactttgttgcctaggctggagtgcattggggcagtcatggctcactgcagccttgacctcctggagccaaacaatcctcctgcctcagccttccaagtagctgggaccacaggcatgcaccaccatgctgggtgattttttttttttttttttttttttttttttggagaccggctttctctatgttgcccaggctggtctccaactcttggactcaagcgatcatcctgtctcagcctcccaaaatgtgtcatacctttttaattgtgcaatagacaagtaaaaagggttaagaagaactgatactcttggaaaaaagaaatatacctttcagtgctaattgggcatttacaaaagttagttatatattaatagaggaaggaactccaaaacgttgaaatactataggctaaattctctaaaatagaataaaactagaaattaatataaacatggaaacaacaaagtctcttaactatctaaaaatttacatatgctaaaaaatcctggattaaagagaaatcaaactttaagacagggttgtccagtcttttggtttccctggaccacactggaagaagaatagttgtcttagaccacacataaaatacagtaacactaatgatagctgattgataggctaaaaaaaaaattccaaaaaaaaaatctcataatattttaagaaagtatgaatttgtgttgggctgcattcgaagccatcctgggttgcatgcagcccatggactgcaagttggacaagcttgctttagaacatctaggtttaaaaagagtgataagtataaaaatccatgggctaataaccctgtgcttaggagaaaatcacaaccttaaatatactactaaataagaaaaggaaagcaaattaattaagcattctacagacaaactagacaaaagcagcaaaataaacccaggaaataaaaatgaattataatacataaaatgtaaaatttatgaagaaacctatgatctggtcttgggtttattcacacatatatgcaatataaattagtctactagtttaacttcatatgaaaagagagtataaagaaattaaaagactgaatgcggtggctcatgcctgtaatctccgcatttgggaggccgaggcaggatcactcgagcccaggagttttagaccagcctgagcaatatagtgagaacttgtctctacaaattaaaacaaacaaacaaaaacaacaacaacaaattagctagtcattggagggtgagcatgtggtccgtactactcgtgaagctgaggtgagaggattacttgagcccaggaagtcgagactgcagtgagctaatgacaccaccgcattccagcctggttgacagagtgagaccatgtctccaaaataaaaaaccagccccattattttctttgataaattattacacatcttttagaaaccagtacttgtaatgttctttaaactattccagaacataagaataattcagtacaagctttcttattcagtcttctcttgaagagtcttattagattaattgatgctcttcattccctctgtaaagaaaaactggcttgataacatggcaagctgaatgcttgtagctagtaggctgtcactttctagtaagactatgtatttatcccaccagttgaagagtatgctgaacaggaggtagttgttagttttcaatttttatgctttttattattataattacatagtttaagcgtagatacagtgctttacaaaaactttaagacattgctgtctaattagggatggacaagtaattgtgtaagttagaaaagttataaaaatccaagatgtggtattagattgctttgaaagtgtttttaatttctagatttatttaaagaaatcaaaactaaaaatccttgatgatgtgttatgggtgtggtttgtacaagagagctaatacagaattccattcagtgaatcctctgtttaaagagaaagccttggcctttgtcagaagatgggaaaacaaatgtacatttataaactttcagttaaaataaaatgtttaaattatatatctgtgtatctttttttttaaacgattccttctaaccttttttttttaaacgattccttctaacccattttttttttgttaaacccaaccagccaactcttggtcctgattgtattggaaactagggcttctattaaagatagttaacatctatttagttcatatacaatatcagcattattcgaagagtttcacttgaattatctcagttaagcttcgtaacaaccctatgtcttctctttatagttaagaaaactgaaccttagagaggtgaagaattcgtccagggtcataaaactagcaagtggcaaaattgagatttaaacactgctaggtgttaccttaggatctaaacttttaaccattactccaaagtacaggctgggtgcggtggctcacgcctgtaatcgcagcactttgggaggccaagacgggtggatcacttgagcccaggagttcaagaccagactaggcaacatgacaaaaccccgtatatactaaaaacaaaaattagccgggcatggtagcacacacctgcaatcccagctccttgggaggctgaggcatgagaattgcttgaacctgggaggcagaggttgcagtcagccaagatcgcaccactccactacagcctgggtgacagagtgagaattggtctcaaaaaataaataaactacataggaaataaaactacctggaatcttttcttttacaaaatcaatatgacacacatatcggtacttgacaaagacaacatgaaaaattttataagatattaggccgggaacggtggctcatgcctgtaatcccagcactttgggaggccgaggtgggagggtcacttgaggccaggagtctgaaaccatgcctggccaacatggtgaacgcccccatcccccatatctactaaaaatataaaaattaggctgggcatggtggctcatgcctgtaatcccagcactttgggaggctgaggcgggtggatcacttgaggtcaggagtttgagaccagcccggccagcatggcgaaaccctatctctactaaaaatacaaaaactaaccgggcgtggtggtaggcgcctgtagtcccagctcctcaggaggctgaaacacaataattgcttgaacccagaaggcggaggttgcagtgagccgagattgctctgccgcgctccagcctgggcgattgagactgtctcaaaaaaaaaaaaaaagaaaaattgtataagatattaatccaagaattctaagggaggtactagcaaatagtatccagctttttatcacaaagttaacctgcagaaaaatgatgggagctaagatgatacagagggtcaagaaaggtatctccctttaagtgacatttgagcagagatctgaatgaagaaatggcaaagtaataaagactctgaggcatatttggttttttttttttaggaatatgttctcagtgaaccatatggggggaaagcttggtttatccattttatagcatgctgtactgttactaagaaggaaatagttggtcaggcacaatggctcacgcctctagtcccaacactttgggaggccaaggcgggcggatcacttgaggtcgagttcaggaccagccttgccaacatggtgaatccctgtctctactaaaaatacaaaaattacctgggcgcagtggtgtgtgcctgtaatcccagctacttggaaggctgaggcaggaacatcctgcctcaggtagcttgaacctgggaggcagaggttgcagtgagtcgagattgtgccactgcactccagcctgggtgacagagtgagactatgtctcagaaaaaaaaaaaaaaaaaaaaaaaaggaaacagttgatttggagataaagaaatggaaaagcagcatgaatagttacagaaggctatattgagattgatctcatttaggtaaaacaaaagactcaaattgttaatctgaacatggactttcaagaagactagggaggagaaattttcattttctagtttatatatttcagcatgtttttattttgttaagatacttataattttataaagagattgaccgggcacagtggctcacacctgtaatctcagcactttggaaggccaaggcaggtggatcactagagcccaggagtttgagaccagcctgggcaacgtggccaaaccccgtctctacaaaaaatacaaaaattaggtgggtgtggtagcacacacctatagcctgagctattgggaggctgcggtacaaggatcacccgaacccaagggaggtcgaggctacagtgaactgtgattgcaccactgccctttagtctgggcagcagagcgagaccttgtctcaaaaaaacagaaataaaacaacaaaacataaaaagatgcttcaattttgatttcatagcattaatttcttttcagacatgaagaaaatgaagtttctgataaacaaatctgactataatgaggcaacggagtataccgaaaagtgtgtggcctttagaatcttacagggttgggttctaatgccagctcagctacttcctgcgcttatggtttagggtcccatatgctcttaagtttttttcttcaaaagtaaaagaggactgataacatgcttagggttgtgagaattaaatgtaaataagttttcagtacatatttcttccctcaccttatttacagtaatgctaggttgtttataggctcaggaatgatgagacctagtgtcagtatagtacagatacatgtaaaactgatcaagagtgataacactaatttgctttaaatggctttacaccatagtgaatgagttattttatttataatttgctttgttccagaaagtattttaggcagattacaaatattttataatagaagtagcatagattaaaaagtgatggagggaggccgggcacggtggctcatacctataatcccagcacttcgggaggccgaggcaggtagatcatctgaggtcagcagtttgagaccagcctggccaacatagtgaaaccccgtctctgctaaaatacaaaacaagccgggcacagtggctcatgcctgtaatcctagcactttgggaggccgaggcggacaggtcatgaggtcatgaggtcaggagatcaagaccatccgggctaacacggtgaaaccccgtctctaccaaaactacaaaaaaaaaaaaaaaaaaaaaaaaaaagccgggcatggcggcgggcacctgtagtcccagctactcaggaggctgaggcaggagaatggcatgaacccaggaggcagagcttgcagtcagccgagatggcgccactgcactccagcctgggcaagagagcgacactccatctcaaaaataaataaaaaaacaattagctgagtgtggtggcacacacctgtaatcccaggtacttgggagtctgaggcaggagaactgcttgaacctgggaggtggaggttgcagtaagcggagattgtgccactgcactccagcctgggcaacagcaagactccatcccaaaaaaaaaaaaaaaaaaaaaagtgatagagggcacaatgactcacgcctgtaatcccagtactttgggaggctaaggccggtggtttacttgaagtcaggagtttgagaccagcctggccaccatggtgaaaccccatctctacaaaaatacagaattagcgggcgtggtagctagcacctgtaatcccagccgctgggaaggctgaggcaggagaatcgcttgaacctggaaggtggaggctgcagtgagccaagatcgtgccactgcactccagcctgggcaacagagcgagactgtgtctcaaaaaacaaaacaaaacaaaaagtgatggaggaagagaatggaaaacacacattgggacaaaatgggatgaatgaaggcagaaagctctgtgtggccatatatatatatatatatttaattgtttttaaacatgaggatcacattaccctaagccttctagcagtcagctgaagagcctttatatcacacaatgtacattgcttatgagataaaaaggattataatcagtgaagaaattgaaagtagattagaattaaatgaatccttttctctatctgccacctcacccagtacacacaaaccctcaggcctaggtggtttacacaggtgaaattttttaaactttaaaggaattagattttggttgtaccagaagataggaaaagagggaagcttcccatattgaaagaaatgaatcatgtataccttcataaactgatggcataaaatattctgtagagttgtgcttctcaaactttttggtttcataacttctttatgctcaaattattaaagatcccgggagtttttgtatctactgagatttaccgtattagaaattaaagatatttatgaattcattttaacataataatgttaacatgttttaaagtctataacgtctatagtttctaaaataaaagttgttggaatggcagatctgtctggtttaatagacatgacacttggatcctcatatctgtgatgtgctgttttcaatagcctttttggataatggtgcatattcttcttagaaaccacaaaaattagatgattgctagttttttacaggttgtaatgtgtaatctgaaaccatatgaaggaatattttatagtgtactatattgaaatccattgttctgtcttacactttgaatggatcttttatctgtgatgattttgtgatattatgcattggtcatttgaaaaatgctgcttcactgaacagatcttccaaatgtaatgttttatgttatataatttgtaccaccactgatctcatcagaaaagcttttcagtattttgaaactgttaagctcacggtggaggatataagttttctaatattctaatttctctggaaagttccaattttataattgacaataaatactgttgttttccttcaagtgacaagctgactttgttcctatttgagaaaatgtctggaaaatacccaagtttggatgactgtagtttgttagttttctttgccggtaaaaatagtggtccatgaaaaaagcagctgcctcagttcgcaagtcaaatcattgcacatcttctcaagataactatcatattttgttgtacagtagaagtgcttatgagtatttcccatttcatcgcagagaatattaaaaagatacatactcaaatatcagaattaaatgccattaacaatttgtactgcttcaacaagtacattctttttttgagagagtctggttctgtcacccaagctggagggcagtggtataatctcagctcactgcaacctctgcctcccgggttcaagcaattctcatgcctcagcctcctgagtagctgggactacaggtgcgcaccaccacacccggctaatttttgtattttcagtagagacagggttttgccatgttggccaggttggtctcgaactcatgacctcaggtgatccgcccaccttggcctcccaagtgctggagttacaggcatgagccactgcacctcacttaacaagtacattcttaagtgaaactggcttttctccccaccctgaaatttgcatgataatgaagactacatcctgttaatatagtttgttgccactgagttgaatcatgttaaggtgctggtagttttaccactggttttgtaccattagtgcaaatcaacacatggaaaaaggcaaataatggcttagtaatagctttgacctgccagaccttgaagtgtctaggggacgctcagtggtccttggaccccacttgtgaaaactgttgctgtatatcagtcttacatacgaatactgatgtacaacatctaacttaacaagtggaaaatacagcattacattgaaataatagtacttttattaggcttggatggtattcttcctttgaatataatgatgaatatgtattaggaagtctgttgataaaattcacattaagtagcctggggagaaaatgcagatgatgatggttatagaagttctaaaaaatcaaaactgataaaactaaagcactcttagaatataaaagccacaaaaattaaaatccatagtagagaggaataaatgaatgcttccttaacaggaaatatgtgtgaatttgtatgtgtatatgtgagtatatttctgttatgtgtttttcaaacccaaaggcatcattcttcccagggctaaacaatgaatgtgctcccattaaaatcagaaaataaagttacccaatattgtgtactgtcattatcattttaacattgtttagtaattgccacataatgtaacataccacagtgataaagatacatttgaaaaaaatatagatgaattctaacatgggttatatgatttatatacctggaatacctcaaagaaacaactgctaaaactggtaggaaccctacgatctcagatggctacatattattaaatttttgtttgtggccaggaatgatgactgacacctgtaatgctagcactttgggaggctgagatgggaggattgctggagtccagtaggtcaaggttgcactgagccttgtttgcacccctgcactccagcctgggtgacagtgagaccttgtctcaaaaataaataaataaataaaatttgaaacctttcctgtaataaagcttttctttctttttctttttctttctttttctttttctttctttcttttttttttttatttgagacagagcctcgctgtgttgccaggctggagtgcagtggcgcaatctcggctcactgcaacctctgcctcccaggttcaagtgagtctcctgcctcagcctcctgagtaactgggactagaggcgcacgccaccatgcccagctaatttttgtatttttagtagagacggggtttcaccatgttggccaggatggccttgatatcgcgaccttgtgatctgcccacctcagcctcctaaagtgctgggattacaggcgtgagcaaccgtgcctggcctttctttttttccttttttttttttttttaagataaagtcttgctgtctgtcatccaggctggagtgcagtggcctgatctcagctcactgcaacctccacctcccaggttcaagtgattctctgcctcagcctcccaagtagctgggattacaggtgtgcgccaccatgcccagctaatttttgtgtttttagtagagacagggtttccccatcttgccgagcctagtctcaaactcctgctcaagcaatccacctgcatcggccttccaaagtgctgtgattagaggcatgagccatcatgcctggccaagcttttctaattaattgcttagaaaatataatgggcatgggccaggtgcggtggctcacgcccataatcccagcactttgggaggccgaggtgggcggatcactaggtcaggagatcgagaccatcctggctaacacagtgaaaccctgtctctactaaaaatacaaaaaaattagccgggtgtggtggcaggtgcttgtagtcccagctacgtgggaggctgaggcaggagaatggcatgaacctgggaggtggagcttgcagtgagccgagatggtgccactgcactccagcctgggcgacagagcaagacaccatctcaaaaaaaaaaaaaaaaaagaaagtaaatataatgggctaaaaacatgtttaaggctgggctcagtggcttatgcctgtaatcccaatactttgatagactgaggcaggaggatcacttgaggctaggagtttgaggccagcttgggtctcaaattagatggatgtagtggcatattcctgtagtctcagctggtaagctgaggcaggaggatcatttgagaccgggaggtcgaggcttcagggagctatgattgcatcactgacctccagcctggggtagcagtggaaccctgtgtctatttaaaaaaaaaaacaaaatatttaaaaaacaaaaagcccgtaaaggaaatacacaaaatctcactgaaaatagataaataaataaataaaggaaagaaatagaaacactaattctaagatagaaatattaagcattgtaaaggcagtagttggttctaaatctataaatttagagtggcggttgaatcctagcaggattctcttttggagtgttatagtattgattataattcatgtgtaataaaattttgaggagaataagtaaagaggtggataggagatttgtcctatcagactttcaaggaatattaaaagcacaatatggtattgacaccagagtagattgatggaatcacgatagattcccaaagtatacctcaggtaattggggatttagcatataccttagtgtatgatgcatctcagtagtaaatggtgttgggagtagttgactggccaccaggcacagattttgtaaatgcagttatcagttgctgtcatgtctacctctctagtttctaggaactttccttgcatcggtatgtgtattccattgtgtatcctgctttcagttagataaattcggtactcagatatctttcaacatcacatatgataaaataattgaaatttttattgaaataaaatttcaataaaataaaattttattgaaataaaattttagtataatgaaactgttgtttattataagactattaatgggccagatgctagctcatttaatttcgtagcttcaaaataaaattaatcttaagtttccaaaagaggagcagattcctaagcaatgtaatttgaccgatgtcagacaagagtcaaatataaaacttgcttttaaattctgtcttcattatacataggcaaagtaccttagaactgtattgtggactgggtgcagcggcccatgcttgtaatcccaacactttaggagactgaggtgggaggatcacttgaagccaggcgttcaagaccagcctgggcaacatagcaaaaacctgtctacagacaaacctaccgcagtattatctagacccaggttatgcttccagctgagcctccctgagccctgtattccccctacactgatttacatagtgttcctcccaaatgtctatactttgctacttccatgcctttgcctgtgttctctcttctggtaacataatttatcttattccatttcccacctgtctatggtttacttatccttggaattataaccaaaattcttcactctttccctaacttaagttttcttgtatttctgcatcttgaaagtatctttgccttcctggattccagtatgctttatacttctattatagtgcacaacagtctgcctggggttgattaattgtgtttacatggtttcttggaaaagtatacaaaaacaagaaatagaaaagagacctgtaaacaactaaaatacagagcaggatgaaagaaatgtcaaaccagtagcatgcaaggagtaattctgagtagcattggagaatacagaagacttttattaattagattacttttgatctgaatcttgagaagtgaaaataattcagctatatagaatttagggagaaggagcattagcatagacatgaaggagtggcctgtggggagagatgcattgggaaatgagactaggaaggcagattgggaccagatctagagagcccatgctacaggagttgggctttcttttcaagggagtagggttgaggaggttgtgaaaattggactttaagacaaaagagagtagaactatgtaaagaataagttcttagtatctttaaagcttgggtttataaaaatgctaaatatattgagacaaaaaagtacatttcagtgacatacggctttaaaaacataaaaggtctcctataaatatgtgtttctgaggtatcattctaaagctcagctaaaaaaatgtctggcaacttgagccattacttgttcatatacatttatacatgcatttgtatttacgtatgtttggaatatttttacttttaatcagtgatacatcaacgttttctttttacatatgcagaccagctgacaattttatatataataaacatccttgaaatttggtatactaaaaataagtagatttaagcaaattttcatctacctattactaaatcagttagtttttaaatgtttaccagctggagttgcctatttgtttatagcatttcttctacaaattaccataacaaggatttactagttaatgctaaaataatgaggattttcaagatacagataaacgagagtaaagcagttaaaatttctttatgacttaagatcagcagcactacttaaattgaagaactttaatgtttcaagagtgttatgtttagggtccttccattgatggcagttagcagtagtctttacactacagttaccttcctgaggtcatatagaaatccgtttctgctattattgtagactgccttatattcatgggaaggaggagtgacaggtaccaaaaaaccagagagggacatatattcaactctagttccttaatttatgggcataaattttttatgttggttttaaggtgtaagtcacatattttgagtgtcatcatgttttaagatttcattttgcaaataatgaaagtcctctaagaattggaatgcttggattgttaaaagtatccactgaaaataaattaatttcttaaataattaaattcggatgactaaaatatttaacgagggccgggcgtggtggctcatgcctgtaattccagcactttgggaggcctaggcaggtggatcacttgagaacaggggttcaagaccagcctggccaacatggggaaatcctgtctctactaaaaatacaaaaactagctgggccgtggtggcgcatgcctataatcccagctactcaggaggctgaggcaggagaatcacttgaacccaggaggcagagattgcagtgagctgagattgtgccactgtactccagcctgggtgacagagtgagactctgtctcaaaaaaaagaaagaataaaataacaaaagtttttatagaccaaggcttcaatttttgtgtatttaaaaatgagttgatgttttgtataacagttgtatgtattctttatgtagttgatagtgatgtacttccttttgtgtgttgcttagccgaatatgtgggagtccatgtcctgcagtgtggcctgatgtaatcaaactaccatatttcaacaccatgaaaccaaagaagcaatatcgtcgaaagttaagagaagaatttgttttgtaagaaggggatgtgtaaacatccttattgcatgaatgttttactttaattctagtgaattataaatgttagtctattctctagtgatctgaggtaaacctataattcttctagggcatttaattttgagttctgtttgctacatgcagattaccattttaccattattatggaatcagtgatttgagattgtgtgtttggtttggtgcttacgtgaaagaactttaataagatcatttaaatgttactggaacagctttcaagttacttgagctcaagttttcattttgctttagaaaaaactatactgttcagttcttaatttgtataataacagcaaattaccgataagtaacaatatatactattgtttagaaagtggttacaaaaattatgtaaaaatgaaatatttattcaaaggaaaattcggatttattgaagtaaagtattatgcacatattaaaaaagtatttacaattatttttaaatgatcttagttttagttttaaaatttaattaaaaataatttaagctcctaaagaaacataagcttgtgtctaaagaacacatctaacttttgtaatcctctcatgctagtattcctgcagctgcgctagacttatttgattacatgcttgccttggatcctagtaagcgctgcactgctgaacaggctcttcagtgcgagttcctccgagatgtggaaccctcaaaaatgcctccaccagagtaagtgactttttatcctattattattatatattattattatatttattatattaaaacagttttaataacatatataataagatatttcatgtctggttatgagaaaaatataataaaggaaagataaaacagcagtaatacacataatttgcacatctgggatatagatgcttgcttaatgtttacccatagggctagcaaaaacagctgccttctagctaattttaggcttgattgacctcaagatttaataatatatttcaactctaagaaaatattactgctgccgggcgcggtggctcacgcctataatcccagcactttgggaggccgaggtgggcggatcatgaggtcaggagtttgagaccagtctggccaacatggcaaaaccccgtctctactaaaattacaaaaattagccagacgtggtggcaggcgcctgtaatcccagctacttgggaggctgaggcaggagaatcgcttgaacccgcgaggcggaggttgcagtgagccaagatcatggcattgcactccagcctgggtgacaagagcaagactccgtctcaaaaaaaaaaaaatattactgctgttgctattctaatactacttctactaaatacttaacactactactggtacagctatagccataattttgagtgccatgctaagcatttttcatttattacattaatctttataaccttataaggtaggtattagtattattatcatcaccacttcacagaggaggaagcaggctcagagaggttaagaaacttgcccaagaatacaaatctagtaaagggtacagccagctctcaaattcacattagtccaataagtaagagaggttctgaaaatactttatagcatagtatacaatataaatttcttatcattgaatgaaaagaatgttagtatcagaagcctgtatagaaggaattattgtctgatgggggaaatatatagagtttgggagtcaaaatagctggcttctcttgaacctgtaacttcaaatggctcctgttatttctctaggattgatttggggagtaggggggaaggaaaacgttcatttgcattccttgacaggatctagaaaccttgtaggtattttcttagtaatttttattttatttttttgtcttgagacaaagtctcactctgtctcccaggctggggtgcagtggcacgatctcagctcactacaacctctgcgtctcaggttcaagtgattctcctgcttcagcctcccgagtagctgggattacaggcatgcaccaccacatctggctaatttttgtatttttagtagagatgggatttcaccatgttggccaggctggtcttgaactcttgacctcaggtgatccacccaccttggcctcctaaactgctaggattacagatttgagccaccacgcccagccttttcttaataatttttaaaatgataaggagcatcattaaaagcaagcctattatctataataataaaatgtttccatgtaataaaaatagcatattttaaatgaacagacatgggctctggagttcaaatcctggttcttctgcttatcagttagatagtgcttattatatttctatgaggctgtcatattcagcttcagtaagcttttattgagctgtacatggttggcctttatgggatgatttgagagccaaaaaggatctattacctgacatcatgagggacctgaatttttcactgttgaattattgtttcatgtttgcttttttcttagtgtgtatcagtaatcttaaaacttgggctcagtaccccttcaaataacattttttaaacttctgatttggaaaaatttcaactctatagaaaaataggaagaatagtacaaagagtattcatgtatatcctttacctagattcaacagttaataatagttggacacatttgctttatcactgtctacttttttcctgaactagttggatatcatgttgtggaggtgacacttataaatatgtaatcatatctgtaagaactaggactttattctacatgcataccatataaagcatatgaaatttaacatgagaatatttaatggtcaatccacattcagatttccccagttgacccaataatttctcttatagacttttttttttaagataaagaatttttcaaagttcagcattctgtttatttgttatgtccttttcatctttaatcactctctagggaagagatcttttgacattcaacattttttaagattccaagctagctctttggtaaaatatttcacaatttggatttgattgccttctttttatcagaattagattaagagtttggggggcaagaatgtaatgttgatggtgatcctgctctgtgataattatgttcaagagaacataatgttactttgtaccattattattggtaatggtaactttgaccaagagatgtaaccactgtacttaaaaatgtcaacatagtaaatgctgacatttttaagtagagcaattatatcactcttgtaaatatatcaagtggaaagcaactatcatagcattttgatatccaccaccaatagtcatttggaaaatgttgagcagttgtacgttgttccattttcatcttgaacttatgttactcccgtaggcttttattctaatgtaaagtatttatgctagaaagtattttattgattactgtatcatatattttaaaaaacaaatacatgtatataaatggaaattaaatttcacgtttcctgtgactaaaagctcttttcttgattaaattgtcattgtaaatatcagtaatgaatatttccttatttatttattgattgattgatggagttttactcttgttgcctcagcctcctgagtacctgggattacaggcatgcgctaccacgcccggctaattttgtatttttagtagagacagggtttctccatgttggtcaggctggtctcgaactccagacctcaggtgatccgcctgccttggcctcccaaagtgctgggattacaggtgtgagccaccgtgcccagcccaaatatttccattttaaataaagaaaaaattagtaaattttgttggaagtacaacctaatgaaagagagggctgagatttttttcccaagtagtttgcatatctgttgattaatattgcttattctagaatgagacatatttccatatgaattccaattttattttttagttctataagtatgcttgtaaattagcatttgagaatgtaaggagttttgtcatagttatatcactgagttcttggaactccttcgacattatgtgtgaaaagcctttcatcaaaaatgattttaggctgggcgcagtggctcacgcctgtaatcccagcactttgggaggccaaggcggatagatcacaaggccaggagttcaagaccagcctggccaggatggtgaaatcctgtctctactaaaaatgcaaaaattagccaggtgtggtggcgggtgcctgtaatcccggctactcgggaggctgaggcagagaactgcttgaacctgggaggcagaggttgtagtgagccaagatggcgccactgcactccagtctgggcgacagagtgagactccatttccaaaaaaaaaaaaaaaaaaaaaaaaaagatttaaaggacgggcacaatggctcatgcctgtaatctcagcactgcaggaggatcacttgatgccagcagtttgagatcaacctggccgacatggcgaaaccctagctgtactaaaaatacaaaaattagctgggcatggtggcgtgtgcctgtaatcccagctactcagaaggctgaggcaggagagtcacttgagcctgggaggtggagattgcagtgagccaagatcttgccgctgcactccagcctgggtgacagagcaagactctgcctcaaaaaaaaaaaaaaaaaaagttattttaggccgggtgcagtggctcatgcctgtaatcccagcactttgagaggccaaggcaggtggatcccttgagcccatgagtttgagaccaatctgggcaacatggtaaaatcctatctctactaaaaatactaaaaaattagccaggcgtggtggcacacgcctgtaatcccagctactccagagggtgaggcacgagaattgcttgagcttgggaaacggaggctgcagtgagccgagatcgcgccactgcgctccagcttgggcaacagagtgagactctgtctccaaaaaaaaaaaaaaaaaaagattctaatgaccttctaggtgttaagattctttctccttcagttttttggatagtaaagaattggaggctgggcatggtgactcatgcctgtaatcccagcactttgggaaccaacgcaggaggattgcttgaggccaggagtttgagacctacctgggtaacataaggagaccctgtctttacaaaaaaaaaaaaaaaagatgaagaattagagatcacatgatctaaagaaggatttcttgtctagtaattatttgccttttcagttgtcttaccaatgcttatgaaatgacattttctagtacttgttactgtttcttttcacagcacatttaatccagtatacctagaaaagattaggaaatcagcatgtaatatcagtgctactttgccagtccatttttaaaattgtttcttaattatgttttttaagtattttgccaaaacttggaactataggtttatcccactcaatttatgggaaatgcctaccttatattctaatcataaactgtgtccttattgtaaagcaaatcacctaaatcagacttaattttatcagaacacacctgactgcattttttcattaaaaacaaacatgttaaaaacacattcaaggaacattctgtaagctatctgtaacaaattatggaatgtatcttgttagatacattactaaagcaatcaagtaaagagtatcagattgatccaatatttaaataaaaacattttataaacaatataatataatatctctcactattttgcaatatgatataatgagtagttaaaattatgcattacttatgaggtaaggactatgaagaaatacatggtattcctttagaaagttggaaggtgtatcaaactcttttgatcaattttttaggaataatcaaatgagagaatggggtatttaaaaatcggaaataggctgggcacggtggcagtggctcatgcctataattccagcactttgggaggccgaggcggacctatcacttgaggccgggagttcaagaccagcctggccaacatggtgaaaccccgtctctagtaaaaatacaaaaattaggccgggcgcagtggctcacacctgtaatcacagcagtttgggaggccgaggtgggcagatcacgaggtcaagagattgataccatcctggccaacatggtgaaaccccatctctactaaaaatacaaaattagcagggtatggtgacacatgcctgtaatcccaactacttgagaggctgaggtacaagaattgcttgaatccaggaggcagaggttgcaatgagctgagatcacaccattgcactccaccctgggtgacaagagtgaaactctgtctcaaaaacaaacaaaaaagttagaaataactccattaattgtattagatgccctgtcaaacgtaaagtatatatagctggaaagtgaattagactagcagccagcctgtaagctttctttaacagcaagtaaaaagcattaagccatttataagacaaaatatcagttgccattagaatgaatatttcacaataatgatttgatggaaatagttgtaaactatgaattaaatgatcagtgatgtcaaacatgaattaatacattgcctactttgtaagaggcactgctgaagagcttgcacatgttaacatacagtactaccccatgaggtagatagtattgttaatcccatttttaaagacaaggaaaatgaggcacagaggtccagttatttgcctaagacacatcaagtaagtgactgagctggcatttgaaccttcaagaaagcaaataaaagtttggttatctggaagacattcctgatccatctgaaagtatcagcatcagtaacctgtactattttagctatttcttgggtaaaatttatctttcctagagatgagtattaagatcatccataaagaatctcttacttttaagggggccaggtacggtagctcatgcctgtaatcccagcactttgggaggccaagactggcagatcacctgaggtcaggagttcaagaccagcctggtcaacatggggaaaccccgtctctactaaaaatacgaaaattagccaggcatggtggcatgtgcctgtaattccagctactggggaggctgaggcaggagaattgcttgaacctgggaggcggaggttggagtgagccgggatagcaccactgcactccagcctgggtgacagagcacgagagcaagattccatctcaaaaaaaaaaaaaggaaagaaaataatctcttacttttaaattgtgggagggaacaaaagccctttttaatggattactttgctttgctctcatggggctgtccttcaagagcaatgcattccctgagcttcaggatagaaaggtggaatcactccagttaccccactgtgcagtactacagtatatctgaatttaaggtatcccaacagagactgagacccacatcatatcatacaaacacttagaaaggaaattctttggcgggtttatgatgcctgaaagcttcccaatatcgatatttcaaattgtccctttgtttgttactccaggaggtttttacacgctgaggcaatgcatcatagtaagatggctgagaggtatgcctttgttttgtttttggacctcaggtgcatagacttggtttaatcataatccttgtgtcactcatcattggtccatgcatggctctcttttatttattttagttactttagttatttttaataatgttaataagcagccatgaacctaccaaacaaaagctagaatgctgaaaataacatactgtaatcatattacccctacccccaccaacctatccccttgccttcctccacctgaggtaaccatcatccctgttttcttttgtatatactttttgttgccatctatatgtactcataaaaggttatattttaaaaattttagttgttaattttataaaagcgcgtcatgctgtttgtaatattttgggaatgactttttaaactaatattgctaagattcaaccatattattgcatctgcctttattttataacatgactaattgtgaaagaggagatgtaaaagaacttgcttaaacaagcaggccatcctcaaagctcagtcttaggaaagcagacatatggatatggaaattcctttaaaaaaattccaggtgtaccctcttggagagtcttcgggtacctcctagaggtaaacagatccaggttgaggattataggtatatattaccaggtggggttgcttaagggaatttgtagatattctgggcaagtttattcacctttctaagcctcaagtttctcatctttaaaataggtacaacagtaacgttccattaaatacttaattagggtaagaagaaagcatttataaaccaaatatttgtatctttaagcaaaagttattctctagtgttatcagttgtatgaagttactttaagatagaattgactaggaattgtgggcagttttgatagttgttattcgcaactctgttgataaatgatgagccgctctatgccaggattacctattttgaaaactcgtctgtagcatcagtttaattctagagcatttggatagacaagcaagttagtaaaaagtaagcttttactgtaaagttcttcacaaatgttatgttctagccttactctttttttttttttttttttttgagatagggtctggctctgtcacccaggccagagtgcagtggcatgatcttggctctctgcagcctctgcctcctgggctgaagccatcctcccacctcagcttcccgagtagctgggactacagacatgtgccaccatgactggctaatttttttatagagacagggtttcagcatgttgcccatgctggtgaactcctgagctcaagtgatccacccaccttagcctcccaaagtgccaggattacaggcatgagctgctgcgcctggccctttactacttttttatcccatatctggtttctgcaaatggcatgtttttcttttttgtgtgacagggcctggttctgtcgcctaggctggagtgcagttacatgatctcagctcactgcaaccaccaccacctgggctcaagctattctcccacttcagcctcccaagtagctgggactgcagtgcacaacatcatgcccaactaatttttgtatttttggcaaagacagggttttgccatgttgcccaggctggtcttgaactcctgggctcaagcaatcctcccgtcttggcctccctaagcactgggattataggcgtgagccactgtgcctggctggaaatggcatatttttctgccttctttttcatgtcttattcagtgtatgatgtactatcataagaactgactttgaaaggttgcaccaacagcaatagtggtgttttttttttttttttttttgagacggagtctcgctgtgtcacccaggctggagtgcagtggcgcaatctcggctcaccgcaacctccacctcccgggttcatgccattctcctgcctcagcctcctgagtagctgggattacaggtgcccgccaccacgcctggctaatttttgtatttttagtagaaacggggttttgccatgttggccaggctgatctcaaactcctgacctcagatgatccacctatgtcggcctcccaaagtgctgggattacaggcatgcccagcatagtagcctatttttatgaatatatattcttcattcataattttgataaatgattatttattgattattcaaaagccaaagaaaaatagattatctgtaaaggcaaagcaagccctgaaggaagtgggacaataaggatgatttttattggaagagttttacagagccattctatgaagtcttcaagaactatttggggtgggggcataactttgttgctatatagtaactgtagcattttttgttaagaaatgccatttacaatttaattcctttttttttttcagtctccctttatggcaagattgtcatgagttatggagtaaaaagcgaagaagacagaagcagatgggcatgactgatgatgtttccacaattaaagcccccaggaaggacttgtctctgggcttggatgacagcagaaccaacacaccccagggtgtgctgccatcttcacagctgaaatctcagggcagctcaaatgtggcacctggtcagtaatgcttccatgggttggttttcttcacattgttttgcagttaattctgatcatattgctctaatgttaaagcatcttgtggctaacaatgaaaattaacatttattcactgaactagacatttctttgtgccagtacagaagtttcattgctattggcaccacaattttaagtaatcttaaggtaacttataaagaagcatcaaattacctgactggcaagtcctcggatttctgtatttcctttttactcttagtgcaggagtgagtaggtcttttactgacactactctcagtgaggctcagcattcaatgtctatagatgcttaagcagtaggaagaaaggtataagaaaacagccaaaaatcataatgagagctctttcataccatttatagcgtcctcatgtcactcctaatgttataatttctctggttatattaaagaatcttaaagattggggccaggcatgctggctcacgcctgtaatcctagcactttgggagactgaggcggatggatcacctgagatcaggagttcgagactagcctggccaacatcgcgaaaccccgtctctactaaaaatacaaaaattagccgggcgtggtggcacacacctgtaatcccagctactcggatgctgaggaagaagaatcgcttgaactggggaggtggaggttgcagtgagccgagattgcgccactgcactccagcctgtgcgacaggagcgagactccatctcaaaatatgtgtgtgtgtgtgtgtgagtgaatctgatatttgtgcccaaaataacttaaaatatgagaagggaaggccaggcatggtggctcacatctgtaatcccagctctttgggaggccacgatgggcagaccacttgagcccatgagttcgagaccagcccggacaacttcctgaaactctgtctctactaaaaatacaaaaaaaaaattagctgggcatggtggcacacacctgtaatcccagctactcaggaggctcaggcacgataattgcttgaacccaggaggcagatgttgcagtgagccaagattgaaccactgcactccagcctgggtgacagagcgagactgtctcaaaaaaaaaaaaaaaaggatatcttatatctagttattttagggaaacttaaatttcttcctttgactcagtctgtcatagagtaagctttttgatgcaaagtctgcctcttcaatgttgtcaagagtgttaaaatcatttaacaactttttaaaaggacctccactccctcattttgcctaaagcatccagaaacacccatctttaatttaacaccatctttagttgaagttttatgaaaacagagactgatataaaatagagagagagagagagagagagagagtgtgtgtgtgtgtgtgtgtgtgtgtgtgtgtaggtggtggcttattaaacatgaaaaaatagactagcacttcttaagagatgagtatatgttgattgatgagttagttgattaaaacagatgtgtggatcagactgaacttttggtggttgaagataaatatagattaactgagaaagctttaggaagataaccattaatgcttgccaatgtagtctacaagcttctacttgaccttggttcaactgcatacttaaagtactcattcaatgaataccaaaagcaattgttatttgttgttcaaaagtattctttcttgaaatagtgagttccccttatacattaaaatatttgtcctgctaacaaaaggatgtgaaatggcaataacagaaattttggatggtgatctgttttcccaggcaacagttgtcatatttggcaagactctcaggtctttatttctggtcctcttcatggaactgatgtcttaaactctaccaaacgtagtagtttactcattttagctggtaaaaaatgatttgccctttctgggctcattttgttgttaatttgctctaacttactttacaaccctgttttaatggtggataattttattttttattttccttttttaactttaatttttttttgagacagtctctgtcacccaggctggagtacagtgacacgatctcagctcactgcaatctccgcctcccaggttcaagtgattctcctgcctcagactccagagtaactgggattacaggcatgtgccatcacgctcagctaatttttgtatttttaatagagatgaggttttgccatgttggccaggctggtctcgaactcctgaccttgagttatctataaatagctgggtgtggtggctcatgcccgtaatcccagcactctgggaggccggggcgggctgtttgcttatgttcgggatttcgagaccagcctaggtaacatggcaaaaccccgtctctacaaaaaatacaaaaattagcctggcctatattcccagttacttgcggggctgaagcaggaaagattgcttgagcctaggaggtcgagactgcagtgagctgagattgtgccactggcactgtggcctggatgataaagtgagaccctgtcttaaaaaatcaagagaaaagagaagaatcagtattgtgattaagaagtgagaattccaggctgggcatggtggctcatgcctgtaatcccagcactttgggaggccgaggtggatggatcacctgaggtcaggagttcgagaccagcctggccaacatggcaaaaccatgtctctactaaaaataaaacaactggccgggcatggtggctcacgcctgtaatcccagcactttgggaggctgaggcgggcggatcatgaggtcaggagatcgagaccatcctggctaacacggtgaaatcccatctctactaaaaatacaaaaaattagccgggcgtggtggtggcaggcgcctgtagtcccagctactcgggaggctgaggcaggagaatggcgtgaacccagaaggcggagcttgcagtgagccgagatcgtgccactgcattccagcctgggccacagggcgagactccgtctcaaaaaaaataaataaataaaacaattagccaggcatggtggcacgcgcctgtaatcccagctcctagtgggggctggggcaggaaaattgcttgaacatgggaggcagagattacatatcatgccactgcactccagcctggggaacagagcaagactctgtctcaaaaaaaaaaaagaaggagaattctggttttttgaaaaaaggatgaatcctctgagtcattttcttctccgtcatcagtaagtatgctgaaataagaaaacgccccttcagcaaaagaggcacctcaattaaagaccacatccctgaattcatatggagagactacctgtggtaatagggaaatgaaaataaggaaaaatgacttttgatttgtagcaaacaagcatgctcacggatcataagaagaacttgcagaagtatctcaaaatatataaagagaatataaaagcattaaacaccagtttttcatcatcttagagttcctcttctatcaatctgtcatctgtgattatgggaattgcttatcattgcagtcttatagttaccatatatggtattatatgcatttgagccttgtcgttatatgtgattcagataagcttgcgtgagggaggacctgtgtaaattatcccaagtctaaactgaaagttggaaaaacaactgaatccttattactggtgatgagttaatactatcatatgcatatattaataataagcatatttctgtaggcattcctaacttacccaaagttacaaaaaaaaaaaggtaatttgaagaaaaacacaggcattttatcagaatctgaaaaatgtcatgatttcaatatagtgcaaagataaccttagattttgcataataaactttattttagagaaagtacggtgtagttaagagctcagattgtggaatcagaatatcagattcagatctcacctctgccacttacagaatatttgcccttgggcaagttgcttggtctctttcggtgtcagtttcttcttctcagtaaaaggaggctaataatagagtctgccttctaaggttgttgtaaggaataaaggatattaaatgcttagaaggtatgtgacactcccttagctgtcatcattatcattattcatttcccattcacaatgtgctgtttcctggttaaatccataacatgaggttttagtagtggtcttgattttccttttgaagtatttacccctaaagatttattcaaaattgactgcagttctttttatgtacaggtacattttaaatgtacatgatatttaactagacttgaggttctctttttacagtatttcttaaatactctccctcaaatatatattttcatatggtaatacagagccattttggtgtgggagtgggaggagctgtgaattatgacagttctaattaatataattttgtctttagtaaaaacaggccctggacagcacttaaaccacagtgaattggcaattctactaaacctactacaatctaaaacaagtgttaatatggctgattttgtccaagtgttgaacattaaggtaaactctgagactcaacagcagctaaataaaataaaccttcctgctggaattttggcaacaggtgaaaaacagacagatccatcaacaccacaacaggagtcttcgaaaccgttgggaggaattcagccttcttctcagaccatccagcctaaagtggagactgatgctgcccaggcggctgtgcagagtgcatttgcagttctgttgactcagttaataaaggctcagcagtcaaagcagaaagatgtgctactagaagagagggaaaatggatcgggacatgaagcgtcattacaactcaggccacctccagaacctagcactccggtgtcgggtaagtgtgcagataccagaccactaacacagctgcattacattgtctactcagtgttgctgactatatataatgtgtatagttcagtgacattgccaaaagatgtcctgaagaatctcaggtaactggcaataggttggtttttcagtctgtttacttccaggaatggattctttaacaaattatccatgtgagatagaactcattgtgaatgataaagatatttctaaggtaaacctatggttaagaaataatatttaactccaaatacgaaaggatgcttgactaaggcataatttatgtacacagtagcttttgttcctcaagcaatgaagtatacgtgaattctgcacctagccgtaattagctttaaaaagccaattacggctgggtgcagtggctcacacctgtaatcccagcactttgagaagctgaagtgggaagattgcctgaacccaggaattcagtacctatctgtgcaacatagtgagaccctgtctctaaaacaattttttttaattaactgggcatggtagcacatgcctgtgattccagctacttggaaggctgaggtgggtggatcacttgagcccaggaggtcaaggctgcagtgagctgtgatcactccactgcactccagtctgggtgacagagtgagaccgtgtcaccaaaaaaaaaaaaaaaaattttttttttttaaagagaagccatatacagtaaaatttaccagttaccatagtacttgtaaactttttgcttttttcatttaacattttgccagagatggaacttctaatcatctttagaactacctacaggaaacactgagtattttgaatatttagttttccatggtaacttttgaccttgtttttgctctgtttcacttaggacaagatgacctcatccagcatcaagatatgaggatcttggagctaacgccagaaccagaccggcctcgaattctgcctcctgaccaacgacctcccgagcctcctgaaccaccaccagtcactgaggaagatctagattatcggacagaaaaccagcatgtacccaccaccagttcttcattaactgaccctcatgccggagtgaaggcagccctgttacagctgcttgctcagcatcagccccaggatgaccccaaaagagaaggtgggattgattatcaagcaggagacacttacgtgtccacttcagactacaaggacaactttggatcctcttctttctcttctgctccttatgttagcaatgatggtctaggaagcagttctgctccaccactagaacgacgtagtttcattggaaattcagatattcagtctttggataactacagtactgcttcatctcattctggtggtccacctcagccttctgccttttctgagtcatttcccagttcagtagctggatatggagacatttacctcaatgctggtcccatgttgtttagtggagacaaggaccatagatttgaatatagccatggtcctattgcagtcctggcaaacagcagtgacccttccacggggccagagagtactcatcctttgccagcaaagatgcacaactataactatggtggtaacttacaggaaaatccgagtggccccagcctcatgcatggacagacctggacttctcctgcccaaggacctggatattcacaaggatacaggggacatattagcacatcaactggcagaggcagaggcagagggttaccatactgagtatctgtttttcctcaggcacatcatttttatctggaaagactt

SEQ ID NO: 17395 - DNA, 145241 bp, Human; identical to SEQ ID NO: 17394

SEQ ID NO: 17396 - DNA, 15271 bp, Human
tccccgtaaaaaatatgaggctttttaggcaatgttgacaaagttttaacaataatggtggagtaattgatgtttctggagctgaaaccccaaaggtgttaggttacttgtaacagaaaaagtcttacaaatagttgttttggaaaaggggacagtatatataattcagaaagcattgttaacctgtgcaaactgtaattataacttagtgtcacaattttcttgccctcttccccttgcactcagatcttatcttgtagtaatgatatttattaactctttccacctaaactgcattgcttgactgtaatgctatgaacacactaggtgtcagatataagctgagtgtatcttcagaaaccaagagggcttatgtgtgggaaagaaaccgagagggaaggaacgctttaacagatggaccccttaaagattcttctgcaagataaaagcaataagacagaaaatgaaaaagaggggagggggaagaattttttttaagccttagaaaggcattgttaaaaaattcacatttttctttttctgtgcacactaaaatccatgatgatttcatctgcactgttcctttgagggaaaaagaagcagtcaaggaggctgtctatgaatgcactggtcgggacaggcttggggcaagctgaaaaaactaccacatgacagagaaaaataatttgccaatatattttagagagtcttttcccataggaccagttattcaagtcatacgagtgcactctttttataaaaggatgtgggaaaggccaagagaattttgcattttatctgtgaagtccggcgagtggtggtaggctgtaatgtgtgagagtgagtgggtccccggcagaagggggcagctgaacgcgacggggagaaagcgcttctggaacttgggcttgtgacaggctgcctgccctctggtccttcagtgccctgctgcatttcacagttgggaagagtggagtgtattatatgaccccaaacaaaagttccattgcgctctcctcagattgcctgccagtgttgatgacctgaacatttaaatatgaatgaattgggggaaaggaccatctcccctggatcccatcaggccagaacaatcctctgttacccctgagtccctcttccctgacctccactacctgtccactggacctccctgcaccctctgccccaccacgtggccaggtgggcgttctaccacctagggctgtggcttggctgggtggaggggcggtgggaacactttttcaatcaattcatccctattgattgagacactgtgtttgtttggggtttcttttctcccctccaaaaaaggaagaaggtgaaaccaggagactgggcagagaaagaaaaaaaaatagtgaacaaaattaggataatttattttagaagagaaagtagaacccccgaaaatggtgatatttgaagagaggtgtctgtgaggaagctaagagcagaaggagagcagcctgtcagaaaacgggctgtccctccctccctaatcacagccctactcacagcaaactccctccctctccattcactcacttacttagggccaatcctttctctctctctctctctctctctctctctctctcttcctttccctctctccctctccccctcccttccctccctctctccctctctctcccccttctttccctctctcttctctccccctctctcctctctctctgtctctgtctccctcccatcctctctctctgtctctgtctgtctccccgccaccctgtctctccctccctccctgtctccctccctccctccctccttccttctctcttactcggagacagtcagaactctcctccctgacagccacaaacctacagcactgactgcattcagagaggaacctgcaaacaaaacttcacagaaaactttttgttcttgttccagagaatttgctgaagaggagaaggaaaaaaaaaacaccaaaaaaaaaaataaaaaaatccacacacacaaaaaaacctgcgcgtgaggggggaggaaaagcagggccttttaaaaaggcaatcacaacaacttttgctgccaggatgcccttgctttggctgagaggatttctgttggcaagttgctggattatagtgaggagttcccccaccccaggatccgaggggcacagcgcggcccccgactgtccgtcctgtgcgctggccgccctcccaaaggatgtacccaactctcagccagagatggtggaggccgtcaagaagcacattttaaacatgctgcacttgaagaagagacccgatgtcacccagccggtacccaaggcggcgcttctgaacgcgatcagaaagcttcatgtgggcaaagtcggggagaacgggtatgtggagatagaggatgacattggaaggagggcagaaatgaatgaacttatggagcagacctcggagatcatcacgtttgccgagtcaggttggtgctggcattggcagggggtggggaggggtggggggtgggagggtaaaatatatttctttgacagtcccaggaggaacttcttttcccttcagctggaaactgcctgggaaggttattagttattaggtgatggtagcggactagccgacggagggcaggcaggggagggggagaggactttacagaaaaggaattctcggtcgagctctgcctggagatgactggcttacacttactaaacccagcgggtcacacagagaggaagctcggggccaatgttgagctggaaggcagactgtgaggggctgccttgccctgcctgtgaaaccagatctgagcagccggaggaaagccgcggcattttcgggtgctaggggagcagaggaggcttccggaccccatccaagtttttattgagggtagaggggtgaatgtaccaggattggagtggaatggcacagatgaagtcactctcttaaaacaaaccttcccctttaaaagtccaatctggggccacattggagaagcagggcatatttatgagtgacagtcatttttacctttagaaaatgtctataagtgcacaggcaccacattcaagacagggaagagctactttgggggacagttgtcattgaaccagcagttacttttgggacactgacttttgctctctgaaagaaaaaaaaataaataaaacaaccagttttgttctttctaaagttactaagagctctctgccaaggaacgcaaccttgacaaagtactctcagatactacgctgaactcactcaatccttaagaggaagaactttaataaatagattctaatcgttggcccaggaccacactaacctgttgctgaatagcaatacctgtcaaaagtatgggcccatggacttggagccaggctatttttatagttaagtgacacagatcctttgcatgcctgcaagcccatgcacgtcaggcacacagatgtgttaataccgtgttactttcatggtaatgccaggctaaagaattgcatcctttgccaactccatttgaaaggaatgccattgttttgtttggtagagcatatggccagtaaagtatgtgcagggactcccagcatttttgtttaaaagtttgccgcagcagtataaacaattaaggcaacactcagaatttccaatctgaaaacctgttgactcagatgttctgttttcaagaaaaccatgaaagaccagggcatctttccgggggtgcagatagcctgctggctgtgtggcttccccttgcaggagaagccctggtgtcctacaagcttcccagtttggctctctcaccagaagcctctctcacttagggaagatcctactttctttccctaaagctctttcttaacccagccccaaaaggcatgatcattaggactttatcttctggagctttttgaggaagaaagctaggttggaacttttcaagttgacacccatttttttttctcaacttttcatggtgggaaaaggtaaaaaagaaaatatttacaatatttggctgtgcatgtgaaacagatttcagtggtctagagggttgcttcctgtctttgtataccaacctccacacatgatggattcaatgacagctcgtatccagttgcctttaaccatgtcatatgactaagtatacctatgcctttgaccacttttaaccgcactaccgttactagcaatatgcccctctttctgacttactggacttgtatagcaaatcactctcttagcatttagagatttggcagtgaaaaaatttgaccatttacattctttcttatgtgtggtcttcctttctgtgacagtcttctctcagttgtatgagatcttgtcatttttttacttctcagttaggtgtttagtttgaaaaaaaatgagcgacttttgaaaaagcgattcgttggacgttcacattgagtcaagtttaagatttgtaatgggaaactcctggttgactttacaacttgactttggattcttagaaaacacttattacaattgcttatttttctctgagggatttcacacatcaacttcaagttgatttaatgtaatttcatgtatttaatgattgctgtatggactgtctactcttcaagcagaaaaccacgtgagcattttgctgctgattttgctagtccagaaaagacatttatcatccaaatgattgtagcaaatatatgaacatgaatagaaaagacctatgtcttgttgcttttggaataattcaactttaataacattccaactatgtggaatgtcaagagtttttggagaatagaaaaaggaatgcatttttctttcccttataaccattttgtgcagcatagaatccagacattgtcacccatgagcatgccacagatgcagacccatagcagcccctttcaacctcaagattcttcaatttgaggctacgtttaatttttgccttttctctccttgattgttggataaagccaaggcctggctacagaagtagagagcctccaaaagctgaagtgctgaggactcttttaactgagtttgtcccatcctgtttaggtagaaagtgctcaatttttgtaaagttgatgcgagttgttattgactaaacagcagggaatcactctaaggctctctgaaatgtatcccaacaaacaaaaattattttatttttatatatgtcacatcacccaagatttctcaccaaggttagtgtgttctttgcatggctggcacaaaaccctcaatgttttaccttaaggcctacagagttcttcacaaggaaagatagaagggatgggtaaagccaagctatcactataaatgtcatgaagctaaattcagtggccttttcagctgatgcagcttatttttattttattttgactcatgacagtaggtggtcaatcaatgcataataataatgtacctctaagtctccatatgctgtcaaacctggatgtgggttctggtaattagcttagcaattgatagcacttgttgtagaaagaatagggaaagaaagacaaatgacacaccaagaaatggatgtgctcacgtagcctaggtgttgttaagcgcaacacataagtctaccccttggaggatactatgtatggaagatttgagttagaagtttgcactgcccagacagggatccaagaagctttgcttggatgaccattttccccaccccaagaaagccatctcaaaatgaagctgactcccaccattccaatcccaccttccgaacttttctgtgaatcacccctcctttagggatgcctttaggggttacacgctctcttccgtgaataatggggaagagcggccacaagagggcgcgttccaaagacttttgctccttgtcagtgtatccagggaaaggcagttgcgcgtactggaagcccctgtctgtagcgccctaatcttggtgattatcagttaccgcctgctccctctcatcctgcagaaaaagttaggaatttatgagatgggagaagcatgactacctgtaatacattaaatgagacagaaggaaaggaaatggaaattctagtgatacatgtgaacattccggagctctatggaaggcagacgagtgataaatttcaaaagcaaacaaagcggagcagggagaaatgtgactatgaatcatcagcgatactgatttgctcacaagtctctccctaatacggtctcccgggtcgtaacaaaaacatcttccatctcccctgattttgttgcctagttttcctgccttatcaacagtttccaccagcgacaaatgacaagtgacttcaaacagggaggaaaaaggttctttctgtaatgccttgtgggaacatggtgttcggcttctgaggatgcgtttgtttccgaactgagggtgtggagagaaatggtggggaaagatgggaaaagagattaatagtggtctgcggcctgtgcagtggatggactgggctgggggtggtggagatgccagggtggaaagtccgttgtaatatttaaagaactgcagtaataccttcccaggcacttttcttgaaaacacatatttgtcttggcccctcttctgctaaaaaatacttgcacgtgatctcctagctgtagttctgaattcttcgtactcgactggttcctaagtccaaaatgagaagtgccaaagttctcaggaactttggaagaagtctctgaaattttgtgggttaaaccttaagaatttttgctacttgtaggaacctaaaacccctttctcccaaaatatttaacctttttcatcaccactttaatggaagaggcatggatgatggacgtttgtgccagggcatttataaatcaataatggaccctaaggagggaaattaaagctaaaaaattaatcaagataatttatggccaaacctatagttctactgcaggaaagatcctctactgtaggtcaaaggaggaataaccttaagacctcacttgctgctttctgcagaaacccctggaagcagtccaaatgcaaagttagggcttcagagaatgcaccctgtaaatggtagttgtgtatacccttaccattgactataccatatctaggcacagtgaaatcttgatgaagaatggaaaattaaaggaacagacgctttttacagggaggcttcccccagcccccatcccatggtaagtttaaatgtgttctataaacaacgaggctttccacattcacattagagacataactattgcccatatgtaaaagagcaacatattttaagcaggaccctggtgaggaaaacaaaaccaaatcgaaacactgcatgtgtgtgttgcttatttaactgaaaatgttcatagacccacaaatctgagatgctggacttttggatgagtccagcattttgcatcttagtgtagggggagggaacaacaaggggcttagttgcttaacccttgccatgccttcatgattgacttattcaaaacatttttaaaattctgaaagcaaaggaaaatgtgctgcaaacacccttccagctatctttccttccagcttacacagtctctcctctgtccaatccttcccacccagcagcatttcagaggtattccctgtgaggtacaaaatttctctttgcccatttttctgcacctctttttctctctctttggtatgtgtccaccaagctcatagaggtttaagtgatgaaatattatcacccacatgggtttgcgtgggactttcttagtgaattactcaggcagagcaggctgtgatacagccttgctcacaagcctcgggagggaaaaaatagcacagaggatgaaaagaatattattagagagcaggtaatgaaaggttcgcaaagcaaccagctatatctggttagctaggtaatagtgcaggaacctaggtcgcacctgtacaaactaatgcagaacctgctcacggcgcactatgggaagacattcatttcaagagtttacagcatgagatatttgagtaaaacctgaaactgattagaaattgatcctgaacatcccagccttagtcaaccttccctttttcaaattgttatgcatggagattggaggattggggcatcttgaaagtgtcactgcagtatagcaatctctctcaggtaatatagagataaagggaatataataaattgacctgttatttattatctttttcatacctaggacattccgaggcttaatatatttctgaagcctacagccctgataaacatcaatcccacgtcagtttccagcagtctcatctccccacacccttctgcaatgaaagctaatgtaaaagaaagaaatatgcactgcttaataagtcagaatacaatagaacttgtaaaatgtacctgcatataaggtagacattaggaagacttgaatctctctcttccccctgttctcctgagcattatggcaacagcattttcatgaaattagatctgttttatattttttcctgataaaatatcatgcaatatacaaatagcagttccagaaatggacaccaggagaaggaggcgacaggcatgtcaattagtagggggaaaatccaaatgtcagaaatatgggggagagagaaagcacgcaggcagtggatgcaaatacagggaacagagtctttcaattcagataattaaacggatgcataaatcagcacccttgcctctctacaatacgcaggcgatgccatgcagttaattatcagccaagaccagcatgaaagtcattttatgatgactctctgatcctaatataacagcacctgacagattgagccccctctaatgagtactctctttgtacaatcctctctcaggaacactaaatcatttgcttccaagtacagctgcctgtgaagaaggggtggggctagatcatgcatcagaaacctgctcttgtgaaatcaggggctgtcctgtaggctgtgtgactggaagccagcagcctcagcctctctggccctaaaaaagcaatttgcacacggctgtccctaattctagtcagccaagtaaccctccctcggcacccccacctaaacatctgtagtcagccttgggtgttattcatggaaagtccactgcatgcgggtcagcactgctgtccatcggcttcaccctgaccccttctggcaggtgtggatgagagtagagcagagctcatggggatgagttaccccaatcctattaagcctccctatccggggcactagtcagacactccagttttacactctttcctagaaaaacaaaacccaaccttgtgccctctgggttctctaatttagcagctactatctgtctgtttttggagtgacaccctgtgcagtttaggatttcagaagctgtcctgcatagaggcagaagggaaaacagcaggtatcttgttaacattctctatggggcaaggcagatgtgcccaagctggaggaaacctgcacaccctccaggctagttatccaaggcttgggaggtttccctcggccttctcctaaggccttggcaggaccctgccaccctaaaatcaactgctgattgcctttttagatttaaatgattaagctctgcttatgggaatcttcttctcttttattttgttaagaaacaaacaacaacaacaaaacccacaccaattcttagcaaaggggaatatcgaattcagattttgaaaaaataagtcatcatgcttcctaaaataagacagcttctccctctaactgctctctctgctctggtattctatctaatcataaacccagctttattattcatttcaactcctgccaaagacatgaggtcggagtcagaggaactccccttaccaccgccaccatcatcatggccagcatcctcgtaagtttatagaaagatgccagagaacctttcctatccatctgcagccctgcttggcccttgcctcagtgaatttaccactatcataatcacagtgtgcagagtgtgttaaattaagaacagaatccacagtacgcaatgcacagaaaagcctgccttctgctgcagagaacttgaaactgtgcctaaaatttatagtaccgtaaacatctcagggcctcgagtgataagtatggctggatttccgttaactatagaaatccaggcagggagatcctcccagggagttgcaagttctaagatgaacttcttgaagattgttcccagatttgtgcatgggatacatgtacagcagacagttgtaaggaggtccacggtcatggaaaagaggatatgtttctatatgccaccaagtgggaaaaatggaagtgagggaaaatatttgattaatcaaaaaattttagtttggatacctgctttcatagtaattgttgctgtgtcattaaacatacagttgcttaggaaaagagaaggaaataggtgactttctaattttagagttaggctggaactgagtggttgctaaattcaactgccctgacaatgtggggatttcctgtccattagcagcgattgctatttgacatatgtttctggtgcccattaatctgccctgtaatgggtcagaggcaaaaatgggggattcagaggtactaggtggctctcttaatttaatagaactcaatgctaaggacgcctctatttgttaataagtaatcaagtcattggctactttctgctaaacactagactatgatagtgaccttagaccccgggcattctaaaccaggctggcaggagggtggtggtggaggtgatgtgaggtaagcctcctagaggaactgtcatccaaacaatctgaaaattgaaacattattaaaggcagcactaagggtggtatgttggagttggggcaggagcacttaaggcagaaggaacagcaggtgtcactgcctgcagttgagaaagggggtggaattctcaaggccttagaccccagagaacaggactgggcaagagctgacattcaagggaggaacagcatgtacagagcccaaagtcccagccactttctgttggatactgagcaataggaattcagtaaaggactttcaagaagaagtgatgtgatcagatccacctgtgggaaagatgcctttagctgcttcatggagaaatgactggagaggaggccttccttagtgttgcagaggcaaagtaaagaaaatgctgctgcagtgacccagcaaagaggtgatggcggaggaatcaggctgtgacaagggaagaagaggctggctcaagtgtgtctcgactgcacagacttacacagcgaggtggggccaggggctgcatttttgtctgagaatagtatttccttagctttctagagcttacagtgtctttttgtttatgttatctcatttgaccttcctaaacctgtgagataacaggtcaaatgtccttatgtcattcccatttttatagaagatgaaactgaggttgagcaattagtcaacagacacagactcgcaggccctcttcattctaaagcaagggtccaaaaccttttttctataaagggccagagagtaaataatttaggctttgtgagccaggcagtctgttgcagctacgcagtccttggttattatagtgcaaaaacagccataggcagcatgtacagaaatgagcataaccatgctccaacaaaactttatttacaggcactaatgtttaaatttcaggtaattttcacatgtcacaaaatatcacttttctttaaccacttaaaagtataaaagccattcttagtttgcaggcagtacagaaacagtttcagcccatgggctgtcatttgttgacccctattcaagagggtctgtcacagaagactcctgcttgcctgaaatttacgagtgcatgtaaatgttggaattaacaggtgtgcctgttttctcttatgctgtctttcatcttcaggaacagccaggaagacgctgcacttcgagatttccaaggaaggcagtgacctgtcagtggtggagcgtgcagaagtctggctcttcctaaaagtccccaaggccaacaggaccaggaccaaagtcaccatccgcctcttccagcagcagaagcacccgcagggcagcttggacacaggggaagaggccgaggaagtgggcttaaagggggagaggagtgaactgttgctctctgaaaaagtagtagacgctcggaagagcacctggcatgtcttccctgtctccagcagcatccagcggttgctggaccagggcaagagctccctggacgttcggattgcctgtgagcagtgccaggagagtggcgccagcttggttctcctgggcaagaagaagaagaaagaagaggagggggaagggaaaaagaagggcggaggtgaaggtggggcaggagcagatgaggaaaaggagcagtcgcacagacctttcctcatgctgcaggcccggcagtctgaagaccaccctcatcgccggcgtcggcggggcttggagtgtgatggcaaggtcaacatctgctgtaagaaacagttctttgtcagtttcaaggacatcggctggaatgactggatcattgctccctctggctatcatgccaactactgcgagggtgagtgcccgagccatatagcaggcacgtccgggtcctcactgtccttccactcaacagtcatcaaccactaccgcatgcggggccatagcccctttgccaacctcaaatcgtgctgtgtgcccaccaagctgagacccatgtccatgttgtactatgatgatggtcaaaacatcatcaaaaaggacattcagaacatgatcgtggaggagtgtgggtgctcatagagttgcccagcccagggggaaagggagcaagagttgtccagagaagacagtggcaaaatgaagaaatttttaaggtttctgagttaaccagaaaaatagaaattaaaaacaaaacaaaaaaaaaaacaaaaaaaaacaaaagtaaattaaaaacaaaacctgatgaaacagatgaaggaagatgtggaaaaaatccttagccagggctcagagatgaagcagtgaaagagacaggaattgggagggaaagggagaatggtgtaccctttatttcttctgaaatcacactgatgacatcagttgtttaaacggggtattgtcctttccccccttgaggttcccttgtgagccttgaatcaaccaatctagtctgcagtagtgtggactagaacaacccaaatagcatctagaaagccatgagtttgaaagggcccatcacaggcactttcctacccaattacccaggtcataaggtatgtctgtgtgacacttatctctgtgtatatcagcatacacacacacacacacacacacacacacacacacaggcatttccacacattacatatatacacatactggtaaaagaacaatcgtgtgcaggtggtcacacttcctttttctgtaccacttttgcaacaaaacaaaacaaacaacattaaaaaattgagaacaagtatggaaagaatgaaagatcaaggaaaaaagaataccaagttacatttcgttaaggtgcttatgatcttagaactatgcaacctaataggtttgaaactgtttacctgagagagaacaaaaagagagacttttttgtattggaagtaatctgattaatttttattttcttcaaggagagatacttgaaaggaatatgtttgtccatctgttggatccaaacatttctatattttgtaaatgttgttgttgttttttttttaatcgtttactatttgcactacaatggtgtttgacctgtctaatccttatttaacaagtattttctttggttgggggtgggggtggggtttaagagctgcacttaatgtgagctataaaagaactgctacagcacacaaaatagctatttttattattataattataattattattattattttgtaccttaaaaaatagacacatacaccaaagacatttgtgtgagcctttaaacagtctgtctgtggttggtatcattcaccatcaatgagtcaggggttgggattcaaggttgagtagtgtggattgtgttcaggcttaaaagacctgagaagtttggtttttgactccttttacatccatgaaacaggacatttcatactggatgtacagtagttgtacactgttggatatcaagttcaatcaaattcatggaactacatgcttgtatgtgtatatatacattgcttgtgcatatgcatatctgtatgtatatatacatgtattgtaccatgtccatacacattttaagcacttcaggctgtcattttttaatgttcttaaagcaatgaatgtttgtgtgcaaaacacagtatttttaagaaggataggctatagtttttgcttttactctgaactaggtgggcgcatttcaaaaattcggatgggaaaaagcctggaaattccagtgaatattcagcaaggccctctttcattgtacagggatcaaatttcctcctcttttttgtgccccctcccacttctacaagttatcccctgtggggaaaacaggatgataatcaaaactctgggctgatgtttttccaacttagtgtctattggaatcaatcttaaatcagaagctttttcagaaaaataatatttaggccagaattagagttgagtgtattttttaaaaatgattaaggcttggttgtgagaaatattacctgtaccagctgggaaaaataatgtcatcactaactaaaagataattaatttgagagaaagtgttaagagagggagagtaaggaagagaacagttaagaggaggcagaggtgagggcagtagtaaaaatctctaaaattttaatttacagccaaaattcttcatgtgtaaatttgtattgattcagatgcagaaatgaaaaaaaaacacctttgttttataaatatcaaagtacatgcttaaagccaagtttttatctagtttattctagtacttagcttgcctggaatagctaataaattattcatgtatgtgcttttgaaaatccagagccctatttttacacacttgtgtgaagttggcaaacattttgaaaaatggaaaaaagtttctaataattgggaacaattacattaattaatattttgtaaaatattgaagcttttagccctatgtcaatttgtagattaaaataaattaattataggaaaggaagataacagtgagaaaccaaacattacaaaaggtggtttagctctccttgaaaaatatactaagttggtatactat

SEQ ID NO: 17397 - DNA, 86639 bp, Human
agtagtgtgatctcggctcactgcaatctccgcctcccggctcaagcgattctcctgcctcagcctcccgagtagctgggaccacaggtgcgcaccaaccatgcttggctaatttttaaatttttttagtagagatggggttttgccatgtgtgccaggctggttttgaactcctggcctcatgtgatccgccggccttggcttcccaaagtgttgggattacaggcgtaagccagcacacctggccccaatcctcctttagctcttaagtgggctctttgcctagatctagaaaccaaactgacactgggcagattagcaagagaaaagcatacaagtgttattagttttacatgcgcatggggatctttaccagagtgaagtctagagaagtggccaaagcaagatgcttttatactttttagacaaaggatgacaaatttgagaagaaatggcaggacaaaggggatctggctagggcagtaaattctaggggattcactaggagataatatgaggggcataaacttagtggaagacagggttaagtatatttattcaggtccattgcagtccccaattcttagtctcaggtgacaagggctattttcttgccctggtacagtgagggtaccgctcctagaggaatctttatggcttgctgaatgcagaaagaagcatatctgtttgccttttcttgtatctttttttaaaattatattatttatttatttatttatttatttatttatttatttattttagagttgaggtctcactctgtcacccaggctggggtgtagtagtgtgatcatatctcactgtaacctcaaactcttgggctcaagcaaccctcccccttcagcctcccaaagtgctaggattacaggtatgagccactgcacctggcccagttagccctttctgaggccactatttttccaatgttgtccactcaaaatggtcaatataccaatccagcatattttgggatggcccatacttcactccttcagggagaaggaaggtttcatggaagaagtgttcaccaagttgcatcctgaaggataaagaggtaataattagtgttacagagcgctcaggcttcatgagcgaggtggcatttgaggggttaagagagagtctggcatggctggaggaggccatcacccagggactggagcactaggctaggagtttggactcagccctgagactagtggggagccatggagggttttatgcaggtggtggctgggtctggcttgcttttgagaacagctacgctggccagcagtgtgttgggtccactgcagaggctaacctttgtcattaccaggcggtcagcctgaagagcaaggggcatgggcagggctaggcagtcttgagatcaggcctatgtaatttgggggaaactggctgagcgcagtggctcacgcctgtaatcctagcattttgggaggccgaggcgggtggatcatctgaggtcaggagttcgagaccagcctggccaacatggcgaaaccctgtctctactaaaaatacaaaaattagctgggtgtgatggcggccgcctataatcccagctacttgggaggcttaggcaggagaatcacttgcacccgggttgggtgcggtggcgcggagtggagcggaggttgcagtgagtcaagatcgcgccactgcactccagcctgcgtgaaagagcgaaactccgtcaaaaaaaaaaattgggagaaacgactgaacttctctgaggttcttgtctctaaactagatgttaccaccttatgaatttactctgaggatcagaggcatgcaaagtacccagtacagagaagggcgtaaataagtcacttcctttcccttctgtactttgaacaaagctgagctgcctttggtctccacagcaaccctgtaaatgattgttcccgctttgcagccggccgcagccttgggctgtttgcgcctgcgcagtgggtgctgagtatgtcgaccgcggcgccgcggacgctgctggagtcgcctggcaacgatgtcgcctggcaactgaataggttggccagtggcgcgggctactggaagcagaaagggctgcggaggcaggtgaggcggcggtggtgggctaggggcccggggacaggggggcccagtgacccacccagtcccattcacacggggccgtgtccccacactcaaaatcacggtcttttgtctccggccggactctcccagcccacgccgcttagaagaaggcaggcccctgtctccagcacccaccgttcctgtgaggggagctcaactcaaacatggccacgtccctcccagtccggcccccacttctaccgttgtcatctggtgtcccgcgtgagcatctggcttaccttttactggagtagattcctacaggcctgtggcctgtccattctactaaccatgataataaccgtaataataaccacagccaacatatctgaagccctggtatgccaggcttacgtgtattcgttaatatgacaactctgggaggcagggaaggaggtactgttatcatctcccctttgaagctgcagaaagacacagatagaggaagtaacttgccaaggtcacccaggcctgaatctggagccagttcttaactactaacctacactgcccatagttgctgaaagtgtgtgtgtgtgtcggcaataaaagttaatcactttttttttttttttttttttgagacggagtcttgctttgtcgccaggctggagtgcagtggcgcgatcttggcttactggaacctccgcctccctgattcaagcgattctcctgcctcagcctcccgagtagctgggactacaggcatgcgccatcacgcccagctaatttttgtatttttagtagagacggggtttcaccatgttggccaggatggtctcgatctcttgaccttgtgatccgcctgcctcgggcctcccaaagtgctgggattacaggtgtgagccactgcgcgtggccataaatcaccttttaacattaattccttttcatggatgtgtcagaagcatctgaatatgggttcctggcagtgaatgagctagacccagatttgaacactggcttctagtcttaccagtttcatggcctccagtaagctccttggccagaacctcagtttcctcatttgtaaaatgtggataataccagccccctccttatggggtagttgaattggatactacttattgctggcacaaggtaagcactaaacagagtgaccaacttggagtttgcttgtttggtttgttttgtcctttaatgcctttgactgaagatccagatgaaagtatcagtggtttcttctgtgaagcactattgtgtgggagggctctggagtttgcagtttgggctgctacttacttaccttcactgggactttgagcaaatctcttcattgctctcagcctcagtttgctcatctgtaaaatgaaagtaaaaatacccattttcctgccctcacagtttggaggatcaaatgagaagtagcttttaaatcataatagaaataatgacagctttttggtctcttttagtgagtggtttctgcagagcttcatttggaaaggcctctgtagttggggaaagatggcccattcccagaactccttggagcttcccattaacatcaatgccacccagattaccactgcctatggccatcgggccctgcccaagctgaaggaggagctgcagtcagaggacctccagacgaggcagaaagccctcatggccctgtgtgacctcatgcatgaccccgagtgtatctacaaggccatgaacataggtgagcgtgacacagcacaggtgaccatgactggggtcctagcatggcttcaggcactgggtagaacttcagtaataagggttgctattgtttgagcctgactccaggccagttccactataggtgcggtgcccgggttctttttaaaaaatgtttatttattgagggagggtcttgccatctcccagactagagtgcagtggcagaatcatagctcactgtaaccttgaaatcttggggtcaagagatcctcctgcttcagcttcctgagtaactaggactacaagtaccaccatggctgactaatttcttattattatttttttataaacaagatcttgctgtgttgcccaggctgttcttgaactcttggcctcaattgattctcccaggtcagcctccaaagttttgggattatatgtgtgagccatcacacccagcctggattatcttaatccttagaaaggccacctacaggggagagtccattctcaacccacagataagaaaagcatggttcagagaaggattgtaagtctagggttgcccaataaataaataaagctagatttgtatttatttatttatttattttttgagatggcatctcgctctcttgcccaggctgaagtgcaatggcacgatcttggctcactgaaacctccgcctcttgggttcaagtgattctcctgcctcagcctcctgagtagctgggactacaggcacctgccatcatgcctggctaatattttgtatttttgtagagatggggtttcaccatgttggccaggctggtcttgaactcctgatctcaggtgatccgcttgccttggcctcccaaagtgctgggattacaggcgtaagccaccatacctggccaaagctggatttttatttgctaaatctggcatccgtaggtgtaacccactcaaagtcatatgactagtttgacacagggttataatttgaccccatatctctcctgaggtcaaagaaatggcaaaggccattttcttaacctcatgacagactttgtgagaagtcactggtaggaagtgtgcagggagaatcacaaggagggttggatgagacatgagcctcttcagtgactctgaaatgctgcataaccaacatgattccccagtgccccaaagcagcagaaactctggtacattcctgccccaactggcccacttattgacttctgggttggttggtttctgagactggcaaaaattcaagggttggtttgtttgttttttttttttttctaggctgtatggagaacctgaaagctttgctgaaggatagcaacagtatggtgcgcataaagaccaccgaggtgctccacatcacggcaagccatagcgtgggcaggtgggatgctgttctggaaaccagtgtgacgcttgcgagccgcacttctcccctgggtggatgcccttgagctgcttagagtgctctggagtgttgtctgccgcatcagtttttgcaggggcttctatttagccagagcaggactctttgtggggtggttttggttgcctctgtgtggatcttatggggccctctgttccagactgatttttatttattttatgttagttccaagctctgagcgctctctctctctctctttcttttctttcttttttgagacagtctctcactctgtcacccaggctggagtacggtgacacgatctcagctcactgcagcccctgcctctttgggttcaagcaattcttgtgcctcagcctcctgagtagctgggactacaggcatgtgtcatcacgctcagctaatttttgtatttttagtagagactggtttcaccacgttggccagcctggtttcaaattcctggcctcaagtgatctgcctgcctcggcctcctaaaatgctgggattacaggcatgagccactgcacctagctgagcttcccactttcaaggtgggaagaaagttcagatcttacttctgcaacaattttgccacttcttagctttttacagagagcccagttccccaacccagatccccacaggggctgtggctttggctcctgtccctgtgagggtgttaaaataacatcctcaaagtgagtatctggtctggtggcctcacttcctgttcatgatggctgagttcttggtttctggcacctggaagtgtccttttcctgtgtaagcacagcttcactttttacacttaaaaaaaattttatagagtattttagttaggtgttggggcaacagggtgagggtggttggaggtgctttcccacatcagctgggttcaccctcttgactggcgatcagtagttttactttgtattagaaacaaaaccccagtgttacagctcttttagaatttttctagcaggttttccagttttcactggaacctctccccaccagcccccgtccccaccccccaaaaaaacagaaccccacatcacaaacacccccaagccctggcccaggtctttcggataaagggggccactgcccagtgtgcacaggcccagaaggaagaaaagacaagaaaggcaaggtgctgactgccttgggggttgtttggtgtaaacaggcagccattcagagaggcttcaaatcggttcaggatttgaagggaaaaaaaacagcaggaaaggtgacttgactcctgtgtgcccctaacctttacttagagcccatcaagctctaagtagctgccctgaactgcccaggttgaaactcttctgcctcttctacccacagaagtagtgacaggaagggggaatgaggatagcagccctgggcttggcatcttgtcaccttgaggagttaatttgcatgacaccccacggacaagagagcttcctggcagcctgttccctgccctcttgcttgcctctggtgaggaggcacacaggccaacatggtgaaaccagtctctactaaaaatacaaaaattagctgagcatgatgacacatgcctgtagtcccagctactcaggaggctgaggcacaagaattgcttgaacccagagaggcagaggctgcagggcatctcataaaacccaaagtcactcagccctgctagtccccaagctctcgctgccttggtggctgatcctgtgtgcagccccggccctgtgtgaaccgtgcatgtgtgtgtggaggtggtgccatggctagcaccctaattcacatgctttgtaccaagaagggcaggctggcactgcagacagaccagtgaagtagggacacaagccccagccttttggggggcccactctttcctgctctgtgatctgggcaacaatcctaatcccagcctcactctgcagatcttagatgacccaggcaaggtgctttaaaaggttaggggcacacaggagtcaagtcacctttcttgctggtttttcctccctacttttctggacctgatgtggacattaggtagtaatccccagttaggggggacagatgctgagaggacaggtccctgaagcctgagcaattatcaggttagtgcaaaagtaattgcagttttgcaattaaaagtagtggtaaaaaccgcaattacttttgcatcaacctacttataatgaatggtagtaaggatttgtttagcagcacctagagtgcctaagccaggggtcctggctgtgcccacattagcaaggcaggaagacatggtgaagtgaccatccctgaccagggacctgataatggcctggcccgtgcactccttcagcgttctcagaaatgtggccaacttctaaatttcccttgaggtcagtggtgatcttataaccaatgtcaatagctttcagagcccatcaagctctaagtagctgccctgaactgcccaggttgaaactcttctgcctcttctacccacagaagtagtgacaggaagggggaatgaggatagcagccctgggcttggcatcttgtcaccttgaggagttaatttgcatgacatcccacggacaagagagcttcctggcagcctgttccctgccctcttgcttgcctctggtgaggaggcacacaggcaaacacaactgactatcaaagcatgagagacatggagtgggtgactagacacggaccaaggaagcccccgtggtcagggaagacccctgcaacttgtgtgtccaacggtgactttctttttccagacgattcaaaacacaccataagtgaaaataaataaataaataaaataaataaaatttatttttatttataataaatgccgcagtggcacagctggttgggcacttcctgtgggcacttggctgaggggtttgcacatgcattctcattcattcctgaacccagccctcagagacgtgacctcagaaggcctctttcagatgcattcaggcccagcagtcagttggttaatcaaaagaaatgattacaaagcaaggaactgaagaaatggtttcctttaaatggttcattttaacccaaaacacaaatgataaggcattcatcaatccccatgtgggacccaggctttttgtcggatatgagaccactggttggtgtttcctatcatattttttttgcttaaaccatactcataacatcgtctgatttgcagctttggtttttttaaagtagagcaagaactcaaagacattaatgaaataacctgtatgcaaaacccttctagaatctttttatttattaatttatatttatttatttatttacttatttgagacagagtctcgctctgtcacccaggctggagcgcagttgtgcgttcttggctcactgcaagctccacctcccgggttcacaccattctcctgcctcagcctccaaagtagctgggactacaggcgcccgccaccacacccagctaatttttttttttttttttttttttttgtatttttagtacaggcggggtttcactgtgttagccaggatggtctcgatctcctgacctagtgatccgcccaccttggccttccaaagtgctgggattacaggcgtgagccaccgcgcctggcctagaatctttttattttttaagagacaaggtctagctctgtcatccatgctggagtttagtggcatgatcctagctcactgtagccttaaactcctaggctcaaacgatcctcccaccttagcctactgagtaggtgggaacacaggcacacaccaccatgcctggctaacttttaacattttagtagggactgggtctcaccatgttgcccaggctggtcttgaactcctggcccaagtgattctaccaccttagtctcccaaagcactgggattaggtgtgagctatctagaatcttttacaatcatctcttttttttgtcttttttgagacagtctcattctgtcacccaggctggagggcagtggtgcagttgcaggtcactgcaacctctgcttcctgggctcaagtgatcttgtgcctcagccttctgagtagctgggattacaggcatgtgccaccaagcttggttgattttttgtatttttagtagagacggggttttgccatgttggccaggctggtctcgaactcctgacctcaagtcatctatccgcctaggtctcctaaggtgctgggattacaagtgtgagccactgcgcccagccaatcatctccttttttttttttttttttttttttggttgggagttggggctcaattttgagtccttccaaagcattcaactttttctcataaacaaatttgaaaaagaaaatcctcttctcatctaattggcttgcctaatatttactgaacttatataatgataacaacaagcataactggtgtacatagatgtggaggcaagggagaccagaagaacaaggggccaaggtgggctgggcctgctgagctcgctcccctggaggttcaggtgagatggatcacgcacctgtagcctttgtctgctcccacaaagccagaggaatgtggtctaccccagatagcatggatcagactccagcagggaccctgactcttctaatttgagcctctcagggcatggtctcacttatgtcactgtccaccctcccttccctagatacgcctttctagagcacgacatcgtccttgccctgtccttcctgctgaatgaccccagcccagtctgccgggggaacctgtacaaggcatacatgcagctggtccaggtgcctagaggtaggcttgcgtcctgcacacagatctgtcgggcactcaagttgtccgtcggtctcctctccaggtcacatatgtaccagggtgtagatcgtccactttttattaaattacaacatacatattagaaaagcacatatccgctgggtgtggtggctcacacctgtaatcccagcactttgggaggccgaggcaggcagatcacgaagtcaggagttcgacaccagcctggccaatatggtgaaaccctgtctctactaaaaatacaaaaattagctgggcatggtggtgggcacctgtaatcccagctacttgggaggctgaggcagaagaatcgcttgaacctgggaggcggaggttgcagtgagccaagattgcaccactgcactctagcccgggcgacagtgcgagactctgtcttaagacaaaaaaaaagaaagaaaaaagaaaagcacatatcctaaatgaacatttggtcaagttgttttcagtgaacatgtggtgtaactgccaccccaatcaagacatgtagagagtatttaccacctctccagaaacttcccacatgcccatactgggtattacccttaccaatgataaatggtatcttcaatttataagaccatagatgatgccccttttaaaactttacataaatggaaacatccagcttgtaatatcttgcttgtagctacttttgcttaacgttttatttctgagatttacgtgtgggatgtattactgatttttgcttgtttatgctggagtatggtatttacactatgtgagtatacaacagtttacttacccattccgttgctgacggacatctgaattgtttctagcttatggctaccaagaatagagtggctatgaacacccttataaatgtcttttgatggacatgtatatgcatttattttgaaacatacctaagaagagaatggctggcctgggtaagattatgttcagcttttagaaggtactacccaatggttttctaaaatacttgcatctgcacatgccatgtcccagctacccaagaggctaaagcaggtgtattgcttgagcctaggagttctaggctgtagtgccctacgccagtcgggtgtccgcactgtttggcatcaatatggcgacctcccgagatggggggaccaccagattgcctaaggaggggtgaaccagcccagatcagaaacaaagcaggtcaaaactcctgtgccgatcagtaatgggactgcacctatgaataaccactgcactccagcctgagcaacatagcaagatcctgtctctaaaaaaaatgaataaaatacttgtaccaatttatacttccactagcagtatatgagagttccaggtgatttatatcctcattaatcatagaagggttttttctgtctttttattttagctatttcggtgggtgtgtagtagtatctcattttggttttaatttatatatttccctgatgattaaaaggggatgtcctgtaaatgttttcttttgtgaaataccatagcacacatttaagggataaagaaggcccgtcccagaggcaatgttgcatacagttcctgtcccactggccctgctgactagatggggagtccagggtaacagctacccgataccacggctcgagagttaagatttatggcagattgatacctgcctggtcgcatgatgcaatgagtatttttagacgagggaattatttcaagggccatgataggaggccttgaagcggataccttagctcaaggtggacaaacagatattgtagcccaggagtcagatgaacctgggttccctctgcccttcccctcactccccgtgtgccctggacaggttatttcccatgtctaaagtacctgcctcagaggccagaaatgaggttgaagtggaaacactggcctggtgtatagctcagcgtcctgcccaaggatggagtgcaaacattcaaggccaggcgtgagcattccctgggttaaggctcagagagaaatgactacgggatcaggtgcagataggcaggcccaacagagcagagcctgtgagggtctaggattgttgcttggctcctgaagcacatcttcttccagctgatctggcctgggagttgagcacattaggcctgtggttttttaaaaacaccaccgtgcccctggtcctctcccaggccaccaggagcagtctctgggggtggggccctgcacacatatttctgaaaatgcaccttgaatgacagtcatgcatgccccagggttgagagcccctggggtattagggtgatccatgggggaccagtgctgggttgagctaaattaatgccctgtgctcaccatgcaggaacctgaggaataagcgagggtctagtcccctcattcttggagtgtggagacaggggacttgctgctctcaaccagtcctcttacaatgattgtgacctatttaaagcattcagagaagtacagagatggtgataaggaacattggataccaccagccagctttgccaaatctttacattctatatccatattttatacttgcttgaaatttttatttgaagaaatcataggtacagtccaagcaccctgtgaacctccccccacccagagcactcttcctcctgcctttccttgagctactaataatctggtgactatgtccccaaaatgcatatctttatattttaccacagatataattacatatggacgatatataatcttgttttgcatgttttaaaactatgtaagtggatcttgctgtatgtatccctctgttacttccaaaaccttaaaaaacctaaataacattagagatttatagaaattttgagatgaatccatgttgcgccactggctgtatttcattcatttccatcactgcacactgttccggtgtttgaatgtatcatgatacactcacccatcccaggctggcaggcttgttggttgtttgtactcctgtactgcagaaggactgtgccatggctgttcctgcccagggcttcctggtaccctggaaggagagtcccctagagcatctgccagggagggcatcgctgggccagggagaatgtgtttgccttcagctttgctggatattgcaactgcttccagcccagcctctggcctccagagagcccggggcatatcccagcctgatggatgtgctatggtgtttcactgtgatatggctttactgtccctgtcctggtgagaggaaacatcttccctctgcctgacacctcatcagattcctctcctgcccagtgcctctggagagagtgtgttcattctgttgccgagttgtttttccatttcttattgatttgaaggagtgtgtaatttatcctggattccagccctttgtcggttacctacattgcaaatatcatttcaaaccaggctgttttcttggcttctcactgtgcctttgttgattcactggtgcagcagtctttctttccttctttccttctttctctttctttctttctttctttctttctttctttctttctttctttctttctttctttccttctttctttctcttttctttttcttttttttttgagacagagtctcactctgtcgcccaggctggagtgcactggcgcagtctcagctcactgcaacctccacctcccgggttcatgccattctcctgcctcagcctcccgagtagctgggactacaggcacccgccaccatgcccggctgattttttgtatttttagtagaaacggggtttcaccgtgttagccaggatggtctcgatctcctgacctcatgatccgcctgcctcggcctcccaaagtgctgggattaccggcgtgagccaccatgcccggccttctttttctttttctttctttctttctttctttctttctttctttctttctttctttctttctttctttctttctttctttttctttctctttctttctctcccttccctttctttctttccttcttttccttcctttctttctctttctctctttgtctctttctctttcttcctctctctttctttctccttctttccttccttccttccttcttttctgagatgcagtctcactctgtcacccaggctgtactgtagtggcatggtctcagctcactgcaaactccacctcccaggttcaagtgattctcctgcctcagcctcccgagtagctgggactacaggcgtgtgccaccatgcccagctaatttttgtatttgtagtagagacggggtttcactatgttgaccaggctggtcttgaactcctgacctcacgatcctcctgcctcggcctcccaaagtgctgggattacaggcgtgagccaccatgcccagccttagcagtttttcatttgaataatgaagtcaatttcatgattttttttccctctggccttttttttttttgagtgccgtgtaagataatctttctttaccctgactcatgaagatattctgccatattttcttctaaaatgtacgagtttgcttttccccatctcctccccttgtctttttctgccatccaccaacactgggtgcaccattaggagtagggggctgtggtactgacaagctcacgaacagaagcctcagtgagggtcagggtggggagcctcggcccttcatcacggggtttactgagtgctgctcatgatctgtgaagggcccagaagggaggcctgggacaccgggtatgcaggggacagttggacaatgagcagagggaggaagggaaggaggcaatgtggcagacgcccaggagatctgttctgggggtacactgagtgtcgtggcctctggattagcgagtgtgactgtgccccaggtggtgtccttcatgggcctctgggtggggggcctggggggtggcgagggcatctatttcagtggctctgttcttaccagcgtgtgaccttgggcagtaccatcacctgtgggaacgtgggtgtcacctgtgtggcttagctgggacagtctctgagcagggcttagctggctcccagtgaatgctggtggccattggtatggtttcctatcagtggccacactggaaggccgttttcaccatggcaccctctgcacctggcagggcgcctggcatgtggctagcgctcaacaaatattggctgtttagtaggttttatgtcatactttaaaggatcaattgctggttgtcttcttgctacagttcacttacctgcttgctcattccttcattcatttgacagtatgtgttgggcccctgttttgttctggccaccgtgcctcagtttcttcccctgtgtcatgggtgtctgggagagtggtttcagaatccttgctctggccaagtctgacttgcatgatttcccagagtaaccaggagggggcaccccaggactgaggattgtcccaagtgggccctggccctgcaggggccctgggcccaagctgctgcgctcacccacacgcattcctctaagttccttccaggctggctactcatgcgccgtggtggtgctgtgtcaggagaggagaaaataggattgtagagacagatgtcacacacaggctgccagcccaggctccctgccagctgggccctgagtgatgcacagggtctgcttctgctccccagcccgatgagagggggaggcctggcaggccaggaaccaagaggccagagtgtccctatcggtgaccatcattcctgctaagtccaggaatggagtagaaccccatgagaaaacaggtttcatttttgtgggagagagagttctgtggctgaaattgacaattcttctctaaccagattttggggtgcagttgaacagctcagggtcccccggaagtatccctctaccatcccactggtcctgactgggcacacctgtgagtctgttctggccctgcctccagtctccctctccttgtgccaggctctgagaccccagcccagctttagcagcagcatgatggggcctgttctgaccctgactccacacgtgtgcagcccgggggtggagatggatgaccctcccagcccggaggagagcaccagcccgagaggaggagggaggcagcaaggatgtgcctgggccctgcctctggaaattggctccgtgaccttggaaaggagaactgggcttgggaaggggagggtgccgcgggtgaaatgtctggatgcagtttgatccaagtcatttgggggttcaggggacatccctggagtcatagcatctaagctagggagaaatctgggggtctacagctataccacccagaatgcacccaatgtcatctgaaccccaggtacgtgggctgctggagaagcaaagtaggtgctcccactgcagtgagccgtatgtctcattccaggctagtggccttgggtgggccaccactgcaccctgtccctcttcagcagccacccgtggacacccagcttccttcgatggacccagagcagcctcctcctcctcctccccttgatgccacagggtgaggggtggaggccagctgccctagaggagcaggcccttttctgtcttgcctgccctcagggcagggtgcaccagaaccccaggcacatcctcagcctgacagtctttggtgggtagttgtaccccattcctggacttagcaggaatgatggtcactgatagggacactctggcctcttggttcccggcctgtcaggcatccccatctcgtcaggctcatctgggtgaggtgagctcatctagggcgaggtccagcctcagtgttgcctcaagtcctcatggtgcagtgcagcccttcctggcactgtcccctgagccagatggaccatttgttctggagggctgacgttggaagtagggtgccagggcctgttgccactgtggggatctggggaatgtggacagagtaaaacccctcaggtcctggcctggtggggtcacattgtgtgatgctgataagtcatcgcctctcctggtctctgcttccacttctgtaggatggaatcaagcatcttggcctcccatgagtgtgccccccagtgagcagtcactgaggagagctgggattatcgtgaccactgttgttgacccattgcaccaccagggtgaccacgtgggctataggtgaggatggcaatatcccacagggagccacatgatggtgggtcctgggaaaggaggctggggctgcgtgaagtaggacaaggcgggattagtcacctgcagtgggcagggctggcccagccatccccaggtcctccccttcaggcaccctgccacctactctagcctcctctcaccagcaaccttggtgagtcctggtgcttacctcccgttggctaagactcctggaccatcccagctcagcatgcgccttctccatggggcattgtttggaggaatgaggtgggtcagaggcgctggccttgagctgctcaatggagtttccaacaccccttcccactcgaccctggagccctgacagatggaatgcagggaaggaggagacttccaagaagctgcccaggtgactttgagctgtgaggatggggaaggacatgctaggcaaagggatcattgggggcaagagcggaacaaggcaggctcaggaggagaaccagtgcaggtgaactgcagggggggacggggccagagaggtcgacagcgcctgaggtttctctgcagcctatgggggaactggagactcctgactaggttctgggaaccgggagaaacctccctccagggaaggcctcctctgatctttgcacacattaggaagggaggctcaatccctttctccctttagccatgtatttttagattaaagatgctcacggcgaaattactgctcttttcacagttggcattaaaagcacaaaataagtctcaacgattttaagtcacacgttatttcttcagaaacaaaagcccctctgggttctggctgtttggtgacgtaggaaggtgtgaagggagtccctgcgtgggcttaggagtagggatggggcggtgacagcaccagggctgcgtgcgtatctgcgcgtgtgtgcatgtgcttgtgtgcatgcatgcgtgtgtgtgcctgccgaccccccactttgcttgaggtcctgctttgaggaggaggctgcagggtggttctgtgctgctccctgtaggcttccatcctgtgcaggtgccaagccaggcaaggactccagcaggaggaaagatcagcgtctctgcccctgcagtgggagcaacagctccctggcctggtgaatcctggcttgactgctccctgacctcaggcacctttcctcatctgtaaaatgggcacctctggcaacctgctgaggtggggtgttacataaaatcattagtaaggagcctggctccgtgcctggttcgcagcaggccctcggtgaatgcactccgttgacttctgatcggcacttttccactatatccagatacctctaaccacacaagccagtcagcgagcactgcatgctcagggacccctcctctccaaaaccctacaaggtttgccctacactactgggggcacaggaaccctccaggccctcagggcacctcttccactctgcaggatgactctgacattggctgaggtgtccacatggtgggaggggtccagggtatggcacagcctgggtcagtgttgggtggggtcttgggggcagcgggaggggcaggagtcatcatcacccccagacctccacaccaggactgcatggacctggcaggtttcccctctttgcagtttctttcctctcgtgatgtttatttgtgatgttcattgcaaaatgactctacctaaatgtgtggaggtataggggtggggtttggaatatgggacctcagaatggaggtgtccccggctgcccttccagatggcaccaagtccagccacaggtcagctacacacatagcacactgggacaatgctgggctccattcagggtattttattttcttaaagtagacaacctttgactttcatccaatccccagcttctctttcccccgtacatctcttcacgtccttggctgtgattccgcacactgacctcggacacacagctactgcacagagagagggagggagatctggcaagggctccggcagtgcctctcctctccatggcgcagttcgtatttacacacggcccttggcgaacgtcctttcaacgcagttgcccataggccctgggacaggaaggcccagatcagggtcccagcagggcctccctcaggccacaacgctggctgtgccttcacaggagtcagagcatttccagccagtctcaggcgcggggcatgctgggaccaggggcaccaccccttgctccccttccttcactcagcaaagccacaaataatttactctttaaataccaagacacttagctattgttcatttgctcccaggtgaaagaaccttctttaaatatgtcgtgtttattttcttaaataaaaacaaagcagaaaaccccaccattaacaagaggacactgcagaggcttatgtacaacacgtgtcccgcgaggctggcgcaggactgccactcactccaaaatttctttggagcagagagacagatcgtccagataacaacttttacactcagcaagccagacacaaaaaagaccacctgaaaaaaaatatgttttgaaaatctgcatttaaaaaagaatactcaactgcatttgaaattttctggatttttttctgcgaaacaccacgagatttggccaaaaaaaaaaaaaaaccaaaaaacaaaaaacaaaaaaaaatgtcagagaaggaaaaccaggttttgatttataaaacatcagactagtagaagaaaagctggaatcccagctggcctagtttgaaataaatcgtgccactcgttttgttgtattggtttttgctgcatattttgaagctgttttttaaaaagagctgtgagtggctggaggtctggttagtgctgtcacccggctcctaaggtcccaggtccagaatgaaagtggtgctgagcagctgtgtgcaggccagcagggaaggtgcacagaccctgcactggtcctccctcttggtcagcggcaaggtccctaggccagagctcgggcagcgagctggccctcctccaggtgacaggggtgcagttggcctaccttgcctcagccctgctgcctatccctaacaatccaatgcagacccccaagtggagtggggccaactcaggaaggcaaagtgaaggggcaggttgggcttgtagtgaccttgtgacagcttctcaagtcttcaagagacctcgacattttagaggattttgccatctccagatgtgtgtgtgtgcatgtgtgtgtgtctatctacctagcaatctatccgtaaatatttatgtttgcagaaatgtggggccaaggaggcagaggccaaggggtgggggacattctttaggccccctgttttctgcccctggattgggcctctctagcacgcgttggggcatgacaccccgtgggtttcaccataggcaggcgggccccgggcccagctcctcagcaaaggccaatgtacttgagattgttctgtatgatgacgtctgtcaccgcgtcgaagacaaactggatgttactggtgtcggtggcgcaggtgaagtgggagtagatctccttggtctccttgttgcggttcaggtcttcaaactgccgctggatgtagacagcggcctcctcgtacgtgttctggcccttgtactcgggaaagcagatggtgagcgggatgcggcggatcttctctgccagcaggtccttcttgttcaggaagaggatgagtgaggtgttgatgaaccagttgttgttgcagatggagtcaaagaggcgcaagctctctgccatccgactctggggaaaggaaagtactggcgttaatcaggcccgcagcaggcagagacagaccctagacctgcagccctgccagaggaagcctttgctagggtctcagcccaagactggtccctgcaatggcacctccttctgctggggaagcccaggttaaatgtcttcacccacctcccacggaaatagccggcagcaccctccttgccagtggcaagtgcttggaagatgttctcttgccccttttgggtctctcctctgggtgccagtgatctcaacatatagctttggggctacagatgtgccaagcacagcctcctaaaccgctgggcacctccagctccgaggaccccccatcttcccactgcccatccacaggctgccccacacctgtacaaggaaggccatcttctgcaggagcccccgtcacatcatagctccctcaatgcaggcgctggcagccttgtgctctatctgggttctggcccagtccttcaaaactctgatccttccatgtggtaccatcggacactaggaagtctgtgagggagcagccttcacttctgtaaccaaagtctccagttcttgagagctgggaaggaaacaccagccagaggccaggctcctcccctgccctccagctgtgggcactcccaccagctgctgtggggcatctggcaccgcctctctgccgaggcaggaccctggcatcctggacagagctctcagtacatgcagaggacaggagtgtggtgggccaggaagaggcagtgaccacaacggagtgtggcgcctgtccgctcctcaattctcttctgagaatcttcgatgtgttatagccaggggtctgggcttttaagaagcatgatgctcttgtctgactccccagttcaccacttccctgcaaaatgaataaattctaacttctaaaaggagtaactacctggaatttgctgctggcaaaagctacccctgcttctaagataaactcaatgagcaaaatatcaaaaatctggaaccaatctggcttagatctgatgctttggatttaagaacttttctggccaggcgccgtggctcacacctgtaatcccagcactttaggaggctgaggcaggtggatcacaaggtcaggagttcaagaccagcctggccaacatagtgaaacttcatctctactaaaaataaaacaacaacaacaaaattagctgggcatggtggcagacacctgtaatcccagctccttgggaggctggggcaggagaatcacttgaacccgggaggtggaggttgcagtgagccgagatcatgccactgcactccagtctgggcgacgcagcgagactctgtctcaaaaaaaaaaaaaaaaaggaacttttctgactagactacatcaccagtgaccgtggtaatgcaagtggtaactgcagctggtagtgatgactcaggcacgaagcaacagcatcaccaatgactgcagtgacaatgacgctggtaaccacagctggacacgagctgccagtctgttctcacatctgcccactcctgttttacagatgaagaaactgaggcacagagaggcaggatatgtgctccaagccccacaaccaggtgctctggcttgctgctcctacagggtgggcccaaaggaggctgcctgagggcaggggtgcccaggaggatgctgcatagaaaccctgctctccagagcccctgagttctctgaggaacagctctggcagcatctgtgcagagaaaggaaggatacccagaggtacccgtcattaccctggaaccctgcactccacctggaagactgtttttccaaaccaatcttgctctttctttagaatgagcttcggaataacaggagtcctgaggagtgagcagcctcaggtctggggatgggggtgctggcctttctgcagagacaagcaacacacaagatctcatccccagcagagcagagaggagccagcgcctccgcagtgaacctggctgcacattcccaaatgtgagataagtggtggtctaggaatgtcacattctgctgagggagtaattagctctaatggattcctggaagccacatcacagaggactgtggtaacagagctgtcatttctcatagaaatgatgctgtaattgggggctatgcttctgaccccaaattttgcatcagttaaataacagatatgaccattagcacgtattattaatttactgagcaaacacttgctgagcgcgccctgagtccacatcagctctcatgccaggtgatggagcttgaggtgggagtcctggggctgcaggaatagagccaggcagggatggcagggtccttttggggtagggggcttcctccggggttgggaagggcgtgatctggccaccagcagggtatggacctgggggttcaagggtgaggggacaagcacagagtgggtgctaggcctgggtctgcctctctgagccctgatgggtcacttggggatgacagttgagatggttttaatacccagcttagcccatcacctcctgggcaggcagtggaatttaggtaagaggaggagcaggagggccacctcactgatgcggaaacagttcacgtgtactggtcatctgaagcctcagatctaaaccagactggtcctctgcagggcacctgtgtgtagggagagctcagctggcagcagtgggaggggccgatagaccacgtggaccccctctctccaaggccaaggcagccactcttcttgtccaacgccatgaaacactcctgactgtggcccccgtgagtcctggggtgagtcaagctgtcccaatgcactaggagccccttccatggtgtctaaactgcttccctgctgatgcctctcagtggaccttggggaccctggacacctctttgagcctcctgttcctgacttagaggtcatggaaactcaggtacttatctcacaaggcagctggaggtgggcacggtgcctcacagtacactcttatcaggattccgccactgcggcagcctcatcaggacagacaaacatctcccgagtgtgggcccttccctcagctcaggcccctgcttgtgcccaggactccccttgctttgcaggcatttcaggctcaggcttcctggtttcctctattccttgagacaaaccatgggaaccacactgactaatatttagtgggcaccgaggagatgatgggcctcaaataataacaaaatctctgtgtagacgcctggtttcctggtcttgtttcttggctgggccctgtctggcaggagtcaggaaagcctgcaggaggcaccaaccacatacctcacttccgggctcagacaggaagcttcagagcgtgggaagcacctgagcttgccgcctcactccatcccagcgtccctgacgcaggctgagccttcactgcacatgggctccaccctagtaggaggtgaagcttaggagatggtgggtgcccatcctgtaatctttatagaacaggaaggctataaagaaggtcagagggcccagcatgggacagtgtggtgccggcagtgtggtgctgatggaccagcaagtgaggcaggagctgcatcgtgggtttgttcctagaccagaggcctgcagctctcagagatgggggacaagacagagcgggaggctgaagaaccacagacggttacaaagtcaggaccctgaccagctgaagttgatgagaggaggccaaacctagagaagagcctcatatttgggtctgaaagatcaactgcagaggaggcagtggggaaaggtgttgccaggccagaagcccagtcttgtcctctgacctagtgcccagcctgggccccggtgcttgcctggtgacctcgggagcctgtgtcacagcggtgcctgcactcttgcagcctggagtgcagacaggtgggcaaagcggcatcctgacactcaaatcaccaccactgaaaacagagccgtctatttgaagctgtagctctggaaactgtgactcaagcatgcatatgggaagcaagaagccccagcatgccttctgctggcctccagggcctggcctcatagccctctgacctgtccatgctctgctcaccctgcaaaacatgactggctgtgcctcctgcacccatctggcctttgtgggctcccctgggtcctcctgcccttggtggatgtggctctgttctccttcctggcctggcctggcctgcatggggttttgccctccctggcctggcagggttaaacattgtcctggtgcagcccacctgtgggccactggggtagagctggatgcagctttggagtcatgtggccctgcaccatggtagtgcatcacccccttgtcctgcagtgacttcctccatcagcctgacagaccctggattcagaggagctgcctctgccaaccatgaccccatggcaagggggagggctcctcacttcacatatggggcccaaggcctcaagaggggctgactccccagggtgcagttgagagcctggtattttccaactgccacagtgtcctgttctggcaagaagccctccttgccttcacctctatggctgccaaaggcagccgcggggggcggggcggggcggggaagagggaggcagaaacacaccaccattcactgctgtgatgccagcccagggctccagtgcccatcctgctctctccagggcctgcttaccagcaagatggcgccttctaggaggctggggtttgtctgcacatttatttatataaataacacggagcagacagttcctgtgagaagcttgtgcaatggtgggaatctcactgcttggcgtcggggaatggtgaggtgatttgtaaccaggccttcagccaccaggcagctggatgcagtccctggggtggtgtggaagtcatttcctggccatttgtgagaagagagctcctgctcagacaggtccaaatagacttgccattgtggaagggactctgccccaggccgtggctttctcactacagcaggggagctgacagcccatccctaaggggcttccagcttgctggcctgcgggtctggggtatttcccctgaacgtggctgccagactgctggccagaccaggtccggcacctggaaggacattcccaggtcagcggccggggcaaggtagggagtggagaggagcctgcgcctggttagttgtgggggtggtgaggcctctcactcctgattctccaccaaggttctcctggtgacacaaaggggcagatgtccctggccatgaacacagggtctggggtttactcactgccggtgcatgctgcaccttggacaagtcatttcctttctctgggcctcagtttcctcatctgtacaatgctgggactgttgtgagaaggcacaaaggtgctgacatgggaagaaccccaagctgctgggccttgccctgtggctaccactggcaccccagtgggccctctccacgccacacccactgtgattcgccttggcactgggacgtcctctcacctgcgaggtctcatcggaagacctgcttccctctgtcccagcatgaggcagctgagggaaggctacccaaatgcagggccagctcagccggacggagtgggagaggtctcgatgctgcagatggggattcagccagcaacacttctttgctggccacagggcccaggtcagcctggctctttgggaggctcctgtggccccttagcctggagatgcaatggccgatgtgatgaatggtggatgtgtttccatcccgcctgcagccacctggaccttacttaaaacataccgtgtcggcacctctggctcagcccctctctcattccccatcaggccagtctccttacagccggtccctctgtttgtggggcacagaacagccccaagtaccaggctcttccagttaccaacgttcctggtaacaggtctggccctcagtgctgggtcatgggagggctgcctttggtttcctgcatcccagctggatgggacctgacatggacactggagtctagctcctgtactttggagctgaggcgcacagatcccccagcaggtgcgcgcatattccagcatcagcctcctgctggtctgagagctcatgggcctgcggtgggagagggaacagaggcatcctccaggcttcctcatctcagccaggggcctgtccccctcccaggtgcggcatatttgcattttaagaggcctctggactgggggcctgtttttggagttagcatccctttgtcacagcctaaacacctccccacaccccactccttccccatcaggcactcacggctttccagctaatgacatccaaggcagctgtgtgggacaagcgcctgggctgggggtggggaggtgagaggctcatccagggcctcacacgttctgacctccagtccattacaccctgccttgacagacatccacagtgctgagtatcacagcccatcctgcactgtagttgcagctccctgaggagcccagagtggggcatccttcctgtccctgcctcacaggccaccacaggtgtcctgctaagaccatggtcctgcatgaggtagctcagtgactacccagggaccagggactgggccgggtgggagggacactggcctgctctgaagcgctctccctcctgcactgcaaatgtcctcaggtgccctgttacaggcgcgtagccacgtcatcccctcactgcacttctgggcccctcaggcggacaggccagcccttcatgacccaggtgtctttttccctctgcacccgcagctccacctccaagttactcctcgttcccacaactcactgtgcctcgagtaggccagtggcccccagaaggcccctcagcccctcacctggcagcctgttgccctgtgcccctcagtgaggagacggaggtcatggcagcttcacgaagcaaggcttacccaggcaaacgcacacacagacgtggtcctgggcacgtggtgagcacatgacagaggctggcacctgtttgactgttttgttgtttgctgtgggaccccagcggcctcagggcccatctggcacatgcgcggcaccttcctggtgtgcttggcctggcccaggccctcagccaaccgcactgccttgtcatcttcacacagggcccagggggtagggggatcagggtggtgattatgaccaccaccctccccttgcacagatgaaggaatgagtaactctgctaggaaaacttgaacagaatttcctgaagtgagcaatcatgtactgtgcttcaaataaactgaggtttagaaaataaactgaaaaagacccagtcaaaatggctcaaacatgagccccggcccccaacttcaggtggggcccctccatttgcaggggtggccagcagtgctcagggcctcatgcctgcttcacgcatcttctgccttaggggtcaccgaggcatcactgaggtgtgggaggccaccctgcagggtcaccccaccttcctgttctaggaaggggtatgttctgggcctcctcctcgctcccctctgggcaacccgagaccccctccaggaggccagacgcactcccagattcccatgtcagctcccagcaggtaggcagtcctcagggacactggtcttgtccaaccccttcccaaaccctgacccttgcacacaccccagagatggtgggaccgtcacctccctactctggatccatgcagccccaaatcacactggtttgggggcaaccacatgcaaacacctactcaggctgaacatacaccatcagctcagagccttgtcacatacctcagccaggtgaggggcccccggactgtgttgtattggggaataggtgggtgatgccagtgtgatatggccacatggctggggaaggctctgtactgacccatctggtctccctgtccactcactctccactaggtcccttactccacaggaccccatgcagtttgctgtggccacagcacagagcaaggccagctggcccaactaggggcctcaaacctcacataaaatgcacgtgacattaaggtttcagctcttcctggaaccagcatcatccctgggacacagatgacctggaacccccagccctgccagcttctgagatgccttcatggcagtccccactgccctctccccttcctcacctccctgggcagaggctctccaggtgctcttgtgtgagggatggaggcaagcagacagccttgctctcaacaaggtgggtgaggacaggcaggagggaatgctggagccggtgtggcagctgcggagtggccaatgcaggcccaacctcctgctctgccagctgttctgaacctgtcccccctccaaaaaaataaccacacacacacagaatatgtaagcatacttccctcgtgagggggctgagggctgatgtgggatacacatggacagcttagtccccacacccaggcacaagtgactgtgagcagctggcactgctgcagatagtgctggccagctacaactctgacaggtgacacaccacaggaatgcagggggcgaggggtgatacaggagcaggacgttttgactggacctctgggggctgaggggaagggaaggcattgcaggaggggctggcagaggcacagaggcatggggatgcagccgcattgctgggaagggtggggccggggccggtctgtcccaccctgggcctcagtttcctcatctgtagagcaagtcctcagttctgttacagactgagaagctcaagtcagcccactgtagaaaagctgggagtgttcatccgaaccgtgaattcagctttttcacgccgagagcagagctgtggggcggggttgtagacatgaatgcgctccattcaccatggacaggccagccctgcggccacccagcctgcagctgagccaccaggcctgaccagggccaccgagtaccaggctctgagggcagcaccctgactgaggggccgaggcagaggtttcatacagagatgagcttcatgctgtcacctttcacaaagtaccggccaagcctctcacccctctgggcctccctttgtggtggaagcttggggacaccttggtggggctgcctgtctgctgggcagggtgtggctggagggacatggggcactgctgacacagtgaccaacatgcctccatcggtagcgggtgcctgcccttggctggcactgactgcccatctccatttcccagagctctgtgtgacaggcctggtgggcaggagcctctgcaacctgcctgggccatcctgagtgctgccgagggggtctgggacacaggcattcccagacttctctagtggggagagggcgagtgggccccaccatctgatgatgcgccgaggtcctggcaggtgtaccgagtggaggggcctgtggtgttggccccctgtgctagatgcctctgcagctgtggaacagggaaggcaccagaggaaatccactccaaggatggtatcagtcgcaaaggaaatagcttattcgcttgcaaccccgtgcttccccagccagtcctggaatcctcatcaggaattcctgagttcacttcccttttggggaagcttgtaggtgcaagctcttggcctacatctaccctcaggccaaaggggtatgggcaggaggctatccgagacagctcaaggtggtggcagcagctgggagccagtgtgtgaggggttgatgggactatgaaacagggaggcggtgctggccagagtgctggggtgggagccggggtaagatctgtgggagagaaggatgctgggaccagcagggccttgcctgggcacagggccaggtggcgctggggccccagctgttgtaaagatgcagtttagccaacgtcagaacactcagctgtcttcccaggggagttgcagccacagcaggcaccaagtccagccagctgtctaacatgtgtcttcctggccagggtcagccgcaggggcagggtgctagcctggaggtgagccctgtgaggttccaggcagagggggctgctatgctcagagcaggtccccttcttctggtaaaatgggccacgtcagacctgaaagctggatgttcctatcagaacgctccctgctcctggtctcttggctggtattccatggcacagcacagcatggggtagctctgcccagctggagctgtggggtccccagaccaggcccctgccttcctgatgggtccacactggccaccttgctccctgcagccaggtccctatccccactgagggtcttctgtgcttcaggatctgaccttggtgtccgtctctggcttctcctggccaggctccccattgcagccagtctacaggtcgcagctgcatcgtgcttaccttgagcacttgccattcccaccccgctggtgtttgtccgatgctccatttctcaggaagtggccctgtccttgctggagaagggggtctccctgccacagtcccaccctgactccaccaggagctcagcccagcctcctgctaagtgtccatctcgccctcctgccgtggccacagacctgctgtgtccagggctgtcatacccctggttgtggtcatctggcctcctggctgcaccctggcatgctccccgcacctcttcaaccatgtacctggtggaaggcattgccactgaccaggtccctggacctcccacggtcttgggaggcaaagagcaaacggcctggtgagcactgggccctagagcctggtgtgcttggggcggggccgaaggatgcctcttctgcttcctccagagacccccaggcagggcctggggctgtggcagctggggaagcagaagggcccctcagaaaccagaaatgcagctgggaacctctttcttggtgctgggagagaagtgaggcccggaggtcaggcagccctcctttgggctgcggggtgaagacaggaggctgagggtgcctgtgttctggccctcctggtccctgcatgaatgccaggggcagtgcctgtcctttcctggttacccccaaggctccagtcttgctgtggatgagactaaggctgcaagggacagaggactggtctaaggatgggaacctgggcaccaggctccctggcttctcagaacatgctcctagtgacacactctgtgatcagacacctctggtttggaaataaggagcaccttggtttcagacagcccactgcccactgccaccgggatctgaggactgtcagggaccagggctgtcacaaacagggttaagtccaaaggggcttgccctgtggagcctggccgcttgcccacgaccctgctggctccctgaggaaggggcctgggaggtactggctgtcttgtgttctgaaacctaattctcccaccaaactgcagtgagaccctgggcatgtcacttctgctctgggccgcagctcctgcctcagtaaaataagctgtttgtccaagatggtcactgggttctactaaagtgaccttgggggaccctggagtgctttggtgtctctggtgcagctggcaatggcctgagcctcacctctctggcatcaccactgacctcagagaagactgccttggcatctccgtttccagaggccccaacacatcacatgcagatggggccctgtcccaagcacttgagacttttctgggcctctttgccactaggcggaaccgagtccagtgcgcttgcctctctcccctggcctgggcttggagatttgtggccgcaccccctgctcggtacagagccagccacgtcacaggagagcctctctggctctgctactctccaccttctctgtcctcaggagcttaggatgcatgacaggtaatgggactgggagacaaaggggcagacagacaaaaaccaggcagacagtgaggccactccccggcagaggctcagtgtgagagcaggtggaggaggcatgagtcattcctgctcacgctcacagggaaggcgcgcaggccccccagcaaatgatgatcgcctgctggaatcccagtgctatcctaccccctcattcgaagtggctctgaggcagcacccctgtgcttggttcacccagcacctagatggaatcgtcgctgaccccaagtggacaagaggacagacaacatggtgcagctgcccaaagaaagatggtgggcagggaggcctgagttgccccgtgtgctcgccagcctcagagtgtggtgggcccttgggtccttcccaacactgagctctcaggagtcaatgacaacagctgcctcccaggccagctgcttcctccctctgctgagcttggcatgaactctctgcagacgcactgctgtttctatgacaaccagggtggacaccctcaccctcagagtctcacaccacagcagaccagtggcaggtgaagctgctgacccttgagctggggcaggtgcccacaggggcacacagcctggttggccaaacactgtctactgcccatctgctcaggtggtgggagagggtctctggtagcgagggtaccctgctctccctctgtctctttaaggacctgccttgctgtgccctgagagacagggcagtgggcaggggagaggggaggacctctggtgacctgttcctggctggagcaccatgggtggggtgggcctcctggtgggagggccccagaacgtggctcgctcttgtcaccctgtggcctcgtcagtctggacttcctcttgtgtgggggctgccgtgatgccctccagttctgttcacctccgagaagtgactgtgagaggctcctgggctcacgaggctcaaaacatttccattctagatgtggaaagtggtgctcagaggggttacctggcttgcctaggcccctttgcctggcccactacccttgccccaaggaaagcaccagacagcccgaaccacccctcaggcctggtcatcctcccactgctactagcctcaggaaatggggaggtgtctggggacagagctggatgaccagggtcacttacagtccaatctggttagtgcttccctcttcctcccgcaaacctcaatgctaccttgacagattggagaattggattgagggttaatgactcagtgagctcctgtctgtccctggagccagtctgcggggacagcacagggcacatggtgctgacggccagcctcaggaactgagaggtggggggctggtacctgctcaactgctgggtcctgcctcccagcagaaggcctgcctatgctctgagccttctcttgcagggcaaccaccactcccacagcttccagggctggggcagctgtttccattcctctagcctggcctttaacactgaaccctgctgcccccgtggttctgtgagcatctgagatgctgagggagacaggctcggccctgcctgcacggagggctctgttccagcttgaacacctcagctcctggcacccattctctgccactccatggctctcaactccacactggttcatcctcctggcccagccacaggcctcccaagtgtaggccctgggtacccatgctctggggtccccttggtcttgagaccctcacttggctcagcacccacccctctcctgtctgactccctttctcccaggctcacttcagattcaggactcccaaaaagacctgagaggagcagcagctgatcccttaacaaggcagggtgcaatcctaaagggtgggggcagagctcggggccatgggagggcaggcccaccctggcctctggatgccagcagggctggctccgtggctttggtggggctgccctcggctctgctgccaggctcacttgggctgccttggttctccttgaactctaccttaccccagaggctcgggtcctggtagctgtgagacagcagttattctgggtgacagtgaagtgcgtcacaagagaaacgtggtcaataggtcttccaaggaggctggagctatctcccacccaggcactgtccaggcctcatgaagacactgctcttcccacgatgacacatcggatatggagctgagcttcaggcccagcctcccctggaagcctccatgtcttcctagcacctttcctctggacccccactggtcaccctcagacaattcctaagctcctgtagcatgcacagcatgtctcctgcctcgaaggacagagaagagcatggcaaaaccctgacttcagagtactgagtccccaaatagggacaccacctctccagcaggcagaggatgctaacacttggggtggccagcaccaggctgtgccagccagagagcaggtggagctgactcctgcctgggaagaaaggtcctaggccatgacacagcttatgaggcaggaagctggggccctgggacattgcatgcagggtccagttttgggctatggctctgagttctgccccatgagggcacctcctggacaatctccttcccattctaccatggtcatgtctcctcaggatccatctacctgcttctgctctggggttgccccctgtgcaaaccctccagtgccttccatggcaggctgtgtaatccaggcctctcccggctgtctcctgactcctgcttccgtctctgtcacctcgaggcctttgctgtgctaccctgcatgggctgctcttttgggtttgtgtagctggtcagctatcagactccttcacttgaagtaagccctagtcacaaccccaacccttttaatttgctgcacagcttttagcaccattggcccctgttctcattgcccatggcctgcctatgagcagtgctgtctgcttggggaccgctctcccctgctctgcccagcacggggtggatggcaggcaaggccagatggcacatgctgcaggcgtttggtgtggcagctgtgtacaggggcaggggttgggattgcctggctgctccccacctgtgtgcccctggccccacccttctgcacagatgcacctgctcctggcccacagatgggctggatcagggcggggggcacaggcctcacacccagacccgccacttctgtggatgcctagggtgtggctggggtgggtgatgggcacctataggaggctttgaagggactcgggctgggccttcctcccccgcagcaggccttgccctgggctggccctccagtgacagctggtctgtgtccttcctcactgtggcttcgtcggtcaatgggtcaatctggcagaacagactgaagaggcatttgataagcaggtgctcttccggctttaaaacgatcaggaactatctgatcccgtattctggtgaatgaaaatgtgggtttgattttcacaccctgcggccaaccccctggggttctgtgtgcagaggcccaggacccgactccactgctgcgctcccttggtgggttccggtgcttcttgctggaacactgtgcttgggacccctgctcccgccccagcttctgctccctacaccccagctgctgccacctgcagacagaggcccccagttcacaggacttgcctggctgaagtggagactctcgagtggcacaggaggattgacaacctggggtggccacaactcctgtcctcagacactctcaggccctgggttttcatgaggccctcgacttttccctggggataagaaaggccaccgctcctgcccacccgcacagggctgctcagctgcccatgtaggcagctcaggagggcacaggcagcttgggaggggcccattttacagagtactcaggcctgtaggtcccaggccagcgacagatggggctcctctgggatgggggccagggcaggggtgtgttccagccgagtccagaagtcagagcctctgcttgccggtggccccctcccccctgcaactatgcctggtgacaactgtagtgctcatagtaacagcaccagctaagcctggcacctcaaacagcaagggctgtttaaacaagataacaggctgccgctaaagccctagctcaggccctaatggcctgaaaagcccttgctctgaacctgccagaaacagctgagcgtgctgctccctgccttccgcagcagttcggctttgccaccttgcctgggcagtcctgtctgccctccctggtttccctgtgtgtgcagtgtggagggggtggggtgacccgtagtaatggcaagggtggctgcttcccagccctgcccattcccctgggcagcagcgggatgtccaggtcagaaggcccccactttgccacagggacaacttttcctgaaacccgagtttcctcatctgtgtggtggggagccccttcgggctgggaggcttagaggttgtgcatgcagtgcaccagcatgccctgcgccaggctctgccaaccgctcacgtctctgggccttccatttccactattctgttgtcagccagcacacacatgttatcctacagcctgagccttcagagtacttccagaactgccctacctcctcactagccaggggaggggcaggagctcaggaactgtgctgctgggccagtcttcacctgggcagtccagatggacacaagtccacatgactaccctgggccacagccaggccagggccccacccacagtgccagggcccagtgtgagatggagacggtgctgtacacagagcactttctcatgcctcagctgggcttcacccactgggcagagctctcccagaagtctgtgtgcagcctccaggatgttggcacccctgtccagccctgcaggtgggtggctgctgttctccagcacaggcccaaggcgccaccccccttaccctcatgtcactctgttttgcttttttgctctcaccagatctcaaccatcactgacttgcagggtcttaggtccaaatgggagcctctgtattcccaagggtgttggtcaaagttgctgaggaggcagagccccagggtaagtgtgatatgtggcgggagtcacgtgactggaggtggtgccttaacaatgctcaaagactcccagtcctgggacagaaaattccaagatggtgggagcatttgctccgaaagggcctggagctcctgtgtcctgctccctggcttcacacccagacccagaaagggaggccgtgggcaccctcagcacctgggtcccacctgctctcaccttgaccccataagctctcctgcccaactgggaggactggcctcttccaaagccccagtccacttctgtttcagctgagaactgtctcctatttgtttttgtgttaaatcttgctgcttttaagtaacctgcacccctgctccccaccagccagtgtcagtcgctgaagggaaattaacaaacagcatgatacaggtgtgttgtagattggaagctgtcaacacagacacaggcctggccaggagcttgcacgccatcaccatgcgaagaaagcacagtgtgagaaacccctcctagtttcagctccagaggatccccaggaacccaaggccgacacccttgcctggtttgcctttgctttgttcagcaaggtgggtgcactctgcactcctagccgctggcactgcagcctcggacccacacctgtaggctcaagggcttgtgaacccctctgcagcaggctcaggctctttcctgggagggacatgagaaactgggggtagtggggagagatcccagtggggaacctctgcctatggccaaaaagatggttttcaaaaatattcatcctttaaaaaaacatatttgggttgttactgcttgagctgggtggccctgtggggcaggaccttgcccatagtcactcctccagctgagccaagttgccttcgaggctctgggcccccttggtcaggatgctgctgtgcttctcccctggtcaccacaggccaggaaaaggtgtgtggggctgtggccgtggccggcctgggctgggaaccttaggatacaaggcccagggcccccagtcgactctggtttcattattaatgaaattagagaaagtacctgagctgaggacatgtccaccacgaggtgtgatgaagcagggattagggtgagctgcagccaggctcctgggctggcctaagcttgtccactatccagacgggagccacatgcagagagaagaaacacctttcactctgccctggccaacactgggtgtcccccctgagatgcccagggccatgcaccctagctgactgtcattccaatccctccagaaactagactgagccagtggggcctcaggtgaagagggctatgcatccggtcagcacagagccttgctgctgcatcctgtcctcactgcttgtcttgttcatggccagtcacaggactcccctgagtggcagatccccccatctacactggttactagggatccccaagtcagcaaggcccccagcactcttagcctccaccttggagtctgttctagatagtggaaaattgtttttcagttactggattatacaaatcccttaaaacaatagtaatctgtgtcttaaaacccagagctgttctcatgtgtgtgtactgagcagagctaatgcgctcaggaaattaattacccactggcctgggcaagcctagccgatgcaggttgaggggatgtggggtgggaagcagctctgccctgaagctcttggaacagttcagacagggtatcattgtgagcatccagcctgatcacgaggcagagcaggaggtgtataaactgggagggacacagtcctggggctgaaccctggctccgtcatcacagggcgctcaggcagcgacacccaccctgggccacactggggactggacactgtgcctgcgaccttgccctgcctgcttagaccttacaccgcctggtcctccgtcatcccgctgcagggcactgtgcatagctctgtgctctccatggcccccgacagccccctcagtcctgcctttgttgactgtccccactgctcccccacagccttgactggattctgcaaggtccagatcagatcaccacccccacgttcatcccaatctgtgcaggcctgctcccaacgtctaggcccccgtctctcctgcaaatgttggtctttgggacagaggaggcacctgttcctggcttctctgcacctagaaaactgtttcctagggcaggctcagggccagtcacagagagcatgcggccagcatttgtaggcactggggaagccagcctgaggccagccctggctacacaggtcctccagggcctgcttgatgccatccccagctgacctgagggaggaagggataggactgcctctgtccctagactgagtttgtcaggcccagggcccacacatactgggtgaacaaggactgcttcctgcaaggatgccacagggcttgttctcagatggagaacatcagatggcccccagcttgtggtctcgtgttagccaatgcaaggttgctctctgtggagtaggattctcttaaatctgccgaggaagagcgggagggaggcaggcaagtgaagagccgctctggcaaattccctttctccagcggggtaaacacgaacagatgcaacccacgcggccacagggtcagagctgggagtcactggggaagcacagtgggagactgacaggcaaggacactgtcgggttcttcagtaagatggcagtagcggatcaatcctgccatacaccagtgactgagcctggctggcagactctccccgccatgcttgggagtcactggctgtggtgcactggtaaaggtctaacaactggcatggaggcgggggctggggaggagtagaactgttttgtagtatttgccagttcctggggtgtgattactcctacctggctgctttgaagccacaaatataatgtcaaacagctcacaaacatcctgaaaattgaaaaattagctcttgtgagccagtatgagccagctctagcccctcactgccctggcatgcagagagggaggctctgccaccactagccctgggtctcagcactctcctctgcaggaagcagccctgcctggcatggtgccgaagagaactctcttgttctctcctccctcctccctcaaggcttaccagcactagggcaagagactgactcctgccttcccataaaggaggccccagcagagcccacgctggctgacctcctgttgtggcaggaacacttgtctgagagatctgaggaacaccatgggcatccccatggaggttctgccaaggcacctgacaacgtcatcatggtggaagagacagagtgatggggttggcctcctggctgctgcactgctgtgttcagtgacagcttgtgccctgggaatggcctctagtgacacagcaggaggtgaccatcatggaggggtggctgatgcactgaacgacagagccaccaggttcatgatgatgaggagttgggggccaaaggaaaaggccctgcaggcagagcaggtgtgggggcagcccaagcagcagggcttgagcccagggccctgccgcctcttgccttgtggctgacctctgaccaaggacctacccagggcaaggagccactgcacaaggcgggctaagaaatggccccacccttggaagctcccagtgtgacaggaaaggagcagctgcttttgacaggggccttgtggctgcatcctccctgggagcagaggaaggaaggagctaacccaaggactgaagtgctagcaagggcctcaaataggtgccaggacatgctgccttctccacccctccctgctcatccccctcccatcttgggcttgagccagcatcccatggggtcacgcataaagcctgggaccctaggcgagcagatacccatcattcactgagcactggccacaggctcagagcggctgaaggcccactgaggtggccgcagccccagttaaggctgagtcctgggcaatgaggcaagggaacttggatgcggggagccggtgctgaagggatggcaggggctgttcacaagtgttggtggggcctctaggccacgggtggcccagctataggtgtgtgcccagccctcttgaggctggccccatcgctccagtgctcgggtaggataacaggccatagagaggaagccaggccaagcttagagagggatgcgggctggggatatcatgtggccagctgagccctgctcccaattccatgcctgccatgcgaggtgccatcagggtgctgctgtgggcttggtcctctgtgtctcccacccctgtggagcctctcaagctgcactgccatgggggctgtccagtccttgggagcccagtgtgccagcctggccctgcctctggatctggtcaggaggctctgctgttccagggtcatgataacttgaggatgctgcagacaaactgcatgtggccctggcacattgcaagatcagaaggaactgcttgggagacctgtgtgtgtcgggaaaagggcggcaggccttctggcttggagctatgcccttgaccaggtcaggaacaggaggcagagtgaggccatgttctgctagggctccctgtggtcctgccactgactaggccaggagacaaggggacgaggggagtgtcaaccttcacagccactcacctctcccaagcccaggtgtcactgtcctccactctcctgagggaaggctggctacacagcagctccaagggtggaacccagtctatacccccaaggcccttgctggagaaccccagcacccacaggatgtgggaccagtatggtgaagaggggggccactggaattcccaggggccagtgccaggaccctccctgagagccagagtctcagccctgcggtatgtgaaggaacctctctgaggctcagtttcctcatctgcaaagccggctggttaggaacactaaaggatatataaggtcccttctcaatctaagccctggtatgctggggagagggtatcatctgtgtctggctattgcccatttgtaattccctccttgggcaaatataaccagctctgtcatcaataggtataagcctgtcttactggaaacaccttgtttcacccacaacacgccattttatggcacaaatgtttaaactccattttaaaagcactaaaacaagcaccctttttgggctaaatgataaaccacagcgctagggtggcaggaacacgctgtgttcacaggacggccttgggcagcccctcctcagggtactgcatacactcctgttatggaccagcacccatagggtctccttgggaagggctgagtgtcccagctgctctgcacccagaagccagggctctggagctccagctcttcccaagcctaccgcctcccgcccgctccacaaagtctgcagagcacccactgtgtgccaggccctctgctcagagcacaggctgtgccgggtgggtgtggacctgccctcgtggtgtgctgaggctgctgacctgccctggagtggggaggggttcctcaggaagccaatggccccaggacaagggaccactatccagggccaggcatagaccacctgcctggaggctggctgctcaagcacttgccacctgcagaacttgccccacaaaaggcatgttcttatgtcccccgtcccctggataccctcactgataacatgttgaccagctgtctctcagataagtggcagagacaccaggcctcccacggtgaaccctgctgtgacccagcctgcctgtggggcccaagtgactactgtgggtcctagatgaaagcacaatggggacactgctgggaactgctgcctgccagctctagaaagacagggcaggtatccctggtagcagaggctttgtggaaatgaagctgtagctgggctggtgtgactgcctcctccttgtcccccagttccctgtgctgctgggagagttgtgctcaccctcatacttggccccagcctgagccttgagcctgcacagcaggtccatcacaggtgcaaaacagacccgccacagggctgggaatgctgacagctccgtcgggaaatgggcagtgagctccctgtgggtttccacatgagaacatttgatgctttacaactagaccttttaatcttgccttctgaaggatcccacaccatttggtggccagcagagtccattagctgatccgcaagggcagaggttgggcaacaagtgcccacctaccccctcaggtgcctccagtggggccgagtgaagacccaggctctgctggtcacagccacctgtgtctgtccctcagtgtgggctggtaggtgccagcttctccactttgcctttccctcctagggcagcagagtgactgtctttgctgactgacccttgtgtgaatgtactaaagacgaggggcagagcctctgccatggctctggctaagtgggaggcccgtggtgggtcctgtgacacatggcctctcaggagctgtccttgtggacttgagggctgggggcccgccagcgccagctgtgtgcctgagcctcagtgcctcgatctgtgacaaaaataacaggcgctgctgccccacaggatcattcaggggacaggtgcgccagaaaaacccccttgtgttgctgggctgtgttcaggcctcctgtgctgcctgaggaagccccagctgggtgttgggcttgggggcactggggtgcctgacacacctgcaggacttggccctagtcagggcaagggactgccaattccttcggacgagggtgggaaccgtggccatggaggggcgtggctccccatgtggctcgctgccatgctccacagacacccggaaatctgccttccctgctctgaggtgctgccctgcactcactgcagccctcacacccgggagcccagagacactgacgttctccttggcaacgtgctgacgcagaagccagcgggtgggccggggggctgtggctccttcgccaggcgtgggggtggggaggcactgccagcatcagggaagatgaggccttggaagctgagcacggaaggagggctatggaggagccgtgtccagagccctggcactgggccccaaggttcattcggcttttgtgaaaacgagcatggcctgttcttggctgccttgcctttgacagggcccagggaggacagttcagcacgttccaaaaggagagagcagagtggcagccctgtgccagcccgtgccagcactggctctggccctggcccggctggagacgggctgtcctcactgccggcaccactctgggggccagctcacctccggggccagcccagcctgcgggaggaatcgcgggaggggattgtctttcctctgcagcctgtttgttttccatctccagatattactggtagagcatgaaaggtcagaatcatttggaatccagtgaatttccagcctcgcttgggtttctcatcaagaatttccttttctggtgaacaaccacttccccaggcctgcagaaaccagggtgatggtggtgggtgtgccagcctggctgccagcccctccctttagaaagtgccttgaatgcctggaacctcacagggatccctgagaccaggccagtggctgctgtccctgcccatggctgcccaccatggctctccccagggacaggcctgggagagggaaagctagagatgtgaggccccacaggggccacccagcccatctagggcctgccccgaggagctcactcacacatcactagatggaggagtaagcaggtgccgggctaggtcagaaaaggcctcccaggaggcgccacttgggatgagacctggaggataagggcaggggtacgagaggcagggatcaggatcattacaagcttaaggctggacagagcagtactgctggagcaaaacaagctgaccacggctagagcagaaggagaggagagagaggcagcaaggtggcaggcacaggccagtaagagccaagagggctgcaggcaggcaaaggcctagccttgggcccatctgtgaagacacctgggtcatctcctcactgacaagttcagaaagcaaacatgacagccaaagccctccatgaaaaactggactgactcaggacccaggtatcctgcctcctgtgtccagcacacctgtgggcacggcctgtcaaaggatgcaactgggagccaggcctggtgcccggggaatttgccacgcctgccactgtggtgatgggtgaggccagtggcgcaagcccgtgtgactggcagacccaccatggcactgtcccaagggtctggcctgagcacctcactttgccttgcagcttctcagccccaagcgctctgcccacggccatgcctcatcaagggagcctgacctcactcatctgctgagatgtcccctctgcccagaaccacacatggggctgaacttgtggcaaccacagggtaaggggccagaaccctggagagcacacagatacacactgggaacagggtggacgcagccgcctgcgtacacacctgcctgcccgtccgtcattcgtttcccccaggcacaccatcaacacctaggcacagttccagggagacccctgatgcgaggaggggagggaggcaagcccgcctccccagctgcctgaggaaagccaaagatcctctctctcagaacactcaggctcctagcaccatggccactgcctagagctgtccaggttccctggctggggcacaggtccaaagctagaaccattgttgctctccgctgaacctaaagaataaagcttgccttaggactgggtgaagcaaggagtgacctcggaggccagtgctcccaagtggagaggctgagcccttgtctcccagcatcaccctcccctagccccagggtacccacaacttcgtgactccttgtttgcccccactcccccatccccagggtcaaaggcctctctcttaagggcagacttgaaatctgtgctcagggaatcctgctgggcaagacagcccctcccttgcctgccacggcctccaccgctgccactcctggctgtggcccccttcgtgtgctagaccttctgtcctggctgggcctcagcacactgccctgctgcttcacccggctccccaccctctccagcaactccactctcaagcccccaccgcttcacactgggtccaggtctccctcgggctgcgcccatgccactgtgaaagaatcccaacacctgcttttacgtcgtcccctttccaccaggacctgggattatcccttctaaacagctcttaaccccatctctgccagatttgcagactcaagatggggttgcaggggtggctgctgttcctggacctatatgctggtaggagactggtgctggcaggagcttcatggatttgccaaactatcacatggattgatcatggatgcccggcggagcctcacactctcttgccctgtggcctccacaccctgagtacttcaggcatgggacatgacacctgcactccacaccctgttccctctgcccccaccttgctggagctgcctcagttatcgtgcagcagggccaggcctgcgcctggttccctttctggctgcagactgtcctggacctcacgagtcctcttgcttccaggaacccacgacagcaggaacaagcagaggaaaacccccggccccacttactgtctggttatcctcgtagagtttcaggtcgtagccgctgagctccacacagaagatgatggctgtgacgccctcgaagcagtggatccactttttgcgctctgacctctgcccccccacgtccaccatcttgaaggtgagctccttgaaggtgaacttgttctccacaatgcccgtggtcatgtcccgggagcgcaggatgtcctcgacagtggggatatagtcagctgcggcgatgcgctccaggtcgttcaggtagtaggccgcgttgtcctccaggtggtactcgctggagcggctgaagcaggcctgtgcccctgggtcggcccagagccgtcgcatgacacccagcagctcgggtgtgatctcgcccttgctctcagcggggcccgtcagcgcaaagagctgcacagcgtcgtaggcgcggtcggggttgtggaagtcgatcctgagggcggccagggcccggatgatgcgggtcagcgagtcgatggcattgtagatgatgaggggcttgtactccttgcaggcctccaggttgaagccgccgctgtggatgatcttcatctgtttgacgatggtgctcttgcctgagttgctggtgcccagcaggagcagcttgatttcgcggcgttgccgctggctctctgagcgcaggtggcggtcaattctccgggaccgccgggctgcttctttttcctctgagctttgccgacatcccatggtctggcagcagcgggcccagacaaggagcacgggatggggcacctctccctcttgccacaggggacactgagaccaggcagacaagagcccagctgccctggaggcactcagtgccagcaggggggtgaggccgagccacactgcagcccctgccccagcgcctcttctccagccggcatggcgctctgtgcagcgggcggtggccgcccctccccactagtgacactccacctccctagttggcaaagtggcctgatttgccgtagtcattccctgtcctcggcgacggtgggaagccgtccgcttgtgtttgcctcggctgctgccgtctggttgctggttgctgtggcgatgttgctgagtggctggagggttggagggccggtcgctggtgtgctccctgcagccccccgcctccggctcccactgtgcatccagcccttcacctgccaaacacagagaaaagcgtgagcctcctccccgcagccccacctcaggctggacagtgaaagggagctcttctgaaagcaaagcagcagagactggccttggaaaatgagccggcaacaatccatccaaccccctctcctccatggggcgctgtagggcccacaccatggtgtaacacatatgtctgctgttgcctggacagtccacctgaagccaggtgcatgagggagaggagggtgtgtgcgaggcctctgcccacccagcccccatgctggactcacttctaccgcatccagttaggattcaataaggtcaccctgttgtgatgccccctggggcccttctcccagacagcactgatagagctcagccttgccctgttttacacgggtggccaggcctcggcccagccctgggataactgagcgcctccctgactctcattacccccgcaggagctgggtcacttctgatcacagggaggaaaagcaccaggagggagacctggcccctgctttcccttgagggcactctgatgggccagcccaggagccagcagataggcagggaccagagcaaggtggaggcttcaggctgtgggagcaccgtgaggtgcctaagcacagtgggcaggggctgcctcactcctgcagaaggaggtagaggggggcttgggctgagaccaaggagctgggggctgcacgtggtgctgcggggaaatccacctgggagaccagatgtcacagtggctcccaagggtagtagtaatcaccgaggccagggcaaggcagggtggcctagaggcctcaggcagaatctttcaccaaccccgcgagtcagggcctccccatccacctttcctgccagcagggaggggcacaccctaggatgcccctgtgactttgccgggtgcttaggccaggcctccccacacgaggggcagctcaaagctcaggcttcttccccggctgtgagcccagggtggcaccaggccccacccaactcacacgcacccctcttgctccttccctgacctatgtccctgtccggagacccacgcagcctccccatcctgccacaggcagcattcgcccctttaataccacccatcaactctgtgacaggccctggggtgggaaggcccgaggcagagagaccccaacagccaaggccccaccctcaactcctgggtgtgaccagcatctgaaactcaacctgctaaaccctcagcaaatggcacttcatcctcccagcagccatccgtgcccctcactgtcccttgcccctcacagaccttgaccactagtcctggcgatcctgctttgaagcaggcccctggtgggctgtcctctccctgggcagaggttctggtctctcctggcagtggtggtggcctctcacacctgctccctagccctgccagcctctgacagccagaggctctaatgccgcctctttcccttggtcagaccctgatattacccccaccactctcagggtggtctcatccttcatgccttgcttgcctctcccaggttgtgtggcctctggcgacttactcccatctcagagcctgtccctcactggccacaggtatctgtgaagagtaaagcgtccagcacaagcctggtcctcagagagtgacagccagtagcagtcactgccctgctgtgcttgtcgctgtgagcgtcaccttgccctctgtcctcctcctccatagcagccctcagctaatgtgtgacctacatgaccttgtgtgctgccgtcgcccctacccccagccagagtgcgggtgaggagggcccgtcctggcctcgttccccactgggaacagagcagtgcccagtgcacagtgggtgttcagtaagcactggttggtggaaggagggagggagggaaggaatcaatggagaggctgaggaactttcccgcttcaccaggcagccaccgatgagaagtgcaccagggaacgccctagaaacatctctgccaagagggcagtgattaaacagtcactcagcccaatcccagtgaggctgaaaattacatctgagaatggaagccttgagatgaccctcccactccagcacacagtgggcagaacatctgcttaaagatgacatgtacatgatatgtgtaatatgcacacgaaccatgagcgcatggaggatggagaccctgtggctgctcccttgtccctgctgacgacctgacagccccttaggtgtggaaaggtgtccaaagccctcagcccactgcctggggacccagggttctccctaccagcaccatcattccagcaggaagccaacatgctcctttcagaaggcagtgtccaacccagtgggaggtgtcctctgttgtcatgactgttcttctcaattccacgtttgaaaatctgaggtacagccaggcgccccttctgtccccagtggtgggcagagaagctgctctgtccaaggatgtgtgatttgtgctttgggatgtatgtgctccctggctccaaggctggggaatcaggagagcaggttggggacactgggctggcagcctgggccctgaactgctgttgtctggaagcctggagctaagggctgctcatgcagtcttcgatcagtgtgcgccggcaacgacagggcaatgtgcaaggaaaggggaaactgaggccaggtagcaatcacatgcatcagggccaagtctgtcacctgcatggggcagtgacgaacagtcacaaccaaggggaggtcccctgcttgaggaccctcgtctttcagatcacctgaaccaaacaagcagaaggccccacccagaattctccctgcggctctgtggggctgtgttgtgtttgggggtatgagcgccctgtgcaggggcaccacgcatgggacagggctgtgcacggatgtaaggaagccttgcgttgggagcctggctgtggttcaaatgggaccttatgacagtcccacctattctgaggcttgacttcttggctcttacacaaggctctagccagccctctctctgagtctaacccgggctttactggacatgctaggactccccaagtcccaggatggaacctgatgatggttggccaagagacaaaggccaagagttgatgaccacattgttccctggcccagaaaccactgatggatcactagagctcaacacccaggaccccccaccacagtgcctctgggcatggctagaaataccagaggaatgggccaggaaaagagtgtgccaggcagaggaggaacatgctgtaaggccctgcggtgtgtggggatgtgtgttagggatgaaagggacaaaccatccctaacacaaaggggaactgaaggaaggtcagagtggctggactgagggagaggaggagagaggtaccaggcaagaggaaggggcagggctcaccagaagtccaactgagcccttggtcttcactgaagagaaacaggacgccactgaaaggttttaagccatgtgtgtacctgcatgtttgtggcagtatgtggtgcctgtgtgcaggtccattgcggtgcgtgtgtgtgtatgcaggtccactgtggtgtgtgtgcatgtatgcataggtgccagtgtgtatgcaggtccattgcggtgcatatgcgtgtatgcataggtgcctgtgtgtgtgcaaatccactgcggtgcgtgtgcatgtatgcatagctccctgtgtgtgtgtaggtctattgcggtgtgtgtgcatgtatgcataggtccctgtgtgtgtgcaggtccattgcggtgtgtgtgtgtatgcataggaccctgtgtgtgtgcaaatccattgtggtgcgtgtgcatgtatgcataggtgcctgtgtgtatgcaggtccattgtggtatgtgtgcgtgtatgcataggtgcctatgtgtatgcaggtccattgcggtatgtgtgcgtgtatgcataggtccctgtttgtgtctgtgagagtgcaggtgcatggatgtgtctgtgtctggttgcttgtatgccagtgtgtgcatgtgtctgttcatgtgcacgcgcagatccatgtacatgtctgtgagcaggtccatgtacacatctttgggtgtgcatgcacaggtccatgcctctgtctgcatgtggttgtgcgtgtgtgcagctgcatgtgtactggtgcatgtgggcatctgcatgtggttgcatgtggcatcctgggagcagagatgccctggagaggaggaaccagctgtggtgtggagctaggctgaggcgactggggcagaagggagatgggtcaggggctctccagcatcccacacttacttgctaaaccatggctttgattctggcacttgggctggggctgctgaatgaggcagatgaagatctattccctatttttgctcaggtgggagggcaggagtcagactacaggcagtaaataagcagcaagtggcagaaggtgcccagtgctacagtggaaatggagctccaggtgggcagggttgggggtggcacatgcgggctgcaagtcagcaaaggtgggtggggctggcctcctggtaagagatgagtatgaacaggtggtgaaggagggaggcaagcaggcatcagggatgagggaaccaccggcacaaaggccctgaagtgggagcatgcctgaccagtctgaggggcaggaaggaggccatgtggctggtgccaagagggtaggaggtcacttaagggcgagtcaggagccagccagggtttgggtgagaagtgccatgacctgccctgtgtgaccagcatccctctggctgctgcgctgaagccagaccagaggaggctcctggatgcaaacatccaggtgataaaaggggagcaacacaggtgagggctgggggaagtggatgcagtgaggctctgcaagatgtgtgagctgtacggtgcacagtgcctggtgatggagtggcggctgggtgggaacagggagacgatcagggaactccagggaccagccagtaggctgaagcaggggctgctcttggagaggggacatattaggagaaagtggcaggtactgggaaagggggactgtcagctgtccctgtggtacaggaccctgctgtgcttatggccagggctcagtacagatgagtggactgtatcagtgaacaccagctagtatccagtccctggcccccgcccccagcagatgtgtagtgtttgcagcgtgaagggtgtggcaaattcaccaggaggtcgcttaggacttagtgcgacatagggccaggcaccaggttcgacatgctggcagccagaggccaagaagccctagtgggctgtgctcaggccagagtctgcacctgcctgcctcctccccagcagcctcaggaaactagcatctcttggctgtaggctcttaaggagctccatcctggtccttgactcacctacccaaagattcctaaggcacgatctccaagccctgagcccactcaggaaccctctgctgagggccgcttgcttcctgtggtttcgggacagatccttcagcccacacatggacatccccctcaagaccctcccttctcacccaccgtccagcaggcccggcctgccctcatcaccctccttccagacgtggccctctcaagtctgttcctgtaacagatgttgagtgatagccctgagtcaggatgggtacatggtcatggagggaaagtgctgccacctctcttgggacctttgcatcctggatgccctccactctaggaaccacttccctccccaggcacaatccctggaggctcagcctgctgctaggcatagagctggggcaacataatacccatggtcacacccaccatagcctgagctcgccaggaccacaccaggccatgggagccagcctgccctgcccgtaacctccaggctgtccccaaagctttgctcaaggcctcctccacaacagccagcacagcacagagtcagtgcccccggctgaggcagaagaagacagcccacagccaaggtcaccgaaggtctcactgcccaagccggctaagccaggggcgggaagacttatcagcttatagaccagctccctcatcactgtgcctgacttcctcagagacggcagtccagcccctcactctccaggtccctagctacctgcctccctccctcctcacctcccaggaaagcctgccccatgctgagcttgggcgacggaaagagtgagccaagacgaagtgatggttcaacacacagaccctgcccccagggagatagtttaggcttgttgaggagacggaactgtacccagactgtgactgggggagaggcacaggcagtcatgcctgaggcccaatagaagccactcagatggccacctttgctggtaacagaagctaggaccccaagaggtggcaggcagcccaggccacagggccagcaagggagagcaaggccacacccctaatgcccgatgggctcccagccctccccagatacctaccacacaccctgaacctgcaggactctctagcctcaatgtggggaccagtggtgtccactgtcccaggcttggggtggcaacaggagtcatggaacccatttcagaccaacaagtcctttccaccctaccggagctgaccccagggctgcctgcgcctacctgccactcaccctgtcctggagtcccctgtggaggctgagctgcctggcatgccccaagcggggctatgactcagcactgccccacccccatcctgaccccagtttgctgagacgccttttatccaggcagccgcggctcctgtacctgccagctccaccttggcacccagcagctggtctggggagggaggaggcccgcgcagtgacagatctccaggctcactgatgcctgtgaccacaggcccttcctcacacaaggatgtggggcagagtgggtaaggctccaaccccaagccagcccacagctcagagcatgcagggaccagcaggaggaaacgcactggggtaccctgaacccacattttgggcgtgtagatggttcatataactcagatcacttgacttgctgcgtgagtatgggaacctgcaggccaagcttgaaaccgcctttacaaaattatgactgagacagtgaaagagatttaactgactccatcttgcttctaacttccaagttgtccttgttcattcctgggtgtaggctgaactaacttggagagaaacttagtttatagtttaaacaaagacggtaacagccctctcccaaagcagacctccttcttgcctgggcactagactgcctttgtaggactcacattagccacaagattagaaattatggtttaggagtcatgcagctgaaggctaaagattctgaccctccctaaactgctcttgagatcagtgcttgagaaatattgcagaccctgcacttgatggatcaactggccccacccagatcaataaactggctcatctgatcttgtggcccccacccaggaactgactgagcaggaacagactgaacaagaagacagtttcaattccctatgatttcatctctgaccaatcagcactcctggctcactggctaccccccatccaccaagttatccttaaaaactttgcttcctgaatgctccaggagactgatttgagtaataataacactccggtctcctgcacagccagctcttcatgaattactctttctctattgcaattctcgtcttgaagaatcggctctgtctaggcagcgggcaaggtgaaccccttgggcggttataagctcaattgaggcatttttatcttattttaactgtcacccagctgcagtgcaccatcacagttcactgcagcctcaaccccccgggctcaagcgatcctcccacctgagcctcgagtagctgggactgcaggcacgcgccaccacgcccagctaatctttttaattttggagaaatgggggtctcactatgttgctcagactggtctcgaactcctgggctcaagcaatcctcctgcctcagcctcccaaagtgctggggttataggtgtgagccaccatgctcattctatcatctcttaaagagtgggtgctgcccccaactctggagccgccgtccctacatcagctcccaccatgatactattttagaaaccgaaggtctggaaaagcctgtgcctgtggccattgcagattaccaggtttcctcctcgccgaatgaggaagcactttccactgcccttttacgcccgacttatcggagccgcatgtgcttccagctgacaagctgcacactccctgtcctgccccagccatgtgtcccatcatgggtttcccagggcctggcctggacctgtaggggcctcctcggtggcagctctctgttgctgaggagccaggtgtcctttgtgttgcccagttcttctgtcccactgccttcaatcctgtcatgctggccccacccagtgggaagtgggctccacagatgctgcagccccatgactgcatttcccctctctccagtggtctggtcatggtccagtgtcctcacaggctcttcatggagccatttccacacatcttcatgggaggtcaggggcaactgtgggctgggccccggggagggtctttctcagggaagctgggcatggtggggtcagggaggggactctgggtcccagctgtggctctgctgtgctttcctcaactatagtgtgcctgctcgggtggctgaggccactgggaggagaggaaggtgcccagggaacctaggtccagaggcccgtggctggagacacgcaggggacagctgcacctccgtgccaccccgtctgctgccactgctgggccgagtgctttgctcacacacgtcatctcatgctaaaagcaggcctgggaggtggcctcggctttacggctgtagaaatcaaagcgcaaagatggaggtgatttcccggggtggcctggctgggagtctgcaggcctctgctcccaccaagccctccaactgggccccacgggactgcagcctgcctaacctggccacacctgggtatcacttgctgtttttactcagcatttttctttaaattgactgccttttttacttaaaaaatgtacttcataatgacttcatagtcctactttcagtggaaagccagggtcacccgccgtagacagaagtaatctaaatacaaaacagtgtagaggaaccgcttctgccactagccaggggcgggaccctgccgaggggccaggcaaggccactggctgttgcttaaacagcggggattagcgcctgctggagggtgtgagagccacgttggcaccaaactgggattttctccttgaaggagaaggattgagagagaaacaaaaaggattaccttcctctggggaagggttagtgccactcatagctgtggccttaggccacctcctagggttcgatggtgttgcagccccctgctctgtccccactgcccgtgcctcctggggacacaagtggggtacatggggaaccagggccagaggccctctctgctgggacaagctgggacaaccagggcggaggcactggtactggtgttgaagggatggaggctgttgggctgtggtataaacactgcaccccttgtcctcaggctggagcccatctcttatctcagcaaagtgggtcaccctctccctggctcagttccatttgtctgctcagcagagcatcctccactgcttctcccgttgctcctaaatcacccagcacgtgcgcccaggcctgaggccttccaccctcagatctgtatgggcaactgatcagtcactcaacctgctatgatcaatactttgctctcccagaatccagccccactgtgtgtggccctgcttggggacagggggacatggtggggaacaagctgagtctgtgtgtcaaggagcttgtattctcgctggggagatggtgagcacataaggcagccaggccatttcaaataaagctcagcaccatggagaagaggacacagagaaaaatgtagaatggcagcagtgaggaatcgctgaggacatcaaggggtggggtgattcccagagctgaccccgcagatgcagcagacgggcttagcctggggagaagctgcctggaaaccatgtccacctatctgaggtgggggttccagcctgagagctgcctccagaaaactcaggggctccagatgaggctccccacctagtggcaggtggccccaagggacccaggacaggatgggggttggtatggcctcctggagcagcacttctgcatcataacctccagtgtgcaatggcacctggacgtgcgatgtcacctggacatgcgatggtagggtgaccacaaaaccgcagacagtgcgtcctctggcaagtgagccagggttggtgtccacgcccacactcatctgggagagcagggacctgacttccctgccttcccagcacgacactgtctgtggcatccccactgaatggctctctgtccagctccccactgggccttggggtagtgaagggcggggctgcagctctcaaggctgcattgcatcatgggccacgaagcgcaggtgctcaggaccaggtggggatgaaggcaaaaatgagcaaggatatgttcacatccagtgctcaaggcttccccatgctgcttcatcctggccagtgtggctgtctgcaagaaggcctgatggtttaaggcttttgatacaacacctacagatgctccttgacttaggatggggttatgtcctgataaacccatcctaagttgaaaatgtgttgacttcccccaacctgctgaacctcacagcttagcctagcctaccttaaatgtgctcagaacacttacattagcctgcaggtagacaaaagaatctaacccgtatcttgtggaatttactgaataccgtactgacagggagaatcagaatgaatggttgtatgagtactcaaagtaaggcttctactcaatgtttattgcttttgcaccataacctgaaaaactgcaagtcaaaccatcctaagttggggactgcttgtatttttggactaaaaagccacatcttccggggaagataaaaaccccacttgccttaatgccagtgacactggacatgggtagggacaagctaccctcccaggaactgccctctggggaaagatcgcctgcatagctcacccctccctccttgttaactccacaagaagcaaggttcctgcctctctggctgcatctcccacccaccacactcacagtgccctgttccaccccacctggctgaaaacacagccctgtgaagcccagggagaacctccttctctgatgaggacccctgactactgcagcatcaggatccctggaaccccagtggactcagtctgggcctgccacctggcccgcgcgaccttgaacaggtgtggtgtgccgctggttcggcagtgggactggacttcccctggggaagaaatggaagggatgccccacaaactggtcctttttcagcctcagggctgccggctcctcctgcaggcaccttccctgaccacatctggcccatatcccctcctcccaccttcgcctccaatggcttgtgtgtggtttccccagggtacccaccgcaggttggtctgggctcctgctctaccctccctcccccaagcaccagctctgcttccctcgaagcaggtgctctgtgaaagattcgcagaacagatggatggatagatggaggaacaccaaaaaatatttgtacagagctcggaagcttccccagcactcccttttgagagcattacctaaaatgacctttcccagcagcctgcaaaggggtcaccctgcagtccacaggcctcaggacctgaggtcgctgctgacccatggcctcctcctggagcccgtgatatccctgggactctgtgggccagctctactggattcccctgggacccctctgcctgggtctaccctcccctactacccccaataccccaggcctcccacagccctcttgcttctgctttccacaaatatttctcaaatgtgcatcacacctgcccctctccgagctgcaggctagcccctaaggacccctcctttggtatggtttccagttccttctgtctgtgtggagagtcctcttcctgaaacttctcctgcccaccctcctccttcactctcccaacttccctggagcctcctgcctggtctcccagtctcccacgtgccctttcccatcccagccagctcacgccccaccttaatatgatcttgaccacttcacaccttattgaattaaaatgggagtttctgggggcaaggtttggggggaagacactgtggactctgcacaccccaggctgagagcccagctagcctcagctctgtgaaaccagcatctcctggtcctcaggcccatcccccatgtcctcttatgctagaaaacctcacacttccctgcaggttgtccctggactcttccgcttgggtgggctggggctccaagggccttgtgaatcctagtcctggggaaagaggggcttccaggctggcctgccgtgggagttctgcagtgtcatcaagcagcctcctcctcatacttggcccctgtggccttggctctgttgtagactcctggtttacaacctttccaagtattatggaatgatccttcacatgcaaaacaaaaataaacaaaaaaacacaacgaggccgggcgcggtggctcatgcctgtaatcccagcactttgggaggctgaggcaggtggatcacgaagtcagttcaagaccagcctggccaacatggtgaaaccctgtctctactaaagatacaaaaaaaaaaaaaaaaaatagccaggtgtggtggtgtgcgcctgtaatcccagctactttcgaggctgagacaggagcttgaacctgggaggcggaggttgcagtgagccgagatcgcgccattacactccagcctggtcaacagggcgagactcaaaacaaataaacaaacaaacaaaaacaaaaaaacacaacgaaaaagaccaacctgcagattccgacattattacacatatatttctggggtgttttttttttttgttttttttttgaggcggagtcttgctctgtcgcccaggctggagtgcagcggcacgatctcggctcactgcaagctccgcgtcctgggttcatgccattctcctgcctcagcctcccaagtagctaggactacaggtgcccgccaccacacccagctaattttttgtatttttagtagagatgaggtttcactgtgttagccaggatggtctcgatctcctgacctcgtgatccgcccgcctcggccccccaaagtgctgggattacaggcgtgagccactgcgcctggcctttttttttttttttttttttttgagatggaatctcactctgttgcccaggctggaatgcagtggcacgatctcggctcactgcaacttccatctgctgggttcaagtgattctcctgcctcagcctcccaagtagctgggattacaggtgtccaccaccatggctggctaatttttgtatttttagtagagacagggttttgccatgttggccacattggtctcaaactcctgacctcaaatgatccacctgcgtctccttcccaaagtgctgggattacaggcatgaacctgattggcctataacatattggcctataacctgattggcctataacatatatttctaataactgttgatggctaaaagttgcaatcaaacctgagactgctggctggctgatctactgaaaagtgaattaaagcaggaagacctaagaaatgacacacgtgtactttattttcacttaactcagataaacatacattcatatatctgtcaattttcagagacacaaactcttcctaaatcagagtttccggttctggggttatgccacttcttgcttaaaccacagcacaccttgcgtgacatctcgtttactttttccaacacaagtgaggtggcaaaggacccggaatctgaactttaggctgttatactccttgtccccaaactcgtggttggcttgcccacaccaaacctaaccacggcttttactgaggcttttccaaagcaaccactttcatttccacagaagccctctatacagtcacagcccaccagtttacacagtattccaggctgtgattacaatgagtacaactggcacaaataggtttgggacaatcacaacggactcaaagggatacatgtggaagggcaagggggttctagagagtgcccgctgccctggagggccaaccctgtactgacacaagccagcatgctttacagtgagaagggagagcacccattaatccagtgagtgctgatgacagaggtaaaaagggtttttgcgcgccaagatttcctcaaggcttgtaaatgactctgcatttcatttatcacaatagcttttgcagtgtttgaaaaatgagagcatacgcacatgaaagacatcactgattcatggcttgaggacatgtgactccgtgtttgtgggctctttgcagccactccacagtaaccagggcccaggccactgggttggcttctctacactctccccacaacctgcctgatgggccttgcacctgcagatccgcaacgggtctcaccttagaaacaggtcctcctttctttgcctcctcaaagctctctgcctatcctgaagccatagtccgagcagatgggaggaaggactacggttagtgaacacagtgtccccatcctacagacaaccccaggctatgccccggctgggcctcccagtgtccttctgctaaaggaaggggagatgagatgaccggggagatgagatgaacagggaggcccttccctgtaaccctgtgctgtcctggctctggacaccctcagccacctgtcctgtcttttggcccacagccaccacggctgaccagacaaagggtgatagtgtcgcctgaggaacactgactcaggaggaaatcaagccagatatttctctgggccaggagtaaataaataaatcaatatgcaaaggttccacctatggaggagagggtggccatgacagcagagaagaagtggggccttcattaagagccaaatcaaagaggttgctgccttggagagagccgtagccccaggctcctggctccccagtttccccagggaaggaaactgctgactccatcaaaccctcacttgagtggggaatctgatttcaccttctgggtctttgaggccctgcaacctcctgccctctgcctccatgtgtggcatcccacaatcccatcccctaccttggggacctaggggcatgagtggtgtccactacatgcccagcacgccttccctgcgtccctttccttgagaactgaggctggcaccacaggttgtggctggacccagccagcctcaggggaacccttaattgccctgactgtccagaattctaccactcactcccgctagccagccccagcctctcatctgttttgcagcagtatgacttctctggtcttgctgtctccagccccctgtgccctgtgctccaccagcagccaggggcatccttgtaaaaatgaggcagagtatgtctcacttgtgcttgaaaccttctcatgtttgctcccgacgcttgcttgacatgggcagaccccgagtcaaagtccagccagggcaccagggctgtgcaatgcctggcctctctgactcccacgcccatgctccccctcccccactcctgccatgctgcctctagctgcctctctagcaccatccctcactcttaactcagggcctgtgcactggctgttccttcctcctggaaaactctttgtccagaaagccaagtggacttcgcttccgcgccctctccccatccaatggctcagatgtcccttccttaggaggcctccctgcccatcctatttacgatggaaaatgacccccatattcgcacacagccacaccacgtgtgctgccttgccccaagcatggtccctttctagcacactgtataatttacttagagtgtttatcgcccacctctttcccactgtgccatagggcagggactgttggtctgtttgttcattgatgtatcccatgtgcccacaaggacctagcaccaagcaggtgccaataaatcaatcccaggccctcgtagtgactgagtgaggaatcggtcaacgtggctcacggaggggatagttggggacttctgggaggtcttctggaaaggcccgtggccttccctgggtggacacgggtagacgcacagcccccgcccacctggacttggccgatcctgatgctgccccactactaagccctcaggcccgggagccaggatgtcccctcatcttgtaagccctttggggctgggcttctgttgctacccctgcaagtgtgctcccaccccacatacattgcatggcccctcagcccccttagaagccctggccctcacccttggccttcttcctgtgccagtgatggggataatcccccaaaccctggcccacccagagcctggggctgcagcccattccctgtggtccctggggaccgcagtggccacaccctccacacctcctctatccattccacaccatcctgggaggagggagagccccagaacagccagcgtggcaagacaaacacactggagactgaggccaagcactccaggagccacgacagagatgggggtgtcagtgtggccaggagactccttggaggaggtgggcagtgttggggggacaagggcagccccaccagtgcctctgtgtcccagccacggggtggggcaaggctgggcatggctgtgcttgcgtgcgtggtgttatcatagaggaaatcaatgcctggcactggcccagtgtttaagggaaatgaatagattttggccgaggacaaagagagtttgattaatccgaaattggataatggaggcaacactctaattatttttcttcccagcatttcatcgagaaatatgtttgcacagcatatcagaggtaactgagcgggtgagggggtgaccatgctggaggaaagcccagctcggagacaggccacccgcacccgccctcaccagcaggggtcctggtagccactctacagggccacaggaagcaagagggctgggtggggctggcctgaggccacatgcagctggggcagctaaggccagagggacatgccatgcagagctgggcaggaggaggcatgagggccaagccctcatggtggagttgctcctcccctggcctggccacagttaggggtagggccactagtgtgggggtgcaagaggagtaggggtgaggtaccaccagttcacagggggtcagggcctgctggggtcagggtgaaggctgtaggtgccaagttctcccacccatagtcagaagggtcttcagaaggcccctcttggcagcttggaaggttttcccagctttgcctctggggaagcctgattagctgctccatagccaaggtcagacaggaccaccgggccccacaaacacagagcctggtactttacatgcctcagccctccttagtcaccttgccccctcctcccttgctgaccccactcctgcaacacctggagctgaaaccacacggtttagcaccttgtttccgtggccatccagcctcccaattccaagaaggcttctaggggctccttgctggaacagagatcaacatcaggtgtacatccaagaggaggctcccggccttgtagagtggttgagtctctaccactcattcacttattcattcttcagtgtacagaaagaggctgccatgaacgaagcatggggttggaccctgaggtcactacagggagtgaggcatcaaatgagagaagagacagtcagcaagcaatgacctgagctgctcatgggactcaggaagacggaggccagtccttcccaataaggggttagcatcagtgtcactaaggaaggggcatgtaaggagagatagggtgggttaaagctgctagataggagggggtacagtggtgaggttcaccagtcactggcaagctcatctaaatcctgcctcccgtgcccgctgcagacatcactaatcgaccatgactctttccctctgggctgcagcacagccttagaatcctcttcagcacagcatgctttggacggtcactccagagttgagataaggaaggaaactatctgtacacttgacccagcccagagcttccaactcaaaggcaaggaaggcccagagagtggaaagcattcgcagggtcaccatcacaggcagagctggacttctacccaggcctggtgccttcccctgccctgagctcctctactggcctgagaggccactccttgatcttggggcacaggggccacctggaaaggccactctaccatcatcatgttcctttactaccttcagggtcttggctcatccccttaggacagttttccatagacatgcctctgaaggtcatcactctgtgaatccccgtgtctgacaaaggccccactgagtcacattgcatcactgagtggcccggcgtcagcccgaggcatctgtccacctgcctctggcttgagagtaacccacagttgggcctgacggggcccagctggtagcatccacctgagggtggtttgtgtttggtggccaaacctgaggcccagagacacatctctggggacccaaaggtacaacctcttaggagcagagggttgagctggagcaggggttctgcagcgcacgagcacacagctcagccctagggcaaaaggggctggacagggccactgaggcatgactgtctgcgaatattcagtccctccacagcgactccctgggtggcgattctcaatggtgactccgcaacgtccctgccctcatggagcttacacaaacacatacgatgaatgaatcaaatagggagcaggtcacgctgtggcgagtgctaaggggaaaaaaatagcagcaggaaagggcataggaaacatggtcaggaacatggcgctgttctacatagaggccccaccagccctgtctggagcagggccacagcctaagagccagccctcactgccatgccagcctccagcacagcctcctcctcagccacccttcctatgaccaaccagggtgagagggaccatgctgcccagatgcggggctgcccagacctactaaggcactgggcacatgaggtccactctccacacctcagaggaccttggcctccatgactcacaggggcagacctcacaaaggagcagacctcacaggggcagacctcacaaaggaccttggcctccgtgactcacaggggcagacctcacaaagggacctctgtcctggcagctctccatcccaggggccaagggtctcctgaaaggtttgctctaaccacaaccacggtcccccatggccatgagaggcctggctgagccctcggggacggggtgtgtttctggttggaggctgctagaaggaacacccccgggcttgacactatgtgtaaggcccctccctgcactgtggcttttaacagtctcgcttcttagcactttttgatggattctccagggacgtctctaaaagagagttataccttaatttagaagcaaataactcaaaactctgtgatgtggcagcttcctttggaaaagagatgaacgcaaagaagccattgctgtgtgaagctgtggccatgtaggtccagggcctgctgatgggaccatctaaacctcaacctcaagatgtgcctcctgctgcctcttgcccaagggtccacagaccaaggggcaagaagcaagacatttagtgaagaattgcagcaggcaattgcctgctgcagttttcactttgggttccctgggccatggtgccaaggtgaagctcacaggctgggtgtgactgactccagcggccctgaaagtccaacgcaacccacccgcccactcagggaagggaggagaaatgctgtggggactgggcagcaggcaggttgcgggcccaccctccaggccttccttctccacaggggccactacatccccaatattatccttgaggtccctgtgaccagccagcttcctgggcactcacttgggcatccatacagttttaatgctctgctgttgctgttctggaatgcataattttagttttacttttgtagagacaggctcttacatgttgctcaggctggtctcaaactcctgacttcaagtgatcctcctacctcagtctcccatagtataggattacaggtgtgcgccatcatgtcaggcccttaataattttcaaatgggggcccccaaaatcatgtggccagctgtgcctgcattgctcagtccctgggcatgccctgcctgcttgacacaggggacctgctctctgggacccgctcttctccagcctcccgaggcgccactgtgactgtgcttccacctcacttgcccgtcaatcctcaatctctctttctcgatgcttctcaactcatcctccccacagtggaggcccaggagcccagctcagcctcttctgatcctacctacccttgatccctaagtgacctcacgtggtccccggcctgccacacacctcagtgccaggggctccaggttgccacctccagccttgctctccctctggccacatgtgcccatcaatggctctccaggtctcagacccacctcctaattccccacctctccagaatgggtttttctgtatcttgcttctcagccaataccagctccatctttctactggttcagaccaaaactgcagctgtcctttaaaagctgcagctttaaaaaaacaaatctcccacctgcatttctcagggcctccagagctcccacccctgggtcagcagcctctctgcctgggatgttgcagtagcccctcatggcccccagccttaccccaccctagcctattttcccacctcagcagagagatcttttcaaagtgtagattagctcctcctgggagggcagctccagtctcttctctgctccaaccctgccaaggtcttcctgcctcattggggcccactgagtcctgcaggacctggccctgacaccccacccacactcctgcaccaggttccagccactctggtggggcctccaggggccagggagtgtctgctcagcgcctttgcacctgctgtctctcccctgctcagccacaccactcacccagcacttctgcatggcactgtgtcagtcccccacccccatctcgtgtcccccaccttctgctttagtgttctccacagtgcagcacttagtaacatgtgttactgtcaacccctgcccgtctggtgtgagcactgtgagtggatgctacgtccctgctgtacccctgcacctggcacagtgcctggcatgcagcaggcgctggtaaatgttagctgaacaaatgaatggatgaatcgcgtgaggttctgctcctccggctcagtccagagggctgatgtctcctcctatgtgctctaggatctgtcaagcggtccctgttggttcaatcctgtgaagcgcctcccctggcggtgttcgcacgaaagggccaaaatgtgtggcaggggctggtgtggggacagggcagggcactcttggctttgggtatggatgaggataatgaggttcagagaaaaaggggctggacctaggatggtgggaccaggacctgactccaggtcttctgccacctagactggaatgctcacctcaccaccccggagccacaacagtctgggtgctcccacgtccctcttcattctgcccaggccgcagcatagcctctgctctgggattctgcctggggctgacccttggcatctgcactgacgcctctgttcatttcgctttgtgctccttccagccaagcacagtgctcacaggtgctcagaggcttggctaccccaggtttccttgctggagggttcgggagagcagcatgctgacctgcctcctccagtgtgcccgtgcacctgccatggtcagcagcagtgagagtgcctttgccaccacacaccgtcttaagtattctgaggctagcgtgggacagacagcacagggctgccttccttgcctccaggggaggaagccgcacacatgtgttcacacacaagatgactaaattcagcattcctgaattgctatattcagcattcctgtcccactggcctctctgcgggggccctgggcagcccttgtgaagtcaatccagttacctgcaaattcctggaattgttctagaagctcctgagggccagactgagaccccacccatactcctgcaccaggttctggccactctggtggggcctccaggtctctgaggttcctcctgagattctagaaaacaaaaggactgagaggctggggacagagggaagaatccattccctgtgtcccaaacccacagtcacatgccaggtccctgcaacagtccaggcgacaggcacagagcacagcagctcaccctgctcagcacagactgcacaccccacgagggcaggccctgttctcgctgcatcaacctgggccttggccaaagccaagtgtgtgttgggtggggagggtaggcacactacaaagatgagtaacaaacagccccttcagagggagagcaaaaacatccccagaaatgagggagctgacttaggggggaaagtgacaccaatttccgagggggagaaattatgtcttattcacctcctgtctcagaaaatcaacgtcagttagaggaacacacaggaagacttttaaaccagatgccagcatctcctcattcctagagaatgaggcttgctcaaggcgcatattttatccaagcaccgccaggccatccacacccccactgcaccccgtagatggatgctcccaggctgccacgattactgctctcaaacatccacatcccagaggcacagagtcactagctaagcatcatccccgaaacaggcaactcaatcctaacaagggggttgcctgggtggttacccagtgccctggctgtgcccgagggagaagtgcctggaagcacagtctcagactgcaaggagccttccccagtctttaaagctagctcttctccaggcccaccccagctcatggggtcatggaactgcttcgcttttacagatgaggaagccgtggtctccaccatagccacagttaaccagcagtggggtcattccacttcccagctccctcagccccgtgcagcccccaccggcctttcccgccatacctcctcctactccccaggcatgctaagtgctcccatcagacctaactgcccaagtgcctcggtctattctctcctctctgcccacaatgcccagcttagctgtgcccatgtccttcaagctccagttcaaatgtcatgttgcccacgagctcacctgaccccccagcccaggacaccactctgaggtccctcccgaggcccctgcacctgcactcaagcggggttggtcgagtagagacgttttcccctatgcggtggtcaatcagtcctgggagggcaggcccagtccactcccacccggtgcaccccagcgtcaagctctgggggagtgaccactcaataaatatttgcttaattgaatttggccaaggagccttctccagagagctcaatccccagggcagggaaatcacttgggcagaaaggagccggtcaggggctcagctgtctccccaagcaagacagacctctctaccaggcgggtccctccaccccaacacggactacgcggaacgctggtctcgcttggcatcatcctcttgtctcagttaacaggagcccccattctcggcctaggccgaatcctgccatcatcacccaggaaggctcagcaccgccctaaaggcagagccccctcggatcgcccgcaggatacggagcgccagccctgaggccctcactcccctcccccaaacacccccaccgccttttaagggaaaaaatattgagccgggaacgtattacaatcgcagcaggtcgatactcatctcttcctctaaatgcctgtgaggaacctgctcgctgcaagagcagtgaccgagaactgctagctgtccgtctgcgggcccaggtcctcgggcccaggcctctggggccctctcctcggtttcaggcaaggccctgcatcggctccggccgcccctccctgatcctccccctagggagacccgcctcagcgccgctcccgcagctcgcctggcccgcccgggctccgcatcagccgctgcttgggggcgcccggcggccccgcgcggcatccccggcgccctctgtccaccctcccgggtcctcaaccgccccctcccgcggggtcatcggcttggcggcgcatccctcccccagcacctgcccgaccagaggccgccccctgcccacctcgcaggcgtccccgcccttggtgtcccccacccctgaggggcatccctgacgctgcgtcctggcggatccggggcacaaaggcctgggaagagtcccaagtgggggcaaggtggatgccccggccgtgcccccgacccctgaggctcagcggcgcgcggccggccgcgggtcggctcactcacctccgggccgcagcacagagcatctgccgagctgctccgggcagggcggggcggggcggggcggcgagcacggggccgcggcgccctcgttccgtacgacgcgggcagcggcgcccacgcggggacgtgaccggaccgcgggcggcgcacacactccggccggcctggttccctccgcccgccctcccgcgccgcccgccgcccgccgcccgccgcccgccgccagtccgcgggtccgcccgccccgcgccgcgccgccgccggcagggggcggagccgcgagcgcagcccgttgccaggccaaccgcgggcgggggggtgccgcgcgcccgccgggcaccacgcgccgggcacctccgccccgccacgagcgccggccctctgtccattgggcacaggcagctgacggacgggccagtagcccaatggggacggacaggggcggggtcgcagctccgcgcgcgccgcagtcccgcaagagctccccgcgccggcgttccaccgactccgctgcgctgaggcctggtagccgagccccaggggccacctctggcagcccgggaaaccaagcctgagcccagccatggtcctggccctctttactgcagccagtcccggctcgccttctctccactcgggttcaaacccagttcggcctcttgtgagctctacgtccttgggcaaccgactgacctctcccagcctttctgtttgcaaagtggggctagtggcacctgctttcctggattgtctcaccaatccttcagaacgtgtgaaaggcctatgcaaaccctaacgatttacaccggtgaggtttgtgcagcgatgggagggagcattagtcatctctgccgccgccccccgccgccaccgcccagtgtctaggggctctttggcgtccctggcaatcctggcacacggaagggtggccttgggagggaaggaagggagaaggaccgaggagctggcccccagcccagacaagcgtgagagagccagttcagttaaggccactgattggcgcttttgggaagctggtggaaagcatcagaccctcagcaaaacgcagctgaacccaggctgcaaaattctgttttcaatttcaaagcctatctgtggacctcagggccaggagtccctcagttccatgcttaaaagactctcaagccagagggccaagacatgaatgctcctgtctctcttctccatctttgtaaatctgaagctttgtgtatcctagagcatccctgacaaagtgcaaatgccttcccagctaacgcgttccttatcacctcacacctttgtaaggtgtggatcatgccattctttgagcagcagccctggacctgaccatggcagaggtccatggagcggtctctccatcatagctctgtggtggaggggcaggggcatgtgcctggctttgccagctggacactgtggcatctcagcatcatcccataacctccctaggaatgtttcctcttctgtgagatggagaccattgcgttacgtacctgcagggtcatgggccacctgtgagggtgctgcctcaactgtcaggaacaggacgtatatttgttatgggcatcatggaggcgaacttagtgctcactggaggtgtccagtgaggaccaagggaattcagccaatggctgaggggctagctaccctttgtgcttgccttccacaccaccaggctgtgtcaggctggacctcttgccaggaggaccacacagagaccggcagctgtgctacctggctgagcctctgtttcctcttctgtcaaaagggaatgtaacagactgtggtcagagggtggctctgagggttaatgtttataggaaatgcatattagcatgtcttgggatagccagaggctgtttccactgcagagtctgggggtcagagttgaattgtttgcagaggtaagcccacatgcaacagtgagatggccctttccagtggtccagagcagaggctagcctgcggaggggtccactggggctggctgacacctccctgacttgacctcaaagtaagagagggacatctcacctggcatcaaaccaatattgtattcatgcagcagtcacttacagatagcctcctccaccagggtatagttgtaggcacagttctaggattcagaccggcccttttctggcagaccctctgcctgtagggcaggggcagaaagcaaacaacgattgggccttacagtcatgtgaggctatctgaggagacccactggggctctgggggcatgtggagtgggggagcattgggcattgggccagcttcccaaaggaagagatgcttggaatgaggccatagcaggcgtggaggtggccagtgacatagggtgggagggaagtgagttccaaggcggggacggtgcaggacatgaaggagcacgaggccaggaagaacccagagaagaccagtgtggctggggccagggtcgttgcccatgcacagatgccagcttggggcagtaggatcagggacgttggcctaagaactgctcgagagttttaacattagtcttttaaatttgagaaggaggaggagaagtttttaattgcctgtttacagtaggcgtggtcccacagacaatgtgagttgtcctactggacataataaaataacaaaaacatcagttagtcagtccagaggaagtgggagtgagcacagaagtcagtctgtgaggctgagttcagtgtacggtctgctgtggctgtgagatggcagggagaccaagagcatgttaggagacagtggcggggcattatcaggacccagggagatgagagaaggggagagggtggggaccactggaggaagagatggtgcttaccaaaaagatggaggagcagttggggaggtggtcaggaaccagagaatggagggtaccagaggcacgggaagagagcatgtggtaaaggaagaagctgttaaccatgctcccagctacctggaagccgagaaagctgaggacagagaagcaccccttggagcaaaggcaggcccagtgggccaggagttcagggcacagggccatgcaaggctaaagctggacaggtgggtcacctgcggcaaggtgggccccagatgccatgtgtggatgtgcagtcccctaacaggaaagggtgtggctgcgaccagaacctgggtgctggtgctctgtcctgagccctcattggctgggagacaacagctggggctttgctgtagccagaggaagggggccatggtggtgactgagcccactcagcacctccccaacccagcaggcacagctggctgaggagtggcccctcaacatggtgtcagcacccgccctgccccaccacaaagaaaatgacccagactccaccactggggctccacaccatggacatccgtgacccctcaatcccattggatctctttggctcatcaaccactgaacccatcctagcccctacatatcagccaggccagatcggggactccccacaaacacatacatttgagccctgctgttctgggctctcctccacatccatgagaaccagcttccccggggcctccctttgtgcacctccagagcccctaggaccctggaattcctggtctacacacatgtcaacctgttctgtagtgacctgtccccagctgactattccactagttttcccacttcccgggggtggggtgggcatatgttgcttgtctctaaaccatggatggcccagagcctggcctgctctggtgccaccccatctggctgattctctgtgccccacctgtcctacctcttctgcaaccaccccccacccccagcggacgctcaggctgccgcccagttgggtggatttccccgattgtttccctggggtctgtgtgccccacccccacttgagcaagccatcgcagatctgggttagttataaatagccaggcccgagactcttcttttagctgaaaagaagcaaagtgaacgagcagaaaggcacacccggcacgcgttttatttttaatcttctccctctgtctcaaaatgaaccccggtccctgtgctaagcatttctaggagcagaagtacaagacaaatgcctgagaaacaaaacccaaggggctgagggtcccgcctggctttgccaccatctgctgtgtgaccttaggtattcaagttgcctctctgggcctcagtttcctcaccaaggagaggtgggtaatggaggtgatcaccttgaatgttgacttttctgacctcaactccttctatattcctcccctaacttgtgcccatcctgactcagcaatgacacctgtcccagggatttcctgggaagctcagataggtgagacgaggctacaatctagccctgatttgaaaattaacaacttccttacccccaggtctttgctcaagtgtccccatcccagaactttgtccttccatctgccagcaaaattaacagaaggtcaaattgtcgcctccctgctgtgagctggaagagggccgtccaggtcaccactgagttgaatctatagccaggagtgggtagggagaccgtgggcagaacctgaggggaagcagagcgggagcaggaggccaggtgtgtggtatgggcaaagcagggagctgcgagagagagaggatcaggcctcgggaggggtggtagggttggggggtttctgcactgatgggatctgcagggcttgggctgtgcagcgtttgtcttgtatcctactcctcagcctccagcaggcccttgcttgtagctgggactcagtgttggtggaattcaggagactcttgccaccctaggcccagatgttctgggcacacagggacagacccttacatggatgaagaaatccacagcacgtggaacacgttttcatccacaaccccctgccaggtaggcccgtttcagtgataaggaaactagactcagagaggttaagtaacttgtccaaggtcacacagattggaaaggatatgttttaaatgagacctaggctttttttttttttttttttttttttttttgcaatctgtgcatattaaataaaaaaggccaacacagtagaagcaacaggaacccacttttcctgggtggtcagagccctgagaacaaacagggcagatctagctgctccatctgataccacagtgagaagctggccaggggcactggaagccacctgacaccagaggacctgggggatggggcatggagagctgctggacattatgagacatggtggggggcggtaagagccactcagcaccctgctccgcctttctaccccatcaccctgggcacctgctgtttgatgtcctcagggagtgggggaagaaggttggggtgatgtcttcaaagaggaaatccctggtactaattggcacttggagacctttaggctaatcaacctgtttatttctctctctagagtaaattagagggtttagctggggagggcggaagaaagaggtgtcttctggtggccacctccctgggggctgtagatggctttgcagtaggcagtgggctgcagggcagtggcgagggcagctgcgtgccgtagggaagggcactgtgcacattccctgtgcttctcatctcagtgactcaggagggctgttctgcccaccgtcctgggctcaggatgccactcgtgctgggttctctaggcaatcacatgctgacattcctcaggagggaagggagctgggaggagccaggtggggcctgtttatgggggagccttgcctcattgtgcttctcccagtacctgcaccccagctgtgccatgtggagcccccttcccacagagccccaggtcccttgaagacgagagcctatggcttcccgtcacctttagttggggcacagctctttttggtgagtgtgacactggcctacactctaggtcttctgtctcagagtcaaaaccaagctcttctccagggctggtcagaccagtgtggggtctccagcagctttgaaatattttggtggatgggaagcgggggcttggctggctccccaactctggggcagggggagggaagagtggaggtctcctggtgtgcctgggccctgcaggagtgagctgtcagctctccgaggggtggcttattgcctctccagctgctgtgcgcttgctatggtagatgccccctgagacacaggcgacaaaagactggtccttcctgggttctctgagcctccgcccttagcccctgacatggctgtcactgcagctgcctgctggtcgctcaggcccctggccaggcgggacgtgtgtgtgggggtggcacttgcaagtccttttgtcaaacccacccactggttctgcaagaccctccttgagccctgcaggccaactggcatgggtgggtgggtgtgtggccagcccgccctcagtgccctttcctgccttgtaggggcccaagagatcatcagcaaaggtctgatttcctcactggtatggaagctgcaggtggaggtggaggaggaggagttccaggagttcatcctggacacactggtcctctgcctgcaggaggatgccaccgaggccctgggcagcaatgtggtgcttgtcctgaagcagaagctcctcagcgccaaccagaacatccgcagcaaggccgcccgtgcgctccttaatgtcaggtgaggcctggcctaggctgggtttctaccaaggctgggagaaggcacctgagctggactggtccagagctcaagggcggccaccctgggcctgcttccccttgcctgcttgtgcccaggggtaggagggagctgggacagaggatgaccttctcccctagggtgaccaccatcccgttggcctgggagtgtactgtatcccaggaaacccctcagcctggacaaagccagatgattgtgcaccccctccccatgaggaaggccagcacaggagatgcactggtgatgatcatgacacccagcggtcactgagtgcctcctgtgtgccaggcgttgtctacaaacctcacatttaggcgaccctccagggaggtgatgtctgccttcacaggtgagaaaaggaggcagtgtcttgtgtctcacaccaggtcacacaggatcacagtctacatcctggcctggaaactgagggagcccaaagcctcaaagctgcagggggcagggtgcggtgtgtgttctcacactgggccccttttcacgaggacaggctggtcaccgaaccccagagtctctgccttagctgtggctatgtctctttagtggagaccctcttgccttccctaagtcctggcttctcttctgagagtctcactagaggctcaggccagtatttctgcaagtggggccccggacccaagccaccgggaggtttgtgaaaatgcagattcctgggccctgtcccagccccatcattcttaggtctgctcagaggtcccctttctgtgggaccatgagagtggctttccaggagagagctctctctctctgaaactgtaacctccctgctgtcccctgtcctcccatgtccactgtgaccaccatccctgccgttactttgtgtgtcatccccgaggggagctcctgaggacagggctttcctctgtttgctgccctaaacccagggtttgcagcgggggagctttggctcccagttgagaattatctggccctaaagaacactgagctggagaaaccctgctcttgtccccactcttgtgaacaaatcggggaatccctgcatcgctcttgtctcagtgtcttgctgtgtgaacgaatcagggaatccctgcatgtggggcccaggactctgcaactttgatcatgggcttcggggttgaggcccactgccctgaaaggctcccagtgtcacagctagtggctggccaacctcatttcccaatctgtgttcccagggaacacctgtgtctttgaggtcattaagagctctacaaaaatgagggttctttggtggctacatttgggaaaggttgattaaactaagtgacacaggggtctttgcactgtggcattcctgtggggcttgtgaacagtgtttcctggcccagggagccctttctttttaggggacagaattgaccctctctcaggaaacttttggggagttcatcatcctcatttccacaacttcattcagtgccagagtaagtggcctaaaagttacctggtctgagtccttagctgcagttgcccagtgcccggcagctgctgctgttgggggcagcttggcccatcactgtcagctctggctcttaggcaaagtcaaaacaggtctccctgtggttgacacccctgggtcctgctgttccccattttggggccacggagaacatgccctatttcttttctgtgtgctggctcagagtgaggccctgtcaccccgtggtcttcactggcagtgggccgcgttcacaccaatgctcctctgcagcccagcatccctgccatgaccagtcctggatcatggggaccagtcctgggactacctggggtagcccccacacaattatttcttttgtgtctccctggggcactcctgggccttgcgcctcttctcccttccaagcagagcccctctctgttccctctctgccccagcatatctcgagagggcaagaaacaggtgtgtcattttgacgtcatccccatcctggtccatctgctgaaagacccagtggagcatgtgaagtctaacgctgccggtgccctgatgttcgccacagtgatcactgaaggtgaggcggtggggggtgccgcagggagggagaccctagcaggctagcagccgtgatgagctttctgtactcaggggctgggtatcgtcccccaaactccacactttgcaaaaaaaaaaaaaacctccccttggcctatcactgatgtcctttcaaggttgggtccaaggcccagccctccctcttctccccagcacagtggcccctcaccagtcactcacattaggacctctgtgccttcgcaccagtctgttccctgggcctggaattcccgcctcccacccaggccccttgtgagctgtgactcaagggttgattagtttgccatccatgattctgttaccctgaggtctaagcaaaccctggagcccttgactctatggtgtttattcatcctaattatttttcttaaactggaggagggggcaaattcagaattatctcccccgagccccctaccttgggactcccagccagtcaggcttcccctctaagtcacccaaccctgggctcatggaagaaccctgggctgtttccacacctggcagactggggcgtggcactcccaggacccctgaaagcatttgactttccctctggcccctacacacccaccagcctggggccctgtgcttcctttgagttccatggaggaccatctgggcttggatttgcaatcagcctcccaaagacaggtcctcccaggccctgcacacctgaccctaatgctgcttgaggtatgcagatgggagaggttggggctttcttggagtccacagcccctccttttactggtgtagtcaggatgctgactgcacggtggcaggggctccccctgcgtgtttatcttggggcagcctcagcccagtgtccttctcggtccaggctttctgtaggagtgcttggagggccacggggctcgagacacaagaggctgagacccagggagatgaggccacttattcccaagctggcactccagctgagggtcctgaagcccctgccacgtgccaggccctgggaggcagtgatgagggatgtggaggagaagcccagcatgggtggggcaaacacaggggacaagtcgcctctgggaagggcttgggatcaatcccaaggacaatgggagttggcagggcccaggctgagaggttccaccagcaaaggggagagtccactgggcactgcaggagcatagggccggcaaggacagcagaaaggggcagcgaatggttgaggagggcatctctcaggaaccatgtgtgttttgtgcagagtaggtgctcaagaaatattggcaacatatatgaactattgggtttactttttttttttttttgagatggagtctcgctctgtcgcccaggctggagtgcagtggcaccatcttggctcactgcaagctccgcctcccaggttcacgcattctcctgcctcagcctcctgagtagctgggactacaggcgcccgccaccatgcccggctaattttttgtatttttaatagagacggggtttcactgtgttagccaggatggtcacaatctcctgacctcgtgatccaccagcctcggcctcccaaagtgctgggattacaggcgtgagccaccgcgcccagctgggcttactttttttaaagagccagtgtctcagtgtgtcacccaggctagagtacgatgtcacgatcactgcagcctcaaactcccaggctctagtgatcctccccgctcagtctcctgagtagctgggactgtaggcacctgtcactacatctggataatttttaaatttttgtagagatggaatctcattatgttgcccaggctggtcttgaactcctgggcaggatacgagggtggatggagaggagccagttgaggccggaaaggcaggagatgaagaggccaggcccaggccggactcagcgaaggtgcaagagccctgagggtgagggcatgttggtggggcataaaccaggcataaaccccttgagactgcacaaggaggagggtcaggagagggctagggtgagagggggtgagaagagggccccttgggctgtttggaacgccttgtgttggtggcctgcagggaagtatgcggccctggaggcacaagccatcggcctgctcctggagctgctgcactcccccatgaccatagcgcgcctgaatgccaccaaggcccttaccatgctggcagaggcccccgagggccgcaaggccctgcagacgcacgtgcccactttccgtgccatggaggtggagacttacgaaaagcctcaagtggccgaagccttacagcgggcagcccggatcgccatcagtgtcatcgagttcaaaccctgagcccttcattcacctctgtgagtgaataaatgtgctaagtctctttatctcgggtccgaatggcactttctgttcctggagcacagtcacatcttttcttgctctcctgccagaggggaaatgcgaggcccagaagcaccgggtctgggtggcacaggctgaacccagtgcggggaatgggtgggaggtggccttggagttgtgctctctctcctggggccaagagttcccctcagaaggtagagagtagggctgagccctccagagacaaggctgggggcagggacttgggctggggaaggaaggaacccagatgcgccaggcaccacccaggtttcagaagatccagtgattgacccctggggtgtggctgggtgtggctctgctcagccaggtctgtcccttccccaccctgggtgatgggaaggaaggtgataggtgaaaccccatgcaggttcttcgtggagaaggtgactcagtcatagaggctcccccagggatgagtgctcaggacaggggtagattctggtttcctcgttaacgtcttaccccaaacagccgcattcttctccaaagcaaggaagtcactcaagcacgcccccaggttggcctgaagcccatcccaccctccattctctccctttgggtgtatgtggcccccagggcagccctcttctgcctgtgccttcatctgggctccttccctgcagtgaaggtgacaagcaggctgggagcttaggcaaggagagagaggtgggctgagaggtggaggaggggagaagcccagcttcagggggctatggggcatggggctgaggttggggagtgactgggagagctccttaatctcctcctactcatctctgcatggtctagtgaggcaatggatctcctcgtttcgggggagaagcagcctgtcctggcctctgttggaggagatgctagagcagaactcagcttccgggctgggccctttcatctgggtctgagctggagccttactctttctccaggagctttctgaggctctctctctctcgaaggtttccctcattcacatcaccccttggcagtcatatttcctgtgaggtgcccactcctcccagaataaacctttcagcaaagccagaatctcaaagggagccccttcttgcagtcctttcagtgagccccaggggccctcactttcccagaagaaacacagggaagttattgtccttggaatcacaggatgaatccaagtagggcctcttgttgtggaagggacaggcagctgggcccagctggggtttcaggttcatccccattctcaaaaaagctgcccctaagagggccgggtgcagtggctcattcctgtaattccagcactttgggaggctgaggtgggcagatcactcaaggccaggagttcaagaccagcctggccaacatgacaaaaccccctctctactaaaaatacaaaaattagctggacatgatggtgcacgcctgtattcccagctacttgggagactgaagcacgataatcacttaagcctaggaggtggaggttgcagtgagctgagatcatgccactgcactccagcctgggtgacagagtgagactctgtctcaaaataaaactttaaaaaaggccccctaagaggaaaccttttctccttcaggaaacatttcctcatgtccatttcctcatgttccagtcctgccttaacacagcaggctggctctaccccttccacaggctctggccaagatcatcaaactccctgctgcaagaccctgtgctcttggtctcctctgtagaaccctctttctttacatggctagtggtgctgatgcttctcatgcctctgttctaggctctctcttctcccactttccctgtgcaatctcatccgcctggctttgggctttctctaccaggttcccttctgagctgggcctgatctctctcccctgtctcccccagatctgggactccagccccagcctctctcctgagttctggattcttatgttcaacttaacatctacccttaaatgtctccaggcaa
